United States Patent
Akbari et al.

(10) Patent No.: US 11,969,446 B2
(45) Date of Patent: Apr. 30, 2024

(54) COMPOSITIONS COMPRISING BACTERIAL SPECIES AND METHODS RELATED THERETO

(71) Applicant: Xbiome Inc., New York, NY (US)

(72) Inventors: Peyman Akbari, South San Francisco, CA (US); Ali Akin, South San Francisco, CA (US); Rounak Feigelman, South San Francisco, CA (US); Wayne Herber, South San Francisco, CA (US); Jason Hudak, South San Francisco, CA (US); Jun Ma, South San Francisco, CA (US); Jackie Papkoff, South San Francisco, CA (US); Lauren Wong, South San Francisco, CA (US)

(73) Assignee: XBIOME INC., New York, NY (US)

( * ) Notice: Subject to any disclaimer, the term of this patent is extended or adjusted under 35 U.S.C. 154(b) by 327 days.

(21) Appl. No.: 17/006,430

(22) Filed: Aug. 28, 2020

(65) Prior Publication Data
US 2021/0060090 A1 Mar. 4, 2021

Related U.S. Application Data

(60) Provisional application No. 62/893,142, filed on Aug. 28, 2019.

(51) Int. Cl.
| | |
|---|---|
| A61K 35/741 | (2015.01) |
| A23K 10/18 | (2016.01) |
| A23L 33/135 | (2016.01) |
| A61K 9/19 | (2006.01) |
| A61K 47/26 | (2006.01) |
| A61P 1/00 | (2006.01) |
| A61P 1/14 | (2006.01) |
| A61P 17/06 | (2006.01) |
| A61P 29/00 | (2006.01) |
| A61P 37/06 | (2006.01) |
| A61K 35/00 | (2006.01) |

(52) U.S. Cl.
CPC ............ *A61K 35/741* (2013.01); *A23K 10/18* (2016.05); *A23L 33/135* (2016.08); *A61K 9/19* (2013.01); *A61K 47/26* (2013.01); *A61P 1/00* (2018.01); *A61P 1/14* (2018.01); *A61P 17/06* (2018.01); *A61P 29/00* (2018.01); *A61P 37/06* (2018.01); *A23V 2002/00* (2013.01); *A61K 2035/115* (2013.01)

(58) Field of Classification Search
None
See application file for complete search history.

(56) References Cited

U.S. PATENT DOCUMENTS

| | | |
|---|---|---|
| 7,115,200 B2 | 10/2006 | Ackermanns et al. |
| 7,232,656 B2 | 6/2007 | Balasubramanian et al. |
| 7,835,871 B2 | 11/2010 | Kain et al. |
| 7,960,120 B2 | 6/2011 | Rigatti et al. |
| 9,616,092 B2 | 4/2017 | Vincent |
| 9,907,755 B2 | 3/2018 | Kabadi et al. |
| 10,064,895 B2 | 9/2018 | Vincent |
| 10,206,958 B2 | 2/2019 | Ley et al. |
| 2006/0024681 A1 | 2/2006 | Smith et al. |
| 2006/0292611 A1 | 12/2006 | Berka et al. |
| 2007/0014362 A1 | 1/2007 | Cruz et al. |
| 2009/0026082 A1 | 1/2009 | Rothberg et al. |
| 2009/0127589 A1 | 5/2009 | Rothberg et al. |
| 2010/0035252 A1 | 2/2010 | Rothberg et al. |
| 2010/0137143 A1 | 6/2010 | Rothberg et al. |
| 2010/0188073 A1 | 7/2010 | Rothberg et al. |
| 2011/0009278 A1 | 1/2011 | Kain et al. |
| 2016/0158295 A1 | 6/2016 | Afeyan et al. |
| 2016/0287636 A1 | 10/2016 | Vincent |
| 2017/0042948 A1 | 2/2017 | Ley et al. |
| 2018/0122510 A1 | 5/2018 | Apte et al. |
| 2018/0147221 A1 | 5/2018 | von Maltzahn et al. |
| 2018/0153944 A1 | 6/2018 | Knights et al. |
| 2018/0255819 A1* | 9/2018 | Vincent ............... C12N 1/205 |
| 2018/0255821 A1 | 9/2018 | Vincent |
| 2018/0296582 A1 | 10/2018 | von Maltzahn et al. |
| 2018/0355343 A1 | 12/2018 | Baram et al. |

FOREIGN PATENT DOCUMENTS

| | | |
|---|---|---|
| WO | WO-2015/164555 A1 | 10/2015 |
| WO | WO-2016/172658 A2 | 10/2016 |
| WO | WO-2016/201053 A1 | 12/2016 |
| WO | WO-2017/180501 A1 | 10/2017 |
| WO | WO-2018/045493 A1 | 3/2018 |
| WO | WO-2018/064165 A2 | 4/2018 |
| WO | WO-2018/115519 A1 | 6/2018 |
| WO | WO-2019/032572 A1 | 2/2019 |
| WO | WO-2019/032573 A1 | 2/2019 |

OTHER PUBLICATIONS

Plaza-Diaz et al., Mechanisms of Action of Probiotics, Advances in Nutrition, vol. 10(Supplemental 1), pp. S49-S66. (Year: 2019).*
Antoniou et al., *Ann Med Surg* (Lond) 11: 9-15 (2016).
Barrett and McCole, *Clin Exp Pharmacol Physiol.* 43(11):1097-1106 (2016).

(Continued)

*Primary Examiner* — Michelle F. Paguio Frising
*Assistant Examiner* — Grant C Currens
(74) *Attorney, Agent, or Firm* — Barnes & Thornburg LLP; Aisha R. Hasan

(57) ABSTRACT

The disclosure relates generally to bacterial strains of the genus *Christensenella*, e.g., *Christensenella* sp. P152-H6d bacterial strains, and compositions comprising such bacterial strains. The disclosure further relates to methods of using such bacterial strains and compositions for preventing or treating a disorder, e.g., an inflammatory disorder, a gastrointestinal disorder, a metabolic disorder, and/or dysbiosis.

17 Claims, 24 Drawing Sheets

Specification includes a Sequence Listing.

(56) References Cited

OTHER PUBLICATIONS

Chassaing et al., *Curr Protoc Immunol.* 104: 15.2531-15.2.14 (2014), pp. 1-16.
Genin et al., *BMC Cancer* 15:577 (2015), pp. 1-14.
Goodrich et al., *Cell* 159:789-799 (2014).
Hatano et al., *J Invest Dermat* 129: 1824-1835(2009).
Hoeppli et al., *Front Immunol* 6:61 (2015), pp. 1-14.
International Search Report for International Application No. PCT/US2020/048627, mailed Dec. 15, 2020 (4 pages).
Ishii et al., *J Pharmacol Exp Ther* 346:105-112 (2013).
Koh et al., *Cell* 165(6):1332-1345 (2016).
Koroleva et al., *J Immunol Methods.* 421:61-72 (2015).
Lee and Hase, *Nat Chem Biol* 10(6):416-424 (2014).
Lee et al., *Cell* 180, 79-91 (2020).
Liu et al. (2020) bioRxiv doi: 10.1101/2020.09.21.306662, pp. 1-15.
Martinez-Fierro et al. Medicine 98(38): e17208 (2019), pp. 1-11.
Morotomi et al., *Int J Syst Evol Microbiol.* 62(Pt 1):144-149 (2012).
Ndongo et al., *New Microbes New Infect.* 12:69-70 (2016).
Ndongo et al., *New Microbes New Infect.* 13:32-33 (2016).
Nielsen et al., *Gut*, 38:414-420 (1996).
Ostvik et al., *Clin Exp Immunol.* 173:502-511 (2013).
Papa et al., *PLoS ONE* 7, e39242 (2012), pp. 1-12.
Rosa et al., Genome Announcements 5(2): e01451-16 (2017), pp. 1-2.
Seo et al., *Sci. Rep* 7(1):851 (2017), pp. 1-13.
Sim et al., J. Vis. Exp. (112), e54128 (2016), pp. 1-12.
Stallhofer et al., *Inflamm Bowel Dis* 21(10):2327-2340 (2015).
Steinbach et al., *Inflamm Bowel Dis.* 20(1):166-175 (2014).
Sudhakaran et al., Genes Nutr., 8(6): 637-48 (2013).
Tindall et al., *Int J Syst Evol Microbiol* 58, 1737-1745 (2008).
Van der Fits L. et al., *J Immunology* 182:5836-5845 (2009).
Waters et al., BMC Biology 17:83 (2019), pp. 1-11.
Written Opinion for International Application No. PCT/US2020/048627, mailed Dec. 15, 2020 (5 pages).
Yang et al., *Microbial Pathogenesis* 125: 411-417 (2018).
Zhou et al., *Sci Rep.* 7(1):1529 (2017), pp. 1-11.
Zhou et al., *World J Gastroenterol* 23(1): 60-75 (2017).

\* cited by examiner

| Database match | Isolate 16S sequence coverage | 16S Percent Identity to C. sp. P152-H6d |
|---|---|---|
| *Christensenella timonensis* Marseille-P2437 | 100% | 97.85% |
| *Christensenella* minuta strain YIT 12065 | 99% | 97.84% |
| *Christensenella* minuta strain DSM 22607 | 100% | 97.78% |
| *Christensenella* massiliensis Marseille P2438 | 100% | 96.6% |
| Brassicibacter thermophilus strain Cel2f | 96% | 87.13% |

Figure 1B

COMPOSITIONS COMPRISING BACTERIAL SPECIES AND METHODS RELATED THERETO

CROSS REFERENCE TO RELATED APPLICATIONS

This application claims the benefit of, and priority to, U.S. provisional patent application Ser. No. 62/893,142, filed on Aug. 28, 2019, which is hereby incorporated by reference herein in its entirety.

SEQUENCE LISTING

The instant application contains a Sequence Listing which has been filed electronically in ASCII format and is hereby incorporated by reference in its entirety. Said ASCII copy, created on Aug. 28, 2020, is named ASP-058_SL.txt and is 3,693,554 bytes in size.

BACKGROUND

The gastrointestinal tract (GI), as well as other organ systems, is a complex biological system that includes a community of many different organisms, including diverse strains of bacteria. Hundreds of different species may form a commensal community in the gastrointestinal tract and other organs in a healthy person. Moreover, microorganisms present in the gut not only play a crucial role in digestive health, but also influence the immune system. A disturbance or imbalance in a biological system, e.g., the gastrointestinal tract, may include changes in the types and numbers of bacteria in the gut which may lead to the development of, or may be an indicator of, an unhealthy state and/or disease.

Members of the family Christensenellaceae have been characterized as highly heritable gut commensal bacteria that are associated with a number of beneficial health aspects. For example, Goodrich et al. reported a study of microbiotas across >1000 fecal samples obtained from 416 twin pairs, wherein the family Christensenellaceae was observed to be the most highly heritable taxon, and was significantly enriched in subjects with a lean body mass index (BMI) (<25), compared to those with an obese BMI (>30). Goodrich et al., *Cell* 159:789-799 (2014). Goodrich et al. further demonstrated that Christensenellaceae is associated with reduced weight gain in germ-free mice inoculated with lean and obese human fecal samples, and that addition of the Christensenellaceae family member *Christensenella minuta* to donor stool reduced adiposity gains in recipient mice, suggesting that Christensenellaceae promotes a lean host phenotype. Goodrich et al., 2014. Zhou et al. demonstrated that fecal microbiota transplantation (FMT) was effective in attenuating high-fat diet (HFD)-induced steatohepatitis in mice, and that the attenuation was associated with elevated abundances of Christensenellaceae. Zhou et al., *Sci Rep.* 7(1):1529 (2017). Enrichment of members of Christensenellaceae has also been observed in fecal samples of healthy versus pediatric and young adult inflammatory bowel disease (IBD) patients (Papa et al., PLoS ONE 7, e39242 (2012).

Morotomi et al. first reported the Christensenellaceae family as a distinct branch in the order Cloistridiales, and also reported its first genus *Christensenella* as well as its first isolated species *Christensenella minuta*. Morotomi et al., *Int J Syst Evol Microbiol.* 62(Pt 1):144-149 (2012). Other reported isolated members of *Christensenella* include *C. massiliensis* (Ndongo et al., *New Microbes New Infect.* 12:69-70 (2016)) and *C. timonensis* (Ndongo et al., *New Microbes New Infect.* 13:32-33 (2016)).

Given the growing evidence for the role of Christensenellaceae in maintaining beneficial health states such as lean body mass, low inflammation and a balanced microbiota, there is a need for identification of additional members of the Christensenellaceae family and *Christensenella* genus, particularly those that show potential beneficial anti-inflammatory properties, such as short-chain fatty acid production and/or anti-inflammatory cytokine production, and have the potential to treat disorders such as inflammatory disorders (e.g., IBD) and metabolic disorders (e.g., obesity, non-alcoholic fatty liver disease (NAFLD) and non-alcoholic steatohepatitis (NASH)).

SUMMARY

Provided herein are compositions, for example, pharmaceutical compositions, comprising a species or strain of the genus *Christensenella*, for example, a species or strain referred to herein as *Christensenella* sp. P152-H6d. The terms *Christensenella* sp. P152-H6d, *Christensenella* P152-H6d, P152-H6d, *Christensenella* ASMB, *Christensenella* ASMB P152-H6d are used interchangeably herein. It is understood that, unless indicated otherwise, these terms may refer to a species as well as a strain of the species. For example, *Christensenella* sp. P152-H6d may refer to the species *Christensenella* sp. P152-H6d as well as the strain *Christensenella* sp. P152-H6d (e.g. the strain deposited under accession number DSM 33327), which is the type strain of the species. The species *Christensenella* sp. P152-H6d can be alternately referred to as *Christensenella* californii.

In one aspect, provided herein is a composition comprising a bacterial strain of the genus *Christensenella*, wherein the bacterial strain comprises a 16s rRNA gene sequence with at least about 98% sequence identity to the polynucleotide sequence of SEQ ID NO: 1. In some embodiments, the composition further comprises an excipient, diluent and/or carrier. In some embodiments, the composition or the bacterial strain in the composition is lyophilized, freeze dried or spray dried.

In some embodiments, the *Christensenella* bacterial strain is capable of increasing secretion of CCL-18 and/or IL-10 by a human cell, e.g., a THP-1 macrophage, monocyte-derived dendritic cell (moDC), or peripheral blood mononuclear cell (PBMC) in vitro, e.g., the *Christensenella* bacterial strain increases secretion of CCL-18 by a human THP-1 macrophage when the strain is co-cultured with the human THP-1 macrophage. In some embodiments, the *Christensenella* bacterial strain comprises a 16s rRNA gene sequence with at least about 98.5%, 98.65%, 99%, or 99.5% sequence identity to the polynucleotide sequence of SEQ ID NO: 1. In some embodiments, the *Christensenella* bacterial strain comprises a 16s rRNA gene sequence of SEQ ID NO: 1. In some embodiments, the *Christensenella* bacterial strain shares at least 70% DNA-DNA hybridization with *Christensenella* sp. P152-H6d, deposited under accession number DSM 33237. In some embodiments, the *Christensenella* bacterial strain comprises a nucleotide sequence having at least about 70% identity to any one of SEQ ID NOs: 2-28. In some embodiments, the *Christensenella* bacterial strain comprises a genome having at least 95% average nucleotide identity (ANI) with the genome of *Christensenella* sp. P152-H6d, deposited under accession number DSM 33237. In some embodiments, the *Christensenella* bacterial strain comprises a genome having at least 96.5% average nucleotide identity (ANI) and at least 60% alignment fraction (AF) with the genome of *Christensenella* sp. P152-H6d, deposited under accession number DSM 33237. In some embodiments, the *Christensenella* bacterial strain is *Christensenella* sp. P152-H6d, deposited under accession number DSM 33237.

In some embodiments, the *Christensenella* bacterial strain is non-spore forming. In some embodiments, the *Christensenella* bacterial strain of the composition is viable. In some embodiments, the bacterial strain is capable of at least partially colonizing an intestine of a human subject. In some embodiments, the composition is suitable for oral delivery to a subject. In some embodiments, the composition comprising the *Christensenella* bacterial strain is formulated as an enteric formulation. In some embodiments, the enteric formulation is formulated as a capsule, tablet, caplet, pill, troche, lozenge, powder, or granule. In some embodiments, the composition is formulated as a suppository, suspension, emulsion, or gel. In some embodiments, the composition comprises at least $1\times10^3$ CFU of the bacterial strain. In some embodiments, the composition comprises a therapeutically effective amount of the bacterial strain sufficient to prevent or treat a disorder when administered to a subject in need thereof. In some embodiments, the disorder is selected from the group consisting of an inflammatory disorder, a gastrointestinal disorder, inflammatory bowel disease, cancer, non-alcoholic fatty liver disease (NAFLD), non-alcoholic steatohepatitis (NASH), metabolic syndrome, insulin deficiency, insulin resistance-related disorders, insulin sensitivity, glucose intolerance, pre-diabetes, diabetes, high body mass index (BMI), excess adiposity, obesity, excess weight, cardiovascular disease, atherosclerosis, hyperlipidemia, hyperglycemia, abnormal lipid metabolism, and hypertension. In some embodiments, the gastrointestinal disorder is selected from the group consisting of ulcerative colitis, Crohn's disease, and irritable bowel syndrome.

In some embodiments, the composition comprises an excipient selected from the group consisting of a filler, a binder, a disintegrant, and any combination(s) thereof. In some embodiments, the excipient is selected from the group consisting of cellulose, polyvinyl pyrrolidone, silicon dioxide, stearyl fumarate or a pharmaceutically acceptable salt thereof, and any combination(s) thereof. In some embodiments, the composition further comprises a cryoprotectant. In some embodiments, the cryoprotectant is selected from the group consisting of a fructoligosaccharide, trehalose, and a combination thereof. In some embodiments, the fructoligosaccharide is Raftilose® (fructooligosaccharide derived from inulin). In some embodiments, the composition is suitable for bolus administration or bolus release. In some embodiments, the composition comprises the *Christensenella* bacterial strain and at least one more additional bacterial strain(s).

In another aspect, provided herein is a bacterial strain of the genus *Christensenella*, wherein the bacterial strain comprises a 16s rRNA gene sequence with at least about 98% sequence identity to the polynucleotide sequence of SEQ ID NO: 1.

In some embodiments, the *Christensenella* bacterial strain is capable of increasing secretion of CCL-18 and/or IL-10 by a human cell, e.g. a THP-1 macrophage, monocyte-derived dendritic cell (moDC), or peripheral blood mononuclear cell (PBMC) in vitro, e.g., the *Christensenella* bacterial strain increases secretion of CCL-18 by a human THP-1 macrophage when the strain is co-cultured with the human THP-1 macrophage. In some embodiments, the *Christensenella* bacterial strain comprises a 16s rRNA gene sequence with at least about 98.5%, 98.65%, 99%, or 99.5% sequence identity to the polynucleotide sequence of SEQ ID NO: 1. In some embodiments, the *Christensenella* bacterial strain comprises a 16s rRNA gene sequence of SEQ ID NO: 1. In some embodiments, the *Christensenella* bacterial strain shares at least 70% DNA-DNA hybridization with *Christensenella* sp. P152-H6d, deposited under accession number DSM 33237. In some embodiments, the *Christensenella* bacterial strain comprises a nucleotide sequence having at least about 70% identity to any one of SEQ ID NOs: 2-28. In some embodiments, the *Christensenella* bacterial strain comprises a genome having at least 95% average nucleotide identity (ANI) with the genome of *Christensenella* sp. P152-H6d, deposited under accession number DSM 33237. In some embodiments, the *Christensenella* bacterial strain comprises a genome having at least 96.5% average nucleotide identity (ANI) and at least 60% alignment fraction (AF) with the genome of *Christensenella* sp. P152-H6d, deposited under accession number DSM 33237. In some embodiments, the *Christensenella* bacterial strain is *Christensenella* sp. P152-H6d, deposited under accession number DSM 33237. In some embodiments, the *Christensenella* bacterial strain is viable. In some embodiments, the bacterial strain is capable of at least partially colonizing an intestine of a human subject.

In another aspect, provided herein is a food product comprising a *Christensenella* bacterial strain described herein.

In another aspect, provided herein is a method of preventing or treating a disorder, for example, an inflammatory disorder, a gastrointestinal disorder, inflammatory bowel disease, cancer, non-alcoholic fatty liver disease (NAFLD), non-alcoholic steatohepatitis (NASH), metabolic syndrome, insulin deficiency, insulin resistance-related disorders, insulin sensitivity, glucose intolerance, pre-diabetes, diabetes, high body mass index (BMI), excess adiposity, obesity, excess weight, cardiovascular disease, atherosclerosis, hyperlipidemia, hyperglycemia, abnormal lipid metabolism, and hypertension in a subject in need thereof, the method comprising administering a therapeutically effective amount of a *Christensenella* bacterial strain described herein or a composition comprising a *Christensenella* bacterial strain described herein to the subject. In some embodiments, the gastrointestinal disorder is ulcerative colitis, Crohn's disease or irritable bowel syndrome. Also provided herein is a method of treating a dysbiosis in a subject in need thereof, the method comprising administering a therapeutically effective amount of a *Christensenella* bacterial strain described herein or a composition comprising a *Christensenella* bacterial strain described herein to the subject. Also provided herein is a method of modifying a gut microbiome in a subject (e.g., a subject in need thereof), the method comprising administering a therapeutically effective amount of a *Christensenella* bacterial strain described herein or a composition comprising a *Christensenella* bacterial strain described herein to the subject. Also provided herein is a method of treating a skin disorder in a subject in need thereof, the method comprising administering a therapeutically effective amount of a *Christensenella* bacterial strain described herein or a composition comprising a *Christensenella* bacterial strain described herein to the subject. In some embodiments, the skin disorder is selected from the group consisting of psoriasis, eczema, dermatitis (e.g., eczematous dermatitides, topic and seborrheic dermatitis, allergic or irritant contact dermatitis, eczema craquelee, photoallergic dermatitis, phototoxicdermatitis, phytophotodermatitis, radiation dermatitis, and stasis dermatitis), and acne. In some embodiments of the methods provided herein, the method further comprises administering a prebiotic to the subject. In some embodiments, the subject is selected from the group consisting of a human, a companion animal, and a livestock animal.

DESCRIPTION OF THE FIGURES

The disclosure can be more completely understood with reference to the following figures.

DETAILED DESCRIPTION

I. Bacterial Strains

Figure 1A:
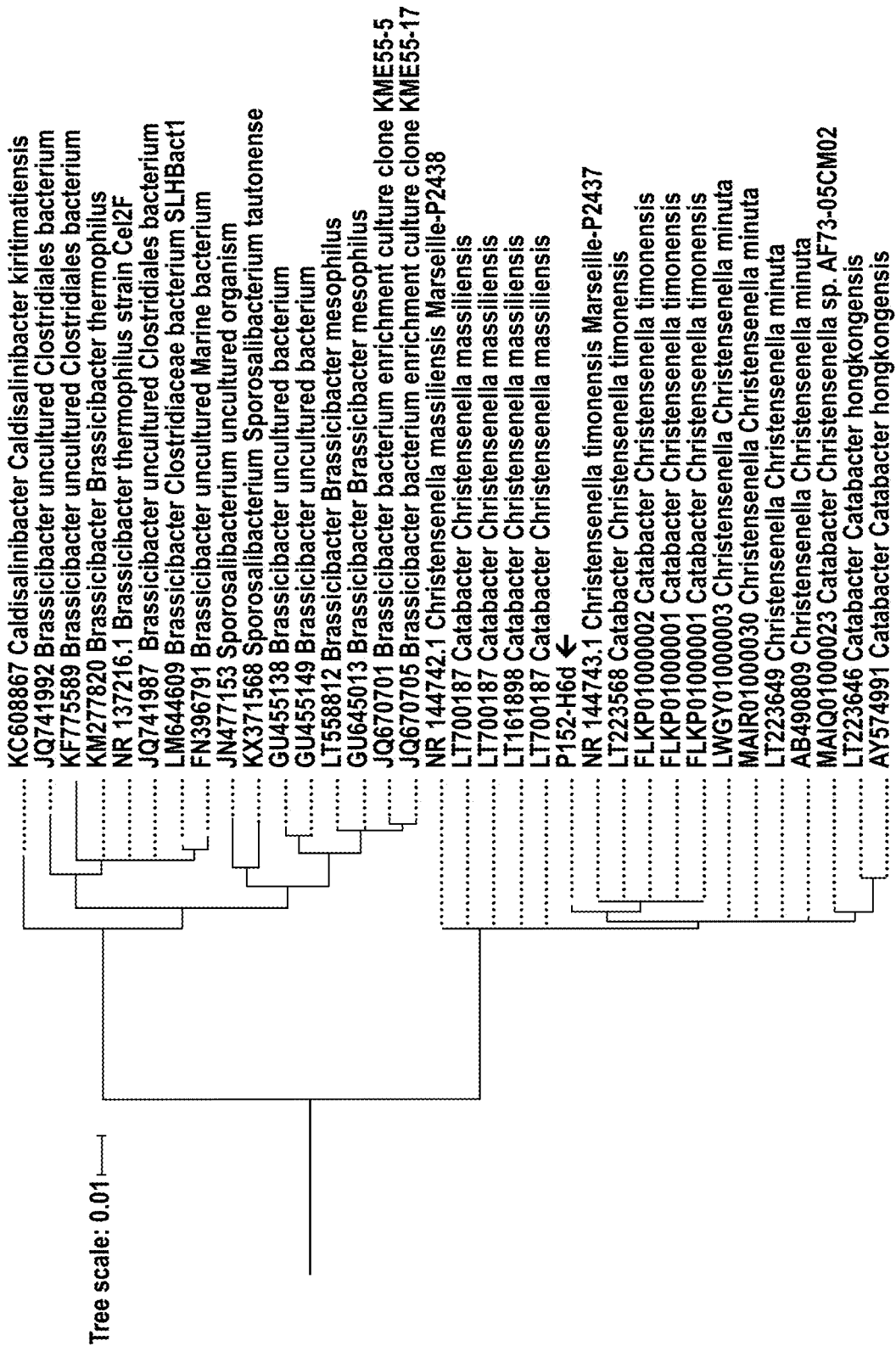
FIG. 1 depicts: (A) a Maximum Likelihood (ML) tree built using 16S rDNA sequences of the closest neighbors of *Christensenella* sp. P152-H6d (P152-H6d) along with other genera, which indicates that *Christensenella* is a monophyletic genus with clear taxonomic delineation between member species, and each individual *Christensenella* species clearly clusters on single clades. (B) BLASTn search results for the *Christensenella* P152-H6d (C. sp. P152-H6d) 16S rRNA gene sequence (SEQ ID NO: 1). The closest match over the entire P152-H6d 16S rRNA sequence length of 1442 bps is the species *Christensenella timonensis*, at 97.85% sequence identity.

In one aspect, provided herein are species or strains of the genus *Christensenella*, referred to herein as *Christensenella* sp. P152-H6d, and compositions, for example, pharmaceutical compositions, comprising *Christensenella* sp. P152-H6d. The terms *Christensenella* sp. P152-H6d, *Christensenella* P152-H6d, P152-H6d, *Christensenella* ASMB, *Christensenella* ASMB P152-H6d are used interchangeably herein. It is understood that, unless indicated otherwise, these terms may refer to a species as well as a strain of the species. For example, *Christensenella* sp. P152-H6d (e.g., the strain deposited under accession number DSM 33237), which is the type strain of the species. The species *Christensenella* sp. P152-H6d can be alternately referred to as *Christensenella californii*.

As used herein, the term "species" refers to a taxonomic entity as conventionally defined by genomic sequence and phenotypic characteristics. A "strain" is a particular instance of a species that has been isolated and purified according to conventional microbiological techniques. Bacterial species and/or strains described herein include those that are live and/or viable. In some embodiments, bacterial species and/or strains described herein include vegetative forms and non-spore forming forms of bacteria. Those of skill in the art will recognize that the genus *Christensenella* may undergo taxonomical reorganization. Thus, it is intended that contemplated *Christensenella* species include *Christensenella* species that have been renamed and/or reclassified, as well as those that may be later renamed and/or reclassified.

In some embodiments, a bacterial strain of *Christensenella* sp. P152-H6d comprises a 16S rRNA gene sequence having a certain % identity to a reference sequence. rRNA, 16S rDNA, 16S rRNA, 16S, 18S, 18S rRNA, and 18S rDNA refer to nucleic acids that are components of, or encode for, components of the ribosome. There are two subunits in the ribosome termed the small subunit (SSU) and large subunit (LSU). Ribosomal RNA genes (rDNA) and their complementary RNA sequences are widely used for determination of the evolutionary relationships among organisms as they are variable, yet sufficiently conserved to allow cross-organism molecular comparisons. 16S rDNA sequence of the 30S SSU can be used, in embodiments, for molecular-based taxonomic assignments of prokaryotes. For example, 16S sequences may be used for phylogenetic reconstruction as they are general highly conserved but contain specific hypervariable regions that harbor sufficient nucleotide diversity to differentiate genera and species of most bacteria. Although 16S rDNA sequence data has been used to provide taxonomic classification, closely related bacterial strains that are classified within the same genus and species, may exhibit distinct biological phenotypes.

Accordingly, a bacterial strain of the species *Christensenella* sp. P152-H6d provided herein includes strains comprising a 16s rRNA gene sequence having a certain % identity to SEQ ID NO: 1. In some embodiments, the bacterial strain is a strain of the genus *Christensenella* comprising a 16s rRNA gene sequence with at least 97.90% sequence identity to the polynucleotide sequence of SEQ ID NO: 1. In some embodiments, the bacterial strain comprises a 16s rRNA gene sequence with at least about 97.95%, about 98.00%, about 98.05%, about 98.1%, about 98.15%, about 98.2%, about 98.25%, about 98.3%, about 98.35%, about 98.4%, about 98.45%, about 98.5%, about 98.55%, about 98.6%, about 98.65%, about 98.7%, about 98.75%, about 98.80%, about 98.85%, about 99%, about 99.1%, about 99.2%, about 99.3%, about 99.4%, about 99.5%, about 99.6%, about 99.7%, about 99.8%, or about 99.9% identity to the polynucleotide sequence of SEQ ID NO: 1. In a particular embodiment, the bacterial strain comprises a 16s rRNA gene sequence identical to SEQ ID NO: 1. In some embodiments, the sequence identity referred to above is across at least about 70% of SEQ ID NO: 1. In other embodiments, the sequence identity referred to above is across at least about 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% of SEQ ID NO: 1.

In some embodiments, a bacterial strain of *Christensenella* sp. P152-H6d comprises a genomic sequence (e.g., a whole genome sequence, or fragments or contigs thereof) having a certain % identity to one or more of SEQ ID NOs: 2-28. In some embodiments, a *Christensenella* sp. P152-H6d strain comprises a polynucleotide sequence of any one of SEQ ID NOs: 2-28, or a nucleotide sequence having at least about 70%, about 75%, about 80%, about 85%, about 90%, about 91%, about 92%, about 93%, about 94%, about 95%, about 96%, about 97%, about 98%, or about 99% identity to a polynucleotide sequence of any one of SEQ ID NOs: 2-28. In some embodiments, a *Christensenella* sp. P152-H6d strain genome may comprise the polynucleotide sequence of each of SEQ ID NOs: 2-28, or each of a polynucleotide sequence having at least about 65%, about 70%, about 75%, about 80%, about 85%, about 90%, about 91%, about 92%, about 93%, about 94%, about 95%, about 96%, about 97%, about 98%, or about 99% identity to the polynucleotide sequence of each of SEQ ID NOs: 2-28.

In some embodiments, a bacterial strain of *Christensenella* sp. P152-H6d comprises a whole genomic sequence having at least about 70% identity across at least 70% of its genome to the sum of all genomic contigs represented by SEQ ID NOs: 2-28. In some embodiments, the whole genomic sequence has at least about 75%, 80%, 85%, 90%, 95% or greater than 95% identity to the sum of all genomic contigs represented by SEQ ID NOs: 2-28. In some embodiments, the sequence identity referred to above is across at least 75%, 80%, 85%, 90%, 95% or greater than 95% of the whole genomic sequence of the bacterial strain. In some embodiments, a bacterial strain of *Christensenella* sp. P152-H6d comprises a whole genomic sequence comprising coding regions having at least about 70% identity across at least 70% of the total coding regions in its genome to the coding regions within the sum of all genomic contigs represented by SEQ ID NOs: 2-28. In some embodiments, the coding regions within the whole genomic sequence have at least about 75%, 80%, 85%, 90%, 95% or greater than 95% identity to the coding regions within the sum of all genomic contigs represented by SEQ ID NOs: 2-28. In some embodiments, the sequence identity referred to above is across at least 75%, 80%, 85%, 90%, 95% or greater than 95% of the coding regions within the whole genomic sequence of the bacterial strain.

In some embodiments, a bacterial strain of the species *Christensenella* sp. P152-H6d provided herein comprises a relA gene sequence having a certain % identity to SEQ ID NO: 33. In some embodiments, the bacterial strain is a strain of the genus *Christensenella* comprising a relA gene sequence with at least about 85% sequence identity to the polynucleotide sequence of SEQ ID NO: 33. In some embodiments, the bacterial strain comprises a relA gene sequence with at least about 86%, about 87%, about 88%, about 89%, about 90%, about 91%, about 92%, about 93%, about 94%, about 95%, about 96%, about 97%, about 98%, about 99%, about 99.1%, about 99.2%, about 99.3%, about 99.4%, about 99.5%, about 99.6%, about 99.7%, about 99.8%, or about 99.9% identity to the polynucleotide sequence of SEQ ID NO: 33. In a particular embodiment, the bacterial strain comprises a relA gene sequence identical to SEQ ID NO: 33. In some embodiments, the sequence identity referred to above is across at least about 70% of SEQ ID NO: 33. In other embodiments, the sequence identity referred to above is across at least about 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% of SEQ ID NO: 33.

The identity of a bacterial strain of the species *Christensenella* sp. P152-H6d may be determined by sequence analysis, for example, of the 16s rRNA gene sequence or a genomic sequence (e.g., a whole genome sequence, or fragments or contigs thereof) of the bacterial strain, using any sequencing methods known in the art, including, for example, Sanger sequencing. An example of a sequencing technology useful for identifying strains of *Christensenella* sp. P152-H6d is the Illumina platform. The Illumina platform is based on amplification of DNA on a solid surface (e.g., flow cell) using fold-back PCR and anchored primers (e.g., capture oligonucleotides). For sequencing with the Illumina platform, bacterial DNA is fragmented, and adapters are added to terminal ends of the fragments. DNA fragments are attached to the surface of flow cell channels by capturing oligonucleotides which are capable of hybridizing to the adapter ends of the fragments. The DNA fragments are then extended and bridge amplified. After multiple cycles of solid-phase amplification followed by denaturation, an array of millions of spatially immobilized nucleic acid clusters or colonies of single-stranded nucleic acids are generated. Each cluster may include approximately hundreds to a thousand copies of single-stranded DNA molecules of the same template. The Illumina platform uses a sequencing-by-synthesis method where sequencing nucleotides comprising detectable labels (e.g., fluorophores) are added successively to a free 3' hydroxyl group. After nucleotide incorporation, a laser light of a wavelength specific for the labeled nucleotides can be used to excite the labels. An image is captured and the identity of the nucleotide base is recorded. These steps can be repeated to sequence the rest of the bases. Sequencing according to this technology is described in, for example, U.S. Patent Publication Application Nos. 2011/0009278, 2007/0014362, 2006/0024681, 2006/0292611, and U.S. Pat. Nos. 7,960,120, 7,835,871, 7,232,656, and 7,115,200. Another example of a sequencing technology useful for identifying strains of *Christensenella* sp. P152-H6d is SOLiD technology by Applied Biosystems from Life Technologies Corporation (Carlsbad, Calif.). In SOLiD sequencing, bacterial DNA may be sheared into fragments, and adapters may be attached to the terminal ends of the fragments to generate a library. Clonal bead populations may be prepared in microreactors containing template, PCR reaction components, beads, and primers. After PCR, the templates can be denatured, and bead enrichment can be performed to separate beads with extended primers. Templates on the selected beads undergo a 3' modification to allow covalent attachment to the slide. The sequence can be determined by sequential hybridization and ligation with several primers. A set of four fluorescently labeled di-base probes compete for ligation to the sequencing primer. Multiple cycles of ligation, detection, and cleavage are performed with the number of cycles determining the eventual read length. Another example of a sequencing technology useful for identifying strains of *Christensenella* sp. P152-H6d is Ion Torrent sequencing. In this technology, bacterial DNA is sheared into fragments, and oligonucleotide adapters are then ligated to the terminal ends of the fragments. The fragments are then attached to a surface, and each base in the fragments is resolvable by measuring the H$^+$ ions released during base incorporation. This technology is described in, for example, U.S. Patent Publication Application Nos. 2009/0026082, 2009/0127589, 2010/0035252, 2010/0137143, and 2010/0188073.

Upon obtaining a polynucleotide sequence of a bacterial strain (e.g., 16s rRNA gene sequence or genomic sequence), sequence identity with a polynucleotide sequence of *Christensenella* sp. P152-H6d may be determined in various ways that are within the skill in the art, e.g., using publicly available computer software such as BLAST, BLAST-2, BLAT (BLAST-like alignment tool), ALIGN or Megalign (DNASTAR) software. BLAST (Basic Local Alignment Search Tool) analysis using the algorithm employed by the programs blastp, blastn, blastx, tblastn and tblastx (Karlin et al., *Proc. Natl. Acad. Sci. USA* 87:2264-2268 (1990); Altschul, *J. Mol. Evol.* 36, 290-300 (1993); Altschul et al., NUCLEIC ACIDS RES. 25:3389-3402 (1997), incorporated by reference) are tailored for sequence similarity searching. For a discussion of basic issues in searching sequence databases see Altschul et al., *Nature Genetics* 6:119-129 (1994), which is fully incorporated by reference. Those skilled in the art can determine appropriate parameters for measuring alignment, including any algorithms needed to achieve maximal alignment over the full length of the sequences being compared. The search parameters for histogram, descriptions, alignments, expect value (i.e., the statistical significance threshold for reporting matches against database sequences), cutoff, matrix and filter are at the default settings. The default scoring matrix used by blastp, blastx, tblastn, and tblastx is the BLOSUM62 matrix (Henikoff et al., (1992) PROC. NATL. ACAD. SCI. USA 89:10915-10919, fully incorporated by reference). Four blastn parameters may be adjusted as follows: Q=10 (gap creation penalty); R=10 (gap extension penalty); wink=1 (generates word hits at every wink$^{th}$ position along the query); and gapw=16 (sets the window width within which gapped alignments are generated). The equivalent Blastp parameter settings may be Q=9; R=2; wink=1; and gapw=32. Searches may also be conducted using the NCBI (National Center for Biotechnology Information) BLAST Advanced Option parameter (e.g. –G, Cost to open gap [Integer]: default=5 for nucleotides/11 for proteins; –E, Cost to extend gap [Integer]: default=2 for nucleotides/1 for proteins; –q, Penalty for nucleotide mismatch [Integer]: default=–3; –r, reward for nucleotide match [Integer]: default=1; –e, expect value [Real]: default=10; –W, wordsize [Integer]: default=11 for nucleotides/28 for megablast/3 for proteins; –y, Dropoff (X) for blast extensions in bits: default=20 for blastn/7 for others; –X, X dropoff value for gapped alignment (in bits): default=15 for all programs, not applicable to blastn; and –Z, final X dropoff value for gapped alignment (in bits): 50 for blastn, 25 for others). A Bestfit comparison between sequences, available in the GCG package version 10.0, uses DNA parameters GAP=50 (gap creation penalty) and LEN=3 (gap extension penalty) and the equivalent settings in protein comparisons are GAP=8 and LEN=2.

In a particular embodiment, a bacterial strain of *Christensenella* sp. P152-H6d provided herein is *Christensenella* sp. P152-H6d, strain P152-H6d. A deposit of *Christensenella* sp. P152-H6d, strain P152-H6d was made to DSMZ (Deutsche Sammlung von Mikroorganismen und Zellkulturen GmbH, Inhoffenstraße 7B, 38124 Brunswick, Germany) under the Budapest Treaty on the International Recognition of the Deposit of Microorganisms for the Purposes of Patent Procedure on Aug. 12, 2019. This deposit was accorded accession number DSM 33237. The 16s rRNA gene sequence of *Christensenella* sp. P152-H6d, strain P152-H6d is provided herein as SEQ ID NO: 1, and genomic sequences of *Christensenella* sp. P152-H6d, strain P152-H6d are provided herein as SEQ ID NOs: 2-28. In other particular embodiments, a bacterial strain of *Christensenella* sp. P152-H6d provided herein is a *Christensenella* sp. strain selected from the group consisting of P235-A1a, P235-A3a, P237-A7a, and P237-B12a. The isolation of these particular strains is described in Example 7 below.

Additional bacterial strains of the species *Christensenella* sp. P152-H6d provided herein include *Christensenella* strains having a DNA-DNA hybridization (DDH) value of equal to or greater than about 70% with *Christensenella* sp. P152-H6d, strain P152-H6d. In particular embodiments, the *Christensenella* sp. P152-H6d strain is one having greater than about 70%, about 75%, about 80%, about 85%, about 90%, about 95%, about 98%, or about 99% DNA-DNA hybridization with *Christensenella* sp. P152-H6d, strain P152-H6d, or any range between any of the above values. Any method for determining DNA-DNA hybridization values known in the art may be used to assess the degree of DNA-DNA hybridization, including but not limited to the spectrophotometric method for determining renaturation rates described by De Ley et al. (*J Biochem* 12 133-142 (1970)), slightly modified in hybridization temperature (Gavini et al., *Ecology in Health and Disease* 12 40-45 (2001)); and those described by Grimont et al., *Curr Microbiol* 4, 325-330 (1980) and Rossello-Mora, *Molecular Identification, Systematics and Population Structure of Prokaryotes* pp. 23-50 (2006). In some embodiments, the degree of DNA-DNA hybridization is determined by digital DNA-DNA hybridization (dDDH) analysis, for example, using the Genome-to-Genome Distance Calculator online tool (see Meier-Kolthoff et al., *BMC Bioinformatics* 14:60 (2013)). In particular embodiments, the *Christensenella* sp. P152-H6d strain is one having a DDH or dDDH value of equal to or greater than about 70% with *Christensenella* sp. P152-H6d, strain P152-H6d. In some embodiments, the DDH or dDDH value is greater than about 75%, about 80%, about 85%, about 90%, about 95%, about 98%, or about 99% with *Christensenella* sp. P152-H6d, strain P152-H6d, or any range between any of the above values.

Additional bacterial strains of the species *Christensenella* sp. P152-H6d provided herein include *Christensenella* strains having equal to or greater than 95% average nucleotide identity (ANI) with *Christensenella* sp. P152-H6d, strain P152-H6d. In some embodiments, the ANI is equal to or greater than about 95%, about 95.5%, about 96%, about 96.5%, about 97%, about 97.5%, about 98%, about 98.5%, about 99%, about 99.5%, or 100% with *Christensenella* sp. P152-H6d, strain P152-H6d, or any range between any of the above values. The average nucleotide identity (ANI) of the shared genes between two strains is known to be a robust means to compare genetic relatedness among strains, and that ANI values of ~95% correspond to the 70% DNA-DNA hybridization standard for defining a species. See, e.g., Konstantinidis and Tiedje, *Proc Natl Acad Sci USA*, 102(7): 2567-72 (2005); Goris et al., *Int J Syst Evol Microbiol*. 57(Pt 1):81-91 (2007); and Jain et al., *Nat Commun.* 9(1):5114 (2018). In some embodiments, the ANI between two bacterial genomes is calculated from pair-wise comparisons of all sequences shared between any two strains and can be determined, for example, using any of a number of publicly available ANI tools, including but not limited to OrthoANI with usearch (Yoon et al. *Antonie van Leeuwenhoek* 110: 1281-1286 (2017)); ANI Calculator, JSpecies (Richter and Rossello-Mora, *Proc Natl Acad Sci USA* 106:19126-19131 (2009)); and JSpeciesWS (Richter et al., *Bioinformatics* 32:929-931 (2016)). Other methods for determining the ANI of two genomes are known in the art. See, e.g., Konstantinidis, K. T. and Tiedje, J. M., *Proc. Natl. Acad. Sci. U.S.A.,* 102: 2567-2572 (2005); Varghese et al., *Nucleic Acids Research,* 43(14):6761-6771 (2015)); and Jain et al., *Nat Commun.* 9(1):5114 (2018). In a particular embodiment, the ANI between two bacterial genomes can be determined using an alignment-based method, for example, by averaging the nucleotide identity of orthologous genes identified as bidirectional best hits (BBHs). Protein-coding genes of a first genome (Genome A) and second genome (Genome B) are compared at the nucleotide level using a similarity search tool, for example, NSimScan (Novichkov et al., *Bioinformatics* 32(15): 2380-23811 (2016). The results are then filtered to retain only the BBHs that display at least 70% sequence identity over at least 70% of the length of the shorter sequence in each BBH pair. The ANI of Genome A to Genome B is defined as the sum of the percent identity times the alignment length for all BBHs, divided by the sum of the lengths of the BBH genes. In another particular embodiment, the ANI between two bacterial genomes can be determined using an alignment-free method, for example, FastANI, which uses alignment-free approximate sequence mapping to assess genomic relatedness. See Jain et al., *Nat Commun.* 9(1):5114 (2018). FastANI has been demonstrated to reveal clear genetic discontinuity between species, with 99.8% of the total 8 billion genome pairs analyzed conforming to >95% intra-species and <83% inter-species ANI values. Accordingly, in some embodiments, a bacterial strain having a genome with equal to or greater than 95% average nucleotide identity (ANI) with the genome of *Christensenella* sp. P152-H6d is identified as a bacterial strain of the species *Christensenella* sp. P152-H6d.

Additional bacterial strains of the species *Christensenella* sp. P152-H6d provided herein include *Christensenella* strains having equal to or greater than 60% alignment fraction (AF) with *Christensenella* sp. P152-H6d, strain P152-H6d. In some embodiments, the AF is equal to or greater than about 65%, about 70%, about 75%, about 80%, about 85%, about 90%, about 95%, or 100% with *Christensenella* sp. P152-H6d, strain P152-H6d, or any range between any of the above values. In some embodiments, the AF is computed by dividing the sum of the lengths of all BBH genes by the sum of the length of all the genes in Genome A. This computation is performed separately in both directions: from Genome A to genome B and from Genome B to Genome A.

In a particular embodiment, a *Christensenella* sp. P152-H6d strain comprises a genome having equal to or greater than about 95% ANI and equal to or greater than about 60% AF with the genome of *Christensenella* sp. P152-H6d, strain P152-H6d. In another particular embodiment, a *Christensenella* sp. P152-H6d strain comprises a genome having equal to or greater than about 96.5% ANI and equal to or greater than 60% AF with the genome of *Christensenella* sp. P152-H6d, strain P152-H6d.

Additional bacterial strains of the species *Christensenella* sp. P152-H6d provided herein include *Christensenella* strains that having the same or approximately the same genome characteristics as *Christensenella* sp. P152-H6d, strain P152-H6d. Such genome characteristics can include, for example, genome size, G+C content, number of coding sequences, and number of tRNAs. In some embodiments, the *Christensenella* sp. P152-H6d strain comprises a genome of about 2.75 to about 2.85 megabases (Mb) in size. In some embodiments, the *Christensenella* sp. P152-H6d strain comprises a genome of about 2.80 to about 2.85 Mb in size. In some embodiments, the *Christensenella* sp. P152-H6d strain comprises a genome of about 2.75, 2.76, 2.77, 2.78, 2.79, 2.80, 2.81, 2.82, 2.83, 2.84 or about 2.85 Mb in size. In a particular embodiment, the *Christensenella* sp. P152-H6d strain comprises a genome of about 2.82 Mb in size. In some embodiments, the *Christensenella* sp. P152-H6d strain comprises a genome that has a G+C content of about 48% to about 50%. In some embodiments, the *Christensenella* sp. P152-H6d strain comprises a genome that has a G+C content of about 48.5% to about 49.5%. In some embodiments, the *Christensenella* sp. P152-H6d strain comprises a genome that has a G+C content of about 48.6%, 48.7%, 48.8%, 48.9%, 49.0%, 49.1%, 49.2%, 49.3%, 49.4% or about 49.5%. In a particular embodiment, the *Christensenella* sp. P152-H6d strain comprises a genome that has a G+C content of about 48.91%. In some embodiments, the *Christensenella* sp. P152-H6d strain comprises a genome that comprises about 2600 to 2800 coding sequences. In some embodiments, the *Christensenella* sp. P152-H6d strain comprises a genome that comprises about 2650 to 2750 coding sequences. In some embodiments, the *Christensenella* sp. P152-H6d strain comprises a genome that comprises about 2650, 2655, 2660, 2665, 2670, 2675, 2680, 2685, 2690, 2695, 2700, 2705, 2710, 2715, 2720, 2725, 2730, 2735, 2740, 2745, or about 2750 coding sequences. In a particular embodiment, the *Christensenella* sp. P152-H6d strain comprises a genome that comprises about 2671 coding sequences. In some embodiments, the *Christensenella* sp. P152-H6d strain comprises a genome that comprises about 35 to 50 tRNA sequences. In some embodiments, the *Christensenella* sp. P152-H6d strain comprises a genome that comprises about 37 to 45 tRNA sequences. In some embodiments, the *Christensenella* sp. P152-H6d strain comprises a genome that comprises about 37, 38, 39, 40, 41, 42, 43, 44 or 45 tRNAs. In a particular embodiment, the *Christensenella* sp. P152-H6d strain comprises a genome that comprises about 42 tRNAs.

Additional bacterial strains of the species *Christensenella* sp. P152-H6d provided herein include *Christensenella* strains that provide the same or approximately the same pattern as *Christensenella* sp. P152-H6d, strain P152-H6d when analyzed, for example, by DNA fingerprinting techniques. Any DNA fingerprinting technique known in the art may be used to identify strains of *Christensenella* sp. P152-H6d, including but not limited to, Pulsed Field Gel Electrophoresis (PFGE), ribotyping, Randomly Amplified Polymorphic DNA (RAPD), Amplified Fragment Length Polymorphism (AFLP), Amplified Ribosomal DNA Restriction Analysis (ARDRA), rep-PCR (repetitive element primed PCR, directed to naturally occurring, highly conserved, repetitive DNA sequences, present in multiple copies in the genomes) including Repetitive Extragenic Palindromic PCR (REP-PCR), Enterobacterial Repetitive Intergenic Consensus Sequences-PCR (ERIC-PCR), BOX-PCR (derived from the boxA element), $(GTG)_5$-PCR, Triplicate Arbitrary Primed PCR (TAP-PCR), Multi-Locus Sequence Analysis (MLSA), Multi-Locus Sequence Typing (MLST), Multiple Locus Variable-number Tandem Repeat Analysis (MLVA) and DNA microarray-based genotyping techniques.

Additional bacterial strains of the species *Christensenella* sp. P152-H6d provided herein include *Christensenella* strains showing phenotypic similarity to *Christensenella* sp. P152-H6d, strain P152-H6d. Phenotypic similarity can be based on, for example, cell shape and size, colony morphology (e.g., size, color and odor of plate colonies), Gram staining, biochemical tests, pH and temperature optima, sugar fermentation, metabolic capabilities (e.g., catalase and/or oxidase status), chemotaxonomic analysis (e.g., polar lipid and lipoquinone composition; see Tindall et al., *Int Syst*

*Evol Microbiol* 58, 1737-1745 (2008)) and/or fatty acid methyl ester (FAME) analysis. In some embodiments, the bacterial strain of *Christensenella* sp. P152-H6d is catalase positive. In some embodiments, the bacterial strain of *Christensenella* sp. P152-H6d is oxidase negative. In some embodiments, the bacterial strain of *Christensenella* sp. P152-H6d is both catalase positive and oxidase negative.

In some embodiments, a bacterial strain of *Christensenella* sp. P152-H6d is capable of fermenting at least one carbon source selected from the group consisting of glucose (e.g., α-D-glucose), arabinose (e.g., L-arabinose), ribose (e.g., D-ribose), and cyclodextrin (e.g., α-cyclodextrin). In some embodiments, the bacterial strain of *Christensenella* sp. P152-H6d is capable of fermenting each of glucose (e.g., α-D-glucose), arabinose (e.g., L-arabinose), ribose (e.g., D-ribose) and cyclodextrin (e.g., α-cyclodextrin). In some embodiments, the bacterial strain of *Christensenella* sp. P152-H6d is not capable of fermenting, or substantially fermenting, at least one carbon source selected from the group consisting of fructose (e.g., D-fructose), glucosamine (e.g., N-acetyl-D-glucosamine, D-glucosamine), galactose (e.g., D-galactose), mannose (e.g., D-mannose), pectin, rhamnose (e.g., D-rhamnose), trehalose (e.g., D-trehalose), sorbitol (e.g., D-sorbitol), psicose (e.g., D-psicose), dulcitol, malitol, palatinose, sorbose (e.g., L-sorbose), tagatose (e.g., D-tagatose), turanose, glucosaminitol (e.g., N-acetyl-D-glucosaminitol), butyric acid (e.g., β-hydroxy butyric acid), maltose, lactose (e.g., α-D-lactose), sucrose, and cellobiose (e.g., D-cellobiose). In some embodiments, the bacterial strain of *Christensenella* sp. P152-H6d is not capable of fermenting, or substantially fermenting, each of fructose (e.g., D-fructose), glucosamine (e.g., N-acetyl-D-glucosamine, D-glucosamine), galactose (e.g., D-galactose), mannose (e.g., D-mannose), pectin, rhamnose (e.g., D-rhamnose), trehalose (e.g., D-trehalose), sorbitol (e.g., D-sorbitol), psicose (e.g., D-psicose), dulcitol, malitol, palatinose, sorbose (e.g., L-sorbose), tagatose (e.g., D-tagatose), turanose, glucosaminitol (e.g., N-acetyl-D-glucosaminitol), butyric acid (e.g., β-hydroxy butyric acid), maltose, lactose (e.g., α-D-lactose), sucrose, and cellobiose (e.g., D-cellobiose).

In some embodiments, a bacterial strain of *Christensenella* sp. P152-H6d increases, or is capable of increasing, production of one or more short-chain fatty acids (SCFAs). In some embodiments, a bacterial strain of *Christensenella* sp. P152-H6d produces, or is capable of producing, one or more short-chain fatty acids (SCFAs). In some embodiments, the SCFA is butyric acid. In some embodiments, the SCFA is acetic acid. In particular embodiments, the bacterial strain of *Christensenella* sp. P152-H6d produces both butyric acid and acetic acid.

In some embodiments, a bacterial strain of *Christensenella* sp. P152-H6d increases, or is capable of increasing, production of at least one anti-inflammatory gene, e.g., an anti-inflammatory cytokine or chemokine, in a cell, tissue, or subject. Exemplary anti-inflammatory gene products include CCL-18, IL-1Ra, IL-4, IL-6, IL-10, IL-11, IL-13, MCP-1 and TGF-β. For example, in some embodiments, the bacterial strain of *Christensenella* sp. P152-H6d increases, or is capable of increasing, production of IL-10 and/or CCL-18 in a cell, tissue, or subject. In some embodiments, the increased production of an anti-inflammatory gene product, e.g., IL-10 and/or CCL-18, occurs in a human cell, e.g., a THP-1 macrophage or monocyte or a PBMC. For example, contacting a human cell, e.g., a THP-1 macrophage or PBMC, with *Christensenella* sp. P152-H6d, e.g., by co-culturing the human cell with *Christensenella* sp. P152-H6d, increases production of IL-10 and/or CCL-18 in the cell by at least about 10%, at least about 20%, at least about 30%, at least about 40%, at least about 50%, at least about 75%, at least about 100%, at least about 200%, at least about 300%, at least about 400%, at least about 500%, at least about 750%, at least about 1000%, from about 10% to about 20%, from about 10% to about 50%, from about 10% to about 100%, from about 10% to about 200%, from about 10% to about 500%, from about 10% to about 1000%, from about 20% to about 50%, from about 20% to about 100%, from about 20% to about 200%, from about 20% to about 500%, from about 20% to about 1000%, from about 50% to about 100%, from about 50% to about 200%, from about 50% to about 500%, from about 50% to about 1000%, from about 100% to about 200%, from about 100% to about 500%, from about 100% to about 1000%, from about 200% to about 500%, from about 200% to about 1000%, or from about 500% to about 1000%, relative to a cell (e.g., of the same cell type) that was not contacted, e.g., co-cultured, with *Christensenella* sp. P152-H6d. In some embodiments, the contacting of the human cell with *Christensenella* sp. P152-H6d occurs in vitro. In other embodiments, the contacting of the human cell with *Christensenella* sp. P152-H6d occurs in vivo.

In some embodiments, a bacterial strain of *Christensenella* sp. P152-H6d reduces or attenuates, or is capable of reducing or attenuating, production of at least one pro-inflammatory gene, e.g., a pro-inflammatory cytokine or chemokine, in a cell, tissue, or subject. In some embodiments, the bacterial strain reduces or attenuates, or is capable of reducing or attenuating, production of at least one pro-inflammatory gene, e.g., a pro-inflammatory cytokine or chemokine, in a cell, tissue, or subject, for example, in the presence of a pro-inflammatory stimulus. Exemplary pro-inflammatory gene products include IL-1-β, IL-4, IL-5, IL-6, IL-8, IL-12, IL-13, IL-17, IL-21, IL-22, IL-23, IL-27, IFN, CCL-2, CCL-3, CCL-5, CCL-20, CXCL-5, CXCL-10, CXCL-12, CXCL-13, IFN-γ and TNF-α. For example, in some embodiments, the bacterial strain of *Christensenella* sp. P152-H6d reduces or attenuates, or is capable of reducing or attenuating, production of IL-12, e.g., IL-12 subunit p40, in a cell, tissue, or subject. In some embodiments, the bacterial strain of *Christensenella* sp. P152-H6d reduces or attenuates, or is capable of reducing or attenuating, production of TNF-α in a cell, tissue, or subject. In some embodiments, the reduced or attenuated production of an anti-inflammatory gene product, e.g., IL-12 and/or TNF-α, occurs in a human cell, e.g., a THP-1 macrophage or monocyte, moDC or a PBMC. For example, contacting a human cell, e.g., a THP-1 macrophage or PBMC, with *Christensenella* sp. P152-H6d, e.g., by co-culturing the human cell with *Christensenella* sp. P152-H6d, reduces or attenuates production of IL-12 in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted, e.g., co-cultured, with *Christensenella* sp. P152-H6d. In some embodiments, contacting a human cell, e.g., a THP-1 macrophage or PBMC, with *Christensenella* sp. P152-H6d, e.g., by co-culturing the human cell with *Christensenella* sp. P152-H6d, reduces or attenuates production of TNF-α in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted, e.g., co-cultured with *Christensenella* sp. P152-H6d. In some embodiments, the contacting of the human cell with *Christensenella* sp. P152-H6d occurs in vitro. In other embodiments, the contacting of the human cell with *Christensenella* sp. P152-H6d occurs in vivo.

Contemplated bacterial strains or bacterial strain mixtures may reduce or attenuate, or be capable of reducing or attenuating, production of one or more biomarkers (e.g. serum or stool biomarkers) of an inflammatory condition, for example, inflammatory bowel disease (IBD), in a cell, tissue or subject. For example, Lipocalin-2 (LCN2), also referred to as neutrophil gelatinase-associated lipocalin (NGAL) or siderocalin, is a potent bacteriostatic protein stored in neutrophil granules and released at sites of inflammation. High LCN2 expression by gut epithelial cells has been demonstrated in colonic biopsies from inflamed areas of patients with IBD (Nielsen et al., *Gut*, 38:414-420 (1996)), and LCN2 has been reported to be among the 10 most upregulated genes in both active ulcerative colitis and Crohn's disease (Ostvik et al., *Clin Exp Immunol.* 173:502-511 (2013)). Ostvik reported that although LCN2 protein was found in both epithelial cells and infiltrating neutrophils, LCN2 mRNA synthesis solely took place in epithelial cells indicating that the excessive de novo synthesis of LCN2 in IBD is localized in the colonic epithelium. Serum levels of LCN2 have been demonstrated to be a reliable biomarker of disease activity in UC, distinguishing active disease from disease in remission with a greater sensitivity than CRP or white blood cell count (Stallhofer et al., *Inflamm Bowel Dis* 21(10):2327-2340 (2015)). Levels of LCN2/NGAL can be assessed in a cell, tissue or subject contacted with a contemplated bacterial strain or bacterial strain mixture by measuring the expression and/or concentration of the LCN2/NGAL gene product in a sample, e.g., plasma, serum, stool and/or tissue (e.g., colonic tissue), by any method known in the art, including qPCR, ELISA, immunohistochemistry or the like. Other biomarkers for IBD that may be reduced or attenuated by a bacterial strain described herein include Serum Amyloid A proteins (SAAs). Expression of SAAs is associated with inflamed colon of IBD patients, and systemic SAAs in serum promote differentiation of pathogenic Th17 cells (Lee et al., *Cell* 180, 79-91 (2020)). Other biomarkers for IBD that may be reduced or attenuated by a bacterial strain described herein include granulocyte colony-stimulating factor (G-CSF). Margarita et al. evaluated 27 protein biomarkers including serum cytokine, chemokine, and growth factor in IBD patients with different endoscopic activities and found that patients with endoscopically active disease showed higher serum levels of G-CSF (P =0.04) (Medicine. (2019) 98:e17208).

It is understood that the bacterial strains of *Christensenella* sp. P152-H6d provided herein may be characterized by an effect on gene product production, e.g., IL-12 or CCL-18 production, in a human cell, e.g., a THP-1 monocyte or macrophage or a PBMC, and that an expressed gene product may have both pro- and/or anti-inflammatory activity. Gene product production, e.g., IL-12 or CCL-18 production, in a THP-1 macrophage may, for example, be assayed as follows. THP-1 human macrophages are made by culturing the THP-1 human monocyte cell line with phorbol 12-myristate 13-acetate (PMA) for 24 hours followed by IL-4 and IL-13 (Genin et al., *BMC Cancer* 15:577 (2015)). A bacterial strain is cultured with THP-1 macrophages in the presence of lipopolysaccharide (LPS) for 24 hours. Gene product production is assessed by measuring the concentration of the gene product, e.g., IL-12 or CCL-18, in the cell culture supernatant by ELISA. Gene product production may also be assayed as described in Sudhakaran et al., *Genes Nutr.*, 8(6): 637-48. Gene product production, e.g., IL-10, IL-12, or CCL-18 production, in a PBMC may, for example, be assayed as follows. Primary PBMCs are isolated from blood samples of donors using a percoll gradient (Sim et al., *J. Vis. Exp.* (112), e54128 (2016)). A bacterial strain is cultured with PBMCs for 24 hours. Gene product production is assessed by measuring the concentration of the gene product, e.g., IL-10, IL-12, or CCL-18, in the cell culture supernatant by ELISA.

Also provided herein are methods of isolating and/or purifying bacterial strains of the *Christensenella* species described herein (*Christensenella* sp. P152-H6d, i.e. *Christensenella californii*). In some embodiments, a strain of the *Christensenella* species described herein is isolated and/or purified from a biological sample from a mammalian donor. In some embodiments, the mammalian donor is a human, e.g., a healthy human donor. In other embodiments, the mammalian donor is a non-human animal. In some embodiments, the biological sample is any biological sample known in the art to harbor live microbes, e.g., stool, saliva, blood, skin, gut, nose, and the like. In particular embodiments, a strain of the *Christensenella* species described herein is isolated and/or purified from the stool or gut of a healthy human donor. In some embodiments, the methods for isolating and/or purifying bacterial a strain of the *Christensenella* species described herein comprise the steps of: isolating and/or purifying ex vivo one or more microbes from the biological material (e.g., gut or stool) of a donor; and confirming the identity of the one or more microbes as a strain of *Christensenella* sp. P152-H6d using any methods for such identification known in the art and/or described herein. In some embodiments, the identity of the one or more microbes is confirmed as a strain of *Christensenella* sp. P152-H6d by genetic or genomic means. For example, PCR can be utilized to amplify regions of the bacterial strain's genome that have high homology to a gene or gene fragment of *Christensenella* sp. P152-H6d (e.g., a nucleotide sequence selected from within any of SEQ ID NOs: 2-28), as demonstrated in Example 7 below. In some embodiments, the gene is the 16S rRNA gene of *Christensenella* sp. P152-H6d (SEQ ID NO: 1). In some embodiments, the gene is the relA gene of *Christensenella* sp. P152-H6d (SEQ ID NO: 33). In other embodiments, genomic sequences (e.g. partial or whole genome sequences) can be used to confirm the identity of the one or more microbes as a strain of *Christensenella* sp. P152-H6d, for example, by average nucleotide identity (ANI) using a threshold of >95% ANI. In some embodiments, the methods comprise the step of purifying the strain from the donor material. In some embodiments, the methods further comprise the step of culturing the strain in a monoculture.

Also provided herein are strains of the species *Anaerostipes caccae*, for example, a strain referred to herein as *Anaerostipes caccae* strain P127-A10a, and compositions, for example, pharmaceutical compositions, comprising such strains.

A bacterial strain of the species *Anaerostipes caccae* provided herein includes strains comprising a 16s rRNA gene sequence having a certain % identity to SEQ ID NO: 45. In some embodiments, the bacterial strain comprises a 16s rRNA gene sequence with at least about 98.00%, about 98.05%, about 98.1%, about 98.15%, about 98.2%, about 98.25%, about 98.3%, about 98.35%, about 98.4%, about 98.45%, about 98.5%, about 98.55%, about 98.6%, about 98.65%, about 98.7%, about 98.75%, about 98.80%, about 98.85%, about 99%, about 99.1%, about 99.2%, about 99.3%, about 99.4%, about 99.5%, about 99.6%, about 99.7%, about 99.8%, or about 99.9% identity to the polynucleotide sequence of SEQ ID NO: 45. In a particular embodiment, the bacterial strain comprises a 16s rRNA gene sequence identical to SEQ ID NO: 45. In some embodiments, the sequence identity referred to above is across at least about 70% of SEQ ID NO: 45. In other embodiments, the sequence identity referred to above is across at least about 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% of SEQ ID NO: 45.

In a particular embodiment, a bacterial strain of *Anaerostipes caccae* provided herein is *Anaerostipes caccae* strain P127-A10a. A deposit of *Anaerostipes caccae* P127-A10a was made to DSMZ (Deutsche Sammlung von Mikroorganismen and Zellkulturen GmbH, Inhoffenstraße 7B, 38124 Brunswick, Germany) under the Budapest Treaty on the International Recognition of the Deposit of Microorganisms for the Purposes of Patent Procedure on Mar. 6, 2020. This deposit was accorded accession number DSM 33531. The 16S rDNA sequence of *Anaerostipes caccae* P127-A10a is provided as SEQ ID NO: 45.

Additional bacterial strains of the species *Anaerostipes caccae* provided herein include *Anaerostipes caccae* strains having a DNA-DNA hybridization (DDH) value of equal to or greater than about 70% with *Anaerostipes caccae* strain P127-A10a. In particular embodiments, the *Anaerostipes caccae* strain is one having greater than about 70%, about 75%, about 80%, about 85%, about 90%, about 95%, about 98%, or about 99% DNA-DNA hybridization with *Anaerostipes caccae* strain P127-A10a, or any range between any of the above values. In particular embodiments, the *Anaerostipes caccae* strain is one having a DDH or dDDH value of equal to or greater than about 70% with *Anaerostipes caccae* strain P127-A10a. In some embodiments, the DDH or dDDH value is greater than about 75%, about 80%, about 85%, about 90%, about 95%, about 98%, or about 99% with *Anaerostipes caccae* strain P127-A10a, or any range between any of the above values.

Additional bacterial strains of the species *Anaerostipes caccae* provided herein include *Anaerostipes caccae* strains having equal to or greater than 95% average nucleotide identity (ANI) with *Anaerostipes caccae* strain P127-A10a. In some embodiments, the ANI is equal to or greater than about 95%, about 95.5%, about 96%, about 96.5%, about 97%, about 97.5%, about 98%, about 98.5%, about 99%, about 99.5%, or 100% with *Anaerostipes caccae* strain P127-A10a, or any range between any of the above values.

Additional bacterial strains of the species *Anaerostipes caccae* provided herein include *Anaerostipes caccae* strains having equal to or greater than 60% alignment fraction (AF) with *Anaerostipes caccae* strain P127-A10a. In some embodiments, the AF is equal to or greater than about 65%, about 70%, about 75%, about 80%, about 85%, about 90%, about 95%, or 100% with *Anaerostipes caccae* strain P127-A10a, or any range between any of the above values. In some embodiments, the AF is computed by dividing the sum of the lengths of all BBH genes by the sum of the length of all the genes in Genome A. This computation is performed separately in both directions: from Genome A to genome B and from Genome B to Genome A.

In a particular embodiment, an *Anaerostipes caccae* strain comprises a genome having equal to or greater than about 95% ANI and equal to or greater than 60% AF with the genome of *Anaerostipes caccae* strain P127-A10a. In another particular embodiment, an *Anaerostipes caccae* strain comprises a genome having equal to or greater than about 96.5% ANI and equal to or greater than 60% AF with the genome of *Anaerostipes caccae* strain P127-A10a.

The present disclosure encompasses derivatives of the disclosed bacterial strains. The term "derivative" includes daughter strains (progeny) or stains cultured (sub-cloned) from the original but modified in some way (including at the genetic level), without negatively altering a biological activity of the strain.

II. Compositions Comprising *Christensenella* sp. P152-H6d

In another aspect, provided herein are compositions, for example pharmaceutical compositions, comprising a bacterial strain of *Christensenella* sp. P152-H6d. In some embodiments, the compositions comprise one or more bacterial strains, including one or more bacterial strains of *Christensenella* sp. P152-H6d. In some embodiments, a composition provided herein comprises a bacterial strain of *Christensenella* sp. P152-H6d and does not comprise any other strains or species of bacteria. In other embodiments, the composition comprises a bacterial strain of *Christensenella* sp. P152-H6d and at least one or more additional strains or species of bacteria. In some embodiments, the at least one additional strain or species of bacteria in the composition is a bacterial strain of the genus *Christensenella*. For example, the composition may comprise an additional strain of *Christensenella* sp. P152-H6d and/or one or more strains of a *Christensenella* species that is not *Christensenella* sp. P152-H6d. Exemplary additional *Christensenella* species includes *C. minuta* (Morotomi et al., *International Journal of Systematic and Evolutionary Microbiology* 62:144-14 (2012); *C. massiliensis* (Ndongo et al. *New Microbe and New Infect.* 12:69-70 (2016); and *C. timonensis* (Ndongo et al. *New Microbe and New Infect.* 13:32-33 (2016)). In other embodiments, the composition may comprise *Christensenella* sp. P152-H6d and one or more non-*Christensenella* bacterial species.

In some embodiments, the one or more non-*Christensenella* bacterial species includes a member of the genus *Anaerostipes*, for example, *Anaerostipes caccae*. An exemplary strain of *Anaerostipes caccae* useful for combining with *Christensenella* sp. P152-H6d in a composition provided herein is the strain *Anaerostipes caccae* P127-A10a, deposited under accession number DSM 33531. The 16S rDNA sequence of *Anaerostipes caccae* P127-A10a is provided as SEQ ID NO: 45. Other strains of *Anaerostipes caccae* useful for combining with *Christensenella* sp. P152-H6d in a composition provided herein include strains comprising a 16S rDNA sequence having at least 98% identity to SEQ ID NO: 45. Additional useful strains include *Anaerostipes caccae* strain DSM 14662, *Anaerostipes caccae* strain 3_2_56FAA, and *Anaerostipes caccae* isolate MGYG-HGUT-00080.

In some embodiments, a composition provided herein comprises at least 2, e.g., 2 or 3, bacterial strains. In some embodiments, the composition comprises at least 2, 3, 4, 5, 6, 7, 8, 9, 10, or more than 10 bacterial strains. For example, in some embodiments, the composition comprises 2 to 10, 2 to 9, 2 to 8, 2 to 7, 2 to 6, or 2 to 5 bacterial strains, e.g., vegetative bacterial strains; or, for example, comprises 3 to 10, 3 to 9, 3 to 8, 3 to 7 or 3 to 6 bacterial strains, e.g., vegetative bacterial strains; or, for example, comprises 4 to 10, 4 to 9, 4 to 8, 4 to 7, or 4 to 6 bacterial strains, e.g., vegetative bacterial strains; or, for example, comprises 5 to 10, 5 to 9, 5 to 8, 6 to 9, 6 to 8, 7 to 10, 7 to 9, or 7 to 8 bacterial strains, e.g., vegetative bacterial strains; or, for example, comprises 8 to 10 bacterial strains, e.g., vegetative bacterial strains. In some embodiments, the composition comprises 2 or 3 bacterial strains, e.g., vegetative bacterial strains.

A composition, e.g., a pharmaceutical unit provided herein, may include each bacterial strain at any appropriate ratio, measured either by total mass or by colony forming units of the bacteria. For example, a disclosed pharmaceutical composition or unit may include two strains at a ratio of 0.1:1, 0.2:1, 0.25:1, 0.5:1, 0.75:1, 1:1, 2:1, 3:1, 4:1, 5:1, or 10:1, either by total mass or by colony forming units of the bacteria. For example, a disclosed pharmaceutical composition or unit may include three strains at a ratio of 1:1:1, 1:1:2, 1:1:4, 1:2:1, 1:2:2, 1:2:4, 1:4:1, 1:4:2, 1:4:4, 2:1:1, 2:1:2, 2:1:4, 2:2:1, 2:4:1, 4:1:1, 4:1:2, 4:1:4, 4:2:1, 4:4:1, either by total mass or by colony forming units of the bacteria.

In some embodiments, the composition comprises a bacterial strain of Christensenella sp. P152-H6d, and optionally, one or more additional strains or species of bacteria, wherein the composition: (i) increases production of one or more anti-inflammatory gene products, for example CCL-18, IL-1Ra, IL-4, IL-6, IL-10, IL-11, IL-13, MCP-1 and TGF-β, in a human cell, e.g., a THP-1 macrophage or monocyte, moDC or a PBMC; and/or (ii) reduces or attenuates production of one or more pro-inflammatory gene products, for example IL-1-β, IL-4, IL-5, IL-6, IL-8, IL-12, IL-13, IL-17, IL-21, IL-22, IL-23, IL-27, IFN (e.g., IFN-γ), CCL-2, CCL-3, CCL-5, CCL-20, CXCL-5, CXCL-10, CXCL-12, CXCL-13, and TNF-α, in a human cell, e.g., a THP-1 macrophage or monocyte or a PBMC. In some embodiments, the one or more additional strains of bacteria in the composition are each (i.e. individually) capable of: (i) increasing production of one or more anti-inflammatory gene products, for example CCL-18, IL-1Ra, IL-4, IL-6, IL-10, IL-11, IL-13, and TGF-β, in a human cell, e.g., a THP-1 macrophage or monocyte or a PBMC; and/or (ii) reducing or attenuating production of one or more pro-inflammatory gene products, for example IL-1-β, IL-4, IL-5, IL-6, IL-8, IL-12, IL-13, IL-17, IL-21, IL-22, IL-23, IL-27, IFN, CCL-2, CCL-3, CCL-5, CCL-20, CXCL-5, CXCL-10, CXCL-12, CXCL-13, and TNF-α, in a human cell, e.g., a THP-1 macrophage or monocyte or a PBMC.

Excipients

A bacterial strain of Christensenella sp. P152-H6d disclosed herein may be combined with pharmaceutically acceptable excipients to form a pharmaceutical composition, which can be administered to a patient by any means known in the art. As used herein, the term "pharmaceutically acceptable excipient" is understood to mean one or more of a buffer, carrier, or excipient suitable for administration to a subject, for example, a human subject, without excessive toxicity, irritation, allergic response, or other problem or complication, commensurate with a reasonable benefit/risk ratio. The excipient (s) should be "acceptable" in the sense of being compatible with the other ingredients of the formulations and not deleterious to the recipient.

Pharmaceutically acceptable excipients include buffers, solvents, dispersion media, coatings, isotonic and absorption delaying agents, and the like, that are compatible with pharmaceutical administration. Pharmaceutically acceptable excipients also include fillers, binders, disintegrants, glidants, lubricants, and any combination(s) thereof. For example, a contemplated composition may comprise a pharmaceutical excipient selected from the group consisting of cellulose, polyvinyl pyrrolidone, silicon dioxide, stearyl fumarate or a pharmaceutically acceptable salt thereof, lactose, starch, glucose, methyl cellulose, ethyl cellulose, hydroxypropyl methyl cellulose, magnesium stearate, mannitol, sorbitol, and any combination(s) thereof. For further examples of excipients, carriers, stabilizers and adjuvants, see, e.g., Handbook of Pharmaceutical Excipients, 8$^{th}$ Ed., Edited by P. J. Sheskey, W. G. Cook, and C. G. Cable, Pharmaceutical Press, London, UK [2017]. The use of such media and agents for pharmaceutically active substances is known in the art.

Stabilized Bacterial Compositions

In some embodiments, bacterial strains of Christensenella sp. P152-H6d described herein may be used in any composition in stabilized form, including, for example, in a lyophilized state (with optionally one or more appropriate cryoprotectants), frozen (e.g., in a standard or super-cooled freezer), spray dried, and/or freeze dried. Stabilized bacteria (e.g., via lyophilization, freezing, spray drying or freeze drying), and in particular, stabilized anaerobic bacteria, may, in some embodiments, possess advantageous properties over bacteria in culture with respect to administration, e.g., administration of a pharmaceutical composition provided herein. For example, lyophilizing bacteria involves a freeze-drying process that removes water from the bacterial cells. The resulting lyophilized bacteria may, in some embodiments, have enhanced stability as compared to bacterial cultures, and thus may be stored for longer periods of time (i.e. extending shelf-life). In addition, in some embodiments, in stabilized form, dehydrated bacterial cells do not grow or reproduce, but remain viable and may grow and reproduce when rehydrated. In some embodiments, viability of stabilized anaerobic Christensenella sp. P152-H6d bacteria is maintained even when exposed to oxygen, thus facilitating their formulation (for example, into oral dosage forms) and use as a live biotherapeutic product that retains biological activity. Thus, in particular embodiments, the bacterial strains of Christensenella sp. P152-H6d described herein are stabilized (e.g., via lyophilization, freezing, freeze-drying or spray-drying), live and viable, and retain some, most, or all of their chemical stability, and/or biological activity upon storage. Stability can be measured at a selected temperature and humidity conditions for a selected time period. Trend analysis can be used to estimate an expected shelf life before a material has actually been in storage for that time period. For live bacteria, for example, stability may be defined as the time it takes to lose 1 log of cfu/g dry formulation under predefined conditions of temperature, humidity and time period.

In some embodiments, a pharmaceutical composition or pharmaceutical unit comprising Christensenella sp. P152-H6d loses at most 0.5 log cfus, 1 log cfus, 1.5 log cfus, 2 log cfus, 2.5 log cfus, 3 log cfus, 3.5 log cfus, 4 log cfus, 4.5 log cfus, 5 log cfus, 5.5 log cfus, 6 log cfus, 6.5 log cfus, 7 log cfus, 7.5 log cfus, 8 log cfus, 8.5 log cfus, 9 log cfus, 9,5 log cfus, or 10 log cfus of each bacterial strain present in the pharmaceutical composition or unit upon storage for 1 month, 2 months, 3 months, 4 months, 5 months, 6 months, 7 months, 8 months, 9 months, 10 months 11, months, 12 months, 1 year, 1.5 years, 2 years, 2.5 years, 3 years, 3.5 years, 4 years, 4.5 years, or 5 years at 4° C. or −20° C. For example, the pharmaceutical composition or pharmaceutical unit may lose at most 3 log cfus of each bacterial strain present in the pharmaceutical composition or unit upon storage for 6 months, 1 year, or 2 years at 4° C.

A *Christensenella* sp. P152-H6d bacteria disclosed herein may be combined with one or more cryoprotectants. Exemplary cryoprotectants include fructoligosaccharides (e.g., Raftilose® (fructooligosaccharide derived from inulin)), trehalose, maltodextrin, sodium alginate, proline, glutamic acid, glycine (e.g., glycine betaine), mono-, di-, or polysaccharides (such as glucose, sucrose, maltose, lactose), polyols (such as mannitol, sorbitol, or glycerol), dextran, DMSO, methylcellulose, propylene glycol, polyvinylpyrrolidone, non-ionic surfactants such as Tween 80, and any combination(s) thereof.

In some embodiments, the cryoprotectant comprises Raftilose®, maltodextrin, alginate, trehalose, and sucrose, or any combination(s) thereof. In some embodiments, a pharmaceutical composition comprising a bacterial strain of *Christensenella* sp. P152-H6d further comprises sucrose as a cryoprotectant. In some embodiments, a pharmaceutical composition comprising a bacterial strain of *Christensenella* sp. P152-H6d further comprises Raftilose®, maltodextrin, alginate, trehalose, and sucrose as cryoprotectants. In some embodiments, a pharmaceutical composition comprising a bacterial strain of *Christensenella* sp. P152-H6d further comprises Raftilose®, maltodextrin, alginate, and trehalose as cryoprotectants.

In some embodiments, a lyophilized powder form of a bacterial strain, as contemplated herein, includes about 10% to about 80% (by weight) of one or more bacterial strains (e.g., one bacterial strain) and about 20% to about 90% (by weight) of a cryoprotectant and/or excipient, such as a cryoprotectant and/or excipient selected from the group consisting of Raftilose®, maltodextrin, sodium alginate, trehalose, sucrose, water, and any combination(s) thereof. For example, 5 mg of contemplated lyophilized powder form of a bacterial strain may include about 0.5 mg to about 1.5 mg of the bacterial strain, about 1.5 mg to about 2.5 mg of the bacterial strain, about 2.5 to about 3.5 mg of the bacterial strain, or about 3.5 mg to about 4.5 mg of the bacterial strain. It can be appreciated that each lyophilized powder form of bacterial strain that may form a component of a disclosed composition may each have different excipients and/or amounts of excipients, as well as a discrete bacterial strain.

A pharmaceutical composition should be formulated to be compatible with its intended route of administration. The bacterial compositions disclosed herein can be prepared by any suitable method and can be formulated into a variety of forms and administered by a number of different means. The compositions can be administered orally, rectally, or enterally, in formulations containing conventionally acceptable carriers, adjuvants, and vehicles as desired. As used herein, "rectal administration" is understood to include administration by enema, suppository, or colonoscopy. A disclosed pharmaceutical composition may, e.g., be suitable for bolus administration or bolus release. In an exemplary embodiment, a disclosed bacterial composition is administered orally.

Solid dosage forms for oral administration include capsules, tablets, caplets, pills, troches, lozenges, powders, and granules. A capsule typically comprises a core material comprising a bacterial composition and a shell wall that encapsulates the core material. In some embodiments the core material comprises at least one of a solid, a liquid, and an emulsion. In some embodiments the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit®"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In some embodiments at least one polymer functions as a taste-masking agent.

Tablets, pills, and the like can be compressed, multiply compressed, multiply layered, and/or coated. A contemplated coating can be single or multiple. In one embodiment, a contemplated coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, agar, alginates, chitosans, or gellan gum. In some embodiments a contemplated coating material comprises a protein. In some embodiments a contemplated coating material comprises at least one of a fat and an oil. In some embodiments the at least one of a fat and an oil is high temperature melting. In some embodiments the at least one of a fat and an oil is hydrogenated or partially hydrogenated. In some embodiments the at least one of a fat and an oil is derived from a plant. In some embodiments the at least one of a fat and an oil comprises at least one of glycerides, free fatty acids, and fatty acid esters. In some embodiments a contemplated coating material comprises at least one edible wax. A contemplated edible wax can be derived from animals, insects, or plants. Non-limiting examples include beeswax, lanolin, bayberry wax, carnauba wax, and rice bran wax. Tablets and pills can additionally be prepared with enteric or reverse-enteric coatings.

Alternatively, powders or granules embodying a bacterial composition disclosed herein can be incorporated into a food product. In some embodiments a contemplated food product is a drink for oral administration. Non-limiting examples of a suitable drink include water, fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, emulsions, suspensions and solutions and/or suspensions reconstituted from non-effervescent granules, containing at least one of suitable solvents, preservatives, emulsifying agents, suspending agents, diluents, sweeteners, coloring agents, and flavoring agents.

In some embodiments, a pharmaceutical composition provided herein includes: (a) a *Christensenella* sp. P152-H6d strain; and (b) a filler (e.g., microcrystalline cellulose, lactose, sucrose, mannitol, or dicalcium phosphate dihydrate), a disintegrant (e.g., polyvinyl pyrrolidone, sodium starch glycolate, starch, or carboxymethyl-cellulose), a flow-aid/glidant (e.g., talc or silica derivatives (e.g., colloidal silica such as Cab-O-Sil or Aerosil)), and a lubricant (e.g., sodium stearyl fumarate, magnesium stearate, calcium stearate, stearic acid, stearic acid salt, talc, liquid paraffin, propylene glycol (PG), PEG 6000, or magnesium/sodium lauryl sulfate).

In some embodiments, a contemplated pharmaceutical composition includes: (a) a *Christensenella* sp. P152-H6d strain; and (b) a filler (microcrystalline cellulose), a disintegrant (polyvinyl pyrrolidone), a flow-aid/glidant (silicon dioxide), and a lubricant (sodium stearyl fumarate).

In some embodiments, a contemplated pharmaceutical composition is formulated as a capsule. In some embodiments, the capsule is a hydroxypropyl methylcellulose (HPMC) capsule. In some embodiments, the capsule includes a banding polymer (e.g., hydroxypropyl methylcellulose (HPMC)), and a banding solvent (e.g., water or ethanol). In some embodiments, the capsule includes two banding solvents, water and ethanol. In some embodiments the capsule is coated with a reverse enteric coating polymer (e.g., amino methacrylate copolymer), and comprises a surfactant (e.g., sodium lauryl sulfate), a flow-aid/glidant (e.g., silicon dioxide), a lubricant (e.g., stearic acid), an anti-tacking agent (e.g., talc), and a coating solvent (e.g., water). In some embodiments the capsule is coated with an enteric coating polymer (e.g., poly (methacrylic acid-co-methyl methacrylate)), and further includes a plasticizer (e.g., triethyl citrate), an anti-tacking agent (e.g., talc), a pH adjuster (e.g., ammonia solution), and a coating solvent (e.g., purified water and isopropyl alcohol).

In some embodiments, a contemplated capsule is a capsule-in-capsule dosage form, which includes an inner capsule and an outer capsule. In some embodiments, the inner capsule includes one or more lyophilized bacterial strains, a filler (e.g., microcrystalline cellulose, lactose, sucrose, mannitol, dicalcium phosphate dihydrate, or starch), a disintegrant (e.g., polyvinyl pyrrolidone, sodium starch glycolate, or carboxymethyl-cellulose), a flow-aid/glidant (e.g., silicon dioxide, talc, or colloidal silica), and a lubricant (e.g., sodium stearyl fumarate, magnesium stearate, calcium stearate, stearic acid, stearic acid salt, talc, liquid paraffin, propylene glycol (PG), PEG 6000, or magnesium/sodium lauryl sulfate). In some embodiments, the outer capsule includes one or more lyophilized bacterial strains, a filler (e.g., microcrystalline cellulose, lactose, sucrose, mannitol, dicalcium phosphate dihydrate, or starch). a disintegrant (e.g., polyvinyl pyrrolidone, sodium starch glycolate, or carboxymethyl-cellulose), a flow-aid/glidant (e.g., silicon dioxide, talc, or colloidal silica), and a lubricant (e.g., sodium stearyl fumarate, magnesium stearate, calcium stearate, stearic acid, stearic acid salt, talc liquid paraffin, propylene glycol (PG), PEG 6000, or magnesium/sodium lauryl sulfate).

In some embodiments, a contemplated capsule is a capsule-in-capsule dosage form, which includes an inner capsule and an outer capsule. In some embodiments, the inner capsule includes one or more lyophilized bacterial strains, a filler (microcrystalline cellulose), a disintegrant (polyvinyl pyrrolidone), a flow-aid/glidant (silicon dioxide), and a lubricant (sodium stearyl fumarate). In some embodiments, the outer capsule includes one or more lyophilized bacterial strains, a filler (microcrystalline cellulose), a disintegrant (polyvinyl pyrrolidone), a flow-aid/glidant (silicon dioxide), and a lubricant (sodium stearyl fumarate).

In some embodiments, a disclosed pharmaceutical unit comprises a dual component capsule. For example, a dual component capsule may comprise an inner capsule, wherein the inner capsule has a reverse enteric polymeric coating, and an outer capsule encapsulating the inner capsule, wherein the outer capsule has an enteric polymeric coating.

A contemplated inner and/or outer capsule may comprise a bacterial strain or a bacterial strain mixture. For example, a dual component capsule may comprise an inner capsule having an inner composition comprising a bacterial strain or bacterial strain mixture and one or more pharmaceutical excipients, wherein the inner capsule has a reverse enteric polymeric coating, and an outer capsule encapsulating the inner capsule and an outer composition comprising a bacterial strain or bacterial strain mixture and one or more pharmaceutical excipients, wherein the outer capsule has an enteric polymeric coating. A contemplated inner and/or outer composition may, e.g., comprise a *Christensenella* sp. P152-H6d strain, and optionally one or more additional strains. The inner composition and the outer composition may be the same or different.

A contemplated dual component capsule may include a total of about 5 mg to about 60 mg of the inner and outer composition, e.g., a total of about 5 mg to about 50 mg of the inner and outer composition, a total of about 5 mg to about 15 mg of the inner and outer composition, a total of about 5 mg to about 25 mg of the inner and outer composition, or a total of about 25 mg to about 50 mg of the inner and outer composition. A contemplated dual component capsule may include a total of about 50 mg to about 120 mg of the inner and outer composition, a total of about 50 mg to about 75 mg of the inner and outer composition, a total of about 60 mg to about 85 mg of the inner and outer composition, a total of about 50 mg to about 95 mg of the inner and outer composition, or a total of about 25 mg to about 110 mg of the inner and outer composition.

In some embodiments, a disclosed dual component capsule includes an inner capsule with a reverse enteric polymeric coating, and an outer capsule with an enteric polymeric coating. Each respective coating, for example, allows for biphasic release of the capsule's contents (including bacterial strains) at distinct sites along the gastrointestinal tract. For example, it has been determined that the GI tract has several regions sharply demarcated by local pH ranging from 1 to 8.2. The normal pH profile of the GI tract rises and falls between the stomach and the colon with pH ranges of 1-4 in the stomach, 5.5-6.4 in the duodenum, 6.8-8.2 in the ileum, and 5.5-6.5 in the colon. For example, while the distal ileum contains a region where the usual pH is between 6.8 and 8.2, the pH drops sharply from 8.2 to 5.5 after passage through the ileocecal valve into the cecum and ascending colon. The pH gradually rises once again to 8.0 in the progression from proximal to distal colon. Accordingly, in some embodiments, the enteric polymeric coating of the outer capsule solubilizes in a pH of about 7 to 8, allowing for release in the ileum, and the reverse enteric polymeric coating of the inner capsule solubilizes in a pH of about 6.2 to 6.5, allowing for subsequent release in the colon. In some embodiments, the outer capsule maintains integrity (e.g., absence of splits, cracks, or rupture of capsule shell) for about 2 hours at pH 1.2 and 37° C. In some embodiments, the outer capsule maintains integrity (e.g., absence of splits, cracks, or rupture of capsule shell) for about 2 hours at pH 5.5 and 37° C. In some embodiments, the outer capsule disintegrates within about 1 hour at pH 7.4 and 37° C. In some embodiments, the inner capsule maintains integrity (e.g., absence of splits, cracks, or rupture of capsule shell) for up to 1 hour at pH 7.4 and 37° C. In some embodiments, the inner capsule disintegrates within 2 hours at pH 6.5 and 37° C.

In some embodiments, the inner and/or outer capsule coating is comprised of poly(dl-lactide-co-glycolide, chitosan (Chi) stabilized with PVA (poly-vinylic alcohol), a lipid, an alginate, carboxymethylethylcellulose (CMEC), cellulose acetate trimellitiate (CAT), hydroxypropylmethyl cellulose phthalate (HPMCP), hydroxypropylmethyl cellulose, ethyl cellulose, food glaze, mixtures of hydroxypropylmethyl cellulose and ethyl cellulose, polyvinyl acetate phthalate (PVAP), cellulose acetate phthalate (CAP), shellac, copolymers of methacrylic acid and ethyl acrylate, or copolymers of methacrylic acid and ethyl acrylate to which a monomer of methylacrylate has been added during polymerization. Methylmethacrylates or copolymers of methacrylic acid and methylmethacrylate are available as Eudragit® polymers (Evonik Industries, Darmstadt, Germany). For example, Eudragit® L100 and Eudragit® S100 (anionic copolymers based on methacrylic acid and methyl methacrylate) can be used, either alone or in combination. Eudragit® L100 dissolves at about pH 6 and upwards and comprises between 46.0% and 50.6% methacrylic acid units per g dry substance; Eudragit® S100 dissolves at about pH 7 and upwards and comprises between 27.6% and 30.7% methacrylic acid units per g dry substance. Another exemplary group of encapsulating polymers are the polyacrylic acids Eudragit® L and Eudragit® S which optionally may be combined with Eudragit® RL or RS (copolymers of ethyl acrylate, methyl methacrylate and a low content of methacrylic acid ester with quaternary ammonium groups). These modified acrylic acids are useful since they can be made soluble at a pH of 6 to 7.5, depending on the particular Eudragit chosen, and on the proportion of Eudragit® S to Eudragit® L, RS, and RL used in the formulation. In some embodiments, a contemplated coating of the inner capsule is comprised of Eudragit EPO® ReadyMix. In some embodiments, a contemplated coating of the outer capsule is comprised of Eudragit® L100 (methylacrylic acid-methyl methacrylate co-polymer (1:1)) and Eudragit® S100 (methylacrylic acid-methyl methacrylate co-polymer (1:2)). In some embodiments, a contemplated capsule is suitable for extended or timed release. In some embodiments, a contemplated inner and/or outer capsule coating further comprises a band/seal, e.g., hypromellose, an opacifier, e.g., titanium dioxide, a plasticizer, e.g., triethyl citrate (TEC) or an anti-tacking agent, e.g., talc.

Further exemplary capsule-in-capsule formulations are described in U.S. Pat. No. 9,907,755.

Unit Dosage Forms

Pharmaceutical compositions comprising *Christensenella* sp. P152-H6d disclosed herein can be presented in a unit dosage form, i.e., a pharmaceutical unit. A composition, e.g., a pharmaceutical unit provided herein, may include any appropriate amount of one or more bacterial strains, measured either by total mass or by colony forming units of the bacteria.

For example, a disclosed pharmaceutical composition or unit may include from about $10^3$ cfus to about $10^{12}$ cfus, about $10^6$ cfus to about $10^{12}$ cfus, about $10^7$ cfus to about $10^{12}$ cfus, about $10^8$ cfus to about $10^{12}$ cfus, about $10^9$ cfus to about $10^{12}$ cfus, about $10^{10}$ cfus to about $10^{12}$ cfus, about $10^{11}$ cfus to about $10^{12}$ cfus, about $10^3$ cfus to about $10^{11}$ cfus, about $10^6$ cfus to about $10^{11}$ cfus, about $10^7$ cfus to about $10^{11}$ cfus, about $10^8$ cfus to about $10^{11}$ cfus, about $10^9$ cfus to about $10^{11}$ cfus, about $10^{10}$ cfus to about $10^{11}$ cfus, about $10^3$ cfus to about $10^{10}$ cfus, about $10^6$ cfus to about $10^{10}$ cfus, about $10^7$ cfus to about $10^{10}$ cfus, about $10^8$ cfus to about $10^{10}$ cfus, about $10^9$ cfus to about $10^{10}$ cfus, about $10^3$ cfus to about $10^9$ cfus, about $10^6$ cfus to about $10^9$ cfus, about $10^7$ cfus to about $10^9$ cfus, about $10^8$ cfus to about $10^9$ cfus, about $10^3$ cfus to about $10^8$ cfus, about $10^6$ cfus to about $10^8$ cfus, about $10^7$ cfus to about $10^8$ cfus, about $10^3$ cfus to about $10^7$ cfus, about $10^6$ cfus to about $10^7$ cfus, or about $10^3$ cfus to about $10^6$ cfus of each bacterial strain, or may include about $10^3$ cfus, about $10^6$ cfus, about $10^7$ cfus, about $10^8$ cfus, about $10^9$ cfus, about $10^{10}$ cfus, about $10^{11}$ cfus, or about $10^{12}$ cfus of a bacterial strain or of each bacterial strain in the composition.

For example, a disclosed pharmaceutical composition or unit may include from about $10^3$ cfus to about $10^{12}$ cfus, about $10^6$ cfus to about $10^{12}$ cfus, about $10^7$ cfus to about $10^{12}$ cfus, about $10^8$ cfus to about $10^{12}$ cfus, about $10^9$ cfus to about $10^{12}$ cfus, about $10^{10}$ cfus to about $10^{12}$ cfus, about $10^{11}$ cfus to about $10^{12}$ cfus, about $10^3$ cfus to about $10^{11}$ cfus, about $10^6$ cfus to about $10^{11}$ cfus, about $10^7$ cfus to about $10^{11}$ cfus, about $10^8$ cfus to about $10^{11}$ cfus, about $10^9$ cfus to about $10^{11}$ cfus, about $10^{10}$ cfus to about $10^{11}$ cfus, about $10^3$ cfus to about $10^{10}$ cfus, about $10^6$ cfus to about $10^{10}$ cfus, about $10^7$ cfus to about $10^{10}$ cfus, about $10^8$ cfus to about $10^{10}$ cfus, about $10^9$ cfus to about $10^{10}$ cfus, about $10^3$ cfus to about $10^9$ cfus, about $10^6$ cfus to about $10^9$ cfus, about $10^7$ cfus to about $10^9$ cfus, about $10^8$ cfus to about $10^9$ cfus, about $10^3$ cfus to about $10^8$ cfus, about $10^6$ cfus to about $10^8$ cfus, about $10^7$ cfus to about $10^8$ cfus, about $10^3$ cfus to about $10^7$ cfus, about $10^6$ cfus to about $10^7$ cfus, or about $10^3$ cfus to about $10^6$ cfus of each bacterial strain, or may include about $10^3$ cfus, about $10^6$ cfus, about $10^7$ cfus, about $10^8$ cfus, about $10^9$ cfus, about $10^{10}$ cfus, about $10^{11}$ cfus, or about $10^{12}$ cfus of a bacterial strain in the composition.

In some embodiments, a provided pharmaceutical unit comprises at least $1 \times 10^3$ colony forming units of each bacterial strain (e.g., vegetative bacterial strain), or, at least $1 \times 10^4$ colony forming units of bacterial strain (e.g., vegetative bacterial strain), or, at least $1 \times 10^5$ colony forming units of bacterial strain (e.g., vegetative bacterial strain), or, at least $1 \times 10^6$ colony forming units of each bacterial strain (e.g., vegetative bacterial strain), or, at least $1 \times 10^7$ colony forming units of each bacterial strain (e.g., vegetative bacterial strain), or, at least $1 \times 10^8$ colony forming units of each bacterial strain (e.g., vegetative bacterial strain), or, at least $1 \times 10^9$ colony forming units of each bacterial strain (e.g., vegetative bacterial strain).

For example, disclosed compositions (e.g., a pharmaceutical unit such as e.g., a capsule) can include about 1 mg to about 5 mg (e.g., 2 mg to about 4 mg) of a bacterial strain, which can each be present in the unit, e.g., within about 5 mg to about 50 mg of a lyophilized powder form of the bacterial strain. For example, a pharmaceutical unit may comprise a total of about 30 mg to about 70 mg, about 30 mg to about 60 mg, about 30 mg to about 50 mg, about 30 mg to about 40 mg, about 40 mg to about 70 mg, about 40 mg to about 60 mg, about 40 mg to about 50 mg, about 50 mg to about 70 mg, about 50 mg to about 60 mg, about 80 mg to about 100 mg, about 90 mg to about 110 mg, about 100 mg to about 120 mg, or about 110 mg to about 150 mg of lyophilized powder forms of the bacterial strain. In some embodiments, the pharmaceutical unit comprises a total of about 30 mg, 40 mg, 50 mg, 60 mg, 70 mg, 100 mg, 120 mg, 130 mg, 140 mg, or 150 mg of lyophilized powder form of the bacterial strain.

In some embodiments, a disclosed composition such as a disclosed pharmaceutical unit may include about 5 to about 50 mg of each lyophilized powder form of a bacterial strain, for example, about 5 to about 45 mg, about 5 to about 40 mg, about 5 to about 35 mg, about 5 to about 30 mg, about 5 to about 25 mg, about 5 to about 15 mg, about 5 to about 10 mg, about 10 to about 50 mg, about 10 to about 35 mg of each lyophilized powder form of a bacterial strain (e.g., a vegetative bacterial strain), about 10 to about 20 mg, about 10 to about 15 mg, or about 15 to about 45 mg of each lyophilized powder form of a bacterial strain (e.g., a vegetative bacterial strain). In some embodiments, a disclosed pharmaceutical unit comprises about 5, about 10, about 15, about 20, about 25, or about 30 mg of each lyophilized powder form of a bacterial strain (e.g., a vegetative bacterial strain). In some embodiments, a disclosed pharmaceutical unit includes about 25 to about 50 mg of a lyophilized powder form of one bacterial strain (e.g., vegetative bacterial strain) and about 5 mg to about 10 mg of the remaining lyophilized powder forms of bacterial strains (e.g., vegetative bacterial strains), or about 5 to about 15 mg of one lyophilized powder form of bacterial strain (e.g., vegetative bacterial strain) and about 5 to 10 mg of the remaining lyophilized powder forms of bacterial strains (e.g., vegetative bacterial strains), for example, about 15 mg of one lyophilized powder form of bacterial strain (e.g., vegetative bacterial strain) and about 5 mg of the remaining lyophilized powder forms of bacterial strains (e.g., vegetative bacterial strains), or about 15 mg to about 25 mg of each of two lyophilized powder forms of bacterial strains (e.g., vegetative bacterial strains) and about 5 mg to 10 mg of the remaining lyophilized powder forms of bacterial strains (e.g., vegetative bacterial strains).

In some embodiments a pharmaceutical composition or unit may include, or may be administered in combination with a prebiotic, i.e., a compound or composition which modifies the growth, maintenance, activity and/or balance of the intestinal micro flora (e.g., can allow for specific changes in the composition and/or activity of the microbiome). Exemplary prebiotics include complex carbohydrates, complex sugars, resistant dextrins, resistant starch, amino acids, peptides, nutritional compounds, biotin, polydextrose, fructooligosaccharide (FOS), galactooligosaccharides (GOS), inulin, lignin, psyllium, chitin, chitosan, chitosanoligosaccharides, lacitol, gums (e.g., guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, isomaltoligosaccharides, and xylooligosaccharides (XOS). Prebiotics can be found in foods (e.g., acacia gum, guar seeds, brown rice, rice bran, barley hulls, chicory root, Jerusalem artichoke, dandelion greens, garlic, leek, onion, asparagus, wheat bran, oat bran, baked beans, whole wheat flour, and banana), and breast milk. Prebiotics can also be administered in other forms (e.g., a capsule or dietary supplement).

III. Therapeutic Uses

Compositions and methods disclosed herein can be used to treat various forms of gastrointestinal disorders, inflammatory disorders, skin disorders, and/or dysbiosis in a subject. The disclosure provides a method of treating a gastrointestinal disorder, inflammatory disorder, skin disorder, and/or dysbiosis in a subject. A contemplated method comprises administering to the subject an effective amount of a pharmaceutical composition and/or pharmaceutical unit comprising a *Christensenella* sp. P152-H6d bacterial strain disclosed herein (and optionally one or more additional bacterial strains), either alone or in a combination with another therapeutic agent to treat the gastrointestinal disorder, inflammatory disorder, and/or dysbiosis in the subject.

As used herein, "treat", "treating" and "treatment" mean the treatment of a disease in a subject, e.g., in a human. This includes: (a) inhibiting the disease, i.e., arresting its development; and (b) relieving the disease, i.e., causing regression of the disease state. As used herein, the terms "subject" and "patient" refer to an organism to be treated by the methods and compositions described herein. Such organisms preferably include, but are not limited to, mammals, e.g., human, a companion animal (e.g., dog, cat, or rabbit), or a livestock animal (for example, cow, sheep, pig, goat, horse, donkey, and mule, buffalo, oxen, or camel)).

It will be appreciated that the exact dosage of a pharmaceutical unit, pharmaceutical composition, or bacterial strain is chosen by an individual physician in view of the patient to be treated, in general, dosage and administration are adjusted to provide an effective amount of the bacterial agent to the patient being treated. As used herein, the "effective amount" refers to the amount necessary to elicit a beneficial or desired biological response. An effective amount can be administered in one or more administrations, applications or dosages and is not intended to be limited to a particular formulation or administration route. As will be appreciated by those of ordinary skill in this art, the effective amount of a pharmaceutical unit, pharmaceutical composition, or bacterial strain may vary depending on such factors as the desired biological endpoint, the drug to be delivered, the target tissue, the route of administration, etc. Additional factors which may be taken into account include the severity of the disease state; age, weight and gender of the patient being treated; diet, time and frequency of administration; drug combinations; reaction sensitivities; and tolerance/response to therapy.

It is understood that a disclosed bacterial strain or bacterial strain mixture may not require colonization of the gut, e.g., an intestine, of the subject and/or persistence in the subject in order elicit a beneficial or desired biological response. For example, in some embodiments, a bacterial strain or bacterial strain mixture colonizes the gut, e.g., an intestine, of the subject and/or persists in the subject after administration. In some embodiments, a bacterial strain or bacterial strain mixture does not colonize the gut of the subject and/or persist in the subject after administration.

Gastrointestinal disorders include for example, inflammatory bowel disease (IBD), Crohn's disease (CD), ulcerative colitis (UC), ulcerative proctitis, microscopic colitis, irritable bowel syndrome (IBS; e.g., IBS-c, IBS-m, or IBS-d), functional diarrhea, functional constipation, coeliac disease, radiation enteritis, *Clostridium difficile* (*C. difficile*) infection (CDI), recurrent *C. difficile* infection (rCDI), *C. difficile* associated diarrheal disease (CDAD), colitis (e.g., infectious, ischemic, indeterminate, or radiation colitis), ulcers (including gastric, peptic, and duodenal ulcers), gastroesophageal reflux disease (GERD), pouchitis, gastroenteritis, pancreatitis, mucositis (e.g., oral mucositis, gastrointestinal mucositis, nasal mucositis and proctitis), necrotizing enterocolitis, esophagitis, non-ulcer dyspepsia, chronic intestinal pseudo-obstruction, functional dyspepsia, colonic pseudo-obstruction, duodenogastric reflux, ileus inflammation, post-operative ileus, heartburn (high acidity in the GI tract), constipation (e.g., constipation associated with use of medications such as opioids, osteoarthritis drugs, osteoporosis drugs, post-surgical constipation, or constipation associated with neuropathic disorders), hemorrhoids, diverticular disease, chronic pancreatitis, blind loop syndrome, gastroparesis (including diabetic and/or idiopathic), diarrhea, dysphagia, fecal incontinence, short bowel syndrome (SBS), intestinal ischemia, infant regurgitation, infant rumination syndrome, cyclic vomiting syndrome, globus, volvulus, cancers of the gastrointestinal tract, and gastrointestinal allergies. It is contemplated that compositions and methods disclosed herein can be used to treat any functional gastrointestinal disorder, including, for example, a disorder mediated by or otherwise associated with a brain-gut interaction.

Inflammatory Bowel Disease or IBD is used interchangeably herein to refer to diseases of the bowel that cause inflammation and/or ulceration and includes without limitation Crohn's disease and ulcerative colitis. Crohn's disease (CD) and ulcerative colitis (UC) are chronic inflammatory bowel diseases of unknown etiology.

Ulcerative colitis (UC) afflicts the large intestine. The course of the disease may be continuous or relapsing, mild or severe. The earliest lesion is an inflammatory infiltration with abscess formation at the base of the crypts of Lieberkuhn. Coalescence of these distended and ruptured crypts tends to separate the overlying mucosa from its blood supply, leading to ulceration. Symptoms of the disease include cramping, lower abdominal pain, rectal bleeding, and frequent, loose discharges consisting mainly of blood, pus and mucus with scanty fecal particles. A total colectomy may be required for acute, severe or chronic, unremitting ulcerative colitis.

Crohn's disease, unlike ulcerative colitis, can affect any part of the bowel. The most prominent feature Crohn's disease is the granular, reddish-purple edematous thickening of the bowel wall. With the development of inflammation, these granulomas often lose their circumscribed borders and integrate with the surrounding tissue. Diarrhea and obstruction of the bowel are the predominant clinical features. As with ulcerative colitis, the course of Crohn's disease may be continuous or relapsing, mild or severe, but unlike ulcerative colitis, Crohn's disease is not curable by resection of the involved segment of bowel. Most patients with Crohn's disease require surgery at some point, but subsequent relapse is common and continuous medical treatment is usual.

Inflammatory disorders may be characterized, for example, based on the primary tissue affected, the mechanism of action underlying the disorder, or the portion of the immune system that is misregulated or overactive. Examples of inflammatory disorders include inflammation of the lungs, joints, connective tissue, eyes, nose, bowel, kidney, liver, skin, central nervous system, vascular system, heart, or adipose tissue. In some embodiments, inflammatory disorders which may be treated include inflammation due to the infiltration of leukocytes or other immune effector cells or mediators thereof into affected tissue. In some embodiments, inflammatory disorders which may be treated include inflammation mediated by IgA and/or IgE antibodies. Other relevant examples of inflammatory disorders which may be treated by the present disclosure include inflammation caused by infectious agents, including but not limited to viruses, bacteria, fungi, and parasites. In some embodiments, the inflammatory disorder that is treated is an allergic reaction. In some embodiments, the inflammatory disorder is an autoimmune disease.

Inflammatory lung disorders include asthma, adult respiratory distress syndrome, bronchitis, pulmonary inflammation, pulmonary fibrosis, and cystic fibrosis (which may additionally or alternatively involve the gastro-intestinal tract or other tissue(s)). Immune mediated inflammatory diseases include systemic lupus erythematosus, systemic vasculitis, Sjogren's syndrome, alopecia areata, and systemic sclerosis. Inflammatory joint disorders include rheumatoid arthritis, seronegative spondyloarthropathies including ankylosing spondylitis, juvenile rheumatoid arthritis, osteoarthritis, gouty arthritis and other arthritic disorders. Inflammatory eye disorders include uveitis (including iritis), conjunctivitis, episcleritis, scleritis, and keratoconjunctivitis sicca. Inflammatory bowel disorders include Crohn's disease, ulcerative colitis, inflammatory bowel disease, and distal proctitis. Inflammatory skin disorders include disorders associated with cell proliferation, such as psoriasis, eczema, dermatitis (e.g., eczematous dermatitides, topic and seborrheic dermatitis, allergic or irritant contact dermatitis, eczema craquelee, photoallergic dermatitis, phototoxicdermatitis, phytophotodermatitis, radiation dermatitis, and stasis dermatitis), and acne. Inflammatory disorders of the endocrine system include, but are not limited to, autoimmune endocrinopathies, autoimmune thyroiditis (Hashimoto's disease), Type I diabetes, inflammation in liver and adipose tissue associated with Type II diabetes, and acute and chronic inflammation of the adrenal cortex. Inflammatory disorders of the cardiovascular system include, but are not limited to, coronary infarct damage, peripheral vascular disease, myocarditis, vasculitis, revascularization of stenosis, atherosclerosis, and vascular disease associated with Type II diabetes. Inflammatory disorders of the kidney include, but are not limited to, glomerulonephritis, interstitial nephritis, lupus nephritis, nephritis secondary to Wegener's disease, acute renal failure secondary to acute nephritis, Goodpasture's syndrome, post-obstructive syndrome and tubular ischemia. Inflammatory disorders of the liver include, but are not limited to, hepatitis (arising from viral infection, autoimmune responses, drug treatments, toxins, environmental agents, or as a secondary consequence of a primary disorder), biliary atresia, primary biliary cirrhosis and primary sclerosing cholangitis. Metabolic disorders with inflammatory etiology include insulin resistance, metabolic syndrome, obesity, Nonalcoholic fatty liver disease (NAFLD), and Nonalcoholic steatohepatitis (NASH). In some embodiments, the inflammatory disorder is an autoimmune disease, for example, rheumatoid arthritis, lupus, alopecia, autoimmune pancreatitis, Celiac disease, Behcet's disease, Cushing syndrome, and Grave's disease. In some embodiments, the inflammatory disorder is a rheumatoid disorder, for example, rheumatoid arthritis, juvenile arthritis, bursitis, spondylitis, gout, scleroderma, Still's disease, and vasculitis. Additional exemplary inflammatory disorders include eosinophilic esophagitis and eosinophilic gastroenteritis.

Exemplary skin disorders include psoriasis, eczema, dermatitis (e.g., eczematous dermatitides, topic and seborrheic dermatitis, allergic or irritant contact dermatitis, eczema craquelee, photoallergic dermatitis, phototoxicdermatitis, phytophotodermatitis, radiation dermatitis, and stasis dermatitis), and acne.

Generally, dysbiosis refers to a state of the microbiota or microbiome of the gut or other body area, including, e.g., mucosal or skin surfaces (or any other microbiota niche) in which the normal diversity and/or function of the ecological network is disrupted. Any disruption from a typical (e.g., ideal) state of the microbiota can be considered a dysbiosis, even if such dysbiosis does not result in a detectable decrease in health. This state of dysbiosis may be unhealthy (e.g., result in a diseased state), or it may be unhealthy under only certain conditions, or it may prevent a subject from becoming healthier. Dysbiosis may be due to a decrease in diversity of the microbiota population composition, the overgrowth of one or more population of pathogens (e.g., a population of pathogenic bacteria) or pathobionts, the presence of and/or overgrowth of symbiotic organisms able to cause disease only when certain genetic and/or environmental conditions are present in a patient, or the shift to an ecological network that no longer provides a beneficial function to the host and therefore no longer promotes health.

A distal dysbiosis includes, but is not limited to, a dysbiosis outside of the lumen of the gastrointestinal tract.

It is contemplated that dysbiosis may include infection with a pathogenic bacterium of a genus selected from the group consisting of *Yersinia, Vibrio, Treponema, Streptococcus, Staphylococcus, Shigella, Salmonella, Rickettsia, Orientia, Pseudomonas, Neisseria, Mycoplasma, Mycobacterium, Listeria, Leptospira, Legionella, Klebsiella, Helicobacter, Haemophilus, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium*, and *Bacillus*. Further examples of pathogenic bacteria include *Aeromonas hydrophila, Campylobacter fetus, Plesiomonas shigelloides, Bacillus cereus, Campylobacter jejuni, Clostridium botulinum, Clostridium difficile, Clostridium perfringens*, enteroaggregative *Escherichia coli*, enterohemorrhagic *Escherichia coli*, enteroinvasive *Escherichia coli*, enterotoxigenic *Escherichia coli* (LT or ST), *Escherichia coli* 0157:H7, *Helicobacter pylori, Lysteria monocytogenes, Plesiomonas shigelloides, Salmonella typhi, Staphylococcus aureus, Vibrio cholerae, Vibrio parahaemolyticus, Vibrio vulnificus, Yersinia enterocolitica*, carbapenem-resistant *Enterobacteriaceae* (CRE), extended spectrum beta-lactam resistant *Enterococci* (ESBL), vancomycin-resistant *Enterococci* (VRE), and multi-drug resistant bacteria.

It is further contemplated that compositions and methods disclosed herein can be used to treat a disorder of the liver, pancreas, or gallbladder.

In particular embodiments, the compositions and methods disclosed herein can be used to prevent or inhibit weight gain, promote weight loss, and/or reduce excess adiposity in a subject in need thereof. In some embodiments, the subject in need thereof has a body mass index (BMI) equal to or greater than 24 (i.e. 24 kg/m$^2$). In some embodiments, the subject in need thereof has a BMI equal to or greater than 24, 25, 26, 27, 28, 29, 30, 31, 32, 33, 34, 35, 36, 37, 38, 39, 40 or greater than 40. In some embodiments, the subject in need thereof is obese, as determined by, for example, a BMI≥25, waist circumference, waist-to-hip ratio, skinfold thickness, bioelectric impedance, underwater weighting (densitometry), air-displacement plethysmography, dilution method (hydrometry), dual energy x-ray absorptiometry (DEXA), computerized tomography (CT), magnetic resonance imaging (MRI), or any combination(s) thereof.

In other embodiments, the compositions and methods disclosed herein may also be useful for preventing one or more of the above diseases or conditions, when administered as vaccine compositions. In some embodiments, the bacterial strains provided herein are viable. In some embodiments, the bacterial strains are capable of at least partially or totally colonizing the gastrointestinal tract, e.g., the intestine. In some embodiments, the bacterial strains of the invention are viable and capable of at least partially or totally colonizing the gastrointestinal tract, e.g., the intestine. In other embodiments, the bacterial strains of the invention may be killed, inactivated or attenuated. In some embodiments, the compositions may comprise a vaccine adjuvant. In some embodiments, the compositions are for administration via injection, such as via subcutaneous injection.

IV. Combination Therapy

The methods and compositions described herein can be used alone or in combination with other therapeutic agents and/or modalities. The term administered "in combination," as used herein, is understood to mean that two (or more) different treatments are delivered to the subject during the course of the subject's affliction with the disorder, such that the effects of the treatments on the patient overlap at a point in time. In some embodiments, the delivery of one treatment is still occurring when the delivery of the second begins, so that there is overlap in terms of administration. This is sometimes referred to herein as "simultaneous" or "concurrent delivery." In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered. In some embodiments, a side effect of a first and/or second treatment is reduced because of combined administration.

In some embodiments, a method or composition described herein is administered in combination with one or more additional therapies. In some embodiments, a contemplated additional therapy may include an aminosalicylate, a corticosteroid, a Tumor Necrosis Factor (TNF) antagonist, linaclotide, an antibiotic, or an immunosuppressive agent (e.g., azathioprine, 6-mercaptopurine, cyclosporine, methotrexate, or tacrolimus (Prograf)). In some embodiments, a contemplated additional therapy may include a biologic agent (e.g., infliximab (Remicade), adalimumab (Humira), certolizumab pegol (Cimzia), golimumab (Simponi), or etanercept (Enbrel)). It is contemplated that a subject treated with a disclosed method or composition may have had an inadequate response to a previous administration of a therapy, e.g., a previous administration of an aminosalicylate, a corticosteroid, or a biologic agent.

Further therapeutic agents suitable for use in combination therapy with a pharmaceutical composition or unit described herein include proton pump inhibitors (such as pantoprazole (Protonix), lansoprazole (Prevacid), esomeprazole (Nexium), omeprazole (Prilosec), and rabeprazole), H2 blockers (such as cimetidine (Tagamet), ranitidine (Zantac), famotidine (Pepcid), and nizatidine (Axid)), prostaglandins (such as misoprostoL (Cytotec)), sucralfate, and antacids.

In some embodiments, a pharmaceutical composition or unit may include, or be administered in combination with, a corticosteroid. Corticosteroids are a class of chemicals that includes steroid hormones naturally produced in the adrenal cortex of vertebrates and analogues of these hormones that are synthesized in laboratories. Corticosteroids are involved in a wide range of physiological processes, including stress response, immune response, and regulation of inflammation, carbohydrate metabolism, protein catabolism, blood electrolyte levels, and behavior. Exemplary corticosteroids include betamethasone, budesonide, cortisone, dexamethasone, hydrocortisone, methylprednisolone, prednisolone, prednisone, or deflazacort. It is contemplated that a subject treated with a disclosed method or composition may have had an inadequate response to a previous administration of a corticosteroid.

In some embodiments, a pharmaceutical composition or unit may include, or be administered in combination with, an aminosalicylate. Exemplary aminosalicylate include 4-Aminosalicylic acid, Balsalazide, Olsalazine, Sulfasalazine, and Mesalazine (5-Aminosalicylic acid). It is contemplated that a subject treated with a disclosed method or composition may have had an inadequate response to a previous administration of mesalamine, for example, a previous administration of ≥2.4 g/day mesalamine orally for at least 8 weeks.

In some embodiments, a pharmaceutical composition or unit may include, or be administered in combination with, a Tumor Necrosis Factor (TNF) antagonist. Exemplary TNF antagonists include infliximab (Remicade), adalimumab (Humira), certolizumab pegol (Cimzia), golimumab (Simponi), etanercept (Enbrel), thalidomide (Immunoprin), lenalidomide (Revlimid), pomalidomide (Pomalyst, Imnovid), xanthine derivatives (e.g., pentoxifylline), and bupropion. It is contemplated that a subject treated with a disclosed method or composition may have had an inadequate response to a previous administration of a TNF antagonist.

In some embodiments, a pharmaceutical composition or unit may include, or be administered in combination with, an integrin $\alpha_4\beta_7$ antagonist, e.g., vedolizumab. It is contemplated that a subject treated with a disclosed method or composition may have had an inadequate response to a previous administration of an integrin $\alpha_4\beta_7$ antagonist.

In some embodiments, a pharmaceutical composition or unit may include, or be administered in combination with, an anti-bacterial agent, e.g., an antibiotic. A disclosed method may comprise pretreatment with an antibiotic, e.g., administration of an antibiotic to a subject prior to administration of a disclosed pharmaceutical composition or unit. Exemplary antibiotics for use in combination therapy include vancomycin, metronidazole, gentamicin, colistin, fidaxomicin, telavancin, oritavancin, dalbavancin, daptomycin, cephalexin, cefuroxime, cefadroxil, cefazolin, cephalothin, cefaclor, cefamandole, cefoxitin, cefprozil, ceftobiprole, cipro, Levaquin, floxin, tequin, avelox, norflox, tetracycline, minocycline, oxytetracycline, doxycycline, amoxicillin, ampicillin, penicillin V, dicloxacillin, carbenicillin, methicillin, ertapenem, doripenem, imipenem/cilastatin, meropenem, amikacin, kanamycin, neomycin, netilmicin, tobramycin, paromomycin, cefixime, cefdinir, cefditoren, cefoperazone, cefotaxime, ceftazidime, ceftibuten, ceftizoxime, ceftriaxone, cefoxotin, and/or streptomycin.

In some embodiments, a pharmaceutical composition or unit may include, or be administered in combination with, an anti-fungal or anti-viral agent. Exemplary anti-viral agents include abacavir, acyclovir, adefovir, amprenavir, atazanavir, cidofovir, darunavir, delavirdine, didanosine, docosanol, efavirenz, elvitegravir, emtricitabine, enfuvirtide, etravirine, famciclovir, foscarnet, fomivirsen, ganciclovir, indinavir, idoxuridine, lamivudine, lopinavir, maraviroc, MK-2048, nelfinavir, nevirapine, penciclovir, raltegravir, rilpivirine, ritonavir, saquinavir, stavudine, tenofovir trifluridine, valaciclovir, valganciclovir, vidarabine, ibacitabine, amantadine, oseltamivir, rimantidine, tipranavir, zalcitabine, zanamivir and zidovudine. Exemplary anti-fungal agents include natamycin, rimocidin, filipin, nystatin, amphotericin B, candicin, and hamycin, miconazole, ketoconazole, clotrimazole, econazole, omoconazole, bifonazole, butoconazole, fenticonazole, isoconazole, oxiconazole, sertaconazole, sulconazole, tioconazole, fluconazole, itraconazole, isavuconazole, ravuconazole, posaconazole, voriconazole, terconazole, and albaconazole, abafungin, terbinafine, naftifine, butenafine, anidulafungin, caspofungin, micafungin, polygodial, benzoic acid, ciclopirox, tolnaftate, undecylenic acid, flucytosine or 5-fluorocytosine, griseofulvin, and haloprogin.

In some embodiments, a pharmaceutical composition or unit may include, or be administered in combination with, an additional bacterial strain. Exemplary bacterial strains include *Christensenella* sp. P152-H6d strains and strains of a *Christensenella* species that is not *Christensenella* sp. P152-H6d (e.g., *C. minuta, C. massiliensis*, and *C. timonensis*). Additional exemplary bacterial strains include strains of the genus *Anaerostipes*, for example, *Anaerostipes caccae* strains. An exemplary strain of *Anaerostipes caccae* is the strain *Anaerostipes caccae* P127-A10a, deposited under accession number DSM 33531. Additional useful strains include *Anaerostipes caccae* strain DSM 14662, *Anaerostipes caccae* strain 3_2_56FAA, and *Anaerostipes caccae* isolate MGYG-HGUT-00080.

Throughout the description, where compositions are described as having, including, or comprising specific components, or where processes and methods are described as having, including, or comprising specific steps, it is contemplated that, additionally, there are compositions of the present disclosure that consist essentially of, or consist of, the recited components, and that there are processes and methods according to the present disclosure that consist essentially of, or consist of, the recited processing steps.

In the application, where an element or component is said to be included in and/or selected from a list of recited elements or components, it should be understood that the element or component can be any one of the recited elements or components, or the element or component can be selected from a group consisting of two or more of the recited elements or components.

Further, it should be understood that elements and/or features of a composition or a method described herein can be combined in a variety of ways without departing from the spirit and scope of the present disclosure, whether explicit or implicit herein. For example, where reference is made to a particular compound, that compound can be used in various embodiments of compositions of the present disclosure and/or in methods of the present disclosure, unless otherwise understood from the context. In other words, within this application, embodiments have been described and depicted in a way that enables a clear and concise application to be written and drawn, but it is intended and will be appreciated that embodiments may be variously combined or separated without parting from the present teachings and disclosure. For example, it will be appreciated that all features described and depicted herein can be applicable to all aspects of the disclosure described and depicted herein.

It should be understood that the expression "at least one of" includes individually each of the recited objects after the expression and the various combinations of two or more of the recited objects unless otherwise understood from the context and use. The expression "and/or" in connection with three or more recited objects should be understood to have the same meaning unless otherwise understood from the context.

The use of the term "include," "includes," "including," "have," "has," "having," "contain," "contains," or "containing," including grammatical equivalents thereof, should be understood generally as open-ended and non-limiting, for example, not excluding additional unrecited elements or steps, unless otherwise specifically stated or understood from the context.

Where the use of the term "about" is before a quantitative value, the present disclosure also includes the specific quantitative value itself, unless specifically stated otherwise. As used herein, the term "about" refers to a ±10% variation from the nominal value unless otherwise indicated or inferred.

It should be understood that the order of steps or order for performing certain actions is immaterial so long as the present disclosure remains operable. Moreover, two or more steps or actions may be conducted simultaneously.

The use of any and all examples, or exemplary language herein, for example, "such as" or "including," is intended merely to illustrate better the present disclosure and does not pose a limitation on the scope of the disclosure unless claimed. No language in the specification should be construed as indicating any non-claimed element as essential to the practice of the present disclosure.

EXAMPLES

The following Examples are merely illustrative and are not intended to limit the scope or content of the disclosure in any way.

Example 1

Isolation and Purification of *Christensenella* sp. P152-H6d 1.1 Source. Isolate P152-H6d was isolated from the stool sample of a healthy human donor. The donor underwent comprehensive clinical and laboratory testing to confirm healthy status including screening for infectious agents to minimize risk of transmissible infection. Serology screening included HIV-1/HIV-2 (IgG and EIA), HTLV-I and HTLV-II (Ab), Hepatitis A virus (IgM), Hepatitis B virus (HBSAg, anti-HBc IgG and IgM), Hepatitis C virus (anti-HCV IgG), Treponema pallidum (EIA, or RPR if EIA is positive), Strongyloides stercoralis Ab, CMV Viral Load, and EBV Viral Load. Stool screening included *Clostridium difficile* toxin AB (PCR), routine bacterial culture for enteric pathogens (with enrichment) including *H. pylori* EIA, *Salmonella, Shigella, Yersinia, Campylobacter,* and *Vibrio, E. coli* O157 (perform *E. coli* O157 culture, if stx1/2 EIA+ve), Shiga-like toxins stx1/2 (Shigella) EIA, Culture-based assays for vancomycin-resistant *Enterococcus* (VRE), extended spectrum beta-lactamase (ESBL) producers, carbapenem-resistant *Enterobacteriaceae* (CRE), and methicillin-resistant *Staphylococcus aureus* (MRSA), *Giardia* antigen (EIA), *Cryptosporidium* antigen (EIA), *Cyclospora, Isospora,* and *Microsporidia* (Microscopic observation with acid fast stain), Ova and Parasites (Microscopic observation), Rotavirus (EIA), Norovirus GI/GII (RT-PCR), and Adenovirus 40, 41 EIA.

1.2 Isolation and Purification. Dilutions of donor samples were plated on isolation media. Colonies were picked from isolation media agar plates (YCFAC, BHI supplemented with Vitamin K and Hemin, TSA supplemented with 5% sheep blood, BUA OxyPras) into a 96-well microtiter plate containing 200 µl of BHI+Hemin+Vitamin K. Once growth was observed visually in the 96-well microtiter plate, 20 µl of culture from each well of the 96-well microtiter plate was transferred into a 96-well Deep-Well plate containing 1 ml BHI+Hemin+Vitamin K, followed by incubation at 37° C. After visually detecting growth, 1 ml of 50% glycerol was added to each well, and 600 µl of the mix was transferred into a Thermo Fisher Matrix tube plate. Individual cultures were subsequently plated on isolation media for conformation of colony morphology uniformity. Colonies were observed after 2 weeks incubation at 37° C., appearing clear and approximately 0.1 mm in diameter. Individual colonies were picked for identification by 16S sequencing and replated on a BUA OxyPras plate. After colonies were visible and monomorphology was observed, a single colony was inoculated into 6 ml of YCFAC media. Once the liquid culture became turbid, a matrix plate was prepared by adding 6 ml 50% glycerol to the liquid culture and aliquoting 120 µl per matrix tube. Purity was confirmed by plating from one of the prepared matrix vials onto a BUA OxyPras plate and testing of single colonies by 16S sequencing.

Example 2

Taxonomic Characterization of Isolate P152-H6d 2.1 16S Sequencing and Phylogenetic Analysis.

A taxonomic characterization of purified isolate P152-H6d was performed using full length 16S rRNA gene sequencing data. Homology searches were performed against existing publicly available strains present in the National Center for Biotechnology Information (NCBI) taxonomy database and the SILVA ribosomal RNA database (Max Planck Institute for Marine Microbiology and Jacobs University, Bremen, Germany).

2.1.1 16S rRNA gene sequencing. 50 µl of a liquid culture of isolate P152-H6d was denatured at 95° C. for 10 minutes. The denatured sample was utilized as a template to PCR amplify the 16S gene by using 16S rRNA primers 27F (SEQ ID NO: 29) and 1492R (SEQ ID NO: 30). Sanger sequencing was performed (Elim Biopharm, Hayward, CA) using a set of 4 primers (27F, 1492R, 515F (SEQ ID NO: 31) and 907R (SEQ ID NO: 32)) to recover a near full length 16S rRNA gene fragment (SEQ ID NO: 1). The four amplicons were assembled into a single contiguous sequence using DNAbaser (Heracle BioSoft S.R.L., Arges, Romania) which was then searched against the NCBI database using BLASTn.

2.1.2 Phylogenetic analysis. Database matches spanning the entire P152-H6d contig were selected, and a distant relative of the isolate was selected to serve as an outgroup on the phylogenetic tree. The P152-H6d contig and its close relatives from the NCBI 16S database including the outgroup were next searched against the ARB SILVA database using Alignment (SINA v1.2.11), Classification and Tree service. For search and classification, sequences bearing a minimum of 92 percent identity (15 total sequences) were utilized to classify P152-H6d. RaxML (Randomized Axelerated Maximum Likelihood) was used for performing the maximum likelihood search for building the phylogenetic tree (General Time Reversible (GTR+gamma) model with gamma as rate model for likelihoods).

The BLASTn search against the 16S rRNA gene database on NCBI yielded a closest match of 97.85% over 100% of the sequence length of 1442 bps (SEQ ID NO: 1). This match was from the species *Christensenella timonensis*, with the next closest match over the entire length of 96.6% identity from *Christensenella massiliensis* (FIG. 1 and Table 1). *Brassicibacter thermophilus* (96% identity) was used as the outgroup for rooting the phylogenetic tree.

TABLE 1

BLASTn Search Results Summary

| Database match | Isolate 16S sequence coverage | 16S Percent Identity to C. sp. P152-H6d |
|---|---|---|
| *Christensenella timonensis* Marseille-P2437 | 100% | 97.85% |
| *Christensenella minuta* strain YIT 12065 | 99% | 97.84% |
| *Christensenella minuta* strain DSM 22607 | 100% | 97.78% |
| *Christensenella massiliensis* Marseille-P2438 | 100% | 96.6% |
| *Brassicibacter thermophilus* strain Ce12f | 96% | 87.13% |

The three selected sequences from NCBI database along with the P152-H6d 16S contig were searched against the ARB SILVA database. The closest match was found to be of 97.98% identity from the species *Christensenella timonensis*. The reference 16S rRNA gene length was 1515 bp (ARB ID: FLKP01000001). The identity dropped to 94.72% over the SEED alignment.

The Maximum Likelihood (ML) tree built using the closest neighbors of the P152-H6d isolate is shown in FIG. 1, which indicates that *Christensenella* is a monophyletic genus with clear taxonomic delineation between member species, and each individual *Christensenella* species clearly clusters on single clades. Based on this 16S rRNA gene fragment analysis, P152-H6d isolate is a member of the *Christensenella* genus. Since 97.89% identity over the entire/partial length of 16s rRNA gene is insufficient to establish species identity (>98.5%), P152-H6d is a member of a new *Christensenella* species, with its next closest known relative being *C. timonensis*.

2.2 Whole Genome Sequencing and Phylogenomic Analysis.

2.2.1 Sequencing. DNA extraction, sequencing, quality filtering, assembly and annotation was performed by Corebiome, Inc. (Minneapolis, MN). DNA was extracted from isolate P152-H6d with MO Bio PowerFecal (Qiagen) automated for high throughput on QiaCube (Qiagen), with bead beating in 0.1 mm glass bead plates. Samples were quantified with Qiant-iT Picogreen dsDNA Assay (Invitrogen). Libraries were prepared with a proprietary procedure adapted for the Nextera Library Prep kit (Illumina) and sequenced on an Illumina NextSeq using single-end 1×150 reads with a NextSeq 500/550 High Output v2 kit (Illumina). DNA sequences were filtered for low quality (Q-Score<20) and length (<50), and adapter sequences were trimmed using cutadapt v.1.15 (Martin, EMBnet Journal, [Si], v. 17, n. 1, p. pp. 10-12, (2011)).

2.2.2 Assembly and Annotation. Sequences were assembled using SPAdes v3.11.0 (Bankevich et al., *J Comput Biol.* 19(5):455-477 (2012)). Protein annotation was performed with Prokka v 1.12 (Seemann, *Bioinformatics* 30(14):2068-2069 (2014)) on contigs over 1,000 bases in length.

2.2.3 Quality Assessment. Sequencing quality was determined by inspecting quality scores generated by FASTQC, with bases of low quality indicated by scores less than 20. Assembly quality metrics were generated by QUAST v.4.5 (Gurevich et al., *Bioinformatics* 29(8):1072-1075 (2013)).

2.2.4 Taxonomy. Taxonomic identities were made using appropriate score cut-offs on average nucleotide identity and alignment fraction scores. These scores were calculated using Joint Genome Institute's Microbial Species Identifier (Varghese et al., *Nucleic Acids Research* 43(14):6761-6771 (2015)) and an internal reference genome database.

2.2.5 Genome Characteristics. Intrinsic properties of the isolate P152-H6d genome assembly were compared with that of the closest *Christensenella* reference, *Chistensenella timonensis* (accession no NZ_FLKP00000000) and summarized in Table 2 below.

TABLE 2

Characteristics of closest *Christensenella* reference, P152-H6d PI assemblies

| Strain | Reference *Christensenella timonensis* Marseille-P2437 | P152-H6d PI *Christensenella* |
|---|---|---|
| Accession | NZ_FLKP00000000 | |
| Genome Size (Mb) | 2.65 | 2.82 |
| Contigs | 2 | 27 |
| G + C Content | 51.7 | 48.91 |
| # CDS | 2504 | 2671 |
| # tRNA | 51 | 42 |

PI = primary isolate;
Mb = megabase pairs;
CDS = coding sequence,
tRNA = transfer ribonucleic acid 2.2.6 Genome wide similarity across P152-H6d and other members of *Christensenella*. The PI genome was compared against each member species of *Christensenella* genus to measure the extent of genomic similarity, in particular, average nucleotide identity (ANI) and alignment fraction (AF). The results are summarized in Table 3 below.

TABLE 3

Average Nucleotide Identity (ANI) and Alignment Fraction (AF) of P152-H6d compared to other *Christensenella* species

| Isolate ID | Reference Species | ANI S → R | AF S → R | # Ref. strain |
|---|---|---|---|---|
| P152-H6d | *Christensenella timonensis* | 80.02 | 0.64 | 1 |
| P152-H6d | *Christensenella massiliensis* | 74.0 | 0.39 | 1 |
| P152-H6d | *Christensenella* sp. AF73-05CM02 | 74.24 | 0.43 | 1 |
| P152-H6d | *Christensenella minuta* | 74.40 | 0.44 | 3 |

2.2.7 Phylogenomic Analysis.

Figure 2:
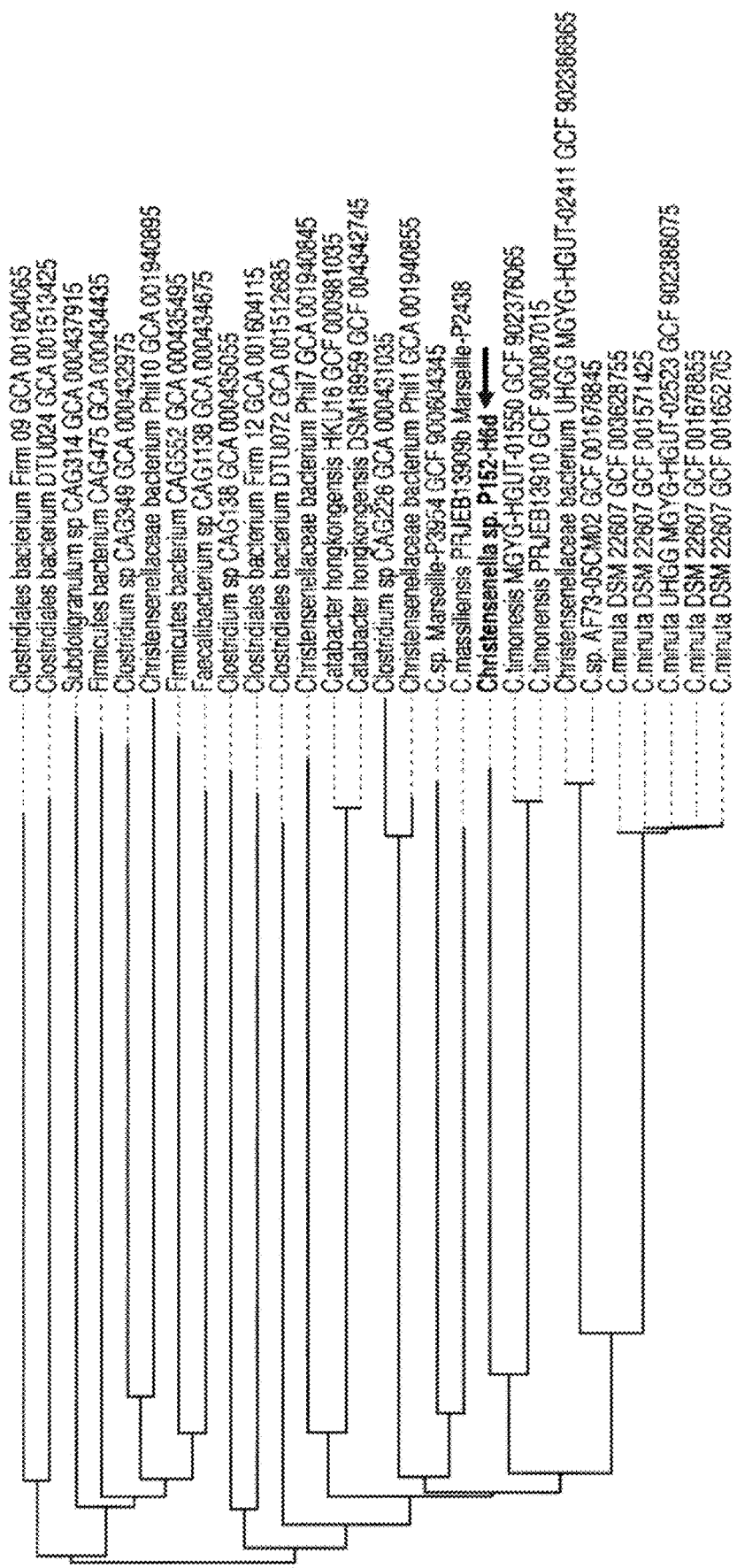
FIG. 2 depicts an ANI-based phylogenomic tree featuring *Christensenella* sp. P152-H6d, other *Christensenella* species, and other genera. FastANI was used to calculate pairwise ANI values among the genomes of the depicted strains. Pairwise ANI values were used to generate a distance matrix in phylip format. Phylogenetic relationships among these genomes were inferred using a neighbor-joining approach using the R package BionNJ. Branch lengths are proportional to ANI distances.

Pairwise ANI values between P152-H6d and all *Christensenella* genomes on Refseq/NCBI, all NCBI genomes with ANI>74.18 (ANI value between P152-H6d and most dissimilar *Christensenella* genome, *Christensenella* sp. Marseille-P3954), and all genomes in the Web of Life branch containing *Christensenella* (available on the world wide web at biocore.github.io/wol/) were calculated using FastANI (Jain et al., *Nat Commun.* 9(1):5114 (2018)) and used to generate a distance matrix in phylip format. Phylogenetic relationships among these genomes were inferred using a neighbor-joining approach using the R package BionNJ and shown in FIG. 2. Branch lengths are proportional to ANI distances. These results corroborate the 16S rRNA-based phylogenetic analysis indicating that the P152-H6d isolate represents a new *Christensenella* species.

Example 3

Phenotypic Characterization of Isolate P152-H6d

A summary of the physiological and metabolic characteristics of P152-H6d is provided in Table 4 below.

TABLE 4

Phenotypic Characteristics of P152-H6d

| Oxygen tolerance | Carbon sources utilized[1] | Nitrogen sources utilized[2] | pH range (optimal) |
|---|---|---|---|
| obligate anaerobe | 4 | 3 | 5-8 (7) |

[1]190 unique carbon sources were tested
[2]95 unique nitrogen sources were tested P152-H6d cells are non-motile and obligate anaerobes; oxidase negative; and catalase positive. Catalase activity is notable in the context of inflammatory bowel disease, as reactive oxygen species (ROS) such as hydrogen peroxide ($H_2O_2$) contribute to epithelial damage and ion transport dysfunction (key events in inflammatory diarrhoea) in IBD. However, catalase partially prevents, and rescues, the loss of ion transport properties in DSS colitis even in the setting of unresolved tissue inflammation. See Barrett and McCole, *Clin Exp Pharmacol Physiol.* 43(11):1097-1106 (November 2016).

P152-H6d was evaluated for its ability to utilize 190 different carbon sources and 95 nitrogen sources, as well as its ability to grow in a wide range of pH using Phenotypic Microarrays (Biolog, Hayward, CA). As shown in Table 4, P152-H6d can utilize 4 carbon sources and 3 nitrogen sources. The carbon sources include glucose, arabinose, ribose, and α-cyclodextrin. P152-H6d was able to utilize cysteine as a nitrogen source, and showed weak growth in the presence of adenine and parabanic acid as nitrogen sources. P152-H6d was able to grow in pH ranging from 5 to 8, though optimal growth was observed at pH 7.

Figure 3:
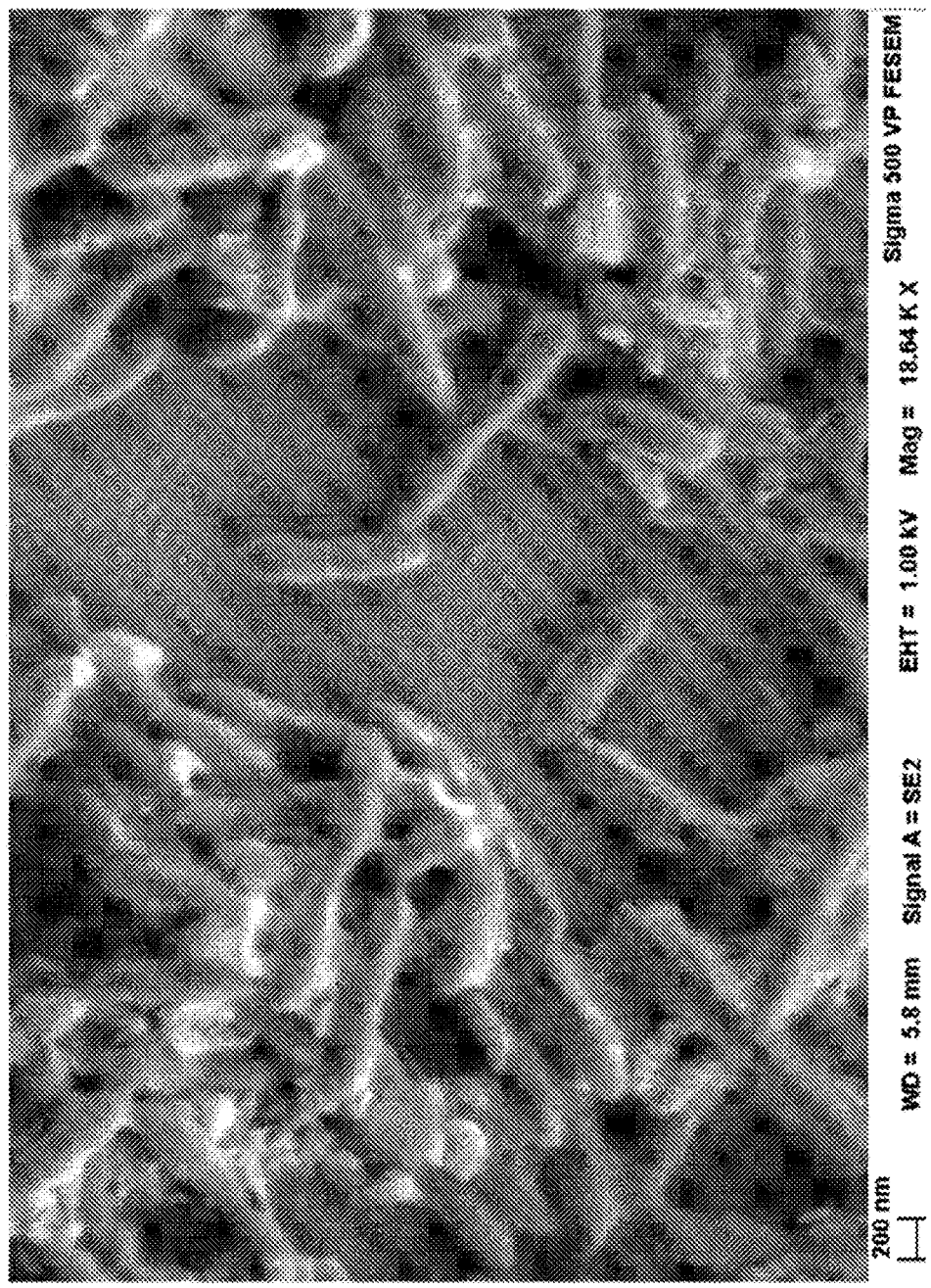
FIG. 3 depicts a scanning electron micrograph of *Christensenella* sp. P152-H6d bacterial cells (18.64 kx magnification).

P152-H6d cells were prepared for imaging by electron microscopy. Cells were washed two times in PBS and fixed in 4% paraformaldehyde at room temperature for 30 minutes. Fixed cells were washed two times in PBS, then resuspended in sterile water. Twenty-five microliter of sample was applied to an ITO Coated Cover Slip, 22×22 mm Thickness #1, 30-60 Ohms Resistivity (SPI Supplies, Cat. No. 06471-AB1) and allowed to air dry. Cells were visualized using a Sigma 500 VP FESEM electron microscope. A representative micrograph of P152-H6d is provided in FIG. 3. Cells appear as straight short rods.

P152-H6d was also assessed for its ability to form spores. Using two distinct sporulation-inducing methods (i.e., heat-shock and chemical-shock), P152-H6d was found to be non-sporulating (Table 5). *Clostridium butyricum* (ATCC 19398) was used as a positive control.

TABLE 5

Assessment of sporulation.

| Strain | Sporulation with heat-shock method (%) | Sporulation with ethanol-shock method (%) |
|---|---|---|
| *C. butyricum* ATCC 19398 | 31.75 | 24.29 |
| P152-H6d | 0.0 | 0.0 |

Figure 4:
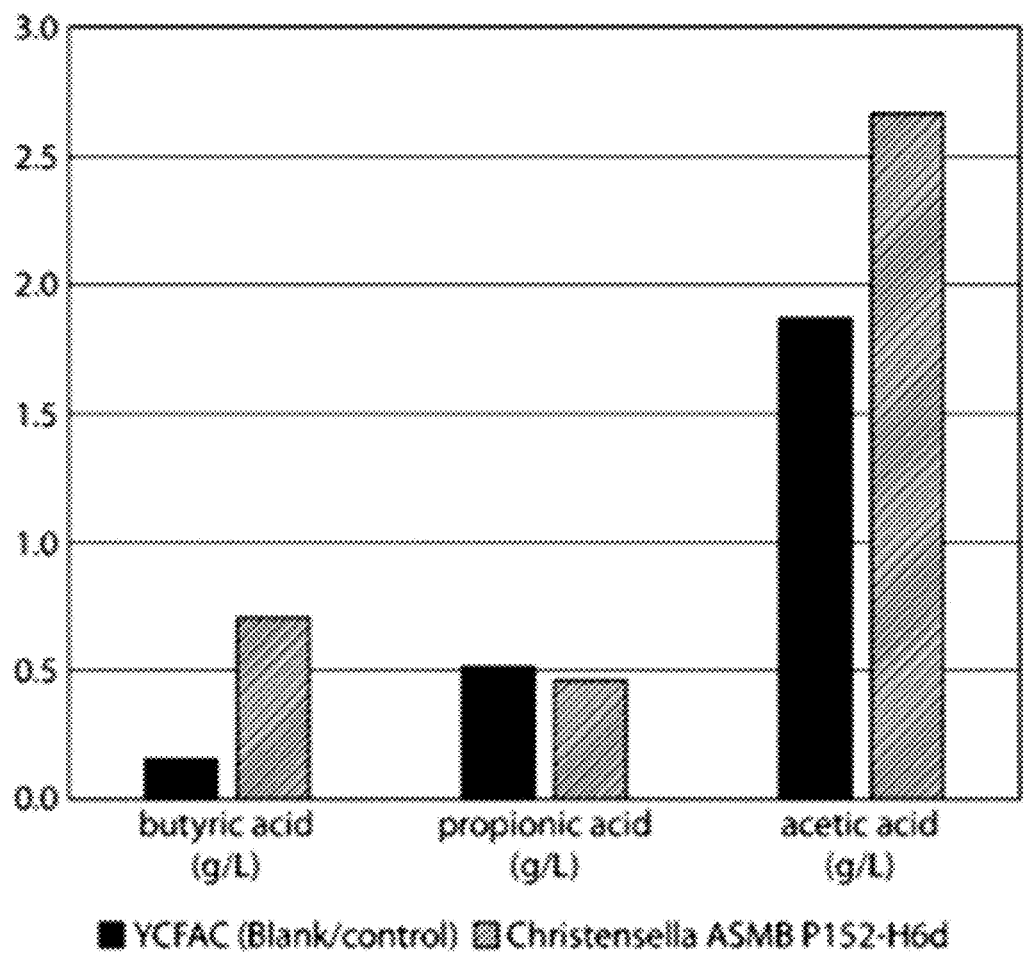
FIG. 4 depicts the short-chain fatty acid (SCFA) production profile of *Christensenella* sp. P152-H6d (*Christensenella* ASMB P152-H6d) cultured for 72 hours. Levels of butyric acid, propionic acid and acetic acid in batch culture supernatants were analyzed by HPLC (ABPDU Berkeley CA). Non-inoculated YCFAC media was used as a negative control.

P152-H6d was also assessed for its production of short-chain fatty acids (SCFAs). SCFAs produced by human gut microbes include butyrate, acetate and propionate, all three of which are found to contribute to the maintenance of intestinal homeostasis through multiple mechanisms (Lee and Hase, *Nat Chem Biol* 10(6):416-424 (2014); Hoeppli et al., *Front Immunol* 6:61 (2015); Koh et al., *Cell* 165(6): 1332-1345 (2016)). The SCFA production profile of P152 H6d was evaluated after 72 hours of growth in batch culture in YCFAC media. Non-inoculated YCFAC media was used as a negative control. As seen in FIG. 4, P152-H6d produces both butyric acid and acetic acid.

Example 4

In Vitro Functional Activity of P152-H6d

This example describes studies of the activity of P152-H6d in an in vitro human macrophage, monocyte and dendritic cell models.

4.1 Preparation of Freshly Cultured P152-H6d for Cell Culture Assays. Freshly cultured bacteria from overnight cultures of P152-H6d were prepared in anaerobic conditions. Bacteria were centrifuged at 4300×g for four minutes. Bacteria were washed once with pre-reduced anaerobic PBS (Gibco). Working stock solutions were prepared by resuspending washed bacteria with anaerobic PBS to the total surface area of $\sim 1 \times 10^{\wedge}10$ μm$^2$. Total surface area=particle numbers multiply by average surface area (μm$^2$) measured by a particle counter (Beckman Coulter Counter). 10-fold serial dilutions were made using anaerobic PBS for specific assays.

4.2 Human Macrophage and Monocyte In vitro Cytokine and Chemokine Assay. The THP-1 human monocyte cell line (ATCC cat #TIB-202) was cultured in 37° C. and 5% $CO_2$ using RPMI 1640 containing 2.05 mM L-glutamine (Corning) supplemented with 10% heat-inactivated FBS (Corning), 100 I.U./mL Penicillin, 100 μg/mL Streptomycin and 0.292 mg/mL L-glutamine (Corning). Passage number was restricted to 8 passages. The THP-1 human monocyte cell line was grown until 70-80% confluent. Cells were counted and resuspended in culture media. 100,000 cells were plated per well onto 96 well plates. THP-1 human macrophages were made by culturing the THP-1 human monocyte cells with 10 ng/mL phorbol 12-myristate 13-acetate (PMA) (InvivoGen) for 24 hours followed by 20 ng/mL IL-4 (R&D Systems) and 20 ng/mL IL-13 (R&D Systems) for 48 hours in 37° C. and 5% $CO_2$ (Genn et al., *BMC Cancer* 15:577 (2015)). One day before the experiment, cells were washed and resuspended in RPMI culture media without antibiotics containing 20 ng/mL IL-4 and 20 ng/mL IL-13.

A working stock solution was prepared for each of freshly cultured P152-H6d bacteria, anaerobic PBS, 500 ng/ml LPS and a positive control bacterial strain (known to induce pro-inflammatory cytokines), and each were added onto THP-1 macrophages at 10% v/v and centrifuged down onto the THP-1 cells at 515×g for four minutes. The test articles or control and THP-1 macrophages were co-incubated for 3 hours in 37° C. and 5% $CO_2$. The coculture media was replaced by fresh RPMI culture media supplemented with antibiotics to limit excess bacteria growth. THP-1 cells were incubated after culture media replacement for 15 hours in 37° C. and 5% $CO_2$. THP-1 cell supernatants were collected and analyzed by ELISA. The levels of CCL-18, IL12-p40, and TNFα in culture supernatants were quantified by using commercial enzyme-linked immunosorbent assay (ELISA) kits from Biolegend or R&D Systems with TMB detection according to manufacturer's specifications.

Figure 5:
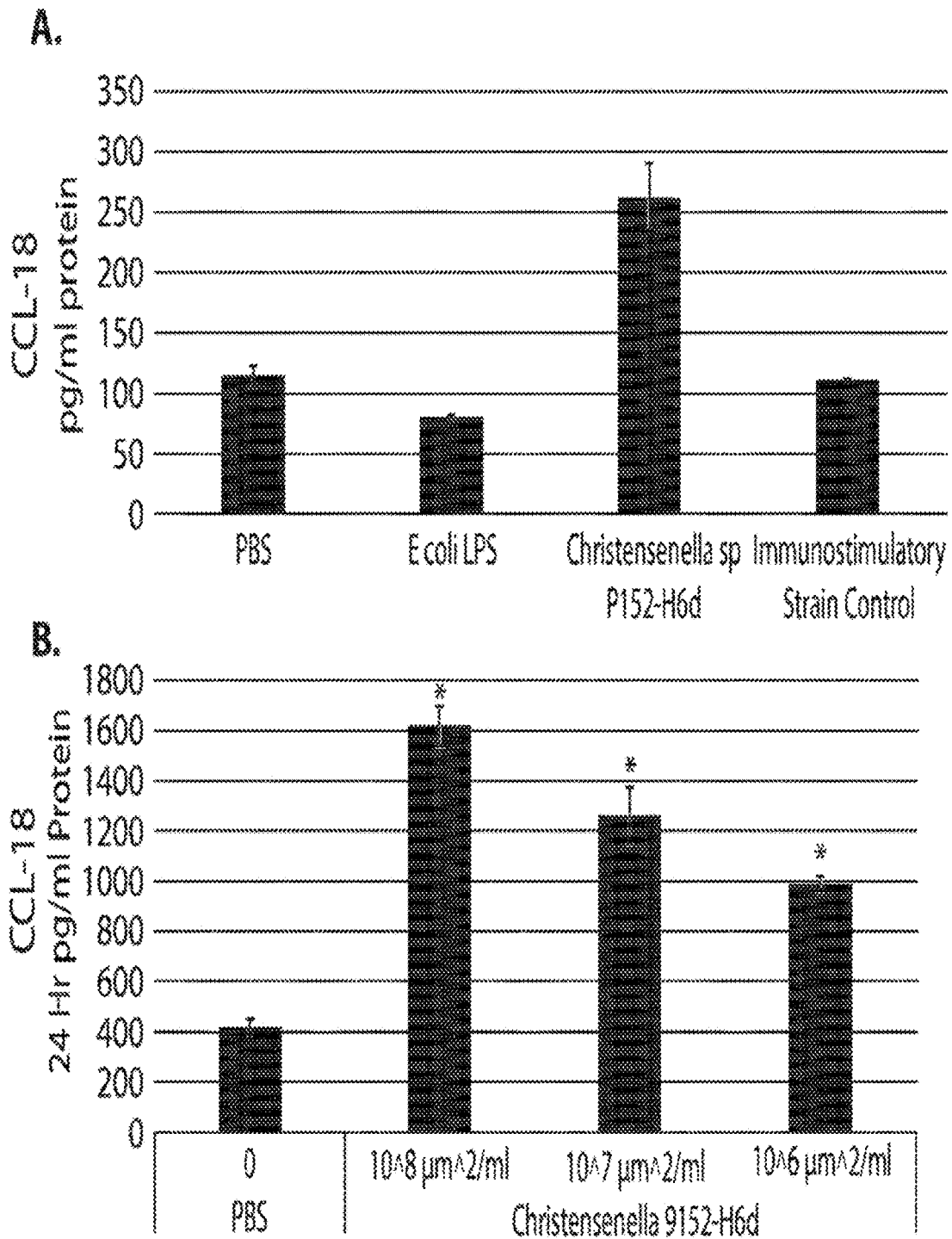
FIG. 5 depicts the effect of *Christensenella* sp. P152-H6d on CCL-18 production in human THP-1 macrophages. (A) THP-1 macrophages were co-cultured with PBS only, PBS plus *E. coli* LPS, *Christensenella* sp. P152-H6d, and an immunomodulatory bacterial strain control (known to induce pro-inflammatory cytokines), respectively, and supernatants were collected and assayed for production of CCL-18. Each test article was evaluated in 4 replicates and results are representative of at least two independent experiments. p value≤0.05 (one-way ANOVA). (B) CCL-18 production in THP-1 macrophages increases in a *Christensenella* sp. P152-H6d-dose-dependent manner. *p value≤0.05 (individual student t test).
Figure 6:
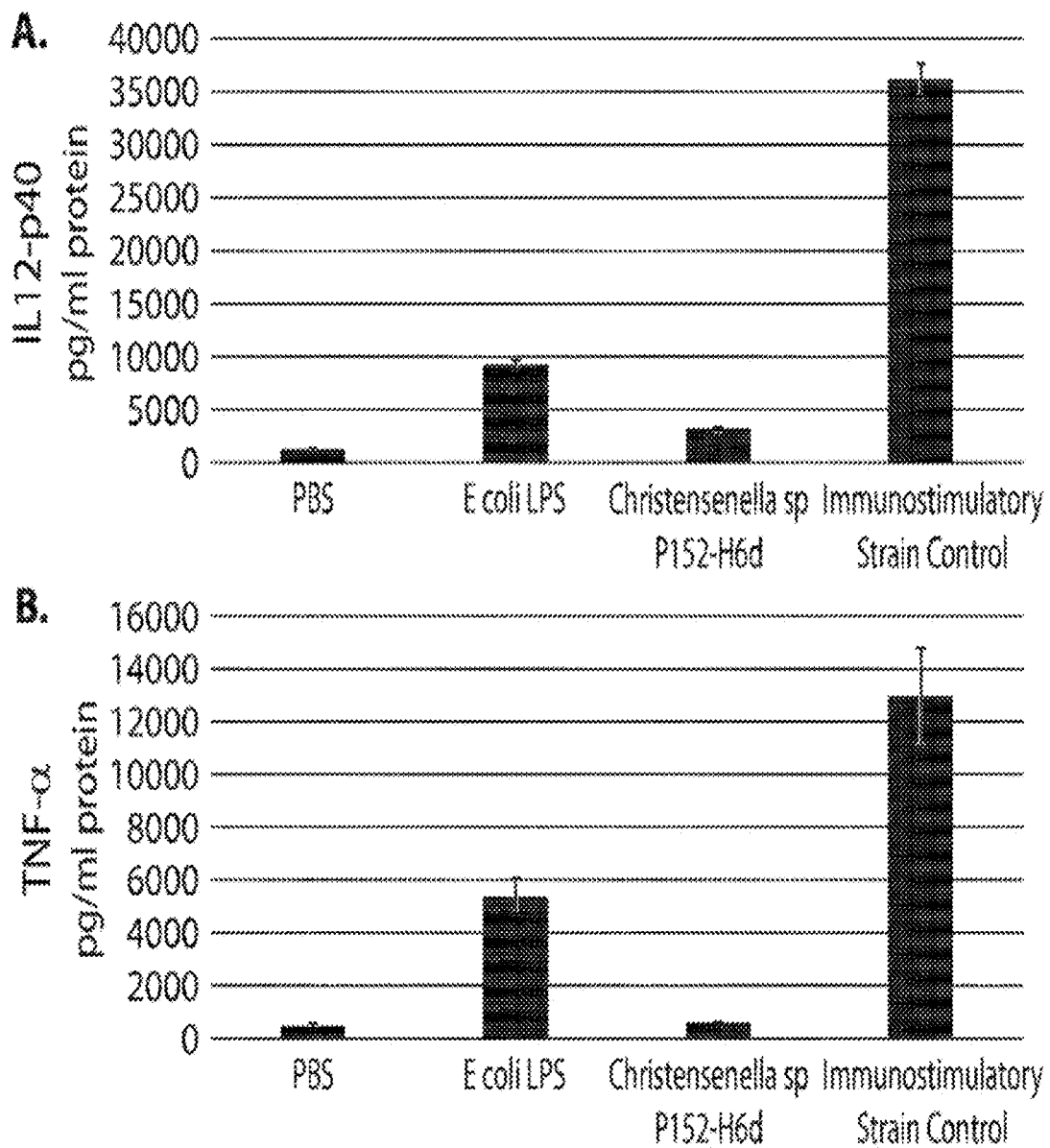
FIG. 6 depicts the effect of *Christensenella* sp. P152-H6d on (A) IL12-p40; and (B) TNF-α production in human THP-1 macrophages. THP-1 macrophages were co-cultured with PBS only, PBS plus *E. coli* LPS, *Christensenella* sp. P152-H6d, and an immunomodulatory bacterial strain control (known to induce pro-inflammatory cytokines), respectively, and supernatants were collected and assayed for production of IL12-p40 and TNF-α. Each test article was evaluated in 4 replicates and results are representative of at least two independent experiments. p value≤0.05 (one-way ANOVA).

E. coli LPS, P152-H6d and the control strain were each evaluated for the ability to induce CCL-18, an M2-macrophage-associated chemokine, in THP-1 macrophages. Induction and polarization of M2 macrophages has previously been reported to be a critical mechanism of protection against inflammatory bowel disease and colonic inflammation (Seo et al., Sci. Rep 7(1):851 (2017); Steinbach et al., Inflamm Bowel Dis. 20(1):166-175 (2014)). CCL-18 is a validated marker for M2 macrophages (Genin et al., BMC Cancer 15:577 (2015)). FIG. 5A shows a significant increase in the production of CCL-18 when P152-H6d was co-cultured with THP-1 macrophages compared to PBS, E. coli LPS and the immunostimulatory strain controls. FIG. 5B shows a dose-dependent response in CCL-18 production to increasing amounts of P152-H6d. By contrast, co-culture of THP-1 macrophages with P152-H6d did not significantly induce pro-inflammatory cytokines IL12-p40 (FIG. 6A) and TNF-α (FIG. 6B). These data indicate that P152-H6d can increase the production of anti-inflammatory cytokine CCL-18 but not pro-inflammatory cytokines from human macrophages, which indicates the induction and polarization of anti-inflammatory M2 macrophages.

4.3 Human Monocyte-Derived Dendritic Cell (moDC) In Vitro Cytokine Assay

Cryopreserved PBMC were thawed in a 37° C. water bath, diluted in warm RPMI 1640 supplemented with 10% heat-inactivated FBS and L-glutamine, and centrifuged (515×g; four minutes). Cells were resuspended in PBS buffer containing 0.5% bovine serum albumin (BSA) and 2 mM EDTA and CD14+ monocyte cells were isolated by selection using Miltenyi CD14 Microbeads according to manufacturer's directions. Isolated CD14+ monocytes were cultured in RPMI 1640 supplemented with 10% heat-inactivated FBS, L-glutamine, penicillin/streptomycin antibiotic, 50 ng/mL recombinant human IL-4 (R&D Systems), and 100 ng/mL recombinant human GM-CSF (Biolegend). Media was replenished on days 3 and 6. On day 7 after isolation, cells were diluted to $5\times10^5$ cells/mL in RPMI 1640 containing L-glutamine (Corning) supplemented with 10% heat-inactivated FBS (Tissue Culture Biologicals) and 0.292 mg/mL L-glutamine (Corning). A 100 μL aliquot of the $5\times10^5$ cells/mL cell suspension was added to each well within a flat-well 96 well plate and cultured for 24 hours at 37° C. and 5% $CO_2$ before addition of test articles.

Bacterial test articles (P152-H6d) were prepared to a total surface area of $1\times10^{\wedge}8$ μm² and $1\times10^{\wedge}7$ μm², respectively. The test articles, vehicle (PBS) control and moDCs were co-incubated for 3 hours in 37° C. and 5% $CO_2$. The plates were then centrifuged (515×g; four minutes), media removed, and replaced with RPMI 1640 supplemented with 10% heat-inactivated FBS, L-glutamine, and penicillin/streptomycin antibiotic. Culture plates were then incubated for an additional 15 h at 37° C. and 5% $CO_2$. The plates were centrifuged (515×g; four minutes), and supernatant was collected and analyzed by a custom U-plex multiplex kit from Meso Scale Discovery according to manufacturer's instructions. Results were averaged from 4 human donors with two experimental replicates from each donor.

Figure 7:
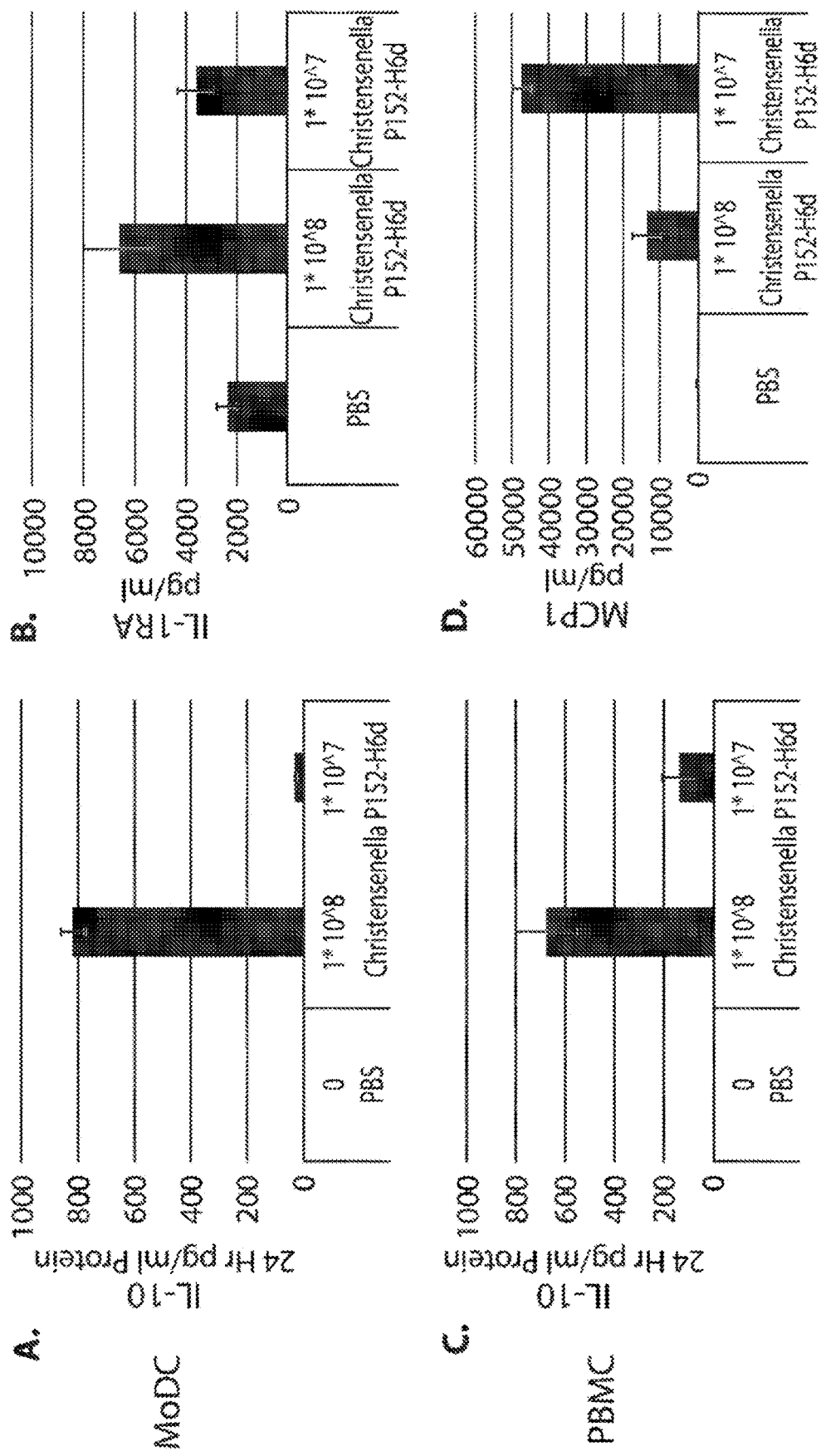
FIG. 7 depicts the effect of *Christensenella* sp. P152-H6d on (A) & (C) IL10; (B) IL-1RA; and (D) MCP1 production in (A) & (B) human monocyte-derived dendritic cells (MoDC) and (C) & (D) human peripheral blood mononuclear cells (PBMC). Human cells were co-cultured with PBS only and *Christensenella* sp. P152-H6d respectively, and supernatants were collected and assayed for cytokine production. Each test article was evaluated in 4 replicates and results are representative of at least two independent experiments.

As shown in FIG. 7, Christensenella sp. P152-H6d induced significant, dose-dependent increases in the production of: (A) IL-10 and (B) IL-1RA by human monocyte-derived dendritic cells (moDCs), in comparison to production of these anti-inflammatory cytokines induced by vehicle (PBS).

4.4 Human PBMC In Vitro Cytokine Assay

Trima residual blood product containing concentrated blood mononuclear cells was obtained from anonymous donors through Blood Centers of the Pacific (San Francisco, CA) and processed within 24 hours of collection. Blood samples were tested negative for HIV, HBV, HCV, HTLV, Syphilis, West Nile Virus and Zika Virus. PBMC were isolated using a ficoll gradient as described previously (Sim et al., J. Vis. Exp. (112), e54128 2016). Briefly, 50 mL of Trima residual was diluted with 50 mL of sterile PBS (Gibco) and 25 mL was overlaid on 15 mL Ficoll-Paque Plus (GE Healthcare) in 50 mL conical tubes. The samples were centrifuged at 450×g for 30 min at room temperature and allowed to stop without brake. The PBMC interphase was collected, washed with PBS and resuspended in RPMI 1640 containing 2.05 mM L-glutamine (Corning) supplemented with 10% heat-inactivated FBS (Tissue Culture Biologicals) and 0.292 mg/mL L-glutamine (Corning). The cells were maintained by incubation in 37° C. and 5% $CO_2$ and used for assay evaluation within 24 h or frozen for later use. Cells were cryopreserved in RPMI 1640 supplemented with 50% FBS and 10% DMSO (Sigma Aldrich) at a concentration of $5\times10^7$ cells/mL and stored in liquid nitrogen until ready for use.

Human PBMCs, used immediately after isolation or thawed from cryo-storage, were diluted to $5\times10^6$ cells/mL in RPMI 1640 containing L-glutamine (Corning) supplemented with 10% heat-inactivated FBS (Tissue Culture Biologicals) and 0.292 mg/mL L-glutamine (Corning). A 100 μL aliquot of the $5\times10^6$ cells/mL cell suspension was added to each well within a round-bottom 96 well plate and cultured for 24 hours at 37° C. and 5% $CO_2$ before addition of test articles.

Test articles were prepared and added to the PBMCs as described above for the moDC assay. After 3 hours of incubation in 37° C. with 5% $CO_2$, the plates containing cocultures were centrifuged (515×g; four minutes), media removed, and replaced with RPMI 1640 supplemented with 10% heat-inactivated FBS, L-glutamine, and penicillin/streptomycin antibiotic. Culture plates were then incubated for an additional 15 h at 37° C. and 5% $CO_2$. The plates were centrifuged (515×g; four minutes) and supernatant was collected and analyzed by a custom U-plex multiplex kit from Meso Scale Discovery according to manufacturer's instructions. Results were averaged from 4 human donors with two experimental replicates from each donor.

As shown in FIG. 7, Christensenella sp. P152-H6d induced significant increases in the production of: (C) IL-10 and (D) MCP1 by human PBMCs, in comparison to production of these anti-inflammatory cytokines induced by vehicle (PBS).

4.5 Crohn's Disease (CD) Fecal Microflora in Human THP-1 Macrophage In Vitro Cytokine Assay Christensenella sp. P152-H6d was tested for its ability to modulate production of the inflammatory cytokine IL-12p40 in THP-1 macrophages in the presence of fecal microflora derived from a human subject with Crohn's disease. Aliquots of glycerol stocks including 50% glycerol: 50% CD fecal sample were prepared. A working stock solution was prepared by thawing a glycerol stocks on the day of the experiment in anaerobic conditions, followed by washing and resuspending with pre-reduced anaerobic PBS to the optical density of OD600=0.3. This working stock solution of the CD microflora was added to THP-1 macrophages (2×CD stool or 1×CD stool, v/v), with or without freshly cultured P152-H6d working stock solution (1×P152-H6d or 0.1×P152-H6d, v/v) or anaerobic PBS control. After four hours of co-incubation in 37° C. and 5% $CO_2$, THP-1 macrophages were washed and resuspended with RPMI culture media supplemented with Pen/Strep to remove excess bacteria. THP-1 macrophages were incubated for 24 hours in 37° C. and 5% $CO_2$. THP-1 cell supernatants were collected and analyzed for IL-12p40 using ELISA.

Figure 8:
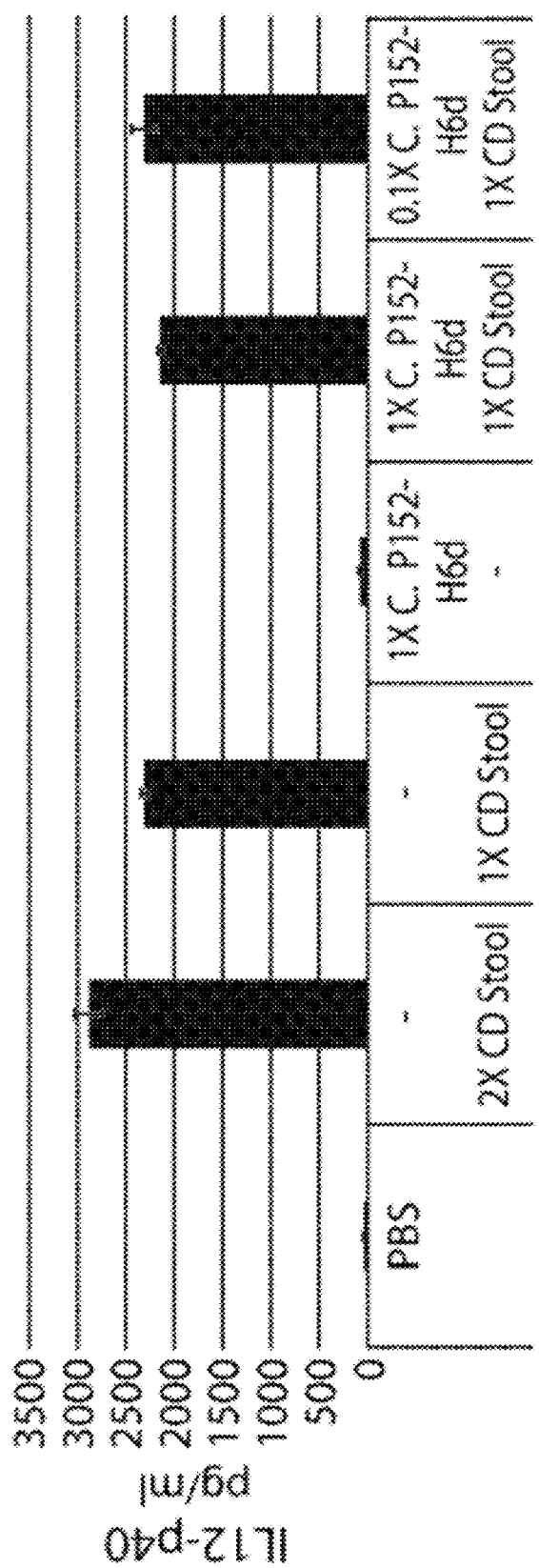
FIG. 8 depicts the effect of *Christensenella* sp. P152-H6d (C. P152-H6d) in a human THP-1 macrophage in vitro cytokine assay in the presence of Crohn's disease (CD) fecal microflora. THP-1 macrophage supernatants were collected at the end of the assay and IL-12p40 concentrations in culture supernatant were plotted for the PBS control, CD fecal microflora, *Christensenella* sp. P152-H6d alone, and CD fecal microflora added with the indicated v/v amount of *Christensenella* sp. P152-H6d. Each test article was evaluated in 4 replicates and results are representative of at least two independent experiments.

FIG. 8 shows that CD fecal microflora alone can significantly induce IL-12p40 from THP-1 macrophages, but addition of Christensenella sp. P152-H6d attenuated IL-12p40 production which was dose-dependent. This indicates that Christensenella sp. P152-H6d can reduce or attenuate the induction of IL-12p40 in human macrophages in the presence of a CD microflora.

Example 5

In Vivo Functional Activity of P152-H6d

Christensenella sp. P152-H6d was tested for efficacy in five different well-validated mouse models of inflammatory disease: (1) imiquimod (IMQ)-induced psoriasis; (2) oxazolone-induced atopic dermatitis; (3) DSS-induced colitis; (4) Citrobacter rodentium-induced colitis; and (5) TNBS-induced colitis.

5.1 Imiquimod (IMQ)-Induced Psoriasis

Psoriasis is an immune-mediated chronic inflammatory skin disorder characterized by scaly, reddened skin lesions and thickening of the affected skin as well as epidermal and/or dermal cellular and histo-pathological changes. Topical application of the Toll-like Receptor 7/8 activator imiquimod (IMQ) is known to cause psoriasis-like skin inflammation both in humans and mice. See, e.g., van der Fits L. et al. Imiquimod-induced psoriasis-like skin inflammation in mice is mediated via IL23/IL17 axis; *J Immunology,* 2009, 182:5836-5845.

In this study, BALB/c mice received daily topical application of 5% IMQ cream (47 mg/day) on the back skin (~area: 4 cm×2 cm) for 6 consecutive days. Test items were administered once daily from days −7 to termination and included live purified individual bacterial strains or vehicle (bacteria freezing media) by oral gavage once daily, approximately 1 to 2 hours after IMQ application. Animals receiving positive control were given 0.05% clobetasol cream (62.5 mg/day) applied topically approximately 1 hour after IMQ application. Skin evaluations were performed daily starting at day 2, including evaluation of back skin thickness using an Engineering micrometer.

Figure 9:
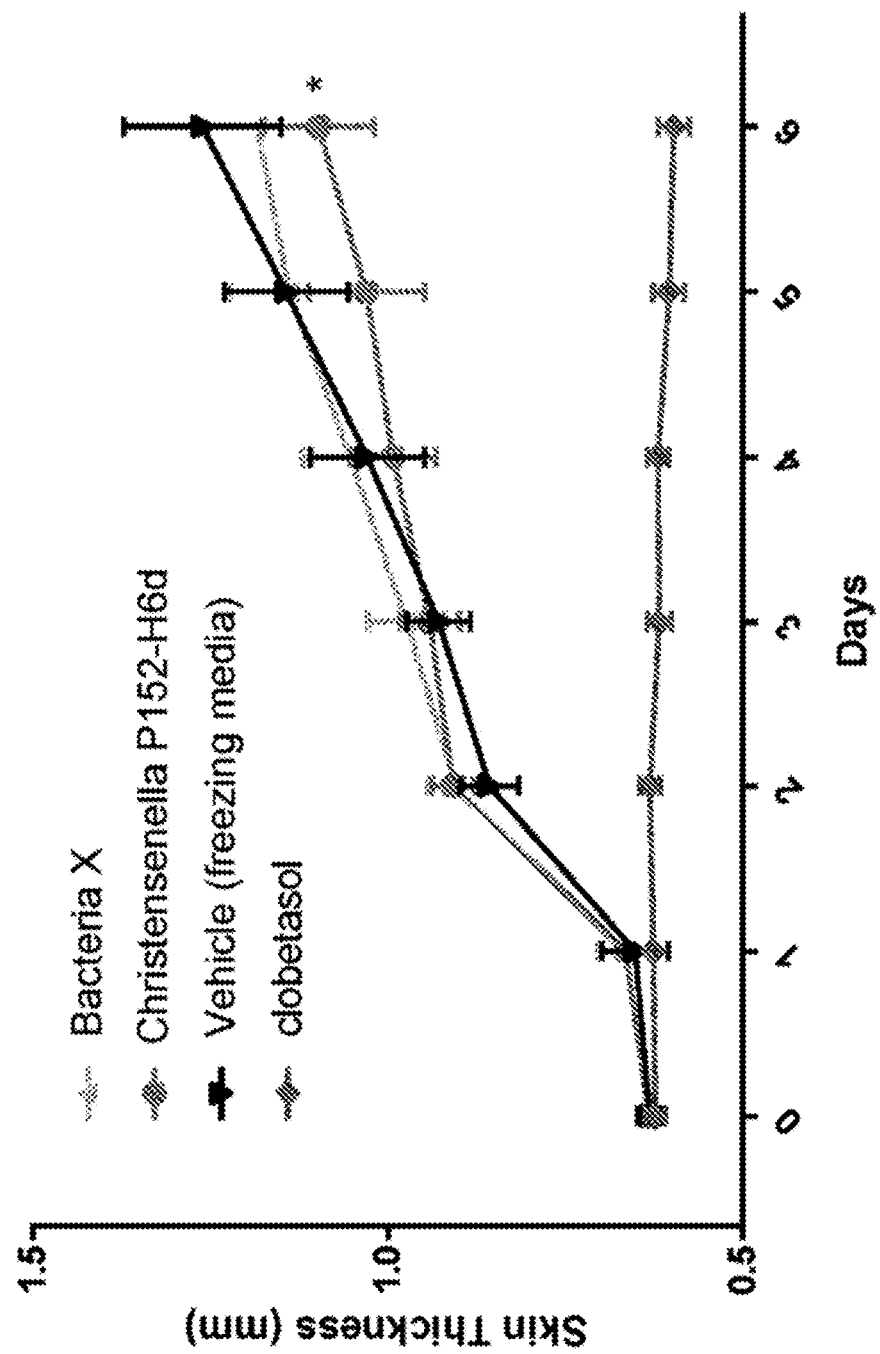
FIG. 9 depicts the effect of *Christensenella* sp. P152-H6d on back skin thickness in an imiquimod-(IMQ) induced psoriasis-like skin inflammation mouse model. *<0.05 in a Two-way ANOVA with a Dunetts post-hoc analysis.

As shown in FIG. 9, administration of Christensenella sp. P152-H6d as well as clobetasol led to a reduction in oxazolone-induced skin thickness compared to the vehicle control, whereas administration of bacterial strain X did not.

5.2 Oxazolone-Induced Atopic Dermatitis

Atopic dermatitis, also known as atopic eczema, is a type of inflammation that results in itchy, red, swollen and cracked skin which thickens over time. Induction of atopic dermatitis in mice through the topical application of oxazolone in mice has been previously reported. See e.g., Hatano et al., 2009 Maintenance of an acidic stratum corneum prevents emergence of murine atopic dermatitis. *J Invest Dermat* 129: 1824-1835; and Ishii et al., 2013 Antipruritic effect of the topical phosphodiesterase 4 inhibitor E6005 ameliorates skin lesions in a mouse atopic dermatitis model. *J Pharmacol Exp Ther* 346:105-112.

In this study, on day 0, BALB/c mice were sensitized with a single topical application of 60 µL 0.3% oxazolone (Ox) on the back skin. Starting from day 5, the animals were topically given Ox challenge (60 µL, 0.3%) on the back once every two days until termination. Test items were administered once daily from days −7 to termination and included live purified individual bacterial strains or vehicle (bacteria freezing media) by oral gavage once daily. Animals receiving positive control were given topical application of 0.05% clobetasol cream (62.5 mg/day) on the back from days 1 to 21. On days of challenges, test items and clobetasol were administered 1 to 2 hours after oxazolone application. Skin evaluations were performed every other day starting at day 5, including evaluation of affected skin for erythema or redness, and back skin scaling, in accordance with the following scales:

Skin Erythema or Redness:

| | |
|---|---|
| None = | 0 |
| Slightly Red = | 1 |
| Moderately Red = | 2 |
| Markedly Red = | 3 |
| Very Markedly Red = | 4 |

Skin Scales:

| | |
|---|---|
| None = | 0 |
| Slightly Scaly = | 1 |
| Moderately Scaly = | 2 |
| Markedly Scaly = | 3 |
| Very Markedly Scaly = | 4 |

Figure 10:
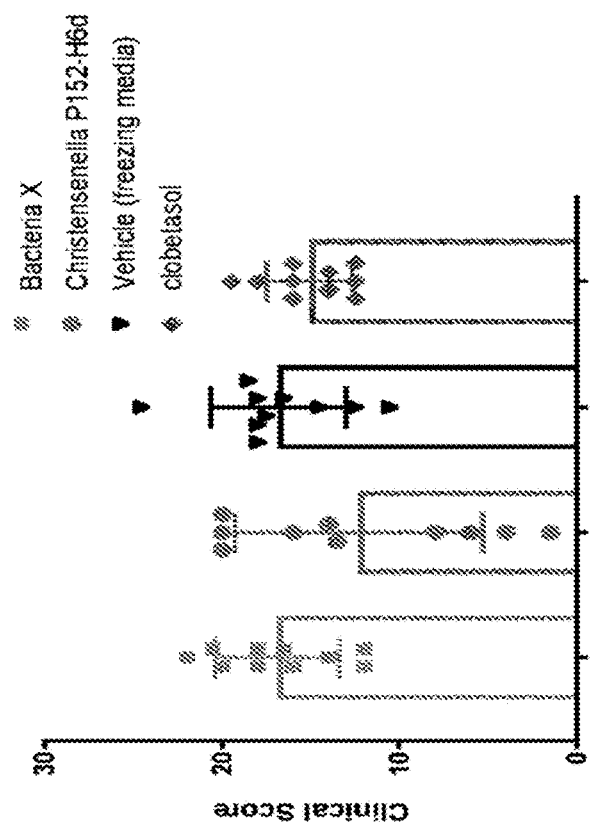
FIG. 10 depicts the effect of *Christensenella* sp. P152-H6d on skin redness (erythema) in an oxazolone-induced atopic dermatitis mouse model. Erythema clinical score provided: (A) over time; and (B) as AUC. <0.005, **<0.0001 in a Two-way ANOVA with a Dunetts post-hoc analysis.
Figure 10:
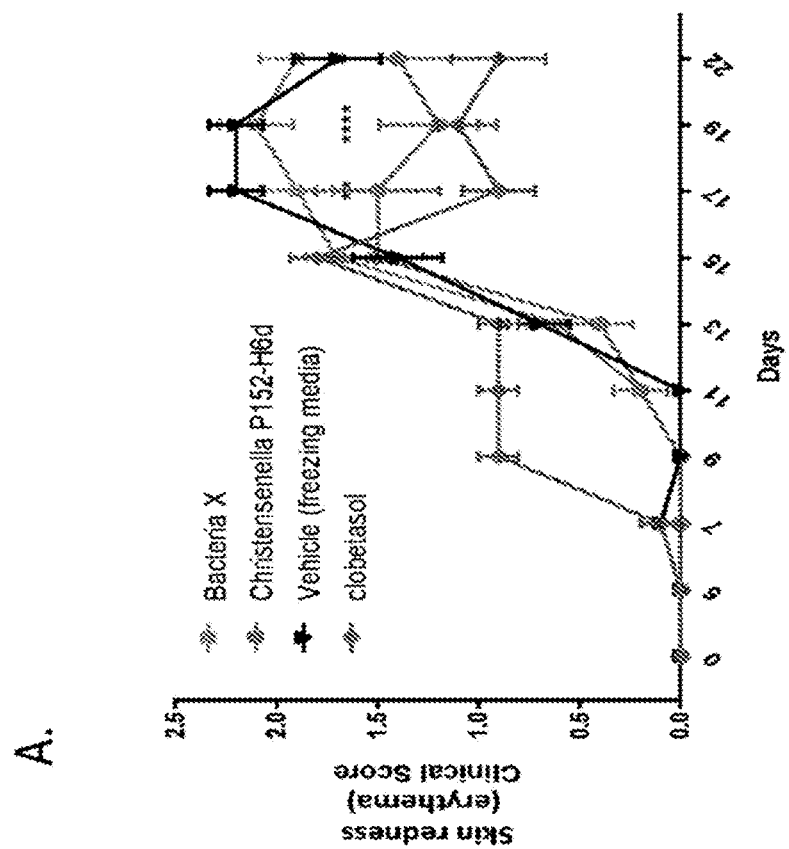
Figure 11:
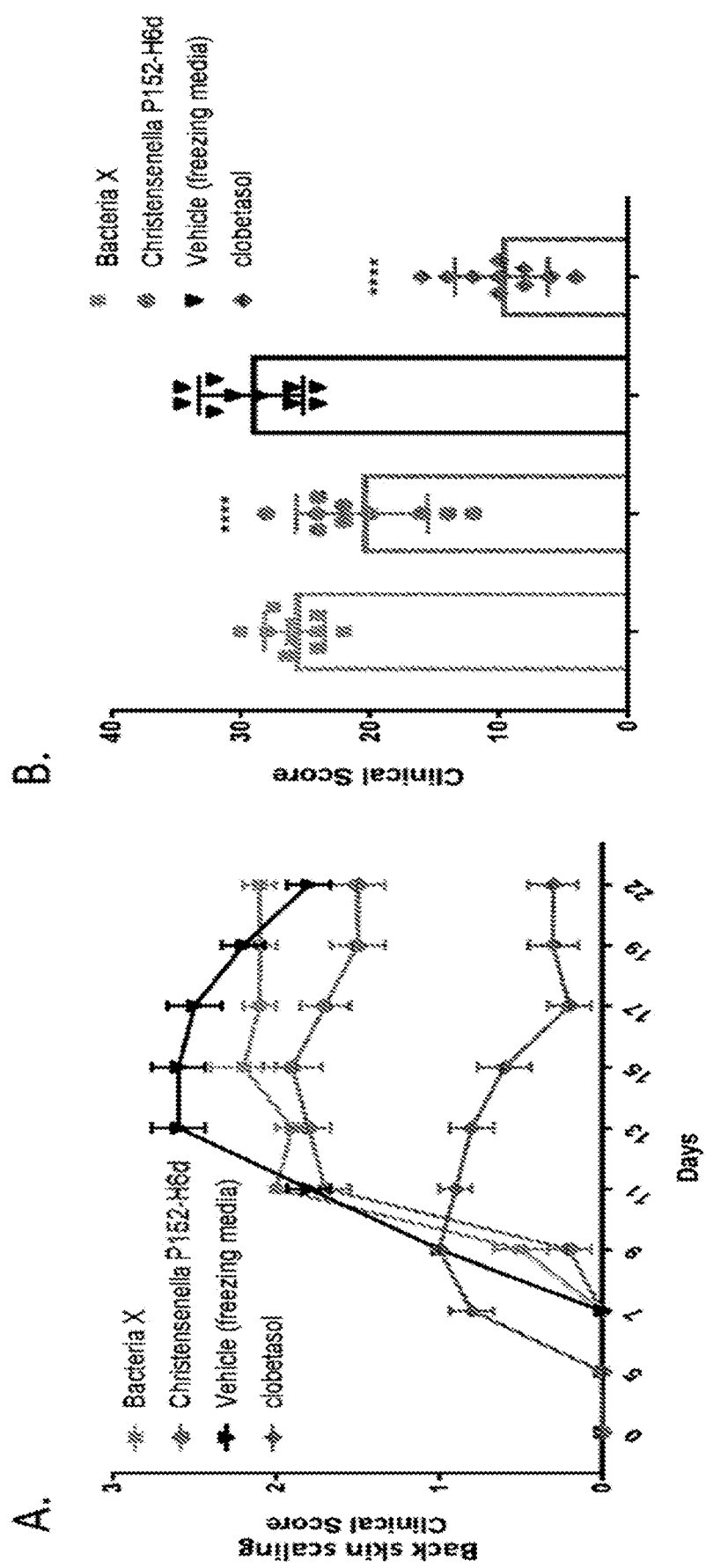
FIG. 11 depicts the effect of *Christensenella* sp. P152-H6d on back skin scaling in an oxazolone-induced atopic dermatitis mouse model. Back skin scaling clinical score provided: (A) over time; and (B) as AUC. ****<0.0001 in a Two-way ANOVA with a Dunetts post-hoc analysis.

As shown in FIG. 10, administration of Christensenella sp. P152-H6d as well as clobetasol led to a reduction in oxazolone-induced skin redness clinical score (A-time-course; B-AUC) compared to the vehicle control, whereas administration of bacterial strain X did not. Similarly, as shown in FIG. 11, administration of Christensenella sp. P152-H6d as well as clobetasol led to a reduction in oxazolone-induced back skin scaling clinical score (A-time-course; B-AUC) compared to the vehicle control.

5.3 DSS-induced Colitis

Colitis refers to inflammation of the inner lining of the colon which can be caused by infection, inflammatory bowel disease (Crohn's disease and ulcerative colitis), ischemic colitis, allergic reactions, and microscopic colitis. Induction of colitis in mice through the administration of dextran sulfate sodium (DSS) has been previously reported. See, e.g., Chassaing et al. Dextran sulfate sodium (DSS)-induced colitis in mice. *Curr Protoc Immunol.* 2014 Feb. 4; 104: Unit 15.25.

In this model, colitis was induced in C57Bl/6 mice via addition of 3% DSS to drinking water from day 0 to day 5, with the exception of naïve control animals. Test items were administered once daily from days −1 to termination and included live purified individual bacterial strains or vehicle (bacteria freezing media) by oral gavage. Animals receiving positive control were administered an antibody against IL-12p40 parenterally once every 3 days starting on Day 6. Animals were dosed at the same time on each dosing day and weighed daily.

Figure 12:
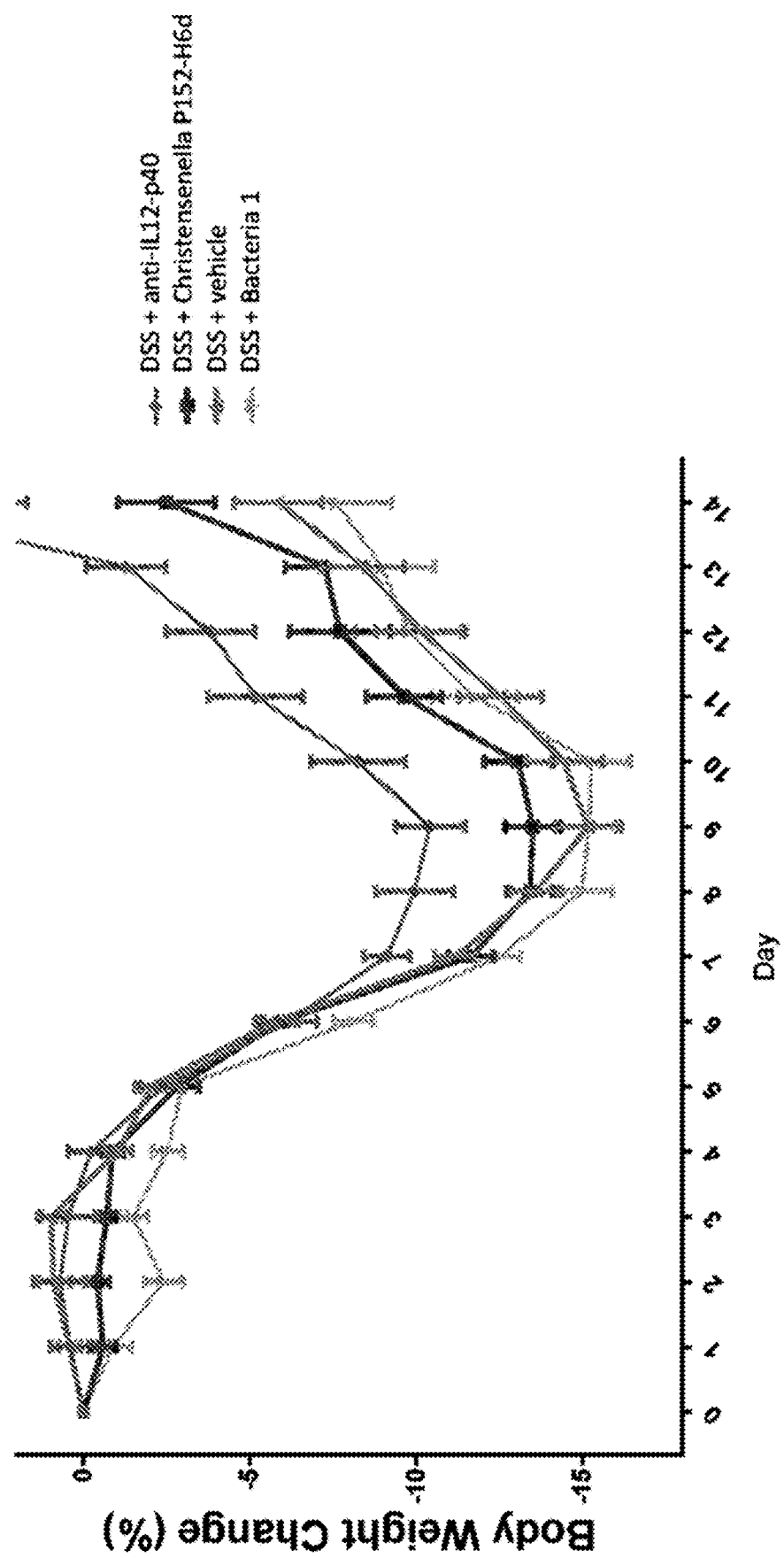
FIG. 12 depicts the effect of *Christensenella* sp. P152-H6d on body weight in a DSS-induced colitis mouse model.
Figure 13:
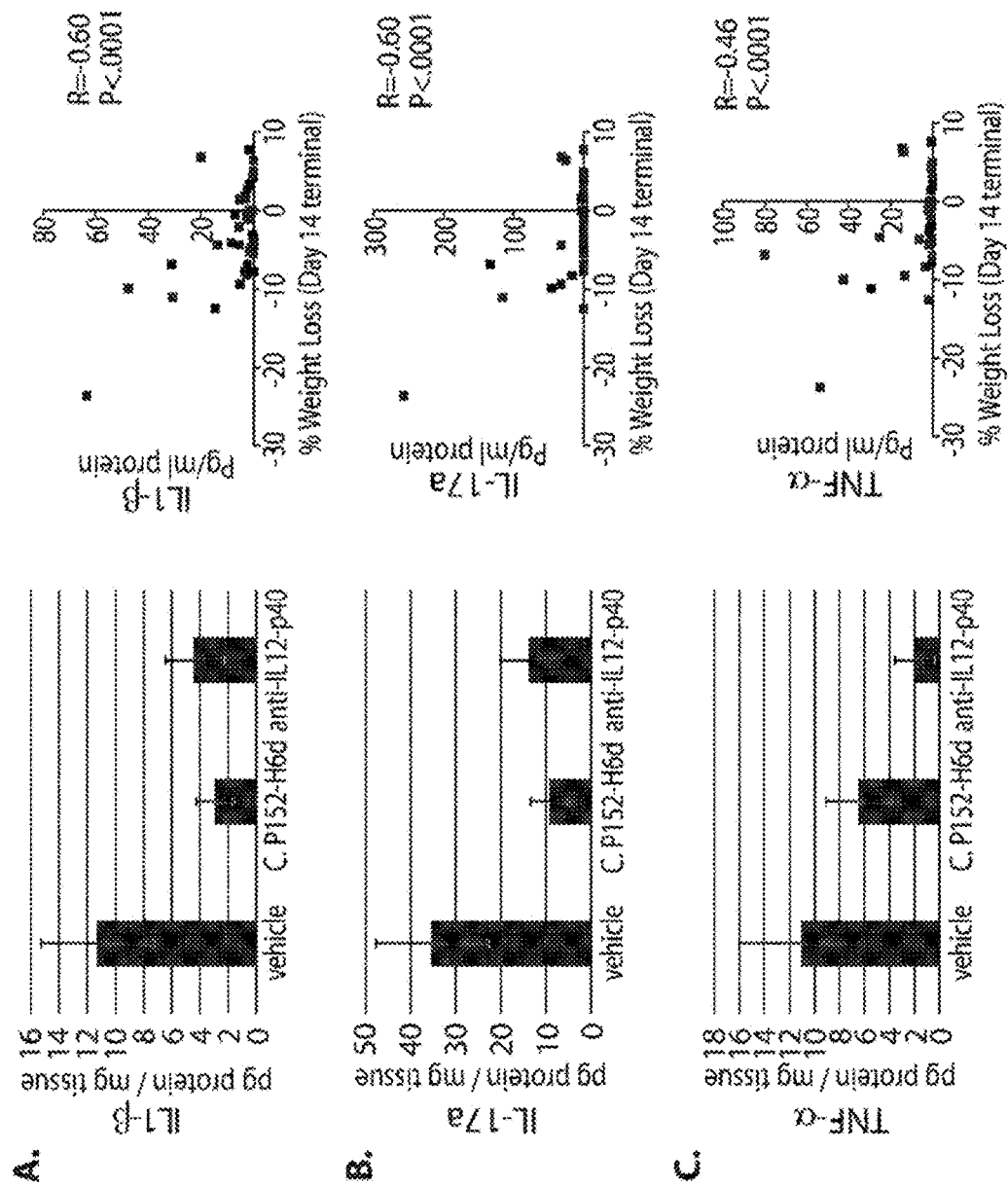
FIG. 13 depicts the effects of administration of *Christensenella* sp. P152-H6d (C. P152-H6d) and an anti-IL12p40 antibody (anti-IL12-p40), respectively, on production of colon cytokines: (A) IL-1β; (B) IL-17a; and (C) TNF-α, in a DSS-induced colitis mouse model. Right panels depict the correlation between levels of colon cytokine produced and % body weight loss induced by administration of DSS.

As shown in FIG. 12, administration of *Christensenella* sp. P152-H6d as well as the anti-IL-12p40 antibody led to a reduction in DSS-induced body weight-loss compared to the vehicle control, whereas administration of bacterial strain 1 did not. As shown in FIG. 13 (left panels), administration of *Christensenella* sp. P152-H6d (P152-H6d) and the anti-IL-12p40 antibody resulted in a reduction in the colonic pro-inflammatory cytokines (A) IL-1β; (B) IL-17A; and (C) TNF-α compared to administration of vehicle. For each of these inflammatory cytokines, reduction in the level of cytokine in response to P152-H6d was correlated with reduction in % weight loss (FIG. 13, right panels).

Figure 14:
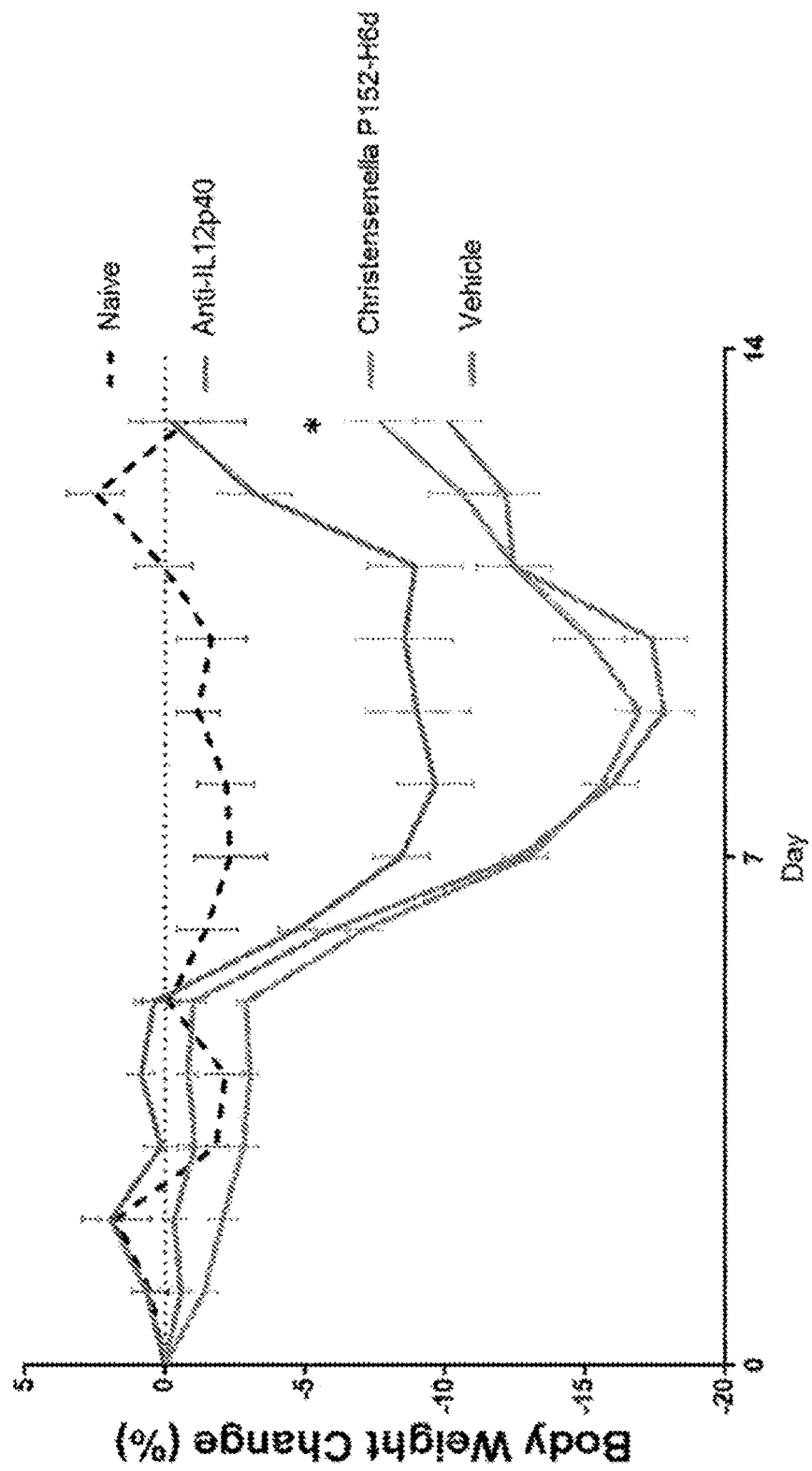
FIG. 14 depicts the effect of *Christensenella* sp. P152-H6d on body weight in a DSS-induced colitis mouse model. *p<0.05, 2-way annova with multiple comparisons, Benjamini, Krieger and Yekutieli method for controlling false discovery rate, analyzed by GraphPad Prism.
Figure 15:
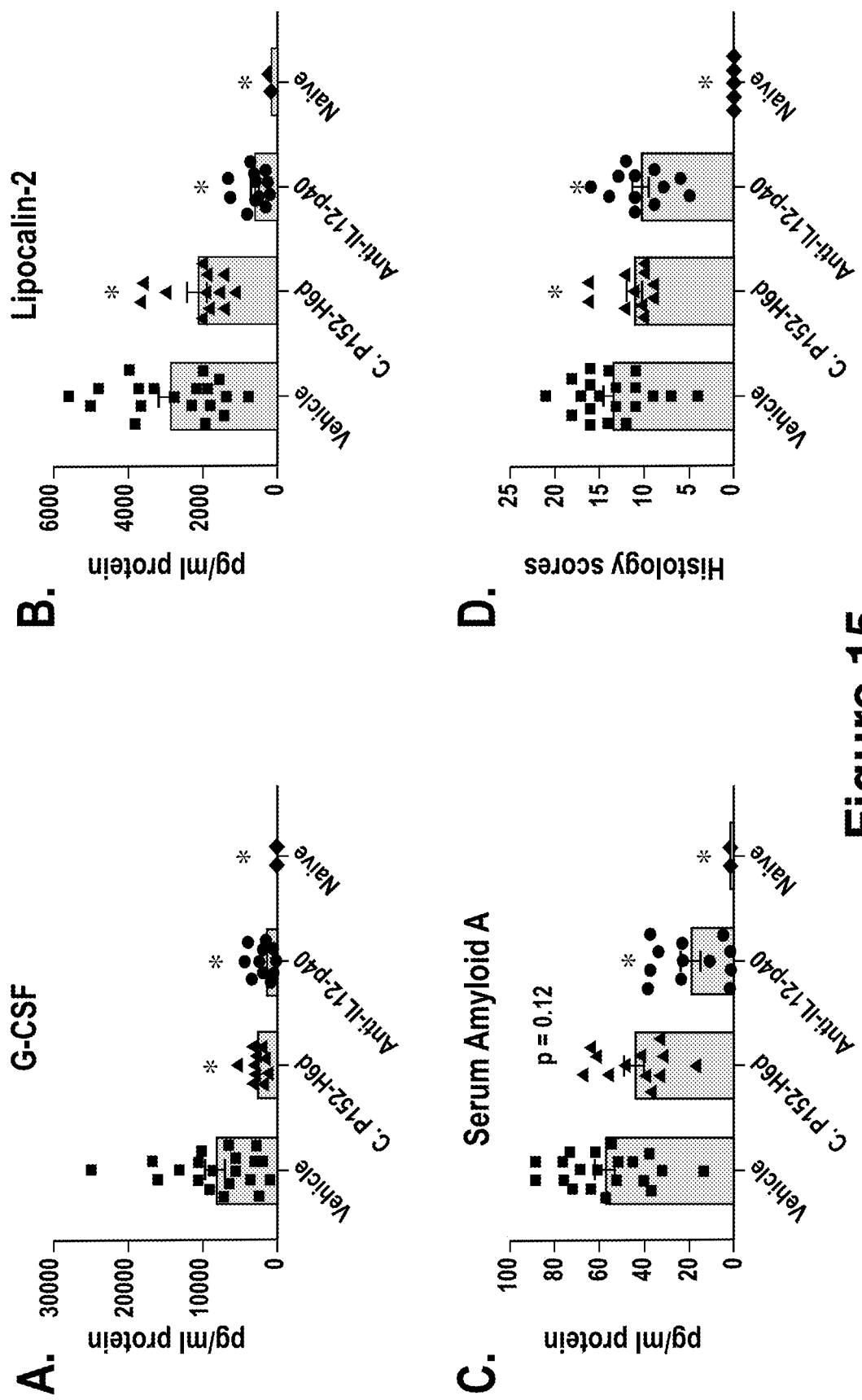
FIG. 15 depicts levels of IBD disease activity biomarkers in plasma on day 14 of DSS-induced colitis, following administration of vehicle, *Christensenella* sp. P152-H6d (C. P152-H6d), and anti-IL12-p40 antibody, respectively. (A) granulocyte colony-stimulating factor (G-CSF), (B) lipocalin-2/NGAL, and (C) serum amyloid A (SAA) were evaluated by ELISA and levels were normalized to ml of plasma analyzed. (D) Histology scores for distal colons following administration of vehicle, *Christensenella* sp. P152-H6d, and anti-IL12-p40 antibody, respectively. A scoring from 1-5 was given to each sample in the category of subacute inflammation, colonic gland injury/loss, erosion, hyperplasia, and submucosal edema. Histology score graphed here is the sum of the scores for all 5 categories per mouse. (A)-(C): *p<0.05, 1-way annova with multiple comparisons, Benjamini, Krieger and Yekutieli method for controlling false discovery rate, analyzed by GraphPad Prism. (D): *p<0.05, Kruskal-Wallis test with multiple comparisons, Benjamini, Krieger and Yekutieli method for controlling false discovery rate, analyzed by GraphPad Prism.

In an additional DSS study, administration of *Christensenella* sp. P152-H6d as well as the anti-IL-12p40 antibody led to a repeated reduction in DSS-induced body weight-loss compared to the vehicle control (FIG. 14). Blood was collected from animals on day 13, plasma was extracted, and plasma levels of known disease activity biomarkers for IBD were measured by ELISA. As shown in FIG. 15, administration of *Christensenella* sp. P152-H6d as well as the anti-IL-12p40 antibody led to a reduction in the plasma levels of: (A) G-CSF; (B) Lipocalin-2/NGAL; and (3) Serum Amyloid A (SAA). Additionally, colons were collected and paraformaldehyde fixed after animals were sacrificed on day 13. Fixed distal colons were parafilm embedded, cut and placed on slides for H&E staining. A score ranging from 1-5 was given to each sample in the categories of subacute inflammation, colonic gland injury/loss, erosion, hyperplasia, and submucosal edema. Histology scores graphed are presented in FIG. 15D and represent the sum of the distal colon scores for all 5 categories per mouse. Administration of *Christensenella* sp. P152-H6d as well as the anti-IL-12p40 antibody led to a significant reduction in histology scores compared to the vehicle control.

5.4 *Citrobacter rodentium*-Induced Colitis

Induction of colitis in mice via infection with the natural mouse pathogen *Citrobacter rodentium* has been previously reported. See, e.g., Koroleva et al. *Citrobacter rodentium*-induced colitis: A robust model to study mucosal immune responses in the gut. *J Immunol Methods.* 2015 June;421: 61-72.

In this model, C57BL/6 mice were fasted 3 hours prior to bacterial infection on day 0. On day 0, mice were administered $10^9$ CFU of *Citrobacter rodentium* (DBS100 ATCC 51459) by oral gavage. Body weight was regularly monitored throughout the study to track clinical symptoms (3 times per week). On days 1-14, the animals were given a PO dose of live purified individual bacterial strains or vehicle once daily. 3-4 hours after last dosing (3.5 h+/−30 min) on day 14, all animals were terminated, and colon and plasma were harvested for analysis. Three efficacy endpoints were evaluated: body weight-loss over the period of the study and colon weight as well as colon length. In addition, colonic tissue was assessed for production of pro-inflammatory cytokines, including TNF-α, IFN-γ, IL-1β and IL-21.

Figure 16:
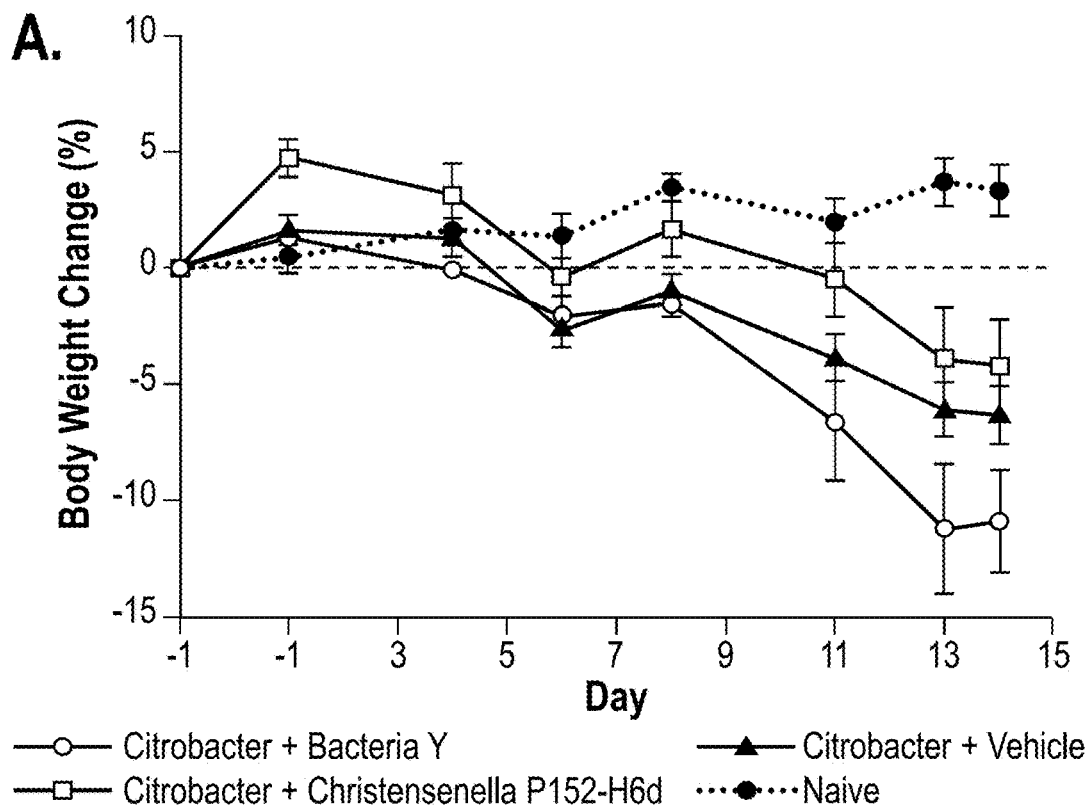
FIG. 16 depicts the effect of *Christensenella* sp. P152-H6d on body weight in a *Citrobacter rodentium*-induced colitis mouse model. Body weight change % provided: (A) over time; and (B) as AUC.
Figure 16:
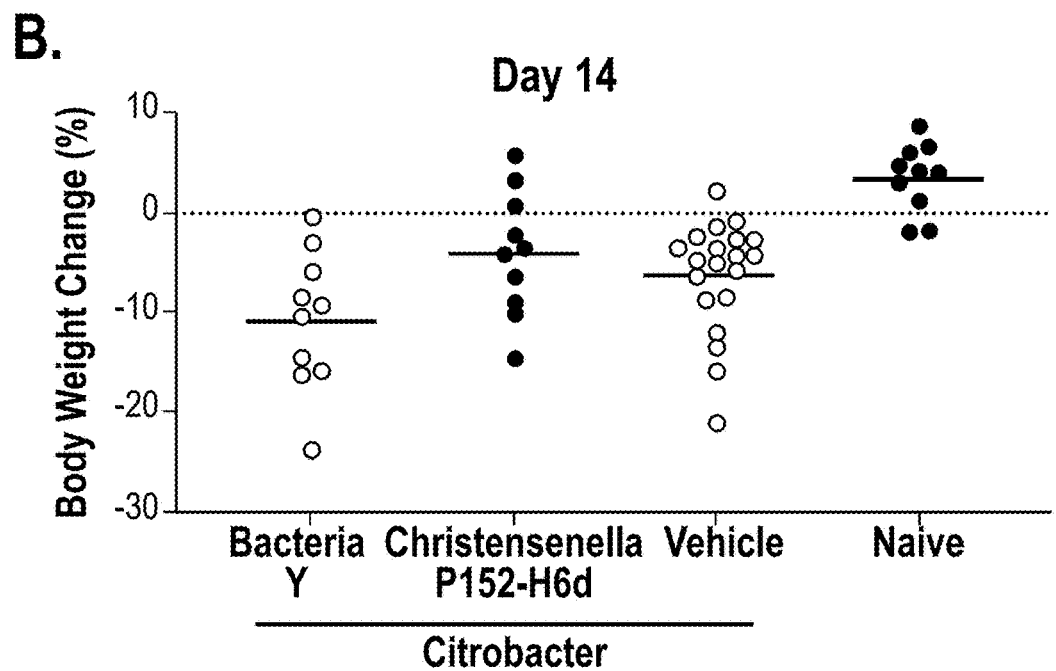
Figure 17:
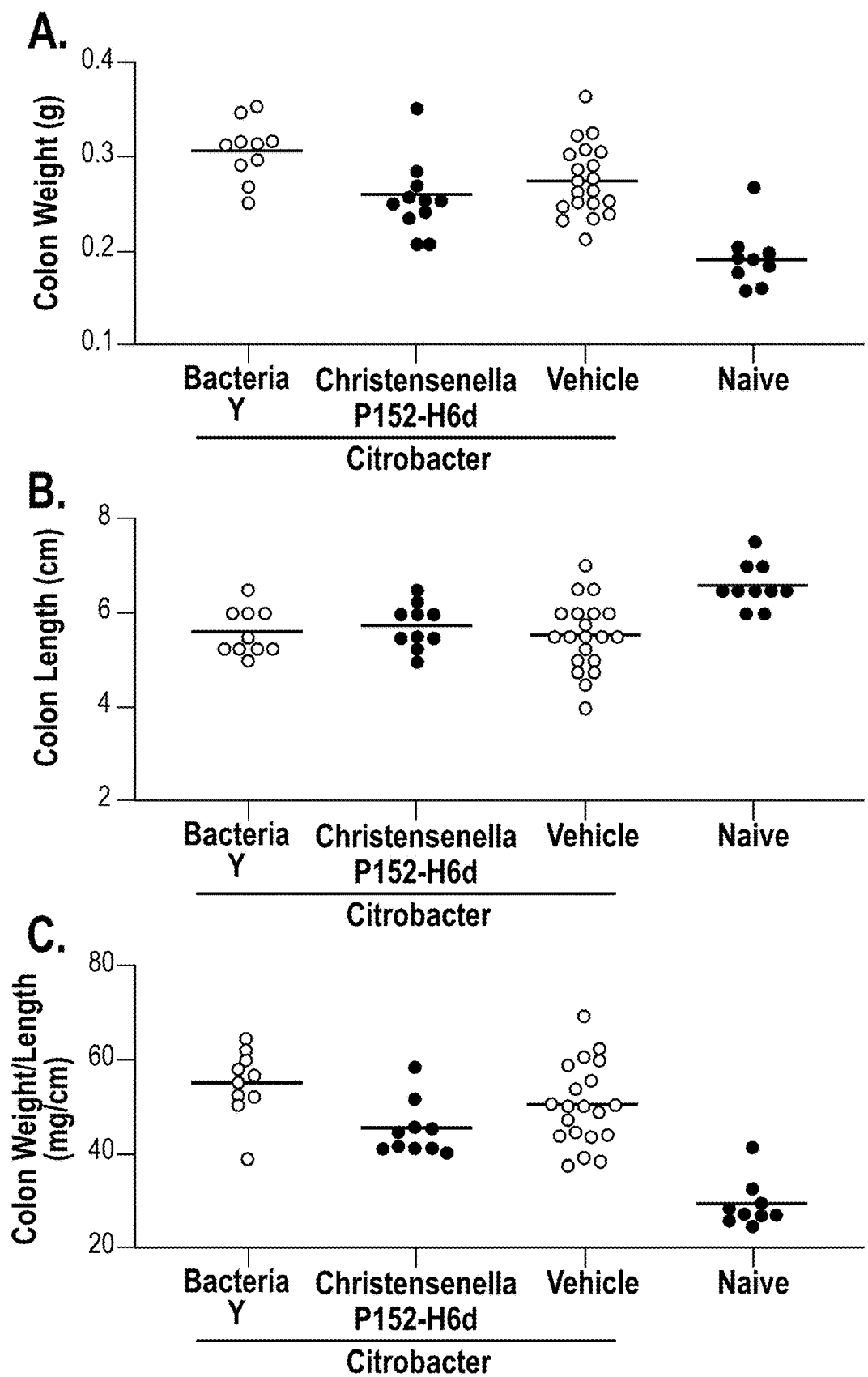
FIG. 17 depicts the effect of *Christensenella* sp. P152-H6d on: (A) colon length; and (B) colon weight in a *Citrobacter rodentium*-induced colitis mouse model. (C) Ratio of colon weight/length. LLOD=lower limit of detection.
Figure 18:
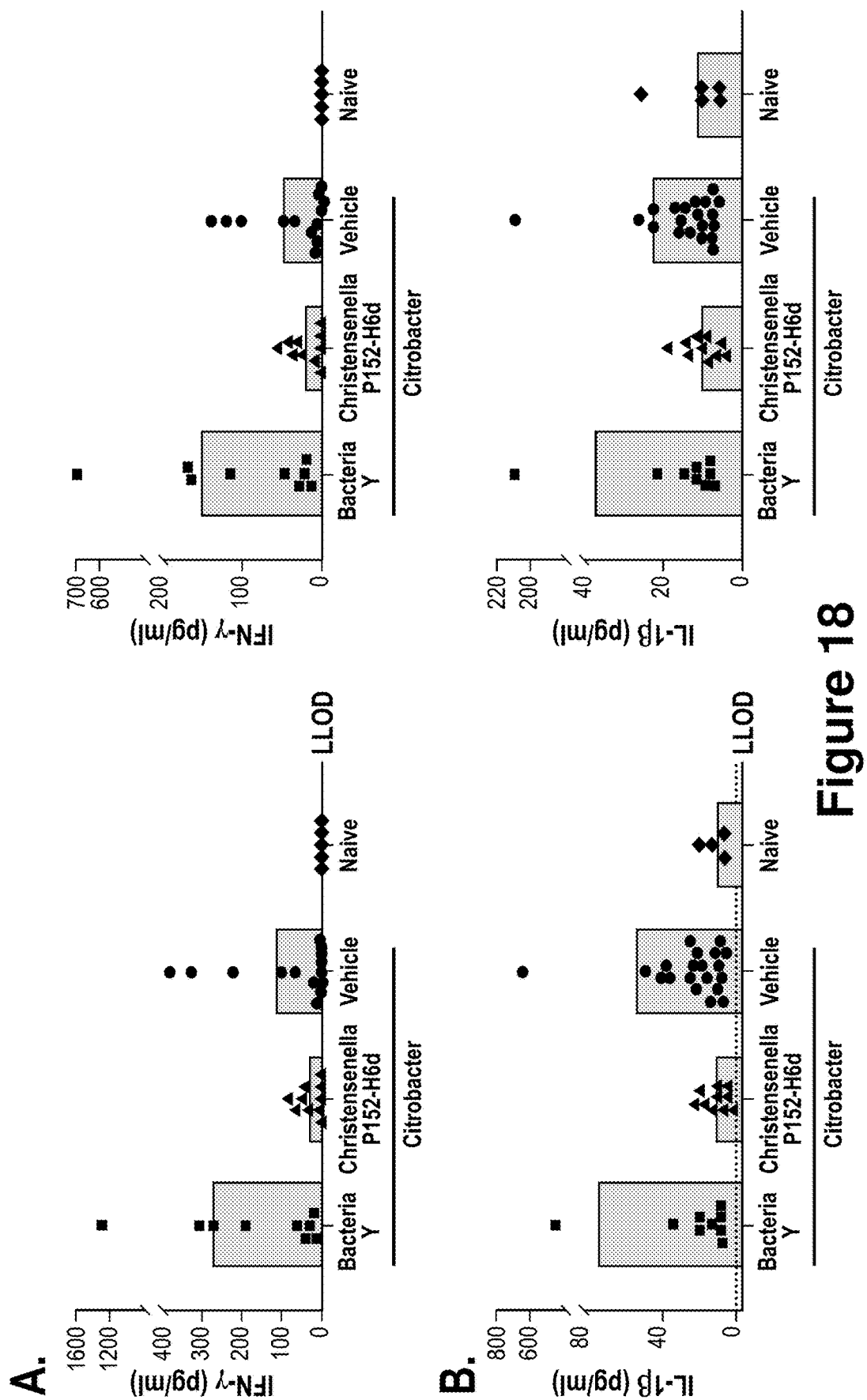
FIG. 18 depicts the effect of *Christensenella* sp. P152-H6d on production of: (A) IFN-γ; (B) IL-1β; (C) IL-21; and (D) TNF-α in colonic tissue in a *Citrobacter rodentium*-induced colitis mouse model. LLOD=lower limit of detection.
Figure 18:
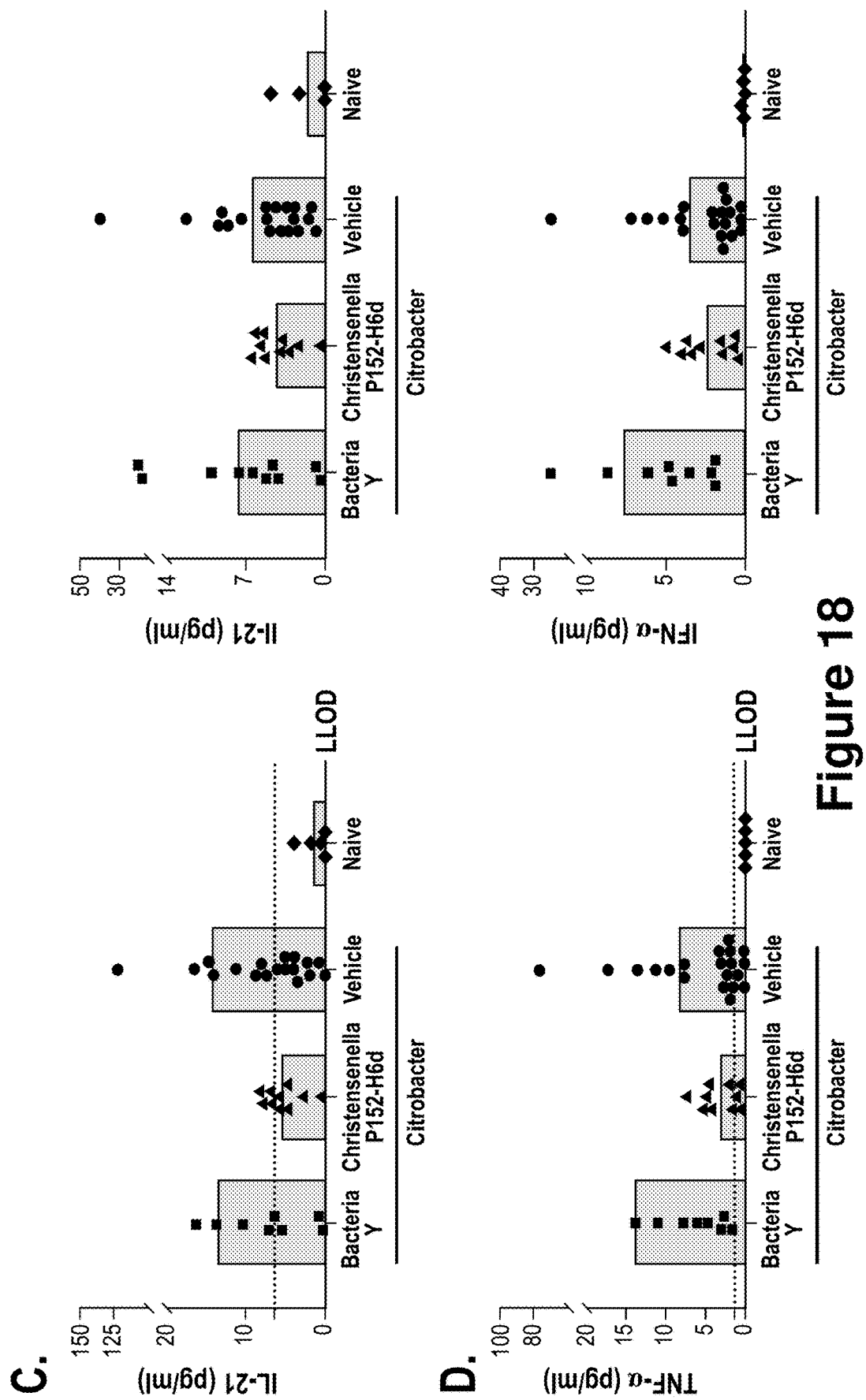

As shown in FIG. 16, administration of *Christensenella* sp. P152-H6d led to a reduction in *Citrobacter*-induced body weight-loss compared to the vehicle control and bacterial strain Y. Similar effects of *Christensenella* sp. P152-H6d were observed on colon weight and colon length, while colon weight and colon length of mice treated with bacterial strain Y were similar to those of vehicle-treated mice (FIG. 17). As shown in FIG. 18, administration of *Christensenella* sp. P152-H6d (P152-H6d) resulted in a reduction in the colonic pro-inflammatory cytokines (A) IFN-γ, (B) IL-1β; (C) IL-21; and (D) TNF-α, compared to administration of vehicle and bacterial strain Y.

Figure 19:
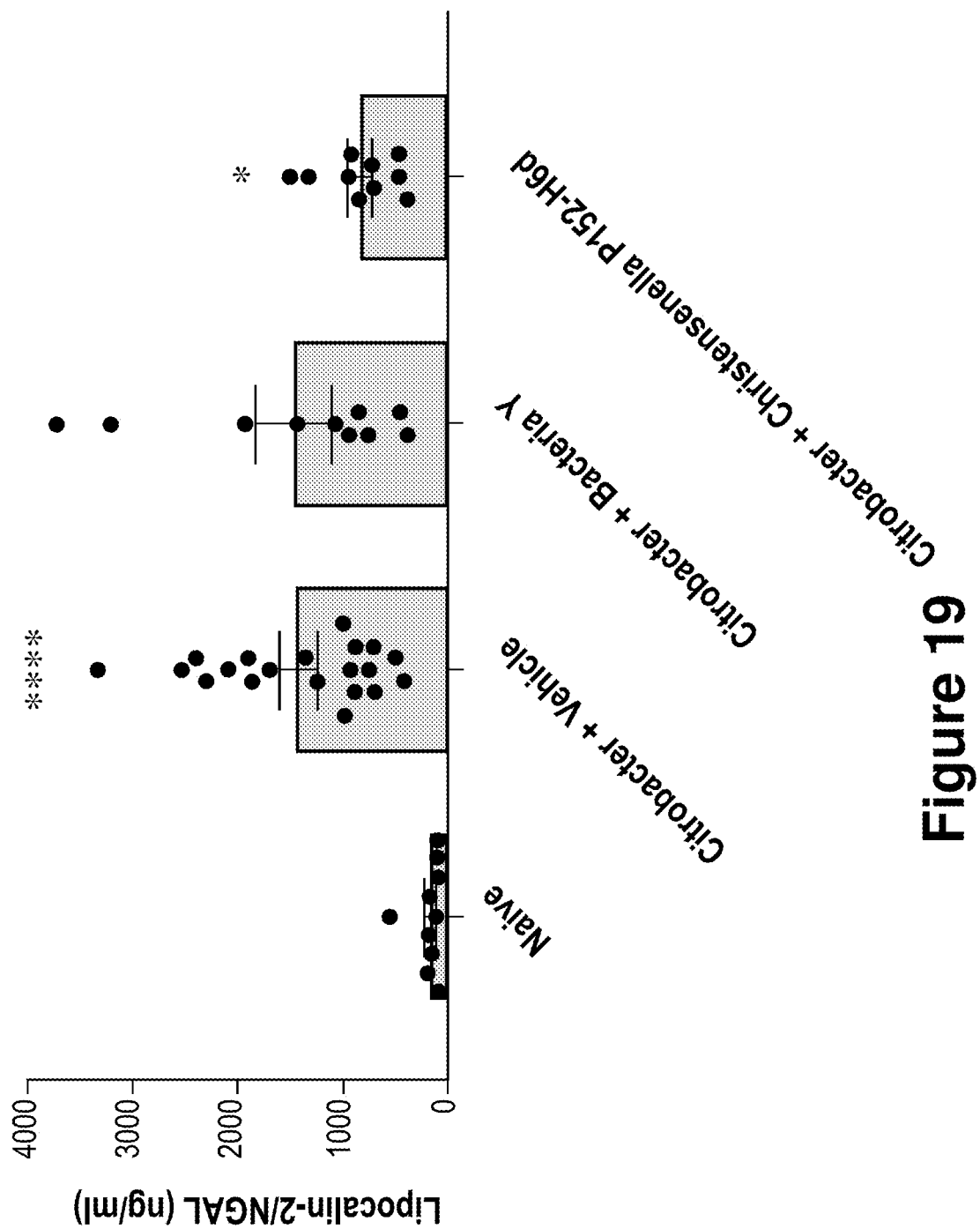
FIG. 19 depicts levels of lipocalin-2/NGAL in plasma on day 14 of *Citrobacter*-induced colitis, following administration of vehicle, *Christensenella* sp. P152-H6d and a control bacterial strain (Bacteria Y). Levels were evaluated by ELISA and normalized to ml of plasma analyzed.

Evaluation of Lipocalin-2/NGAL, a disease activity biomarker in inflammatory bowel disease (Stallhofer et al., *Inflamm Bowel Dis* 21(10):2327-2340 (2015)), was performed on plasma samples. Administration of *Christensenella* sp. P152-H6d resulted in a reduction in plasma levels of Lipocalin-2 compared to vehicle control and bacterial strain Y (FIG. 19).

5.5 TNBS-Induced Colitis

Induction of colitis in mice via administration of 2,4,6-trinitrobenzene sulfonic acid (TNBS) has been previously reported. See, e.g., Antoniou et al., The TNBS-induced colitis animal model: An overview. *Ann Med Surg* (Lond) 11: 9-15 (November 2016).

In this model, colitis was induced in C57Bl/6 mice via addition of 5 mg TNBS+50% ethanol by rectal deposition on day 0, with the exception of naïve control animals. Vehicle or bacterial test articles (*Christensenella* sp. P152-H6d; *Anaerostipes caccae*; and the combination of *Christensenella* sp. P152-H6d and *Anaerostipes caccae*, respectively) were dosed ad-libitum from day −3 to day 3. Body weight change was assessed as % change of body weight from weight at day 0 for each mouse. Colons were collected and paraformaldehyde fixed after animals were sacrificed on day 3. Fixed distal colons were parafilm embedded, cut and placed on slides for H&E staining. A scoring from 1-5 was given to each sample in the categories of subacute inflammation, colonic gland injury/loss, erosion, hyperplasia, and submucosal edema. Body weight changes are presented in FIG. 20A and histology scores are presented in FIG. 20B (sum of the distal colon scores for all 5 categories per mouse).

Figure 20:
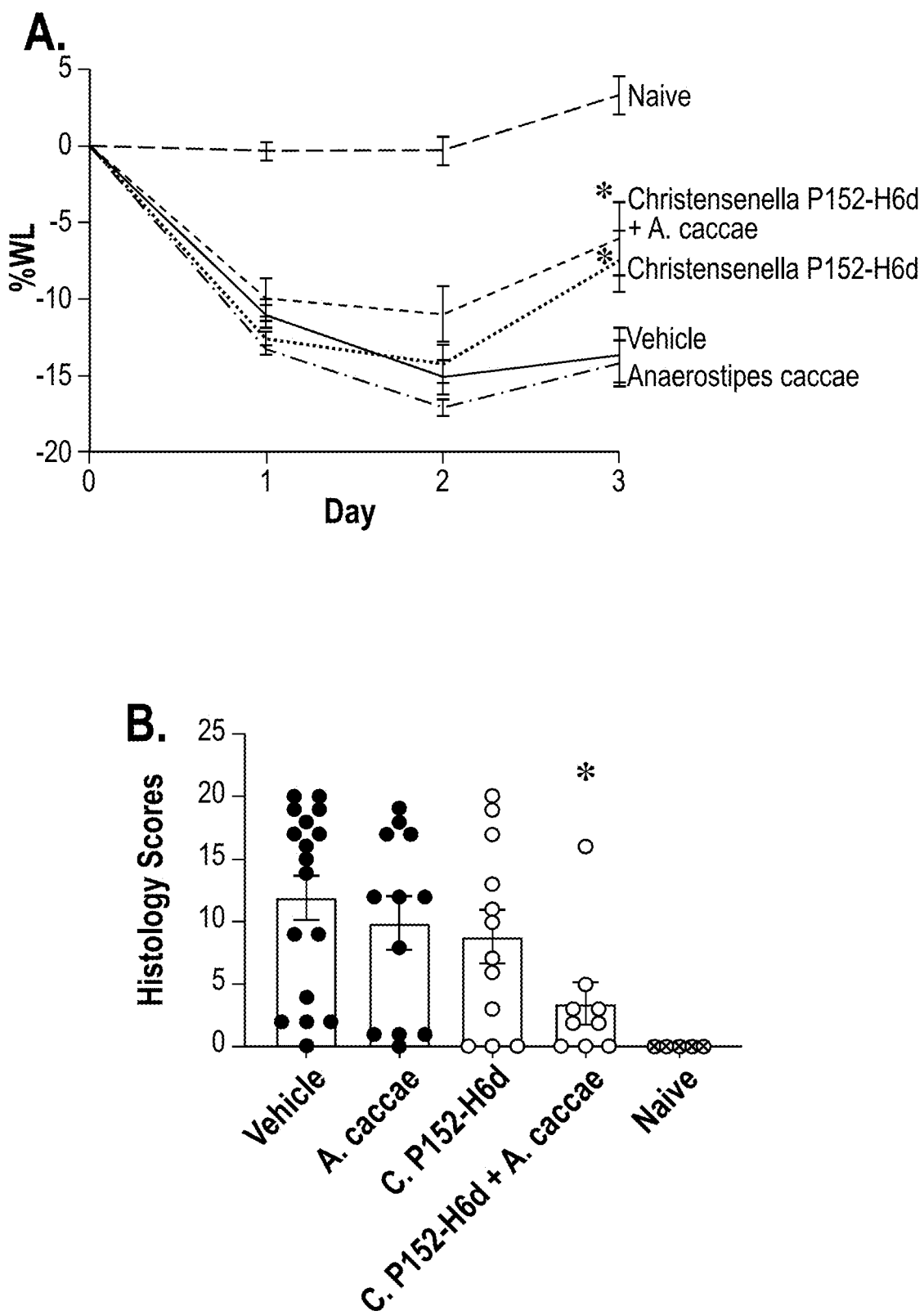
FIG. 20 depicts the effect of *Christensenella* sp. P152-H6d, *Anaerostipes caccae*, and the combination of *Christensenella* sp. P152-H6d and *Anaerostipes caccae* on: (A) body weight; and (B) histology scores for distal colons, in a TNBS-induced colitis mouse model. A scoring from 1-5 was given to each sample in the category of subacute inflammation, colonic gland injury/loss, erosion, hyperplasia, and submucosal edema. Histology score graphed here is the sum of the scores for all 5 categories per mouse. *$p<0.05$, Kruskal-Wallis test with multiple comparisons, Benjamini, Krieger and Yekutieli method for controlling false discovery rate, analyzed by GraphPad Prism.

As shown in FIG. 20A, administration of *Christensenella* sp. P152-H6d by itself led to a significant reduction in body weight loss compared to the vehicle control. By contrast, administration of *Anaerostipes caccae* by itself did not lead to a reduction in body weight loss compared to the vehicle control (a slight enhancement of body weight loss was observed). However, administration of the combination of *Christensenella* sp. P152-H6d and *Anaerostipes caccae* led to the highest reduction in body weight loss compared to the vehicle control, exceeding that of *Christensenella* sp. P152-H6d alone. In view of the effect of *Anaerostipes caccae* alone in enhancing body weight loss, the combined effect of *Anaerostipes caccae* and *Christensenella* sp. P152-H6d in significantly reducing body weight loss compared to vehicle as well as to *Christensenella* sp. P152-H6d alone is unexpected, and suggests that *Anaerostipes caccae* and *Christensenella* sp. P152-H6d can work synergistically to modulate colitis-related disease activity.

As shown in FIG. 20B, administration of *Christensenella* sp. P152-H6d alone, and to a lesser degree administration of *Anaerostipes caccae* alone, led to a reduction in histology scores compared to the vehicle control. However, administration of the combination of *Christensenella* sp. P152-H6d and *Anaerostipes caccae* led to the highest reduction in histology scores compared to the vehicle control, significantly exceeding that of either *Christensenella* sp. P152-H6d alone or *Anaerostipes caccae* alone. These results also suggest that *Anaerostipes caccae* and *Christensenella* sp. P152-H6d can work synergistically to modulate colitis-related disease activity.

Example 6

In Vitro Functional Activity of *Christensenella* P152-H6d Combined With *Anaerostipes caccae*

To further assess the synergistic activity of the combination of *Christensenella* sp. P152-H6d and *Anaerostipes caccae* in modulating TNBS-induced colitis described above, the combination was tested against each strain individually for its ability to modulate the production of inflammatory cytokines in THP-1 macrophages.

Working stock solutions were prepared for *Christensenella* sp. P152-H6d, *Anaerostipes caccae*, and the combination of *Christensenella* sp. P152-H6d and *Anaerostipes caccae*, or anaerobic PBS control. Individual bacterial test articles were added to THP-1 macrophages at 2× and 1× dose, respectively, and the combination was added at 1×+1× dose or 05.×+0.5× dose, respectively, of each of *Christensenella* sp. P152-H6d and *Anaerostipes caccae*. After four hours of co-incubation in 37° C. and 5% $CO_2$, THP-1 macrophages were washed and resuspended with RPMI culture media supplemented with Pen/Strep to remove excess bacteria. THP-1 macrophages were incubated for 24 hours in 37° C. and 5% $CO_2$ THP-1 cell supernatants were collected and analyzed for IL-1-β, IL-12p40 and TNF-α using ELISA.

Figure 21:
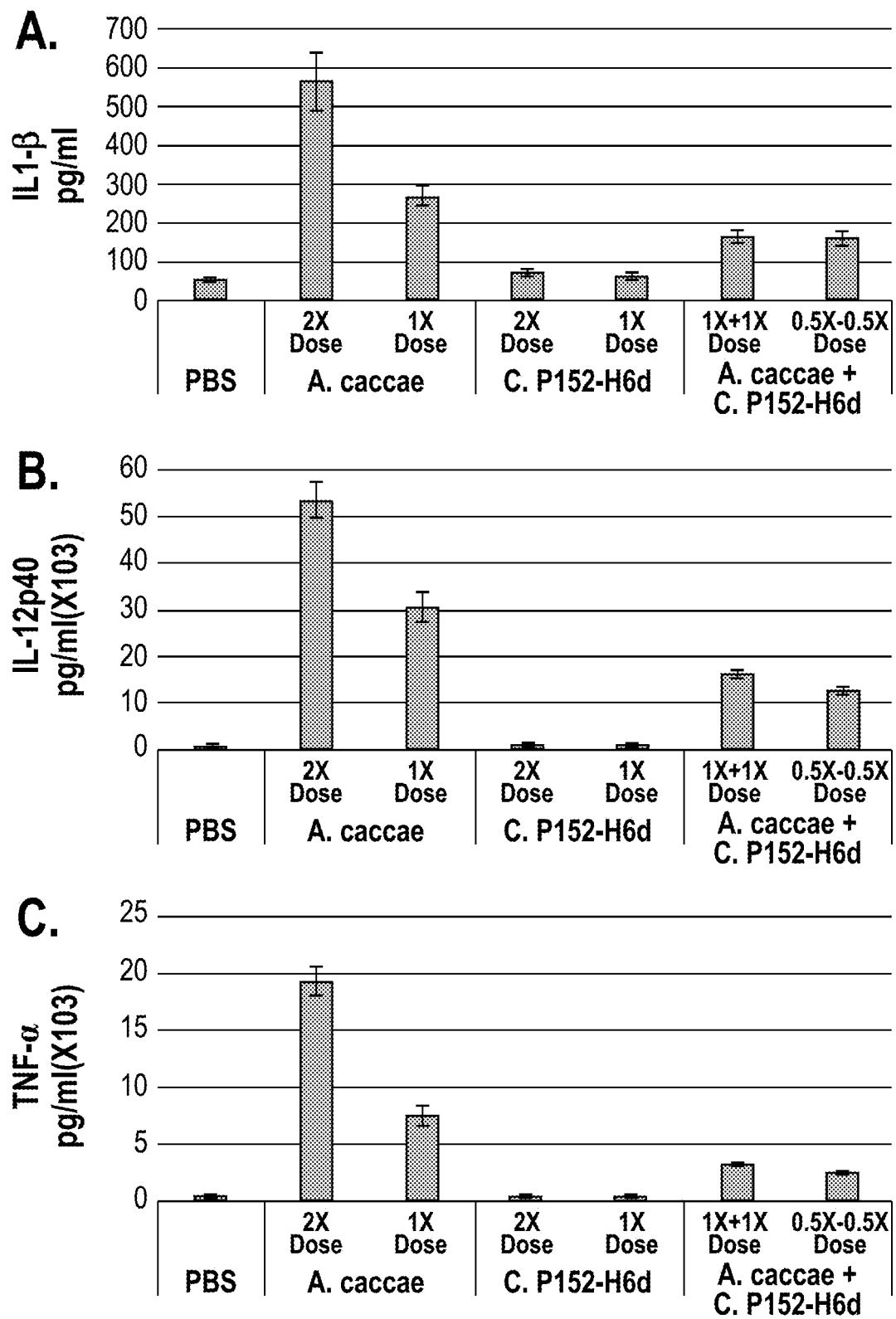
FIG. 21 depicts the effect of *Christensenella* sp. P152-H6d (C. P152-H6d), *Anaerostipes caccae* (*A. caccae*), and the combination of *Christensenella* sp. P152-H6d and *Anaerostipes caccae* on production of (A) IL-1β; (B) IL-12p40; and (C) TNF-α in human THP-1 macrophages. THP-1 macrophage supernatants were collected at the end of the assay and cytokine concentrations in culture supernatant were assessed by ELISA. Each test article was evaluated in 4 replicates and results are representative of at least two independent experiments.

FIG. 21 shows that *Anaerostipes caccae* alone significantly induced each of the inflammatory cytokines IL-1β (A), IL-12p40 (B) and TNF-α (C) from THP-1 macrophages, but the addition of *Christensenella* sp. P152-H6d significantly attenuated production of each of these cytokines relative to *Anaerostipes caccae* alone, which effect was dose-dependent.

Example 7

Targeted PCR Screen for Additional Strains of *Christensenella* sp. P152-H6d 7.1 Stool source. Stool samples from healthy human donors were used for isolation of new strains of *Christensenella* sp. P152-H6d. The donors underwent comprehensive clinical and laboratory testing as described in Example 1 to confirm healthy status.

7.2 Selection of stool samples. *Christensenella* sp. P152-H6d species specific primer pairs were designed against the relA gene of P152-H6d (SEQ ID NO: 33), selected for its relatively low homology to the relA gene of three other members of the *Christensenella* genus (*C. massiliensis* (SEQ ID NO: 34), *C. minuta* (SEQ ID NO: 35) and *C. timonensis* (SEQ ID NO: 36)). A sequence alignment of 4 relA sequences was performed using Clustal Omega, and primers were designed from regions within the relA gene of *Christensenella* sp. P152-H6d with multiple mismatches to the other three *Christensenella* species. As shown in Table 6, the relA gene from *Christensenella* sp. P152-H6d was between 79 and 85% identical to the genes from *C. massiliensis*, *C. minuta* and *C. timonensis*.

TABLE 6

Percent identity of relA genes from four *Christensenella* species

| Species | *C. massiliensis* | *C. timonensis* | *C.* sp. P152_H6d | *C. minuta* |
|---|---|---|---|---|
| *C. massiliensis* | | 78.794 | 79.179 | 86.928 |
| *C. timonensis* | 78.794 | | 85.044 | 80.537 |
| *C.* sp.P152-H6d | 79.179 | 85.044 | | 78.812 |
| *C. minuta* | 86.928 | 80.537 | 78.812 | |

Two primer pairs, Ch_relA_1 and Ch_relA_2, were designed for real-time PCR screening of stool samples from healthy donors to identify samples for isolation of additional strains of *Christensenella* sp. P152-H6d. In short, genomic DNA was isolated from stool using a commercially available kit (Qiagen PowerSoil Pro) and used as template in real-time PCR amplification (20 µl reaction volume, SYBR Green detection). Genomic DNA isolated from *Christensenella* sp. P152-H6d was used as positive control (1e5 copies/reaction). Positive stool sample with the lowest threshold cycle for both primer pairs were selected and used in the isolation of additional *Christensenella* sp. P152-H6d strains. Dilutions of positive stool samples were plated on isolation media, and colonies were picked from isolation media agar plates into 96-well microtiter plate containing 200 ml of liquid media. Once growth was observed visually in 96-well microtiter plate, 10 µl of culture media was removed from each well and processed for PCR based screening.

Figure 22:
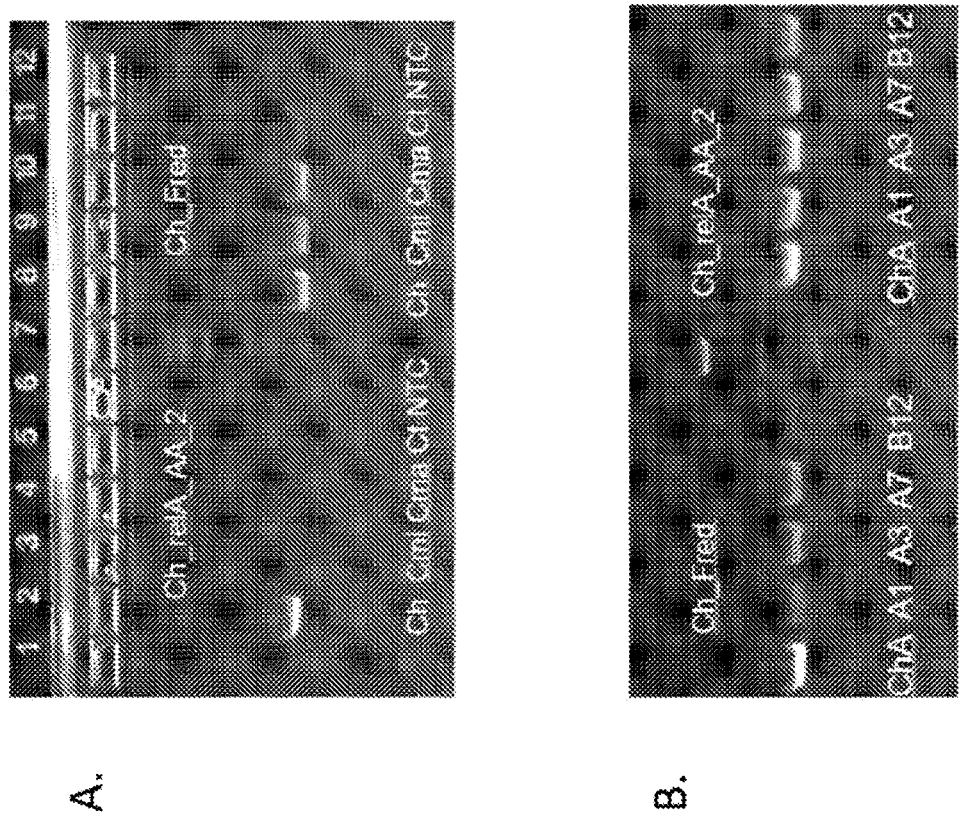
FIG. 22 depicts PCR amplicons from a PCR-based screen for additional strains of *Christensenella* sp. P152-H6d from healthy human stool samples. (A) Amplicons generated from *Christensenella* sp. P152-H6d-specific primers (Ch_relA_AA_2) and primers spanning homologous regions of three different members of the *Christensenella* genus (Ch_Fred). Ch=*Christensenella* sp. P152-H6d, Cmi=*C. minuta*, Cma=*C. massiliensis* and Ct=*C. timonensis*. (B) PCR amplicons confirming isolation of four additional strains of *Christensenella* sp. P152-H6d (strains P235-A1a (lane A1); P235-A3a (lane A3); P237-A7a (lane A7); P237-B12a (lane B12). ChA=*Christensenella* sp. P152-H6d.

7.3 PCR screening assay. A third relA primer pair, Ch_relA_AA_2, was designed for PCR screening of isolates to identify isolates of *Christensenella* sp. P152-H6d. The amplicon for Ch_relA_AA_2 is larger (589 bp) than the two relA real-time PCR amplicons (105, 121 bp) and was designed for easier detection in a 2% agarose gel. Specificity of the primers were tested using either 3 µl culture or gDNA (~1e5 copies) from *Christensenella* sp. P152-H6d, *C. massiliensis* DSM 102344, *C. minuta* DSM 22607 and *C. timonensis* DSM 102800, respectively. To add robustness to the screen, a genus specific primer pair (Ch_Fred) was designed from conserved regions within the NAD(P)H flavin reductase gene (Fred; SEQ ID NOs: 37-40). Verification of specificity of the *Christensenella* sp. P152-H6d species specific primers and the *Christensenella* genus specific primers is shown in FIG. 22A (Ch=C. sp. P152-H6d, Cmi=C. minuta, Cma=C. massiliensis and Ct=C. timonensis). The PCR screen was carried out in 96 well PCR plates with 3 µl culture as template in 25 µl PCR reactions (Phusion master mix, NEB, 40 cycles) and 15 µl of the PCR reaction was run on 2% agarose gels with control to identify positive isolates. All isolates were further purified as follows.

7.4 Purification and verification by 16S sequencing. 20 ml of culture from PCR positive wells of the 96-well microtiter plate was transferred into 96-well Deep-Well plate containing 1 ml of liquid media, followed by incubation at 37° C. After visually detecting growth, 1 ml of 50% glycerol was added to each well, and 600 µl of the mix was transferred into a Thermo Fisher Matrix tube plate. Individual cultures were subsequently plated on isolation media for conformation of colony morphology uniformity. Colonies were observed after 2 weeks incubation at 37° C., appearing clear and approximately 0.1 mm in diameter. Individual colonies were picked for identification by 16S sequencing and replated on an agar plate. After colonies were visible and monomorphology was observed, a single colony was inoculated into 6 ml of YCFAC media. Once the liquid culture became turbid, a matrix plate was prepared by adding 6 ml 50% glycerol to the liquid culture and aliquoting 120 µl per matrix tube. Purity was confirmed by plating from one of the prepared matrix vials onto an agar plate and testing of single colonies by species specific and genus specific PCR testing (FIG. 22B), as well as 16S rDNA Sanger sequencing. 4 new isolates were identified: P235-A1a, P235-A3a, P237-A7a and P237-B12a, all with 16S rDNA sequences identical (100%) to *Christensenella* sp. P152-H6d. (SEQ ID NOs: 41-44; Table 7).

TABLE 7

Percent identity of 16S rDNA genes from 4 *Christensenella* isolates to *Christensenella* sp. P152-H6d

| Strain | P152-H6d | P235-A1a | P235-A3a | P237-A7a | P237-B12a |
|---|---|---|---|---|---|
| P152-H6d |  | 100 | 100 | 100 | 100 |
| P235-A1a | 100 |  | 100 | 100 | 100 |
| P235-A3a | 100 | 100 |  | 100 | 100 |
| P237-A7a | 100 | 100 | 100 |  | 100 |
| P237-B12a | 100 | 100 | 100 | 100 |  |

Incorporation By Reference

The entire disclosure of each of the patent and scientific documents referred to herein is incorporated by reference for all purposes.

Equivalents

The disclosure may be embodied in other specific forms without departing from the spirit or essential characteristics thereof. The foregoing embodiments are therefore to be considered in all respects illustrative rather than limiting on the disclosure described herein. Scope of the disclosure is thus indicated by the appended claims rather than by the foregoing description, and all changes that come within the meaning and range of equivalency of the claims are intended to be embraced therein.

SEQUENCE LISTING (45 sequences)

SEQ ID NO: 1 - DNA, 1442 bp, Christensenella sp.
tctctcctttcggttagccactggcttcgggtgctcccaacttccgtggtgtgacgggcggtgtgtacaaggcccgggaacgcattcaccgcgacatgctgattcgcgattactagcaactccgacttcatgtgggcgggttgcagcccacaatccgaactgggaccggctttttgagattcgcttacccttacggggtcgctgccctttgtaccggccattgtagcacgtgtgtagcccaagacataaggggcatgatgatttgacgtcgtccccaccttcctccgagttgtccccggcggtctcactagagttcccatctttacatgctggcaactagcaataagggttgcgctcgttgcgggacttaacccaacatctcacgacacgagctgacgacaaccatgcaccacctgtctctctgccccgaagggaacatgtatctctacatgcgtcagaggatgtcaagccttggtaaggttcttcgcgttgcttcgaattaaaccacatgctccgctgcttgtgcgggcccccgtcaattcctttgagtttcaaccttgcgatcgtactccccaggcgggatacttaatgcgtttgcttcggcacggaaccctatcgggccccacacctagtatccatcgtttacggcgtggactaccagggtatctaatcctgtttgctccccacgctttcgtgcctcagtgtcagttacagtccagaaagtcgccttcgccactggtgttcctcctaatatctacgcatttcaccgctacactaggaattccacttccctctcctgtactcaagtcacacagtttcaaatgcaaccccggggttaagccccggtctttcacatctgacttacatgaccacctacgcaccctttacgcccagtaattccggacaacgcttgctccctacgtattaccgcggctgctggcacgtagttagccggagcttcctcctatggtaccgtcatttgtttcgtcccataggacaaaggtttacaatccgaagaccttcttccctcacgcggcgttgctgggtcaggctttcgcccattgcccaatattccccactgctgcctcccgtaggagtctggaccgtgtctcagttccagtgtggccgttcaccctctcaggtcggctacccatcgttgacttggtgggccgttacctcaccaactatctaatgggacgcgagcccatcctgcatcgaataaatccttttacctcagttccatgcgaaaccgtggtctcatgcggtattagcagtcgtttccaactgttgtcccccgttgcagggcaggttgctcacgcgttactcacccgtccgccactaagtatactcacagttccacccgaaggcttcacaaagagcaacttcgttcgacttgcatgtgttaagcacgccgccagcgttcgtcctgagccatgatcaaa

SEQ ID NO: 2 - DNA, 580412 bp, Christensenella sp.
  misc_feature (223442)..(223539): n is a, c, g, or t
gttccgatgtttacatgcggtttggttctctcaaacttaccctttgccattgctttgttctccttaatttatttctctctttgttctttcagtggttttaatcggccactgtattatttcttttcgcctgtgatcttctccaccatgctcttcggtaccggttcataatggtcgaactgcattgtgaagttgccgcgtccctgcgtccgcgagcgaaggtccgtcgcatatccgaacatctcggacaggggcaccatcgcgcggatgatctgtccgccgccgcgcgcttccgtaccttcgatacgtccacggcgcgagtttacgttgcccataacgtctccaaggtaatcctcgggcacaacgacttcgactttcatcatcggctctaaaaggatgctgccgcccttggcaaacgcttccttgatcgccatggaaccggcgatcttaaacgccatttcagaggagtcgacttcgtggtacgaaccgtcgaccagcgtgactttgaagtccatgacctcaaatccgccgatgagaccgctctttgcggcttcctgaatacccgcgtcgatcgacgggatatattccttggggatcgaaccgccgacgatcttgctttcaaatacataaccgctgcccggctccaaaggctcaacgtggatcttacaatgaccgtactggcctttaccacccgactggcggacatacttgccttccacatcaaccggctttgtcatcgtctcgcggtaggaaacctgaggtttaccgaccgaagcctccaccttgaattcgcgcatcatacggtctacgatgatctccagatggagctcgcccatacccgcgatgatcgtctggcctgtttcctcgtccgtgtaagcgcggaacgtcggatcctcttccgccagcttttgcagcgcgacggacattttttcctgtccggcttttgtcttgggttcaatcgcgacctggataaccggatcagggaacaccatgttttcaaggatgatctgctgcttgtcgtcgcacagcgtatcgcccgttccaacgtccttaaagcctaccgccgccgcgatatcgccggcttcgacctcgtccacttcttccctgtggtttgcgtgcatgcgcaggatacgtccgatcctctcacgcttgcccttcgttgaattgagcacataggaaccgctgcgcagttttccggaatacacgcggaagaacgcgagctttccgacaaacgggtcagccatgatcttgaatgccagcgcagagaacggtccgttcacatccgccgcacgttcgatctcctcgttcgtgcccggcttgatacctttgatcgccggaacatcgagcggagaaggcatcagctccacgatcttatcgaggagcggctgtacgcccttatttctgtacgcgctgccgcagcacacggggatgatcgttcccgcgatcgtgcctttgcgcagcactttgatgatctcttccttggaaatatcttcgcctgcaaagtatttttccatgatggactcgtcgtggtccgcaaccgcctcgatcagcttttcgcggtattcgtccgccatttccttcatatcctcaggaatatcggtcacatcgaacttcgtgcctgtcggatcgtcatccggatagacgacagctttcatttccacaaggtccacaatgcctttaaacgtgtcttccacaccgatcggaagctgcagcgcaacaggattcgcccccagcctttccttgatcatgtccacaacgttgtaaaagtctgcgcccatgatatccatcttgttaacgaacgccatacgcggaacgccatagccttcagcctgtctccaaaccgtttcagactgcggttccacaccgccctttgcgcagaatactgcgaccgcgccgtcaagtacgcgcagcgaacgctcgacttcgaccgtgaagtcaacgtgtccgggcgtatcgatgatgttgatctggtgtccttcccactgcgtcgtcgtagcagcggaagtgatcgtgatccctctttcctgttcctgttccatccagtccatgactgcgttgccgtcgtgggtatcaccgatcttgtatgtcctgcccgtataaaaaagaatacgttcggtggcagttgttttaccggcgtcaatatgcgccataataccaatgtttcttactttctcaagcggaaattttccagacattgtatctcctttcccttcgataaaaacttatttcaaatttaattgtttacctactcatacagtatatattatacacctgcgcgagcctgccgatgcgtgatttcacagtatatttaccactcattcacacactttttacatgcgcacgtataatacacgctgccgtgtgttcgtgcatgtggcggtcgtaaaactcccttcgcgggcggacgttgcacttcccccgcgtgccccctttgctggtcgttgtttcgcttcgcgttcccgctcgtgaaaccgatttattcctgacgaccgcagcagtcaagttttgccccgttcgagtttcttgggggccccatttccaaggcccactctgttcctgacgatcgtaaccgccaaactgcttacacgcagggctccatttccaaggcccgatttacggagttagcggctttaaaggcataatatcccctaaaaccgcttcccgactatttcatgcgattgttaagacatgcttaccagcgatagtgcgcgaacgccttgttcgcttccgccatcttgtgcatatcctctttcttcttcacgctcgcgcctgtgctgttggccgcatccatgatctcggaagcgagcctctcgcgcatcgtgcgctcagaacgtttgttggaaaaaagagccagccaacggatcgccagcgtctgacggcgttccggacgtacttccatcggaacctggtatgtcgcgccgcctacgcgccgtgcctttacttccagtacaggcattatgttttccatacaggaattgaacacttcaatcgcgtcttttcctgttttttctttgataatatcgaatgcgtcatagcagattctctgcgcggttccccttttgccgtccaccatgatctggttgatcagcttggttacaaccgtgctgttatacatcggatccgctattacctcacgctttggtactccaccacgtctaggcatcgaaaagccctccttatactaaaacagaataattactttatttaccgttcccactcctatagcgtccgccatatgttgcccgtctacttgctcagacaacagacgcgctccgcgccgtctaactcgcatacgccgggcagcacaatgcctgacgttattcgcagacaccgcttataccaaacacatccggtccggcagaaggaacacatggtttgatcccgacgcctttgcaagcaaagcgcgcaggctcgggaggcaaattattgttccgcctgacggtaaacgtaccgataggaaacggaatacacttcttatttcttcggcattttcgcgccatagcatgaacgcgactgcttacgatccgcaacgcctgctgtatcaagcgcgccgcgaacgatatgatatcttacacccggcaggtcttttacccttccgcctctgataagcacaacactatgctcctgcagattgtggccgatccccgggatataagccgtaccttccataccgttgacaaggcgtaccctggcaattttacgaagggccgaattcggttttttaggcgtcatcgtcctgaccgccatgcatacgcccctcttctggggacactgcttcaaaataggcgagttagacttggaaacctgagacttcctgccttttttaaccaattggttgatggtaggcatacacgcaccttcctttcatttcgtatcaataattattgtagtttcccaaatgcctgcgcatcaagcatttgcaggaaaccgttatacagcacatgtttcgggcacatttcctgccccgatgttttcccatatgccgcaccgtatagacaaatcccccgcaaccctgaaggggactagttttcaatgatcgcagcgcaggccgcgcacacgtctatgccgcatacctcgccaagctctttcatcgtttccacattcacgatgtggacttccatttcgccgatcgcccgcaaaatcctgtctttgacatgctcttccgcatcgtccgccagatagacgcacaaagcctctttcgcttccaggctgcgcagcagttgttttagcccaaccaccttgttttcagcgtttttcagttcttcatacatttacgcacaccactttttaacgcaaaaagcacgcctaaatataataccactcaaatattcatgttgtcaaggggcgcttcgtcatcgtcgtccttttcccctgacggttcacacggtttgcgcaggtacgaatatgttttcgttttcttgaaatatatcctcggcataccgttgttcatctggaagaagaaccagccgttttggagcatctgccgcacaagcggtatctccgccacatcgatcttgaccgtcttggacgcttttttcagtgcattcatccccaactgtttgccaaggaaataccccgccagtgccatcagcgccacaaacaggatcggcagcagcgaaaacaagtttaccatcggctccgcgaatcccgggatcaaaagcagcacaaacgccgctaccaaaaagccaaaaaacacgcccaggtgcagataatccatcctgcggaacgcctttttgcagtcgtcacagataccaacctgcattgtcaccagcgatccaacgggcgtacgcacctttttaccgatgccaaagaacatcccctttgccgaatacggctccggatgcgccatttcaaatgaggcgtaccccgccttcttttgcggcgttcccttacagaactggcaatcctcgcccatgtgcaggtcgtcaatgttctccgggatataggaaagcgttgttttccaacgctccatcgccgtctttttatcttcgtcgctcttaagcgtactgatataacagtgatagcaaccttttttgtccagccagttgcaaagatcgctgtccgcgatgacacatgtcttcctgtattcgcgttgctgctggctcatatctttctcgtcgctcatgcaaaaactctcccatcatttacaaaacaggcgaagggtttctcccccctccgcctgcaagtttcccatactatacttatgtgctttaaatctccgtatccgagatatccatgtcgatctgggatgcaatatcgtcgtttaccacattggagatcacgtcgatattcttgtagcgcttcatccccgtaccggccggaatcagcttgccgatgatgatattttccttcagccccagcagcggatcgaccttgcctttgatggccgcctccgtaagcaccctcgtcgtttcctggaaggaagccgccgacaggaagctgttcgtggaaagcgaagccttggtgataccgaggagcacgcgcgaagccgttgccggttccttgccttcccttatcatctgctcgttttccttctcgaactggaagatatcgaccatctcgcccggcagcatcgccgtatcgcccgaatcctcaatcttacatttcttgagcatctggcgcacgatgatctccaaatgcttgtcggaaatctcaacgccctgcaaacggtataccatctgtacctctttcaaaaggtattcctgcacgcccttcacgcccttgatctttaagatatcgttcgggttgatggaaccttccgtcagctcgtcgcccgcttcgatctcctgtccgtcttccacaatcacgcgcgagccgtaaggaatgaggtatgttttcgcttcgcccgaatcgtttgcaacggtgatctcgcgctttttgcgcgtatcgttgatggtcaccacgcccgcgatctctgaaatgaccgccaggccgcgcggcttcctcgcctcaaacaattcctcgacacgcgggagaccctgcgtgatgtcgccgccggcaacgccgccggtatggaacgtacgcatcgtaagctgcgtaccgggttcgccgatggactgcgccgcgataacgcctaccgcttcgccgatatccacaagtccgcctgtcgccatatttgcgccatagcatttcgcgcatacgccgtgttcgctcttgcaagtgaatacggtacggatattgacttcctcgatgcccgcgtccacgatctgctttgcgatcgccggcgtgatcatctcgtttgcgccaaggatcaggttccccttcgcgtcccttacctcctgcgaggtatagcgcccgcggatgcggtcctcaagcggttcgatgacttccttgccgtttgaattggtcagctttctcatgggcacgccctgcgtctgctctcccaaattctcaaagcagtccacctcgcgcacgatcacattatgcgatacgtccaccaggcggcgcgtaagatagcccgagtcagccgtcctcagcgccgtatccgcaagaccttttcttgcgccgtgcgaggagatgaagtactccagaacggtaaggccttcacggaagttcgccctgatcgggatctcgatgatctcgccgttcgggtctgccatcagtccgcgcataccggccaactgcctgatctggttcgtggaaccacgggctccggagttcgccatcatgtagatggggttgaatttatcgaggctcttcatcagagcatccgttactttattagtggtgtcctcccaaaccttgaccgtgctgtcttttctttccttgtcggtcagcaggccgcgcttatattgtttttcgatgccgacgactttttcttccgcatcttcgagcaattcctttttcgcaccgggtatcttgatatccgaaacggaaaccgtgatcgcgccgatcgtcgaataatggaagccctgctttttgatcgcgtccaaaacatgcgatgtctttgtcggacccagctttaagaagcacaggtcgacgagctttccaagctgcttcttgtcgatcagctgatctacttcaaatttcaattcgttttcaggcttggaacggtccatataacctaaatcctgcgggatcgcgttgttgaagatcacgcggcccgtagtggtttcgatgatgcccgtcttcatttctccgttcacttcttttgtgacgcggatcttgaccatcgcctgcaaatcgatatttcctgtgttgtacgccagcaccgcttcctccggggaagcaaagatgctgccttcgcccttcgcgccttcgcggtggatggtcaggtaataggacccgatgaccatgtcctgcgtcggtgaaacgaccggctttccgtcctgcggctttaagatattgttcgctgccagcatgaggaaacgcgcttctgactgtgcttccacggaaagcggaacgtgcaccgccatttggtcgccgtcaaagtcggcgttgtatgccgtacaggcaagcgggtgcagcttgatcgcgcggccctcaacgaggatcggctcaaacgcctggatgcccagcctgtgcagcgtaggcgcacggttcagaagaaccggatgccccttgatcacttcttccagtacgtcccaaacctcggggcgcaccttttccaccatacgctttgcggatttaatgttgtgcgcaaagccttcttccacgagctttttcatgacgaacggcttaaacagttcgagcgccatttcctttggcaggccgcactggtacatttgcagctccggccctaccacgataacgctgcggcccgaatagtcgacgcgcttgccaagtaagttctgcctgaaacgcccctgcttgccgcgcagcatatcagataaggattttaacggcctgttgcccgggcccgttacagggcggccgcgcctgccgttgtcgataagcgcgtccaccgcttcctgcagcatgcgcttttcgtttctaacaatgatatccggtgctctaagctgtagcagcctgttcagacggttgttgcggttgatcacgcggcgatatagatcattcaaatcggaggtcgcgaaccggccgccgtcaagctgtaccatagggcgcagttcgggcgggatcacgggaacaacgtccatgatgatccactccggcttgttgcccgactgacgaaacgcttccactacctctagacgcttgatcgcgcgcacgcgcttctgtcccgtgcatgtcttgagttcctcgcgcagctcgctcgcttctgcttcaaggtctacctttttgaggagtatcttgaccgcttccgcgcccataccggcggagaatgcttcctcgccgaacttggcctgcgcttcgcggtattccttatccgtcaaaagctgcttgtattcaaggcccgtttcacccgggtccgttacgacgaacgccgcaaaatacagcaccttctccaaagaacgcggggacatgtcgagcaaaagccccatacgcgacggtatccccttaaaataccagatatgcgaaacaggcgctgcaagctcaatgtgtcccatgcgctcgcggcgaacctttgcgcgcgttacctcaacgccgcacttttcgcatacgatacctttatagcgtatcctcttatatcttccgcagtggcattcccagtccttcgtcggcccgaaaatgcgctcacagaacaacccgtccttttccggcttcaacgtacggtagttgatcgtttccggcttctttacctcgccgtgcgaccattcgcgtattttttccggagacgccaggcctatctggatcgaatcaaaagtattgagttcaaacaagggtaactcctctcctctctgctatgtcaaaaaatttactaaacttaaccaattactccatatcgtcgtcttttaaactgtccgtatcgatattgaggtcttccgtgatgtcgattccctcttccaggtcttccatatcagggatcacgtcgtccgcgaagtcatcgtcaaagtcgatgtcgtcgtcctcaagttcgcctaaatcaggcaaatcgagttcgtcgatcgtcaggtcgtcgagatcctcgatgaccatatcgcccgcgtcgaagtccccgtcttcgctcggcaggtcttcgctgcccgcgatattgatgtcgatcatcatgccgtcgtcctcgtccgtctccttgatcgcgatctctccgcggtcctcggaaagcaccttgatgtcaagccctaagctctgcatctccttaatgagtaccttgaacgattcgggcacgcccggctccggaatattttcgcccttgacaatggattcgtacgttttcacacgtcccaccacgtcgtccgacttcacagtcaaaatttcctgcaacgtgtttgccgcgccgtaagcttcgagcgcccaaacttccatttccccaaaacgctgtccgccgaactgtgctttaccgcccaggggctgctgcgtgaccagggaatacggacctgtcgatctcgcatggatcttatcgtctaccaggtggtgcagtttcaaaatatacatatagccgacggtgacgcggttttcaaacggttcgccgctgcgtccgtcataaagcaccgtcttgccgtccggcgaaagcccgctctttgcaagcaattcttcaatgtcttcctcactggcaccgtcgaataccggcgttgcgaccttgtagcccatcgcgcgcgccgccatgccgagatgcacctccaacacctgcccgatgttcatacgcgaaggtacgcccagggggttcagtacgatgtcaagcggcgtgccatccggcaggaacggcatatcttccatcggaaggatacgcgagataacacccttgttcccgtgtcgtccggccattttgtcgcccacggatatcttccgcttctgtgcgatatacacacgtacgagcttgttgacgcccgccgtcagttcatccttgttttcgcgcgtaaagatcttcacgtccacgaccacgccgccttcgccgtgcggtacccgtagcgaagtatcgcgcacctcgcgcgccttttcgccgaagatcgcgcgcagcaggcgttcctccgccgtcagctccgtttcgcccttgggcgttaccttgccgacgaggatatccccgctccgcacttccgcaccgatacgcacgataccgcgtgaatcgaggtccttgagcgcatcctcaccaacgtttgggatgtcgcgtgtgatctcttccggcccgagctttgtgtcgcgcgcttccgcttcgtattcttccacgtggatggaagtgaatacgtcgtccttcacgaggcgctccgagagaagcatggcatcctcgtagttgtaaccttcccaggtcataaagcctacgagtacgtttttacccagccccaactcgccgtgatcggtggacgggccatccgcgagcacctgtcccgcttctattttctgcccttcatatacgatgggcaactggttgatgcacgtgccctggttggaacgcgcaaatttgatcaggttaaattcattttccgtgccgtcgtcgtttgcgatcacgatcttgtccgccgttaccgtcttcgccacgcccgcctttttggaaatggagagcacgccggagtcgtacgcggccttgtattccatacccgttccaaccaccggagattcggggatcagcagcggcaccgcctgcctctgcatgttggaacccatcagcgcgcggttcgcgtcgtcgttttccaggaacgggatgagcgacgttgcaaccgatacgagctgcttgggcgaaacgtccatcaggtcgacttcgtttctggaaacctcgacgatctggtcgcgcacgcggcacataacgcgctcgtttacgaacacgccgtcgtctcccaaaggctcgtttgcctgcgcaacgatgaggtcttcttcctggtcggccgtcatgtactgtaccttgtttgtaacgcagccctttttcttgtcgatgatacggaaaggtgtttcaatgaacccgtattcgtttatccttgcatatgtggaaagagaaccgatgagtccgatgttcggaccttccggcgtctcgatcgggcacatacgtccataatgcgaatgatgtacgtcacgtacgtcaaaactcgcgcggtcacggttcaggccgcccggtccaagcgccgacagccttcttttgtgcgtcagctccgccagtgggttcgtctggtccatgaactgcgaaagctgcgaggaaccaaagaactccttgatggaagccgtcaccggacggatgttgatcaggttggatggcgtcgcaacgtccatatcctggatggacatccgctcgcgcacgactctctcaagacgcgtaagtcctacgcgcagttggttctgcaaaagctcgcctacagagcgcagccgcctgttgcccaaatggtcgatatcgtccgtcaggccaatgccgtgcttgagccctaagaaatagctcaccgaagcaaacatatcgtcgatgatgatatgtttgggaatgaggacggaaagcccttccgtcaggcgctcctttaaaagcgctttatccttcccgcactcgtctatgatttccttgagcgccggataatatactttttcgttgatgccgacttgcgccggatcaaaatcaaggtgcgcctttgcatccacaaaatggttgccgtgtacgcggaaagtagcttccccaacggaaatctccaccatattgacgcccgcgttctcgatttccagcgcctttttctcgctgatcgcctcgcctgcggaaacaagcagctcccccgtctcttcattgatcacattggaagcggctacctggtccttgatgcgctgcgcgatcgagagtttcttgttgaatttataccgcccgacgcgcgccaggtcgtaacgcttggggtcaaagaacaaagacccgatcagcatattcgcgctttccactgtcggcggctcgcccggacgcaggcgcttatagatttctaaaaggccttcttcctggttcgtcgtattatcctttttgatcgtcgcttcgacgttctcgtcgtcgccgaaatactcccgcaggtcggcgtcattagaaagccccatcgcacgcaggaaaacagtgacggggagcttcctcgtcctgtccacgcggatatacatgcagtcgttggaatccgtctcgtattccagccacgccccacggtttgggatcacggtagaactgaaaaggtccttacctgttttatccttgctctcgccgtaataaacgccggggctgcggacaagctgcgaaacgatgacgcgctccgcaccattgatgatgaacgtccccttttccgtcatcagcgggaaatcgcccataaaaacttcctgctccttgacttcccccgtttccttatttaaaaggcgaacctgcaccttaagaggagcggcgtagttaacgtcccgctctttacattcttccacatcatacttgggcgtatcgaggatcttgtaatccacaaattcaagtatcaggttttcagaatagtcggtgatgggggagatgtcctgcagtacttcgcccagaccctcttccaaaaaacgtttgtaagagtttttctggatttcgattaagtccggcatgtctagaacttctttgatcttggaaaagctcatcctcttatttgttccaaacttaacttcctgcatacttaacaacaactcctatattaaaattgattataccagtcaaaacgcacatgcatggccgcgtccggcaaaaagccgctttccatgcggattttccccgcatccaaaagggcgcgagatgggacaatactccacagtacaactatgctaatgcagtttactatattatcatagcaaaatcaagatgtcaacacttttttttcgcacccgctgcacagttttcgcaaagcgtccgtcatcatactgcccggcgtgcaaaaacaggacgcgcggttccgcgtcctgttttcttatttcaatattatttgattttcgcaaagatcatccgccctgccgccgtctgcaatacgcttgtcacgatcacggtaagcgtcttatcgctcatgcccttcgcgccctccacgacgatcatcgttccgtcgtctaagtacgcgatgccctggctctgctccttgccatcctttacaatggtgacggtcatctcctcgcccgccatcaaaatcggcttgaccgcattcgccagctcgttgatgttgaataccggcacgtcctgtaccgccgcgaccttgttcaggttgtaatcgttcgtcaccacagtgccgccgatatccttagccagcttcagcagcttgatatccacttccggtacatcctcataatcggcgtccgtcacctgcacgcgcgttttcagttccttttgcatatcgccaaggatatcgaggccgcgcctgccgcgcgtgcgcttcatagaatcgcccgaatccgcgattttttggagttccttcaatacgaactccggcacgatgatatccccttcaaacatgcccgtcttacagatatccaaaatacgcccgtcgatgatcacgctcgtatccagtattttaggggatacgcccccctttttattgtgctcggccgctttacttccgggcgccttcttgccgcgcaggatacccgcgatatcgatgcgccgctttacgccgatcgaaaggccgatggagccgaacagcaggtaaacaaggatcgtcaatggtatggatatccacgcgatcggaatgaacccgatgatcacagagatcaatgccgccaccacaagtcctgcgatcaggcccagcgtcccgccaaaaagcgttgccgtaggcgtagcgtccagtttcttttctatgttctttgtatttctctcaaacgcctgcgccatcctgcgggataaaattaaaaatatgattccggatataattccacttacgatatatgcgacgaacggcacccacgtctggaaatttgagaacaggtcggcctgtgcgaagtagttatataatgttactcccagcagcaccagccccggcccgatcaaaaagcccagaacaatgatgaacaatctcatcagcttgtaaaacatgttgctttctcctttccttattcagttgtatctatataaacggcgtctcctgcaatcccgacgcctttatttcttcattaatttatcatacaaatatgtcttgcgtgtgaacaaacccttaaaaattcctaaaacgcctttgcaagaacatccgagagcgtccccactccctccgccttgatattcttatccatccccttttccaaactgtaccgcgggacgaacacgcgcttgatccccatcttcgcgcattcgctgacgcgccgcgaaagctgggctacatgcctgatctcgcccgacagtccgatctcgccgatgaacgccgtgtcacgcggcaagggcaggttgcgcagggaagaaacgatggacatcgccatcgccatgtcggcggcgtgctccttgaccttgatcccgcccgccacattcacaaagatatcttcattatagagcttcaaaccgatcttcttttccagcaccgcacagatcatgtaaaggcggttcacatccacgcccgaacaaagcctgcgcgggatattaagctgcgtgtgcgcgcacaacgcctggatctcgagcagcatggggcgcgttccctgcgtggccgcaaaaatggaaacgcccgaaagatcgtccgcaaaatccccttcgaacagcatcgtcgggttcttcacttccatcatacccatatcgcgcatctcgaaaacaccgatttcgtccgtggaaccgaaacggtttttgaccgcacgcaaaatacgcaaattcgaggtccgttccccttcaaaatataataccgtatccacgatgtgctccaaaacgcgcggccccgcgatcgcgccttccttggtcacgtgcccgatgataaacgtagcgatgcccatgcgctttgccgcctgcgtcaggcgggacgcgcacccgcgcacctgcgccacgctgcccggcgcggaagaaaggttcgcgtcatacagcgtctggatcgaatccacgatcaaaaatttgggctttagctgctcaacgccggcaaggatactgcccacctcggtttccgccatcaggtaaatgttttccgcgacaccgagacgctgcgcgcgcattttgatctgcgcgggagattcctcgcccgaaacgtaaagcacattgcccgcagcgcaaaggagctttgccacctgcaaaaacagcgttgatttaccgatgcccggctcaccgcccgcaaggcatacgccccccggcactacgccgccgcccagcacgcggtcaaattcgccgatgcccgtcgcgaaccgtttctcgctttcgagtgggatcttgtcaaaggtaatgatcttggccggcgcgcagggagccttcgcttttcccgcaggcgcagcctccaccacttcctcgaccatcgtattccattcattgcacgaaggacagcgccccgaccatttcccgcttgtatacccacactccgagcatacgaactgcgtctttgtcttaaccatcttgtcctccgtcctgcggcgtttcgcccgttccttccgtatttgcactttccatgtatgcgtacagtaccgcctcgtccgcaaccttcgtatccgtcgtgtcgtaataacagataccgtttttattcgccgacgcaagcaggtttttggtggtatctcccgtcatggtctgcgtcatctgcgcgtccgtatagcacaccgtcactttcatatccttggtataagcgacaaagttgtcgcccagcgcgtaattcgtgacgttctctgcgatcttgaccggcgcagcgccgttcgtggaaagcatgagcgacccgctgatgatatcctttgacgttgcaaagacgatatctttgccgttcgttttcggttcatagaccgcgtctccgaaattatagctgtcgaatttagccgcgccgctcgaaaaatcgatgcgcttcagcgtgcctttcccgtctgcggcgtactccgcccatacgaggtcgcttccggagatgctcgccgcgctgttgcccgtcgtggtattttcataaagcttgaccgttgaggcctcgcgcgtgcttaagtcatatacgtataacctctgtgtcgtgtcgcccgcccactgcatgaacgcgatcacgttgcccgcaatggagatctgcggctgcgcgtatacgaattccttgatcaaaaactgctcgcccgccgcgatgtcatatccgacgatacgcccgccgccgttatcgtaacaatccacccataccgcgtaattgcccgaaagtatgggcgataaaagcctgtcatattttttgtccacacccggcagcttctttacttcgcccgtctgcgtgttatagatcatcaccgtatcgagcgccagcgtcccctgctgtgaaagctgcgtcgtaaaaataatgctgtccccgtcgataaacggctcgtttttgatacggaccttgtaggttccgccgccctcgtccgtaaattcattgatatacagctcgctgggcactacgtcgcctgtctgcaacgtattttcttccaggttgaactccgcctccaccttgggctggtagcgcagcgaaggatccacgcccttgaccaggtcctcgatcagcgggaacccaaaaaagatcatagcaagaacgccggccgccgcaacggcgatcaaaatgatataccgccacatcgaccagaagttgctccgccttacacggtccgcgcccatcggacggcggatcgtgctcattcccctgtgtttccttcttttcatcttaccttctctgccgttgcaaaatacacaccgcctgtgcggcggcgccttccccgcgtccgaccgcgccaaggaattccgtggtcgtggccttgacgtttacatattcgcgcgtcatatccagcgcatgtgcgatattgtccatcatttgctcacgatatgcgctgatcttcggcttttgcatgatcagcgtactgtcgatattgatgatcttgtatccgtatttacgcagcaggtcgccgatctcccgcaaaaggttgatcgaataaatatccttatacttcgggtcggtatccggaaacagcccgccgatgtcgcctaagcgcgccgcgcccaaaagcgcgtccatgatcgcatgcacaagcacgtccgcgtccgaatgtccctccagcccgatatcgctgggtatatccaccccgcccagcacgagcttcctgccctgcgcgaactggtgcatgtcaaacccgttcccaatgcgcaggtcggatgattcctggtttttcacgatctgcttaccatggtctacgtccttgcgcgtcgtcagcttgatattgtccggcgaccccgttacgacgtggaccttcgtacccagccgttccaccagcgacgcgtcgtccgtccccaaaaagccgtcctccgccgctttatcgtatgcctgcatgatcaggtcttttttgaacgcctgcggcgtttgtacgcacaccagttcctcgcgcggcagcgtctctgttacaacgccctttttcgcgcgcttgatggtgtccgtcgccgcgaccgccgcgaccccgcttccgtggcggatcgcgctcgagacgcagtcgcggatgatgcgctccgtcacaaagcagcgcgccgcgtcatgcaccaccacgatatccgcgtcgccaggcaccagcgccagcgcgttgtatacggaatactgccgctcactgcccccgtcgcagatcatcaccgtttcatcgccgccgatatacttttccaccttgcgcttcacgatatcgcgttcctctgccttgcatgtcacgatgatatccgaaaacaggccggtggcgtgaaaggtctttaagcaccggatcacggcgctttgttcttcaaacttgatgaataccttgttggtatcgagctccattcttttaccgcttcctgcggcaaggagcacagcacaaattttcatccctattcaattacctcgtacattccgtcggcctcttgttttttcgtcgtttccacgatcgccaaaacacggaccttcaaaggtttcgaaccaaactctatggttatctcatcgccgatctttacggcataactgcttttctgcactttcccgttcaccaggacgcgcgcgccctcgcatgccgactgcgcaaccgtcctgcgctttattaaacgcgatacttttaaatatttatctaatctcatcgccctactccgtcttttatcatcatttcccgccgctcgttgcggctattcgtaaatacgccgcgaccgccatgtcttgccagtctacttgctcaaacacccaacctcgctacgcgatgttaaactcgcatacgatcggcaacacaatgccggacgctatacgcttgtatcgggtacgactgatccgcagtcgtgatgcggcgtttgctctccgacgcctttgcgagggcaacgagcaggctcgggacgcaaatacccatctaaagactgcggtatgcaccgtcgctcccactctgcgtattataccattttttgaaaaatattcaaccaagcgccgcgcaagttcatggcttattcatattcaccgcccgccgcgccaaacaaaaaaagacgcccacagagtgaacgtcccttattgttctttacttattttacagcgtctttgaaagctttaccagctttgaaagccggaacagtggaagcagcgattttgatctgctgtttcgtctgcggattgatacctgttcttgccgcacgttttctagcttcaaacgtaccaaatccaacgatctgtacctttccaccttttttgatttcagcaatgatgctgtcagcaaatgcgccaagcgcagcgtctgcgtcctttttggagataccagcttttgccgcaatagcagctacgagttcagtcttattcaaaaccttcccctccttaaataatattccgcaacggctggggagccgtccggttagattacaaaaacgattataatacattcaaacccataaagcaaccatatttttaaggtttttcagcatttatccaattatttttttagcctcatcccataagttgttcagttcgtccgcgcttacgtcataaagccctttttgtgcggtcttttccatatattccatacgcgtgataaacttttcgcatgtgcggttcaaagccacctccggattaaccttcaaaagccgcagtacgttaatgatggaaaacaacagatcccctgcttccgcttccgccttctcgtcatttcccgcgtctatttccgcctgccattccaggagttcttcgcgcaccttttccatcgcgccctgcgcgtccttccagtcaaagccaatgcccgccgcctttttctggagcttataggcgcgcatcattgcgcccatcgagcgtggtacgtcatgcaggacggatgcgaaatccttgttctgcttttccttgcgtttgatcgcttcccagttcaggaaaacctcatttgcggtgtttgcttccgcctccccaaaaatgtgcggatggcggtttatcatctttgagcatacggacgtcgccacgtcgtcaatgtcgaactcaccgcactgccgaccgatctccgactggaacaccacttgcaggaacacgtcgcccagctcgtcgtatagcgcgaacatgtcgtccgcgtctacagcgtccaccgtttcgtacgcttcctcgaggatatactgccgcaggcttttatgcgtttgctccgcatcccacgggcagccgttttccccgcgcagtatcttcatgatgcgtacgaggtcgtaaaggccgtagcgttctttcctacggagcggctgcggcggcaatacgagcacgccgccctcgctgccctgcgttatgcggtcgatatcataaaagtttatccattccttttttccgtccgcataccacaatgcctgcgtgtcttccttataataatccgaaagcgcgcactttaaaccttctgctaccaacacattttccacacccgttactacaacagcctttgacgtatccacaccgagcgggtccaggtcccgcgcattcactacggtatacccgtctacgtccatacgccctgccgcttcccccaccgcagccgcttccgcgtaaccgcccgtaatatattcgatatgcgcgcccaatttttccagttcgcgcacaaacccgttcttaaaagtgtctcccgccgtgcaaaaaacgaccgtcccgtttttttcctgctgcaaaatgcgctgcgccccttgcgtgaacagcgcgtcaaaatcctcggcctgttcgtataaatcgtccagcgttaccgcattcccgttttcctgtaaaatcccttgcgcgcacaccgtttttccgctctgcaaaacaagcgtgcccgcctgccttatagcccgcaccgcccgcaaaggcaacaagtcgaattcgcccgcgcttccaaccacctgtatcatattttgccctcaacttttcatagattccttaaaattatagccttatgccgcatggatttcaaccggataccgtcgttccgcctgcgcgcccaatacaaaaaggagcctgcgtcattcgcaaactcccctttgttcctccagaaaaactggttgccgactgattataatttatccgtatgcgtctgcacgttatactgctccgcaagctggtcgtacacgtcgtttaagtgcgactgctgcgcctcggacaatttcttctcgataatcgtctccttgatatcgtcaaacgggatcacgccgcccgcatccttcacattctttaagatgtggtaaccatagtccgttgccaccaggccggaaatctgcccttccgtaagcgccagcgccgcttcttcaaactcgcttaccatgccggaacctttgtaaacaaggtacccgtccgtcttttgcggctcgctctgcatgcccgtatcttcgccaagctcttcgaccagcgcgtcaaaatcttcgcccgcattcgcacgggcgagcgcctcgtctgccttggccttgatttccgcaagcgcctcgtcgcgctttacgtccgcgcccgcatcgtcgccgtctgtcctcagcgtcttgatctcttcctgcacgtcgtccggtatctggatcaggatgtgcttgatatagcgcgcgtccgaaggattcacgactgcgatgctcgaactgttgtatgtcgagtaattcgccgagtcttcctcgaccttgggctgctgctccgctacctgctcgtcatagaaggttttcgcttcttcttccgtgtatgttacttcaccgtcgatcttttcgcgttccttggtgaccgcgtcggtcttgaccttttcctctacgcgtttgtcaaggtcgtcatacccgtaaagcgtaaggaactgctctgtttgcttatcgatcgtggactgcttgtccgcttccgcgatcgtatcgtcttcttctacgctcttcttgatagactccttgaggctttccatgttttcctcatattcggcgcggatagaagccttgttctcttccgaatcgtctacaaagccgtcttccttcgctttctggaaaagcatctccatctgcatcaggctttgcagcatgctcgtgcgcatggacgcaagctggtcttcgccgtattgcgacgcatatgtagccatcgtcaggccatattgcgaaagctgggcctccgtctgctcgtccacttcgcccttcgtgatcgccacgccgttgacttcccctacgacctgcgccgcgtcacgctccttgttgacctgcaccatcgagcacgacgcaagggaaacgcacatcacgcccgcgagcgctacgcccagtaacttcttccatttattcatcattaagtaagtatcctttctaaacaataacggatttattatacagcaccacgcccgtcttcgcaactttttgttctgttacctctgccgaagctgtttcaaaaactccaggaaatcgttcatttgcatatcttttttgatcttgtaaacgatgaccggcgggactgacggtctcagtataacatggtctttatgcaaatccacgatttttaacagtttttttacatgtggctgtacgtcctccgcatatttcagctcgatgccgtcgcgctttttgatgacgctcgcgatccctgccgccgacgcgtaactcttgatggccgccgcgacgatcaggttattgacctcttttggtatcttgccataccggtctgtgatatcggccgccgccgctttcgcgtcgctcacgcttttgacgcgggagatcagcttgtaaatatccatcttatccgtctggtttttgatgtagcggtcggggatataggccgggacattaagctccaccgccgtgtcgatgtccggcgtcacgcgcttgcccttcgccgtcgctaccgcctcgcgcatcagcttgcaatacatcgcgtaaccgacggtcgccatatgcccgctctgctccggccccaaaaggtttcccgcgccgcgtatctgcaaatcgcgcatcgcgatcttaaagccgctcccaagctgcgtgaattcgcggatcgccgccatacgcttggctgcgttctccttcatggtcccgtcgcccaaatacgtgaaataagcgtaggagttcttatccgaacgccccacgcgtcccttcaattggtataactgcgacaatccgaatttatccgcctcgtaaacgatgatcgtattcacagacggaatatcgatgccgctttcgatgatggtcgtacacacgagcacgtcgtactcgccgtcgatgaacccgccgaccacgcgctccaattccgcctcgcccatctgcccgtgcgccgccgcgacgcgcgcgcttggtacattccgcttcacgtctgataatagcttgtccatttccctgatccggcggcataccaaataaacctgtccgccccggtttatctcccgcatgaccgcgtccgcgagcaggccgtccgaatagcgcatgacgtacgaatacggctgtttgcgcatggcgggcggcgtgtctatggtgctcaggtcgcgtatgcccaccatggacatttccagcgtgcgcgggatgggcgttgccgacagcgtcagcacatccacgctctcgcgcatcagcttgatcttttccttgtgcgaaacgccgaaccgctgttcctcatccacaatcaacagtcccagatcattgaactgcacgtcgtttgacagcagcctgtgcgtgccgatgatgatatcgaccttaccgcgtttcaggtcggcgagcacttctttgtgacggcttttcgaaaaacgcgaaagcccggcaatggtcacgggaaaatccgcgaaccgctcgcggaacgttttaagatgctggcgcgcgagcagcgtcgtcggcacgagcaccgccacctgcttgccgtccatcaccgccttcatggccgcgcgcatggcgacttccgttttcccgtagcccacgtcccccaaaagcaatcgatccatcacgcgcggcgattccatatcctttttgatctgctcgatgctccttagctgcccgtccgtttcgtcatacaaaaacgcgtcctcaaactgtttttgccacacggtatcttcggaaaacgcatgccccctgctctcaaagcgctgagcatacaactccactaagtcaaacgcaagttttaaggcggattcgcgcgcctttgtctttgcggtctcccattccttgccgcccagcttggataattgcggcggcgcatcctcgctgccgatatatttctgtacgcggtcgatctgcgccgtcgggatatacagtttgtccccgccgcggtattcgatctccatatattcggcaacattgccgcccgcttccagtgtcttgagccctaagtatttccccttgccgtgtacgtcgtgcaccacgaaatcgccgggcgaaaggtcgctgaaaatatcctcttccgccgcggaacgcgcggcttttttgcctgccgtctttttatgtacgcgcccgaaaatatcgtttgcgcctaatatgatcatccttttggacgggatctcgaacccatacggcaaatattccccgcaaacggtcacgcccttttcctgcgcctcgtttgtgacgggcgcgatcaggtcaaaatccttcagcgcggtgctcaaagactgcgccttgccgcccgcgcacaaaacgaccccatatccgtgcttcaagcggtcctttaccgcctccgcgagcatatcgatgcgcccattgtagcccgccgcggcgcgcagatccatatccgcctcgcacacggtcttaaggcgcgcgttcctgccgcccgccatatcgaggatatatccctctttttgcctgatcacaggcgtcagcgcagagatgctctctccctgcacggcaaacgcttcgccgccttccgtaaggcgcttgcacgcatcgtcaaattccgtcttgagcctctttgcttccgcgtacacatattcaaaatcgtcgaacagcaaaagcgcgtccggaaaataatccgtgatatacgcaggcgcaaacatcaccggcaaaaacgtgtccgaattgtcgaaattcccatattcttcaatggcaacgagcagcttctcgctaagctcgtggttttcctgttcctttaaatagccgcgcagcttatcctttgcggaagcgtccagcacgacctcccgcgcaggcggcagcaaatattcttctatccgctttttctctgatttttgcgtctcactgtcgaaaaagcggatgctttcgatctcattgtcaaaaaaagtcacgcgcacaggccgtttgctgtccgacgggaagatatcgaggatctcgcccctgcgcgcgcattcccccttggaatataccgtccccgcacgctcatacccgtttcttgtcagcgtgtccatcaagtcttcgagatcgtattcctgtccggttttcagcaaaaagcacgacgatgcgaattgcccgggcggcagcatgcggctcaaaaacgtacgtatggaaaggaacaccacaccccttgtctgcgcggtgtttttgaggatgcccacacgcttcagttcttcttccctgccctttgcttctacgctgcgcagcgaaaaatcattgtccggaaataaaacgccgcccgctgctgcggccatgtcgcgcgcgccctgctccgtcgccgtgacgcacaagacctgcctgtgcgcgcttttcctcaatgcctgcgcgaaatacggttttgcgtttgccgtaacgccgaaaaccgagcaaggcaattgcccccctcggatacacttcaaaacctcttcaaatgccccgcttttttcgatcagcgggctgatcgtgtcgttcaaattatgtttctccttgttgccgtcggtcgttgcgccggatcagtcgcgcttcttcgcaaccgtgatgcggcgtttgctcccgacgcctttgcgaacttgagagcaggctcgggatgcaaatgaccatccaaggctgcggatgctttggcagtaggctgttcccgtctcctcactcacccttatcgcttcatgccgcccttacgtgcaccattccgcttatcgggtggttcgtcgcctttccccttccgaactcatttcattcgagttcggcggggtccccatttaccgcctgcgactcgcttcgctcaagtcgcgcggggacccctatttattaaattccgcctgcgcggaatttacgccctccgtgatcacccgctcgcaagcatcggccgctcgctcaaaaagctcctgtgcgtcgccgcgtttttccttttcgaatttaccgagcacatgcccgacgaggtttgcctgcggcttgcctatgccaatgcgtatgcgcgtaaaatcgcccgatttcgtataactcaaaatggaacgcatgccgttgtgcgtacctgcgctccccttatcgcggatgcgcagcgcaccgaacgggatatcgatgtcgtcgtacagcacgatcaggttttcaaggcctgcattataataattgagcataccgtccaccgcgtacccgctgttgttcatatacgtcgtcggctttgcgagcatgaccttctcgccgccgatcatcccctgccccgccagcgcgtcaaacttggtttttttcagcttgatgccgtgccgctttgcaagcgtgtcgatggcgcaccatcccgcgttgtgccgcgtattcttatatttcagcccgggattccccagaccaaacacaaaaaacatacttatttcctcttatccgtccaattcgttttcaccgtctgcctgctccgcgcgatcgcaaaagcgcccgccggaatatcttccgtgatcgtcgaccccgccgcgatatacgtttccttgcccacgtttacaggcgaaacaaggttcgtgttacagccgatgaaagcatcgtcccctacgctcgtacggaatttcttttttccatcgtaattgacgaccaccacgccgcagcccacgttgatgcgctcgccgaagtccgcgtcgccgatgtaggtgaggtgcgacaccttggtgccgtcgccgatattcgaatttttcacttccacaaagtccccaatgcggcacttgtctccgatgtcggagcccgggcgcacatacgcgtacggcccaaccgtcgtgttctcgccgatcttcgcgtcaaggatcacggaattttgcaccgtcgtcccgtttccgatctcgctgccggcaatacgcgatcccggatacagcgtcacgtccccgccgatcctgctccccttttccagcgttacattcggatagatgaccgtatcagcgccgatcgtaacatccgcgtcgatatataccgcctgcggatcgaccatgctcacgccgtttttcatgtgctgctccgcgatgcgcccgcgcaagattccggcgcactgcgcaagctgcgcgcggtcattgacgcccatgcattcgcgcgcgtcgcccgcgatatacgcgcctactttttcgcctttggcgttcaatatccctacgatatccgtcaggtaatattccccctgcgcgttcgcaggcttaagttcctttaagcattccagcaaaagcggcgtgcatacgcaatagcacgaagcattcacctcgcagatcgcccgctgctccgccgtcgcgtctttttcttccacgatcgccgttacgtcgccaaattcgttgcgcaaaatgcgtccgtacccatatggatcatcaagctctgctgtcagcatcgtgcaggcataattgcccgcttccgccgcttccaccatcgccgccacggtctcctgcttaagaagaggcatgtcccccgcgatgatgagcgtatatccgtcaaatccttccaataaatgcgccgcgcacatcaccgcatgcccgcttcccttgcgctctgcctgctccgcatacaggacggaatcccccagccgctccttgagccggtccgccccgcgcccacagacgacgacgcatttttccatgtccgtcccgcgcacagcgcgcaacacccactcaagcatcgaaagccccgcgatctcgtggagcaccttgggcgtcttagacttcatccgcgttccttcgcccgccgcaagcacgactgccgcacatttatttcccatgatttgtttctccttcaaacatttttcaaacctatattattatacacaaaacgcaccggtaagcaaagcgcaaaaaaaaggaaccctttaaagggttcctttttttcgcttcgctgtgaatcaatactcgccgctttccgtaccaaacgtatccgtctgatcctcaggcatattttcatattccttcaatataacctgctggatcatttcacgggtgtcggagtttatgggatgtgcaatgtccttatactccccgcttggcgtcttcctgcttggcatggcgataaaaaggccgcttgcgccttctatgattttcatgtcgtggatcacaaacatgtcatcaaaggtgacagaaacgatcgccttcatcttgcctgtgccgtcgattttcctgatccgaatgtccgtaatgttcatattcaatcctccaccttgtcttgtctatgactgatactaactttatgcctataccacagcaaagtatattgcacaaaaaaacattcttaaatattctgatttttgttattctatcacaaaattttccaaaaatcaatatttgcgtccgctatcggctttttggagcgttccttttcctgttacatggctgaaaattcgatttttgtttcgctcagctcttctaaaacgaagattgagcggtattcgctgatacgctttttctgcggatatttgttgacgatggccgcccccgtgcccgccaccgaaatatggaactctcccagcatatcgctgatcgccttgatcgttcccccgccgccgataaaatcatcgatgaccagcgccttgccgccctcgcggatgagccgcttggaaagcgacatggtctgcaagcgccgcgacgagccggataaatagttgatcgaaacgacgctgccgtccgttaatttgctctccctgcgcgcgatcgcaagcggcaggttcaggatgcgcgccacgctcatggcgagcggtacgccctttgtctccacggtaacgataaaatccgcttttttatccatgaaccactcggcgatgatctgcgccatcccgtctacatagtaaggcgtgcagaacaggtcgaccaaatacatgtaaccgccgggcaaaatacgcgacgtatccgacattttttcgatcagctcgcgtatcagcgcttcgcgcgccggctttggcatgcgcggtacatagcggatccccccgtgcgcccccgcgaccgtttccacgtgtccgatccccgtatccaaaaacgcctgtttcaaaatggccgcatcctccgaaaggctggacttcgccgccccgaacaattccttgaaataatttaaggaatataatttgtttggatttttggcaagcagcgcccccatcatagcgattctctgtttcttccctggcataactatccccccatcgcacgtttaggttgcagaaatcttgtatattcagtataatagatacgccgtatcttgtatacggtgaaattttaccgggagaacagaatggatatagatttttcgaccttacaggataaaccgatccactttatcgggatcggcggctgctccatgagcggccttgcgcagatcatcagcgcaaacggctttaccgttacaggctcagatatgaaggaatccgcgttcacgggccagcttaaaaaacgcaacatccccgtgaccatcggccacgacgaaaaaaacgtacacggcgccgggctggtagtatattccgcagcgatcaagccgttcaatcctgaatttgcgtatgccgcgagccataacatccccatgctcgaacgctccaagcttttagggcttatctccgcgcattacaaacgcgttgcgtgcatcgcgggctgccacggcaaaacgacgatcacgtccatgctcgcgctcatcatgcaaaacaccgcggacgactgcacggtgcatgtgggcggtatggtggatttccttgagggcggcgtaaaaatcggcacaaacgacgcgttcatcaccgaagcgtgcgaatatgtgcgcagcttcttgacgctgcatcccacgcatatcctcgtcaacaacatcgacgacgaccatcttgactgttaccgcgatatcgatgatatcttcgatacctttgtggaatttatagaaaagttagacgatacgggcgtgctgctcctaaaccaatcggacgagcttgcataccgcctgaaagagcattcgccctgccgcgtcgtgacatacaacgacggtcccaaaagcgactggtacttaggcaacgtttccttcaacgaatttggattcggcagcggagatgtgatgcattgcggcgagaacctcggaaggctggagcttaccgttccgggcctgcataacctgcgaaacgccctcgcgtcggcggcctttgcctatgaagtattcggcgtagacgttgcgacgtcgatccgttcgctcaaaaattataagctcgcaggcaggcggttcgagttcatgggagagcgcagcggcgttaaggtgttccacgattacgcacaccatcccagcgagatcgcagcatgcctggaggctgccaaattggtgccccacaagaaactttgggtagtgttccagtgcaactcatacacccgtgcgcgcaccttgaaagataagtacgcgctgtgcttcaaagacgcggacgaggtcatcatgccggatatctatcccgggcgcgatacggatacgcagggcattcacgcacgcgatgtggtcgcggcagtcaatgccaattccgccatctgcttatacatcccgacgttcggggagatcaaggactatctcctgaaaaactggcaccctggggacatcgtcgtcacgctcggttcgggcgacgtcaacaagcagcaactcatattctttgaagactagcaagcaggcggggtaaaggtatcccgccttttttacagcaaataaacttatcgatgcgctacgcgctacaaaaaaagcgcctgctgcatagcagtttcttgcaaatgttgatgctcaaccatttgaaaaactgcaatcattatgcggatcggaaaggacacaaacggtatttatggattacgaaaagtttatcaactacttcaacgcgcatgacgaattcagcaaggaaagcggcgtgcgcctgaccaaggtcggcgaagggttcgccgaagcggagatggcgtatagccccaaacgcaccaatttcatgggcaccatgcacggcggcgcgttgtttaccctggccgacgtcgtcgcgggaacggcgctcctctcccacggcagcctgtgcgtgaccttaaacagcgccatcaactatatccgccccgcgtctgccggaaagctgcgtgccgtcgcgcacgaaacacattgcggcgccaagataggcgtatgcgacgtgaccattttcaatgaagggaatcatgtggtctgcacgtgtacgtgcaccatgtatatgacgggcaagcccctgcccgcaatttgcgaagaaggtgaaaatatatgaagaaaaaatatgcgtttgtcctgctgggcggcgaatatgatcccgcacagcaccgcgcgaagtttgaaacgaaaacgcaggttacctatatccgtaccgtgcgggattttgacgaagcaaaagaggccgtgctttccctgcaaaaagacggcgtaggtgcggtcgagctgtgcggcgccttcggaaaacagaaagcatgcgagctgatcgacgccacggacggcaaaatcgccatcggtttcgtcacgcacctgccggagcaggacgccctgtttgacgccttcttcacaggattttgaattttgccgtcagcggcccgtcctcagaataaaaacgacctgcgcgtaaattcgcgcaggcgttttttactgcttccattatacgttgttccctgccatcaatgcaatagtccgcattactttttgatgttcttgaacgcttccgcctgctgcctgatgcccacttccgccgcaaaacgctcgatgctggatgcgccgaagaatccatctacgcccttcgtgcggctgatcacatactgcgcgtcctccggctccgcgatcggtccgccgtggcagatcacgaaaatatcaggattgaccgcgcgtcccgcgtcgcagatcgcctgcacgcgctgcacgcaatcgtcaagcgtaagcgccgtctgcgcgccaatggacccctttgttgtcagtcccatgtgcgccaccaggcaatccgcgcccgcctgcgccatcttcgtcgcatcctcttcattgaacacatacgggcatgtgaacaaatcgagctcgtgcgcttttttgatcatatccacttccacgtcatatcccattcccgtttcctcgagattcgcgcggaacatgccgtcgataagtcccaccgtcgggaaattctgcacgcccgagaagccctggtccttgagctgcttcaaaaagacgtccatcagccggaacgggtccgtgccgcatacgcctgccatgaccggcgtgtgccttacgacaggcagcacctcgctgcccatttccacgacgatctggttcgcgtcgccgtacgacagcaggcccgccagcgagccgcgtccagccatgcggtaacgtccggagttataaataatgatcaggtctacgccgcccgcttcgccgaacttggccgaaatacccgtgcccgcgcctgcgccaaggatgattttcccctgtctgatctgctcttttaaccggtcgatcacttcttgtcttttcatactgctacctctcctttttcacattgatctcatctattaatttttgcgcggcagcccttgcgaactgcgcgtcgttgatatgacagtccatttcgatcagctccgctttgtcgcggtcgatatttgcgcggatcgcttcaaaaagcgccgcatcctcctccggcccgtaaaacggctccccctcttgatcgatcatggaaacgccgcgaagcggcagcatcagcgccgccgggcctgtgctttggcttactttttgcgcgatcacgcgtcccagctccgcgctttcttcctttgttgttcgcatgagtgtggtcgccgggttgtggcggtacaaattccgccctttatacttttccggcacgctgtcatacggcccgaaattggccatatcgagcgcgcccacggaaaccacctgcggtacgccgtattttgccgccgcatccatgcgctcccttcctgccgccaggatcccgcccaagagctcgtcgcaccattccgttgtcgtaaggtccaacactcccgcaaaaaagcctgatgcgatcagtttttccattgctttgccgcctgttcccgtcgcgtggaataccaacacctcatacccacgctcttccaaatattcgcgcgcgaaatccacgcacggcgtagtcacgccaaacatcgtcgctgcaataagcggcttcttttccactttttgctccgcttcaaatttcaacatgcccgccatcgcatgcgccgcattgctgaaaatctttgtggaaagcgagttcaggcccgccacatccacaatggatggatacatcatgatatcgctcgtgccgacatagaccgaaacgtcgccccccgccatggtggaaaccatgattttaggcacgccgaccggcaacgcacgcatgcccggcgtaacgatggacgtaccgcccgaaccgccgaacgacagcacgccgtcaaatttcccttcgcggtatagctgcggcaagagtatcccgatccccctggaaagcgcggccgtcgcccgcgcgcggtcttttgcctgcgcgattgcttcgatatcctcgcccgcagcacgcgccacctcgccgttgcttacatccggctcaaaggcggacgcgaatacgccgctgtgtatcgtaagcgtgccgatcccaaggtcatttaacagtccttttacatataaatattcggcgcctttggagtcaaaggtgcccacaagcgcaactgttttcatgtcatttcgctccattttgggtttgtatccagtataccacttcgcgcgcccgcgcactataccccagaaagtatttgcaaaaatatgaaaatgtgataaaatagaaaagtcctgaaaaaatcgaatatctgggtgtggcgcagtttggtagcgtgcttgaatggggttcaagaggtcgcaggttcaattcctgtcacccagaccagtaacggtgttcgtaaaggaagtgagaatctttcatacggacaccgttttattttgtgccgtattttagtgttacgccctgcctcgtgtcaatctgtacatctgttgcaggaatcggcaggatgtcgggaatttcgattgagccgatgcagtgataatgaatgtctatgtgctgcactgtaaaaccgtcgatcttctgcgcgtcgtgtacctctatgcactcgacaagatcatataacatttgctgtgttagcttgcgtatacgggaatacttttttactgtttctacaaacacatcaacgccctgcgctttttcggcttcccgttgcaattcggcttccaaagcattaattttgtcagacaattccgcctgttcctgctcatattgtgcggtcatcgttgcaaagcgttcatcagatattttcccgcaaacattatcctcatacatcctttgaatgatgacatcaatatcatcgagacgttttcgggcagttttcaggtctttttccctgcgcttgatctcaagttcagttttatcctgcgcgtagcccctcacggcagcttcaaaggtttccgaatatttgctaacaaaccttgtaagccgcttaatttctccaagtacgaccttttccagaaagtcagcgcggacatagtgcgaagtaggacattccctatgatgtttgttatatgcggtacagttaaaatacttgatatcgggcgtcctttggctaaaatgatagcctaacggtttaccgcaatccgcgcagatcagaagcccggaaaacatattccgttcgcctgtaatcgttctgcgttttttgatcctgcggcgtatttcctgcacctgttcccatttttcacgaactataatcgcttcgtgcatatctttgaatacaagcggatttttattcttgacctgtttcttattcttgtaactcttcgtaaatgtcttacaattcaccaaatccccgcaatattcccgcaatcccaaaattttaataatggtagtgctgttccatctgctgggcttttcgcttcgattcccgccctttttgatgcctttgctgattgcgtaattcatgggtgtcggtatgcccgcgctctcaaggtctgccgcgatctgtgccgtgcccctgccgtcaagataggcgttgaatatccgttctacaatatgcgctgcttcctcatcaacaatccagtatggcttaacattttccgggtttttcatatacccatacggcggtttgccgagcggtatacctgcctttgcttttagttcgttgactatcctgcgctttttgctgatgtcctgcgcgtagctttcgttgatgacgtttcgcagtgcaacagatatgaggtcaacgccctccttgctgtcaaagccgtccgacacggcgactatgcgcacatcgttaaaatcaacacattgcttgatgaacaagccgacttccagataatccctaccgagccgcgagaggtctttcacaaacaccgcagatatttttcctcgttccatatcggcaatcatgcgctgatactctgggcgttccaccactgtgccggatatcccatcatcggcgtaaacctttgttgtgtatccctgttccgtggcagctttttctaatagctttttttgattctgtatggaatagctgtcgccttccaaattatcctcacggctcaaccgtaaatacagagccgcaatattactatttgaccgtttcaaaattacctcctttcgcggtcaatagcagcatttaactgctattattatagcatatccagcggctatatacggtcactttcgatgttgtttttcatcattttcaggataagcgagccaagcgtttcgttgccatcggatttaaagtgcggtgtgacaatataccgccgactaccgtattcgtaaacggcaggttgcgtaatatcttttatatagttgtcggaatcacgcttattcataacttaatacggtttattgcccgtctcttgaaacaggtcgtcaatcgtccgttgttcctccttggtaatcgcttcaatatctcctgcgccggacaaatattcctgcgtcgtgtattcgcggcggcttccatccggcaggaagcgcatcactttatggattcgacggaggaacgccgtccatacttcgggctgtgtttgttgctcgtgcttgtattgttcacggatatccaagttgcttataatatatacgcgatcataacacgcctgcttattggaatacctggcgggcagggcaagcggatagccatccagataattattcatatcctgaatgcgaatcccggagcaaaattcatcaaatagcatgacgctttcgcccatatagccatcaaacggattcttgtagttgttcactgcatacacatttgaatacccatagcgttccataacgtagcgcgtcttacctgttgcggtttgtccccaaatatatgttacatggagatcgcgccatttatcccggttttcctctgccgtgagcgtttgccgtacatactccacatcacgcatcccgcgcaggtagaagggaaattccataaggatttcggcattggtcgctccttcctgtatacggcttatgatcctgccttcaatggaataccctccgctttctccgggaagttctccccattcctcgaaagtcccttccatgacggtttcctgcttttgcttatcctttttccatttcccggacttctccacataggcgcggttctcttggcatgaccctttggcggcttggatatttgccgccggaaaataccgcttaactgtactgaaccgaacgccgcccgtaaatgccatgaacaaatgcgtatgcagcgtctgtcctgtttcatccgccatgcagtaatatatcatggagcggaaatgttcatgcaggattttcctgatatgctcatgggacaaaccgcttgcatcgggattattgattgtaagaagccattttctggcttgcgggtctttcgtcattctgtatctcctgtatttgcgacaatgcgacgcttgcgacaatatatgtcgcgggcttgtgtcgctttgtatatgcgggtttcagccgttttgcgacagattgcggtaatacttacgcaatctgccgcctgcggcggcgagagcggcggctcagggcttcgccccgccgccgctctcgataccgcataggttttcataaattaccgcgtttagtttctccatatctccaaccgtaggcactcgcacgggttgagctatcccgccgttaaaggcaagccagccaacaccccttccgccgacaggaccaaaccgcttcatacgctcccggctatccccgtcaaaaaccatattctgggtttccgaaccgctatccccaagcaagcataccgctccgaattgttcccggctcgcgctgccagatacgccgaagatttgcgcggagggctgctgtgttgccagttgtacggaacaatggcgtgatcgggagagcgacagcaatatattcagcttgcgttgcgcttcttctttttctttcttgccgtctatcaaattgacgagactcgcaaattcgtctacaaataaaatcttgagattgcgcgttttgtcctctccgctcttgcgtttcacgtatgcggcaaaaaagtcatccagcccttgcggtgcttcatctccacgatagaagcacggaagtccgcttagaaaattgaaatcattatcttcctttgggtctattactgttatttcaactggctgcaactccggcggcgcgagtaaaattgtacgggctaacagcaattttgccgctactgtttttccgctcccggtacgcccgcaccacaagacatgagcggattttgaataatctattttcatccattgttctccgcccatgcggtgcgcgttttcatccagcaggaaaggaatatcgctcataacaacacctattttctgaaaagcggatcttcgggcgcttcatgttctattggttttgcacctgatccaatatgaattacaatgtatcgtgtatcatttccgcttctcccgccattttctatttcgcccagaatatgcccgcgcagaaggtgtgccacattctcgcgtttttctatccaaacatcacggcttacccattccgaaaaaaatacatactttattgcgccgaatgttcccactggctcgcgagaaacataaataggcgtgcgcccgtagctaacggtattccgaaacacctcggcaatccctttttctatcctgctaacattgcgcggagtaccgatcagctttaggcagattaacaatattagcacaaagagcgcgaccataataatatgaagcgcgtaagtaagtatagcggtgatagcactcggaaatactgcgaggttaaccgggagtataccgatgattgcatcacgattttgccagcatagtatgaacacagctgcaatgatagctggggctatgatcttttggggcgctcgtttgatttccacaaagctgtgtttgaggcgaagggcagtttgtttcctgcgccgttccgctttccggcgggctttttcatcatctgttatatggttttccatagtattttcctttctgttatatgagaaagggggaatccccctctctcatataaagcaaatcagcctttcttcaaattaatctcggcagtgagaatggttccaaccgaaaagctgcccggtataggctgctcccggctgtctgtgtttgcaatctcatacggcaggccgcttttgttattcccgctggcgatctcagcaatccgtgaaacaggttttcctgtctctttgtcaacccacgttcccagcacgacatatttcttctccattcgcctttcctcctttccgtcgttatatatttctctctatagagcccctacgtcatatctatcccccctcccgacccgttcgggctgtctttaggataacaggggaaactgcggatttggtttcgtgcgcgaaacgcggaaaatatcccgccctgttttcacaaggcgggagtcctgcttttttattccatatcctgtatattcgcgccccacaacggcaagccgttattataaagaatctcgttgcattcgtgtatgtcaatcccgctgtctaagtaatcccttaaaaccagcaagccgggaaacgctgcgaaaaaaagttgccttgtcttttcgcggttcaggttcaaaccaacgcacacagcgcaaatcgtatttatgcttgacgtatatgcattcccataataattgttgttatttactattttgctgatctgcggccgtgacaagttgctcctcctccctaattccgcttgggtcaatccttgtttatgcatttcttttttgacaatatcgctgaaactttgggtcagccgatactcgatgttcattttgtttgtccattgaatggacgcgcgcgttcatattactcctttctgcaaggcatcctgcaaaaatgcagtgcctatcattgaattagccgcctgcgcattaggctaatataaaatttagcacgattctttctttgggtatgcgacaacaaaacacaccatcgtacaaaaagatacaaatgcgtacatttcttccttgacttcatctatacagcgcgataaaataaacgaaaatcaggaaatatacggaggaattatgcatcttaattttagccagtttgcccagcttctatatccgtactgcggtcaatatgatacgaaaagtaaatttgttattacccttacaaacaaattgctgaagtgaccctgaatttgtaataaggacggcaactatgctaacccgtttatgaataaatcaagtaattatcttggaaaatttttccggggcgaacgctccaccttgccgcgcaaagatacgaatgtgcttttaggtaaattagataaatataggtttgaaagctttatcagggaattttcagatgatgcacagcgcaaccttgcagcctctttcaacaaatgtggtatttcttccgtcaatgaaaaaaatgtgccggaaagatgcgccgatatatttgaagatattttgaaaaatggaaaatatgaggaatagggcaagtatccgcggtatgacttgctcccataatggatagacatatttcaattaacaaaggcggctgtaagtaaaatcagccgcctttcgcttattactttattgttttgttacgcgctgtgctgtttctgttttctccacataaatgtaatcgtaccaaccgcgccagccgcaatgacaatcagaagcaccaacggcaaactctcatcacccgttttgggagctttcgttgttccctccgctgccgcgctattggctaccacgctattggctaccacgccaaacggcgacaggctcgatgttgtaaacgtcaaatagccatccgctaccgttccggataattcttcaatctgcccatcggatttataatgcagcaccttcatcgtcctgccgttatatgcttcgccaacccatacggaaacagttagttccttgttatagtcaatgtgctgtcctgaaacttccagtgaaatatccttgagccatacgaattgttccccggacgctaaagcgttctgcatcgcgtttacgattcccgcatcgtcgacatcattgacctcaactgtggagccgagcggcaaattgccctccgctgcctgcatcttcacgctgttatcgctgcttgcgttgactccctctgtgtaactaaggttataatattcgggtaaatccaaagttacactgggagcatcgcttgcatagtagagcataccgtcatgcagaggatgtccaacccatatccattcgggataaagaggggtatatgtaccatgataaactgtatcttttatacgtacttcctcatccatatttaactgcagataaggtatagaatgtagagtaatcttaaaggcggccttataatccgtggcgttatcggtcagtaccgtgagttgtccgtcccacacgccattgctttcgctcgtcatattcgagatggacaagccagcagcaccgccttcgccaatccctatattatccacaatggtaaattggctccaccagcagtttacttgaatatccaactgatcccataaaggagaacctatctttttatatgatacttccccggtaataacaatcggctctccgtccacgacctgcggttgattgacggaaaattctatttgcaaatccggtgcgataatttcaacagctttgcgggaagtatctccattgctaacgaggcaggaatatctgccataattctctgtagtcatggattcaattgtaaaggctggctgatctgaaacaacgctacttttgctgttccacgcatcattggtattaggattgccgaatggtagaaatctccattcataagtcaaggtatctaaccccgtcatatccgaaggaaaattgacggccatttcaattttatcattagggcgcacataagggataccttctcttttttcgccgtttacagtagtttctatatctatatttgctaaactacttaaatcaaaagcggttgcttctattgattgcggctgtgcaccttcatccgccgtgggaacaaacgtttccgccgggttgcctattgcgtttgcgccctccgcaggaggtgcggaaacagtttccgtcggttgcggttcggtgcttcccgccagattcgggtcagcggattctgtcggctgtggatttaccgattccgttggttgcgggcttgacgattctgtgggctgcggctgggaagatacgctcggaaccggggtttcggttgccgtcggtgtgggctgtaattcgccctcctgcgcgaagctcaccgcgaaactgctgaataccagtaatgcagaaagcagcgctataagtacaattttcattctcttcattttctcttgactccttgccctttcagtatttggtttattaaaaagctgctatcaccataatataacgtattttgcgtatcgtcaactagtatctcgttatttgcatattgttttgtacttctcttctacaataaatgaaagaggtgagattatgacttttggcgatacattacgcaatttaatagaagaactggatattacacagaaacaattagccactgatttgaaaatagccccatccacaatcggtgggtatgttcaaaatacgagtgagccggacttttacaccttaaaggctttggcaaaatatttcaatgtttcattggattacctgctcgacttcaaccgatctgaaatcacaagcactcaaaatgaaaaagagcttctgcgcatttttcacaccttgaccccagagcagcaggaattatatattgagcagggcaaagcttttgtgcgtattaatcagaaagaaagggtaaaggcttccgattcaagtcgaaaagtgtcaaataagtaggataatacttatcttagaaaaaagccaagacaagtgctatgtcatatgttatgatttattctgaggtgaattaaatggtttttccttctttggtaaagtatgtacgcgaagaactaaacattagtcaagaggacttagtacatgaactaaaatcagctttgctactattaataaatgggaaaatgaaaaactcatcccaaataggatggcaaaatcagttttttgattactgcaaatgtaatggtattgatgctacaagcctgtcatctgaaaagaattaataaatttcatatattaaaaaaattcggaaagtattaggcctatatcgtaccacaactttcgtataatgaggtgcttttatgttattaaatgagctgtttcaaaacacaagctatgatgatgtgcaatttacagaagatgaaaaagctgggttagaaagcaaaatatttctaaaaacagttcgagagaaagaagttccttttgttatttgtgcaattcgcgataaggaagtcaaacttacaccagaagaagcggttcgtcaaatgtatgtcgataggcttataaatcattatggttatgcaagagaaagaattaagctggaattacctgtccattttggaactgaggtaaagcgtgcagatatttctgttgctgacaaagatagacctatggttccttatatcattgttgaacttaaaaaacctaagttatctgagggtaaggagcaacttaaatcatattgtaatgcaactggctctccaattggcgtatggacaaatggagaacagatttcatattaccatcgcaaagatcctaactattttgaagacattacaaatattccaaaatcgacagaaaaattagaagatattattaatgaacgtcttacctatttggagttaacaaaaaatgataaacttcaaaaagagaaaaaatcgcttaaagaccttatccttgaaatggaagatgaggttttggcaaacgccggagtagatgtttttgaagaagtattcaaactagtttttgcaaaactatttgatgagttaaccgcttcaaaagacgatactgcatatcttcgttttaggaacaatgggtatacagactttgagttgaaggagaaaattcaagaactctttgatgatgcaaaagataaatggtcgggtgtttttgaggaagataatagaattctattgtcgccttcacacttggctatatgtgttgcttctctccaaaatgtaaagttgttcaactctaatttggatgttgtagacgatgcctttgaatacctaatgagcaaatccagtaaaggcgaaaaaggacagtatttcaccccgcgttatgtaatagatatgtgcgtaaaaatgatgaaccccaaagcggatgaatatatggttgatactgctgccgggagttcgggatttacggtacatacgatttttcacgtttggaacgctattcgtaaggcaaaggggcttccaactggtgaaaacttcacaactgagcagagaagcaacgaagaaactgattatgtggacaagcgtgtctttgcaattgattttgacgaaaaagctgtccgtgttgctcgtactttgaatttgatagctggtgacggacagaccaatgtactccacttaaatacgttggattatacccgttgggatgaaataacgaaacaagaagcatggaatgatacctacaacaaaggttttagaaatcttaaaaaacttcgtccgaaaaaggaaacaggatataaatactttaaatttgatgttttgatggcaaatccaccttttgctggagacgttaaagaaaaccagataatttcgcaatatgagcttggcaaaaatgcaaaaggaagatggcaaagtaaagttggtcgtgacatcctttttatagaacgcaatttgaactttttaaagccgggcggtcgtatggcaattgttttacctcaaggacgtttcaataattccagtgaccaatttattcgtgagtttatagctgaacattgccgcatattagcagttgttggattacatggtaacaccttcaaaccccatactggaacaaaaaccagtgttctatttgttcaaaagtgggatgatgaactatgcccaagggtaaatgattacaatatattctttgccacaatgcagaaatctggcaaagataattctggtgataaaatctatgtgcaggatgagtatgtagactatttcagaatgaaatataaggatacagaggatattgaccccaccaaagaatttgaaggaatacaatctcatagatacactaagaaggagtttgttgagaaattcggagatgagaaaaacgctactttgtactatgataaagttgcaaaacgtgtattgaatggctatgaatatgatgaactatcggcaaaagaaaaaaagtattgcgcccgaaaggcctacaccaacagttacaaagagtacagattggacactcacggccatttaattgttgaccatgatttgtataatcacgatggattaacagaagatggaatagcagaagcatttgctgaatttgccaaaaaggaacatctaagttttttttgagtagcctgtcccaatcgccctttaatcgtgaaaaatatgagcgattgaaggacaggcttaaaataaatgaaatcagattgcaggactcttttaagaacaaagattttaggttggatagtggattctggacaaccgttattcctcataacaaaaaattaatatacacaaagataggtaacatccttgaaagcacacaatatggtatttcaattgaaatgaatgaaaattcccttggtactcctatttatagaatgaatgaaatacataatatgctttgtgatgttaaaactggaaaatatgcaattttatctgatgtagaaaagaatcaatttttactaagcaatcgtgatgtattgtttaatagaactaattcctacgaatgggttggaagaacgggtatctactattctaatagcgtagattcagtgtttgcctcctatttagtacgattaattccggacgataaaaaagtatcgccagaatacttgactgcattcttaaatactaagtatggaattaaagcaattaaggcgagagctaggcagtcaataaatcaaacaaatgtaaatcctgaggaagtaaaagaaattgagattccaattttgaatcaaactattcaagctaagattattgatagttttacacattcaaataggctaaggagccaggcagaagaaacctatctctatgctgaaaagtttttcttatgtgagatagagttgcaaagctatcaaccgtctaccaacgctgttacgattaagaaaaaagaccagtcttttgcaaagactggtcgactagatgcagagtactatcaacctaaatatgatgagttggaaagtaaattagctaacatactacaaaaaccgcttgttgaattggtatacataaaaaaatccattgaaccaggttcagctgcttaccaagagactggcataccttttattagagtaagtaatataactaaatatggtctttctgagcctgatatccatcttgcagagaatgtagttacagatatagaaaagttatatcctaaaaaagataccattctgctatcgaaagatggaagcgttggtattgcttataaggttgaagatgatatgaaagctgttacttctggggcgctccttcatctaaaagtgaaaaatacaaaagaggtcaaccccgattatttgaccttagtattgaattcgctagttgttcaaatgcaagcggagcgtgatgcaggtggttctattattcaacattggaaaccttcagaaattgaaatggtgcaaatacctattttagatatggaattacaattggaaatcgcatccaaagtcaaagagtcgtttgaactaagaaaacaatctcaaacattattggagaaagccaaacgcgcagtagaaattgcaattgaacaagatgaagatgctgcgctggcttatcttgggaggtgagattttggcatatcaagattggattaatgaaattgatattggggttgattactatgctgcttttataaaggcgtggatagcttttaattcatggtataaccaaaattactctgatgaaaaaacagatgcagcaattattgcgcgaatgcaactagatagtaatgattttagagtacatttgatgaacttgctaaagggaaacacacaagaagctgctgaactcaagtcaaatataggaaattttcatgaagcacttgtcaatgccaatataagaacccaggaacgtactggtaaagattatcaaattactttttcggaagttgctacagttaacaaaagcaatcgggctgatggaacataccgcggtgtcaaatatacggtcgaacggaaacgcgataaagttattactaaagttgttcgcctaagcgacaatgctaaccttttttattttgaacaagacatatacgatgaagaagaattgtctttgtgcagtgacttttgtaggttgacgccagagcgtaaagaacagtgcattgcattctataaaaatacgaatccttataaaataagaagtttgcttgttaccgagcgcccggaggataaagacaagtacaacttaatgggctcagtgcagtttcttcctgatgtagaggaaatcagcaaaggagttattgaggttttgtatgtaattcgctgtgcattaatgcatggtgatatatctcctaataatgccaataagaaagtgtatcgatatggctatgaaatacttacaaccgtattaaagaaattacgttaagtaaataggaaaatcaggggcacgacagccgattcaagccgtcgcgccgaagaccgtttcaaagattgtgtaaatctccgatagtctctcatgtagaagcgatgccaagttactgttaaatgccactatcaaccgctcaaaagcctttatttaatcacgtttctagtgtagttcctttatgaacacccttaccatttttgttttagatagcataataaattcttatattcccaaatctgcaatgacatcttttacgctttgtattttgttaattctatcaggattggtgctgcaaaacaaaagtccgttttcggtatcaccatttgcagattttattagaacttctgaaatgcagtattttgcagtgccgggatcacaggctttcaaacaattgtagcaatttgtaattttttcagagtcattcatcattctctctacaaacgaatttcgcagcacacgagcgggcattccaactgggctatcaatgattattaagtcagattttgttgcaaagatgtatgcgtttttatagttttcgtttgcatcgcactcatctgttgcaataaatctcgtcccgacttgaactccatcagcccccaaagacattgcatgacttacatccaccgaatcaaaaataccacctgcaacaaagacagggatacccttttgatatatttcctcataggtctttttgagttcaatcacctttttaaaatcatcctcaaaaaccttattagtttcatctagattctctaaactactacgtttgtatccttgatgtccaccagaatacggactttccataatcaaaaaatcagccgtggattgatgctttttatgccaaagattcagtaacactttagtagctttaaaagacgacagaacgggagcaattttaacatccgtgccttttgccaaagcaggcagttccaatggtaatccagcgcccgaaataattgcatcaacaccggcgctaatcgctgctctcacataatcctcgtatagctgtgttacagacataatatttacggcaattacgccattgtcctgtgcgagttcttttgcctttttgatttccacaggtagtgttttcaagtttgtttcttctggttgatatttaaaacgcggattgccatatcctatctgtgcactggaaataacccccatgccgccctcgtgagcaactgctcccgcaagccctgaacaactaataccaatccccatgccgccttgaattatggctttctttaagattaagttcccaatatgtacttcgctcatcttttctccttataatttaaggcaacatcgcacctgctcggtcggctattgccctctcacaatgtcccctaaccttttataaccccaaattgattatatcacgcttgatgtttcatatgctactttattagttaaacgccgctaccaaccgttcaaaatcctttattaatcacgttttagaatgcttccttcaggaacaaacaaggtgatcatgatatcccccaatccaaaagacgtttctattatacccctaagccccgcgttttcacccgcttttcgccctttattttagcgttttaccgtaataacgcacccatacgtaaaaattgtataaacgccttcacaatgcggcttatggcatttatgaattatcacatattcccatttaaattgcgggcgttttttattgaaatgccttaacgtgtgtagtataattgattttacaaagtgtgagacttatgatcaaatagcatgttttctttataaggcgcacaatagtaaaacgttttagaaggaatgaaaacaatgcctgcaagtataaaagatgttgcaaaattagccggcgtttcacaagctaccgtatccaacgtacggaccggcaacaagtacgtgaggcccgaactggtaaagcgcgtgaacgacgcgatcgagcagctcggctatattcccaacccgatggcaagccggctgcgcggcaataaatcctttgttatcggcgtaatactgccgaccttttaccacccgttccatgctgggatcttaaaaggcatccaggacgttgcactcggaagcgaatatctgatcaacgtatatgcgacgggcagcgacctcaagcgggaatacgattcccttgcccgttttttatatagcatgccggacgggatcatcatctcaagctatgcaaacgagcaaaacgaatacggcaaggagtgcctggatacgatcaaggctctcgtaaactgtaaaaagaagatacctgtcatcagccttgagcggcatcttaagatttccggtgtggagtctatcctttcggactatgagcagtccgcgtatgataccatcgaatacctgatcggcctcggtcataaaaaaatcgcccatatttccggcccgatggggcgggatgttagcatcaagcgttacgagggctaccgccgggcattaaaagaacacggtatcccctttaatccgtcctatgtgcgcgaaggcttgttcacgccggaaagcggttatgcctgcatgcgcgacctgatgctcaaaacggatatcactgctgtatttgccgccaacgatgaaacggggatcggcgccatcaaggcgctcaaagacctcgggcggcatatcccgcaggatgttgccgtgatcggtatcgacaatatttatgccgggacactcatagagccttccctttctactgttgatgtgcccggataccagatgggccgcatggccatgtcgaggatgcttgcgttcaccgacgaccaccagcttcccaactataaaaaaccgacgtatctgagcacgacgattatcccgcgcaagtccaccgaggctgaccgcgagaccacttgggatctgtatgattggtaataatacggttatcacaaacggcagtatactgccgtttttttgtttgcaaataaatatcccccatgccagtgcatgggggatatccttattaaggctgctatgcaaagcgtaaatgcctgtacatattgccttagataagaggctttaattctgcgtgatcatatgctgtttccttgtcattctcgattgcagtaccaggatgaccagcagtacgccgccggtgatgcatccttcccacagataggatatctggttcaggtttatgatgttgcctatgatcgtaatgatcatcgcgccccacatcgaattgagcactttgccgcggccgccggacagcagtgtcccgccgagcaccaccgccgcgatcacgtccatttcatagccgtcccccaaaaggatattgcccgaataggtacgcgccgccacgatcgcgcctgcaagccctgcgcatgcgccgctcaaaaggtaagtaaagaatttcactttgttgaccggtatccctttcatgaccgccgcttcctcgttgccgccgatagcgtagcagtcgcgcccgaataccgtgtatttcgctacgatcgccgcgatcacaaatgccgcgaccatgatgattgccggaatggggataggccctatcgtccccgtcgcgatcaccttaaaggacgccacggaaacagacagtgattttcctccctgcgtcagcagcaaacccaggccctttacgccggacatcatcgccagcgtgacgatgaacggttgtatcctcagcttcgtgacgcaaaagcccgtcagcgcgccgattcccgcgcacgcgcccactgccgcgatcgccatgacaaacggcgcctcgcattgtgccgccaccatgccgacgatcacggacgcgaacccgaaaagggaacctaccgaaaggtcaatgccgcccgtcaggataacgaacgtgccgccgatagccatgatcccaatcatgctcgcctgcttgaataggtttgcaatgttgttgaccgaaaaaaagttttcaaacgcaatggacgcgacgaccataataacgatcactgcgacaagcgttgcatttccgctgataaagtgctttaatttatttccctgcatcttttacgccccctttgccacagtagttttggcggttttgatcttacggcttttggcgcccttatccgactggatataaaccgccagaataatgatggccgcctcaaggagcatagaccaggaagtatcgatgccgttcatgttgaccgtcatggtgatgatggatatgatgaagcagccgatgaccgtcccgatcacgcgcggcttgccacccgccatggacgtgccgccgatgacgaccgcagcgatggcctgcatctccatccccgatccaaccgagcttggattacagttctgtgtgcgcgaaaccgccatcacgcccgcgagcgcggtaagcgcgcccagcaaaaggtatacgacgatcacgatgctgtccgaatggatacccgataatttcgccgccgtggcgttattgccgatcgcctcgaccgatttgccgaataccgtgcgttccgcgatgataaagaacaccactgcaaacgcaacgacataaacaagctgtatcggaaccccgccgaacgtcgtgcccgaaatcgccaaaaacgtttcatcgagtatctgcacggtctttgcattgctcaccatacgcgccacgctgcgcagtatgatcatcatcgcaagcgtcagcaccataggctgtattttgaacttgaccgtcagcacgccgataaacgagccgatccccgcgccaagcagcagtccgatcagcaggcatccgatgaacggcacgcccgcttccgccatcatagcgaccaccgtagcgcacagcgccatcgtcgcgcccacgctgatatcgatgccggccaccgcgatgacgaacgtcatgcccatcgccacgcacatgaccgtcgtggaatggatgaccaggttccagaccgtcgtcgtgctgataaagttctttgttacacaaagattgataacaagaagcaccaggaataccatgaccgcgccgtatttttttgcaaactcgctgcgtttcagcgaccggttactcaaatcctggatcttctgtaattctgtatttgaattttccattgattttcaccctctccgaattttcataaactatacggcgtgcgcttccgagatcctctggataatattatcctctgtgatctcgtcgctcaaaagctctccgacttcttcgccttccctgatgatgatgaccctgtcgcagtcccttgccaattcttccaaaatagaagatatcatgatcacgctgatattttccttggcaagctgctggatcagcatctcgatctccatcttcgcgcccacgtcgatgccccttgtcggctcgtctaagatgatgatatccggatttgcgcacaatccgcgtgcgataatgcatttctgctgattaccgcctgagaggaatttgatcaattgctttgcgcccggcgttttgatcttgagctttccgatatagtcctcaacgatctcctcctgctttttgcggtcgataaacccgcatttgctgattttctttaagatggacatcgtcacattatccttgattgacatatccggaaagatggcgtcgcgcttgcgttcttccgggcaaaggatgatcttatcggcaagcgcgtcgcgtacgctgcggtacttcacttccttacccttgacgacgatttccccgctctctatcttcgagcagccgaacagggcgtttgcgatttccgtacgtcccgcgcccaaaaggcctgccagtcctataacctcgcctttcctgagctcaaagctgacgccttttaatttgtcgccgtcgtttacctttttgaattcgcagattgccgtgctggtctttagcgcttcattgaattccttgcggaaattcacgatggacgacgcgtcgcgcccgatcatcttggagatcaggctcagcttatcgagcttgtccacatcgtagcatcccatatattcgccgtcttttaaaatcgtgaccttctcgcatatctcataaatttcgttcagcctgtgcgtgataaagatcaccgcgatgtttttcgcccgaagctggcgcacgatgtccatcagggacgatacctctttgtcgtcgagcgaggacgtcgcttcgtccatgatgaccagcttcgcatcctgcgataccgccgtcgcgatggcgaccatctgctgcatcgctgcggaaagcgtgctgatcgggagcgtcacatccacgtcgatattaaagtccttcaatatctcccttgcgcgcctgtttgtttccttccagtcgatgagtccgcttttctttttgatctcgtttcccaggaacatattttccgcaatgctcaaaaaaggcgcagtgttaagctcctggtagatcggctgtattcctgcggcctgcgcttgtgcaggcgacgtaaaattcacttcgcgccctgcaaactgtatcgttcccgcgtccctctggtgcagtcctgtcagtattttgatcagtaccgatttacccgcgccgttttctccttccagcgcgtgtacctcgccttcccgtacaacaagatccacaccttttagcgcgttcacgccgataaatgacttgcagattcctctcatctcaagcaatatggatttttcttcagacattataagcctccttgctgctagatttcatatcacggccggacataacccgtgccgtggatccttcttcacttttcccacaatctccggatatcaggactgccgccgaagcatgcagccccattccggaggataaataaagggaacagcggcttgccattccctttttcttctgccttgcttagaaagccataccgttcgtcagtgcgtcagccgcgtttttgccgtcgatgatctccgacgggatcgtcgtttccttcgtcaggttttcgccgttgaagtaagccgcgatcatggaatagatcagctcgccgttctgcgtatcgcaagtggaaacagccgcgatctcgccgtcaacgatcttctgcacagccgccttctgcccatcgataccgaggaccgtgatgtccgtgaggcccgcgttcttcagggatgcgatcgcgcccagcgccatttcgtccgtatggcagaataccgtgtcaaactgcccattatacgactggatgatgttatccataaccgtctgcgcttcgtccatcaggaagttgcctgtctgctgtacgattactttgtagttgtcgccgccctttgcgatcgcgtctgcaaaaccggaagagcgtccaatctccggatcggaaccgaggataccctggatctcaacgatgttcgcgctgtcgcggttagcggtcagccaatcgccgcaaacgccgccgtctaccgtatagtcaaagaacgttcccgcaacgaactggtcatcggatttggcacagtcattgccgagaaggaataccggaatattgtgttccttggcgatttccaaggccgcctgtcctgcttcatattcgatcgggggataaacgatacagtctacgccctgcgcgcaaaggtcctctacgtcggaaatctgttttgcctggtcgtcgtctgcatccgtgtaaacaagttcgatatcgtatttctcagcgacttcgatcatattattgagttgtgcgatcagccatgcgccgttcgtgttgcgttccgcaaagcccacctttttaccggccagcacgctcatatccgtttcgatcacctgcgcaagcggacggtcaccagactcggccgtttcctgctccgccggggattctgctggagcagtactctcctgtgttgccggggcagacgtgcaagctacgagagcaaaacacaatactactgccagtaccgcaaataaaactttcttcatcttttcctccttttttgccatatttcctatggcatccttgcttttttattttacggaagcacctgcatctggcgataataccttctctcccgcggtatttgctcttcgccgccgcagtgcttccattttgagacgcagttggtaaatccttttactttgtgttttaaaaaaacgcaataatttaatccgataggtgtttttaccccttgtttttgatttttttgtgatttatggaattatttttcgcttaatgtttaatttttctatgaattatttgcttatccatgcaagcctgttggtaaatcgtttttacaaatctatcctaacatatacaccctagcctgtcaacactaattttccgctttcaggatatttttttatatttatccaatcgctttacatctgtaaaaagttattaaaaaagagcctgatacaggctctttttattcgttcttttttgtcacccaccgatttcaacggtgatttccatgccttccagcagcttcgtcaggtgccggacctgctcgtccgtgggcgtgtaaaaatcgtcgcattcatattccttgcccaactttttgtattttggttccccaaagcggtggtatggcagcaggtgtatctccacaaggccgatctcctttgcaaactcgcccgttttcctgatattttcctcgtctgcgttcatgccgccgatgagcggaatgcggatgatcatctttttgcctttgcacgccgcgatcttccgcgcgttttcgagtatcagttcattgcccattcccgtatacttttcgtgtatactgctgtccatgtgctttatgtcgtataagaccgtatcgattttgcacaccgccttttcaatcttctcccacggcagcgcaccgcaggtctcgatcgccacgtcgacgccttcgccgtgcagcgcgtccgtcagttcgccgataaaatccgcatggcaaagcgcttccccgccggagagggtcacgccgccgcccgactggtcataaaattccttgtccttgagtgccagcttgagcgcgccctccaccgtatatcttttccctcttaatttgagcgcggccgtggggcacacgtccacgcaggtatagcatccgtcgcagccttccacaaagacgcccggcgtacggcgcacatgtgtcggacactgcgcgacgcacagcccgcagcccatgcactccgcctcgttgaattcaaattccggctcaaatttctgggattccggattagagcaccaccggcacttcagcggacaccccttgaaaaacaggatcgtgcggatgccgccgccgtcatggatactgtatccctgggtattgaatatcaatgcttccataaatcattctccatcttttttttcagatcgccgcgttttccgtgcgtgtgataatggaatcctgcacgtcccgcgaaagctcgttgaagaacgcgctgtatcccgcgacccgtacgacaaggctcttgtatttgtccggcatctcctgcgcttccttcagcttgtccgccgaaaccacgttgaactgcacatgaccgccgcgcatcttgatatacgaacggatcaggctcataaacttctttagcccttcctcgcccgcaaccaccgtcgggttgaatttctggttgaaaataacgccgttcgggcacctcagatggtcaaggccgtagcataccgatttgagcgcagccgtcgggccgtgcttatccacgccgttcgaaggggagacgccgtccgcgagtatcgttccggcaagcctgccgtcgggcgtggccgccgtggtgtagccaaaggcaacgtttgcggcaaccggtacgaacgagcctacgaacggtccgccatgatatccttcgtagccttcgagcgaatcgaaaaatacatccgccgcataatgcaccatcgcgtccacttccttctcgtcgttgccgtatttttccaccctgttgaagaggtattggcgcattggctcctcgccttcaaagtttttattcagcgcgtcgcacagttctttcatcgtatattttttatcgtcgaacacaacctttttcaccgcgtaaagcgaatcgcccgcgtttgccacgcccaggccgagcggcgccgtccagttatatttcgcgccgcccttgagcgcatcctttccgtgctccaagcacgacggaccaatgagcaacgaggtaagcggtatgggcatcagctccgattgcacctcgtccacaatcgcgttcaagcgtacggacagcgtggtcgtgtaggccatctgctgctcatatgcctttttcacatcgtcaaatgtttttaggtcctccggctttccggtatgcgggccgacctgctcgtgacagatattgcacacgccgtcgcttaaggccagttcagcgatcttcgccacgttataatatccgccgttgcccctgtgccatgcgtcaagcggcgcgttctccacacagccgaccggcgcgtaatcgcgcgcatcctcgagcgtcacacccaggcgctgcatcgcctcgatatacacctcgtcgtttaatatctgcggcatgccgttgcccatgcggatcgcttccgcgaccttttccatgaattcatctggcgtgccgttgtgcaggcgaacggaaaaattcggctgcatgagcaggatgtgcgtatgcgcttccaggcaccggtatgaaagatcgttcgttccgtccgtgccgtcgcgcctgatcccgccgatcacgaggttctgccccatcggataacccgcatggatcctcgcgtccgcttcacggtataccttgatcggctccgtgatcttcacccagaaggcttcgagcagttcctgcgcctgctgcttggtcaaaacgccgttttcgatatccgcggcataatacggatacatatactggtcaaaacgccccagcgtataggaaacgccgttgtcgttgatttgctgtaccacctggcagaaccacagcgactgcatcgcctcatagaaactttccgccggaaattccggcacgcgcatacatacctgcgcgattctttcaagctcagccctgcgcttttgatccttctcttcctttgccatctcaagcgccttgtctgcgtaacggtgcgcgaacatgatcgtggatttgcagaaactgatcgccgattcgtaccacagacgcttatccagcgcgtccggctttgtcatgtcaagctccgcaagtttctgttcgcattttttgataagtccgcccaacccttcgcggcacagcatcccgtaatcgagcagcacatgcccaaggccgccgtcctcatgcagccccagcgagaacacgtttgcgtcataacgctccaaacggatatcgtccgtgatataggactggatacggtcatacatcgttttgcccttccaataaggaacgatgtcgcggcggtattcctcgatctcctccttgatgggggtaaacgaatcctgcggacgctcctcaaacgtttcgatctcctcatcgatccattctaccgcaaattccggaaaaagcggcgcgctgcgctgtttgcccgcctggtgcccgacgatcaactcgtccggcaggatatacacggacatgcccccaagtattttttcaaaggccttcgcccgccgcatcagcggatgcaggccttccgtttcctgataagactgcgtaatcaatctcgcgcgttccatacagatataagatttcgcgttgacgacctggctccttaaacgctgacaccgcgcgtatgcttcgctgtttgtatcaaatacagcgtcgcggtctaccggtactgcgtaagtatccctaacctctgttttcatttttctacctcctggctttcttcgatttccttaaaagatgtttgttacacatggtaaaacgtttttctattatacaaaaaaataaactctctattcaatttatcatcattttttgatctattcaaaccgaattgttggaaaaaccttttactacactatcatatcctgtgctccctcaattgtcaatatccttttttcatcccctacgcgtcttcccgataggccacgccgtccatcctgttaatctccggatccgtccaaatgtcgagatcgtctctgttatacgacgaaaactcactgatcacacacccttcgccgcccccgcatatccagtgcgttacattgggtttcaccgtgaattgttctccttttttcaggatcaactggtggaatacacggaagcaatcctttttatcggcgggaatcttcgccctgatctccgcttgcggggtcggctcgccttccgtatacacatacagcgtaccatagcgtacgcggaacgtttcctctttgccgatgttgccttcaaacggcgggtggcactgttccggacagatctgtccgggcagtaataccatttctttggcggcataacgcttgttgttgacataaatatgtatctggataccgaactcgtcgatcctgccaagtcccatatccgctatctcgagattttctttttcttcctccgtcaggtaaatatgcgctttttcgcagtattccagcgcttttttcctgatttcttcccttttttcccctgaaatggccataacaattttccccctcttttaaaaaaaacgtttttctttcctgcgattttatattataatctatttgatgcaatgtcaataccataaaagcggaggtactatgatgaatcttgattacgaagaaacccgcccctacatagggcacgattaccagacctttgggatcaggcgcgaaatgctgctagacggcaaggaggacggcgtaaagctgctgcgcctgaaaaacggcgcgcaactgcaggcggaggtgatcctcgaccgcggcctttccttgggcgaggtgacctacaaagggcttaatttgagcttcctgtcccataccggcatcgttgcgccttcctattacgtggaaaacggcaaagacggattttataaaaacttctttggcggtatgatgatgtcctgcggcatgacgcatatgggcgctccctgcgaagatgacggaaagagcctcggcctgcacggccccatgccctgtacccctgccgaagaggtgtgcgcagacgtacaaaaagcgtccggctccgcgcctgagatcgttgtgcgcggcaagctgcgccaaagcgaggtctatgcggagcacttggtgtgcacgcgtaccatccgcttgaaatacggcgaaaataagctcgtgatccacgacgagattgaaaacgtggggtttgaaaagcagccgtttatggtgctgtaccacttcaacttcggctatccgctcatcagcgaacatacaaaggtcatccttgccgagcaggaatgcaatgcgcgcgacgagattgcccaaagcggctatgacacgcgctgccggatggacgtaccctcagcgggccggctggaggaatgctttttttacaagctgcggggagatcagggcggcgatacgctcgttctcgtggaaaatgaagcgctcgggcttgccgccgcgctcaaatacaatgtccgccagcttgccttcatgaccgagtggaaatccatgatggcgggcgattacgccctcggcatcaatcccggcgtctatacgcccatgggccgcgcgcatgcgcgtcaaagcggcatgctcttatacatcgaaccggcggaggtcaaatcgttcgacttcgaactgtgcgtatcggacgatgcccgcgagatcgataccctacgggatgcagtaaacatgctgtgatcccctaaataccaaaaaacctcgggtgatccgaggttctttattgtccggtatgatgccgcgcggccttgcccttcctactccttgaagaaaaactccgcacgtcccgttccgagggattccccctgcgcccagtcgtttgccgtgccgacctgccactcttccttgagttcgccgttttccacgcggttaaaacccgcgtccttgttggcgatgatcaccgtaccgtttgcaagcgtgtattcaggccttccgtctacctcgcgcctgcccgcgatgctgtttccttcacggatcgccgcctcctttgcctgctcgtactgatcttccggtacttccgtatatcccaaatagaattttgtcgtcatactatttcccgcctttcttattttttatccggtcggtatatttataacggcatttccgcctgtttaaacaaagaagccgcgcggctgcacggccgcctctgtcatcagctttacaaagcccttggaatcgattttttttgcaagccatacgttcggcttcctgccccacgcgccggaaaaatcgacgacgctctcgcctgccgtaatgccctgcgtgctcacgtccatgcataccttttcgtattccacaagcccggggcgcagcaggctgccgatgcataccgcgtcgtgcaccggacaggcaaaaaagcccatttcctcttcgtacgtccctgcgtacagccacaaaagcccgcccacaagcctggatagcttgccgcgttcatgctcttccagccgctcgatatcctctttgtaaaaaagcgccttcatcgtgacgtcgagcgcgcataaatatatttcacatccactgtttataacgatctgcgccgcttccggatcgacaaagaagttgaactccgccgccgagtttacgttgcccggcgcatagaccgcgccgcccatgacgacaatcctgtccacattttccttgcatgcaggttccttcaaaaaggcctgcgcgatatttgtgagcggtcctaagcataccagcgtgaccttttcttccgaccggcgcagcgtccctgcgataaagtccggcgcatgcatgctttccggcttgcgcgcatgcacgtcgatctttttattccccaggccgtttatcccatgtattttcacgcccgaatcgttccggaggggcctttttaacgggccggagcaccccgcgtagaccggaatatcctccgcatccgcaaacgccagtatatccagcgcattgtgtacggtgttttccaaaatgctgttccccgcgaccgccgtcacccccaggatattaagctcttttgcgcgcgtcgcaaggatcagcgccaccgcgtcgtcgtgccctggatcgcaatcgatgataatgttccgcatgatgccgctccttcctttttcttattattatagcagaccgccgtgttttaaacatttgatttgcacattttccttaaaatctgatatttttgccgcaaacggtttaataaaaaagtatgagcaacgcttgaaaggaaaccaagatgccgaaccgtaatataaagaaaacagtaacaggccaaaggacgatcgacggcgcgggcgtacatctcgtgcgcgtgatcggttatgacgataccggcgatttcgacccgtttttgatgttggacgcatttgattccacaaaccctgacgattacaccaaaggctttccgtggcatccgcaccgtgggatcgagacgctgacttacctcatccacggcgatatcgagcacggcgacagcatgggcaacaagggaagcattcgtgacggcggatgccagtggatgacggcgggaagcggcgtgctgcaccaggaaatgccgcaggcggcggatcatatgctgggattccagctctggctcaacctgcccaaggcaaacaaaatggcgcagccaaactattttgacatcacggcggatatggtcacgaccctaaagcacgaaggcggcgtcatacgtatcatcggcggttcgtataacggctataccggccccacgcagggcaaatatgtaaagcctgatatcctggatatttcccttgatccggacgcgcggctttccttccctgccgcaccggaaaaaaacgtgttcgtatatatcatatcgggcagcgcggcgttcggggacaacagcaagcaaattccgtcgcgtacagcggcgctctttggcgagggaacggattttaccgtgcatgccggaaacagcggcgtacgctttatctattttgcggccaaacctctgcatgaaccggtcgcctggggcggccctatcgtcatgaacacacaggaagaactcaaccacgccttttcggaactggagcaaggcagctttattaagcatccttaattcttttccctcctatataccataaagagacggcagtcatgccgtctttttgtttttcaaaaaatagttgcacgcgcaatcattacgatgtataattatataagttgcaaacgcaactatttttttgtaacgtaagaaaggatttgccatgaaggaaaaatactcgctcagtaaatatgcttcgatcatcaaccgcttcagtatgcagttttttgaccaggagttaagcgactcccaaatcggggcaggacagtatttctttcttgcgcgtatctttgaacagcagggcatgaccgcccaggagatcgcagccaaggggcattttgacaaggcgacggccacccgcgcgctgcaaaggctggaagagctcaactatatccgcagggagacggacttaggcgataagcgaaagtgccgtttttataccacgcttgcggcaaggccgatcgtatccagggtttatgccgcggcaggaaaatggaacgatatcttaaagcgtgatatggctgcggacgaaatagcggcgacggaaaaagctatggatcaaatggcgaaaaacgcctatgaatatatttcaagtttgattgagggggacaaataatggaagaagcaacgatcaataagccaattgccgaaaccaggaatccgctcggctataagcccatcggaaagctactacggagcttcgcacttccggcaatcatctcctgtctggtaaattcgatctacaatatcgtcgaccagatttttatcggccagggggtcggttacctcggcaatgcggccacaaccatatcttttccgattatgacggtgctcgcggcctttgcaacgctggtcggtaccggcggcagcgcatacgccgccttgaagctcggcgaaaaaaaagaagaagccgcgcaaaaaacgctcaataacgtatttgtgttatgtatcatcttgagcgtagccatcgtcaccgtaggcctcgtattcctcgatcccatgcttcgcatgctcggtgcgacggacgccacattaccctacgcgcacgactatgcgttcgtgatcctgctggggacgcccttttccctgatcagcatcgcgctttccaacatggcgcgcacggacggcagcccgaacttgtccatgtacagtatcctcatcggcgccgtgctcaatacaatactggatccgatctatatttttgtatttcattggggcgttacgggcgcggcgatcgcgaccattacctcgcagctcatttccacgatcgtactcgtggtatattttgcccgaaagggaaagagcatgcagttccacaaaaaatatatgcggctttcgggacgcgtatgcaagatgaccttcacgctcggcatatcgtcctttgtgacgcaggtcgtcgcctgcgttatgcaggtcgtcatgaacaatacgctggtatattacggggatcaaagccctgtcggcggcgatgtcgcgctttccgccatgggtatcgtgatgaaagtggccatgattctggcgtccgcctgtatcggcatcggtatcggcgcccagccgatcctgggctttaaccgcggcgcgaagcagcccaaacggatcaagcagacatacgtgatggcagcgtggatatccacagccgttgtgagcgtggccgccatcttgtgccagcttttccccgagcagatcctgagtcttttcggaagcgagaatggggattttacagcgttcgcggtaaaagcgatgcatatcgcgctgctcggcatcttctgctccggtttccagatcgtttccaccagctatttccaggcgacggggcaaccgctcaaagcgacgatcctttctatgctgcggcagcttctgctgctcatccccatgatgctgatcatgccgcttttctttggtttggacggcgtactgttcgcctttcccatcgcggatatcggctcggcggtgatcgtagccttcttcatgatctatgaaatgcggaagctgaaccgctggatcaaggaggacgagtcaggcaacctgtgcatggcgggcatataaaacgcgcagaccatcattctgccaatacgaagaaaggccggtactgcttactgcaatatcggcctttttgatttctattttacgcttcgcatttgaccgcttcgtcaaactctttttggatctccgcagaaggctctttgtctgccaggctcacgatgacgcacgtgatcagcgccagtccaaaccccgggatcatctcgtacacgcccgtcggccctgccagaagctggttccacaggatagagactacaaacccgacgatcatgcccgccagcgcgccgttcttggtcgtgcgcttccagaagagggccagcaggacgatcggcccgaaggcgctgccaaagcccgcccatgcgaacgataccaccgacatgatggacgtttccggatcgcgcgccaaaaatgccgccaggacggcaatggcgatcacgccgatccgtccgatccacatcagtttcttctcggaaggctttttctttgccagctttccgtaaatatccgccgtgatcgccgacgaagccaccaaaagctgtgaatccgccgtgctcatgactgccgcgaggatcgcggaaagcaggatgcctgcgaccaccgggacaaagagctgtcccgccagtactaagaataccgtctgcgcgcctgccgcattcgtaaacatatctcccaaatatacgcgtcctaagataccgaccatgatcgcgcccgcaagcgcaagcacgatccatcccgtagcgatcctgcgcgaagccttgatcatacgcggctccttgattgccatataacggatgatgatatgcggcatgccaaaatacccaagaccccatgcgaggtttgaaatcagcgccatcggcgcaagcggctctccattcgcggtcgtaaacggatcgaggaaccccggcgcgatctggtttgctgccgcaaccgcctctgccggcccgcccagcttgcccatcacggcaagcggcaccacgaagatcgccaccagcatcagcatgccctggaaaaaatctgtccagcaaacggccttaaagccgcccataaacgtatacgcaatgataaccgcagcgcagatgaccattgccaccgtataatccatacccgggaacacagccctaaaaaccgtaccgcccgatacgaagcctgataccacataaaaagtaaaaaataccaagatgaccgccgaacttaaaaaacgcagcacgcctttttcatccctgaaacggttctcaaagaactgcgggatcgtgatcgcgtcccccgctacataagaatactggcgcaaacgctttgccacaacgagccacgaacagtacgcgcctacagcaagtcccacgccgatccatacttcgctcatgcccgacagatacagcgcgcccggcaggcccatcaacaaccagccgctcatatccgaagcctgcgcgctcagcgccgcgaccgccggatgcaggccgcgccctccaagcatataatccgaaatcgtggatgattttttgtaaaaataaaagccgatcaacaatacaaaaataaaatacccaataaaagacaggattactccccaatccagttccatacccacacccctcaaaaaaatgataattacttagtcattataccgaaaaatagcgcagcccgcaacaattccggcggtttttgcaaaacaaaacccgaaaacgcattgcattcccgggcgtattttcccacgcttcagagtatttcctccacctctttgtatcgcttgatcatcctgacgtacgattccgcggcatacctgacatagtccctttcctgctcattcaattcgcgtatgaccttagccggcgatcccatgatcatcacgccgtccggaaactccttgtccggcgggacgagcgaacccgccgccaccaggcttcccttgccgatcttcgcgccgtccagcacgatagcgccgatgcccaccagcgaaccttcgccgatctcgcacgaatgcaggctcacgccgtgcccgatgctgacgttatcgcgaaccacgaccggttctttactgcccgtatgcagcatacagttgtcctgcacattcgaatttttgccgatactgatatggtttagatccccgcgcagcaccgcccccggccatacgcttgcgttttcgccaagtattacctcgccgatcacgaccgccgttttatgcacgtatgccgtttcatggatatccggctttttttctccaagcctttctatcataaaagctccccggaaaacgtcttgatggcgattgccgtctcgatacgcttcttttccgtttcacagccgatctggtacggcttcctgatgctccccgtggcatggtatgcgtttgccgcgcacccgcccgagcaataatattttgcccagcactcgctgcagccctgctttgtaaagacgtgcgtatccaggaagttctgcttgatctcctggtccacctcttcttcaaatacgcttcccatacggaaaccttccatccccgcgaactggtggcacggatacaggttcccgtccgccgataccgcgaggtattcgctgcccgcgccgcagccccgcagacgcttgttgaggcacggccctgaattcaggtcgatcataaaatggaaaaagttgaaccctttccctgccttttcgcgtttcaagtattcacgcgccagcatttcatactcatgcttgatttgcggcaggtcctcctcgcggatcgcataactctcgcccgtcactaccggttctacggagatctggtcaaagcccgcgtccgcaatggcgcatacgtcgcttgcaaaatcaaggttttccgccgtatacgtaccgcgcacataatattccttatcgccgcgcccgtcgatgatcttatgggcattttgcaataccttgtcatagctgccctcgcccgcggcgtttttgcgcattttgtcatgcacttccttgcgcccgtccatgctgatcaccacgtttttcatctctttattgatgaattccgtcatctcgtccgtcacgtggtacgcgtttgtcgtaagtgtaaagcggatgttcttgccgtgcagcttttcctgctcgcggccataaagggtcgcgcctttcaccacctcaaaattcatcagcggttcgccgccgaaaaagtcgatctcgaggtttttccgtccctccgaatgcgcgatcagaaaatcgatcgccgcttttgcggtatcaaggctcatcagggcacgcgtgccgtggtattcgcctgtttctgcaaaacaatatgagcagcgcaaattacaatcctgcgccacaagcaggcacagcgcctttacgaccggcgtattgaactgcgcgttttccgcgcaaagctcgcactccgaatacaaaagcccctgcgccgtaagctcctctatctcatccaaaacctcgcgcgcttcgtcgcccaggtcggcgatgatctgttcgtttgttttgcctgcgttcttgaatgtaagcacgcgcatcgcgtccttatcgatcgcgtgcaccgaccccgactccacgtcgagcgccgcatagtgcccgcaaaattctatcaaatgtaccattgttttcctttcctctattacactgtatgcgccgtttatacgcgtcacatcgccggcaacgttccaatatgatctaatcctgccgagcctgcgcgctgcgcttgcaaaggcgtcggcatcaacccccgcattccgctcgccggtaaatatcatcgttattacaccgtatgcgtcgtttatacgcgccgctttcccccgcacatagaaaaaatgacggcatgtgcaaaatacaccgccgtcatcgttttaagctgttatttatgccttcttctcacacttctggttggcaagcgtgcaggaagtcttgcaagccgactggcaggatgtctggcattcgccgcagccgcccgtcttcagcgtatctttcaaattgctcttggttatcgttttaatatgtttcatatgaacaaacctcctaaaggaaactttccgttacttagtgtagcacggttacgaaacaatttcaagtgttacgaaacccttactttttcttttttgtttcctcttttttaggttcttccttcttggcttcttcgaccttctcaggaaccttgccttcttcgaagctctccaccgaagcgatcgcgccctttgaaattaccagttttgccttgtccgggccgcattcaaaggtaatcaggtcctctttgatggaaacaatcttaccataaaagccgccgatcgtcttgatattgtctcccacgcgcagcgtcgaaagcatatccttgaatttcttttcttttctcttattcggaacgatgatcaacactacaaaaataacgatcaacaggatcgggaacagcagtgtcatcgcattgccgcccgtgaggccgcccaaagcatctgtgctcataaactcatataccgcctttcaaatttacaaaaaatgtacttttattataatatcgtgaccgcgccgttaagtcaaccattatttgcgtcagccacgccttttttgccctgcaaacaggccgttttacgtcctgttttattccttgcacaaatcgaacagccgctggtgtgataattctttttgtccaagctctcccaccagcttaccgttgcggatcaccagcacgcggtcacacatacccgacagctccgaaaaatcggaggatacgagtataatgccggcgcccttgcgtatcagttcattgatgatattgtatatttccaccttgccggcaatgtccacgcccttggtcggttcatcgaaaatatatatattgcagtgcgaaaacacattgcgcgccaccagcgtcttttgcttgttgccgccgcttaaatagcgaaccttttggcgggcgttcctggggcgtatgcccagccgctcaatataatcccagcttttttcctcttcgtcgcgcggcatgatcagcctgcccttcgatatccccttcaggcgcttgatcgtgatgttctgcgccaccgacagatccataaaaagcccctgcgtatcgcggttttccggaataaacccaatacttaaccgaacgccgtccttatttttttcggccgatgcgacgcttacgcttccctcatcgagtttatccagcccgacgatcgcttttaaaaggttggtacggcccgagcccacaagccccgcgatgcccagcacctctccgctgcgcagcgcaaagctgatgccgctcaaaaacttgttgcgcagcccctccgtctttaggagtacctcgcctttcggtacggacagcttagggtaatgctccttgatatcctcgcccagcatcttatgcgcaatatcgtcgcgctccgcattctccggcagcacggaatccgcgatctcgccgtccttcatgacggtgatcctgtccgatatcttccgcgcctcctcgatccggtgcgtgatgtatacgatcgccaccccgcgcgctttgagttccttcaatagtccatacaaccgctccacctcggacatcgtgagcgaatccgtcagttcgtcgaggacgatcaccttgtaatcacggatcagcgtgcgcgcaaactgtagcaaatacttttccgccatggaaaggtgcgccgccttgcgccgcggctccacgtcgatgcccagcttgtgaagcacggtattcgtttcctgctccatcgcatgccagtcgagcacgcccttgtgtttgatctcgctgcccatgaagaggttttccgttacgctcagctcgccgaaaatggtgacctcctgcgggcaactgatgatgcccagctttttggccgcatgcggggagctgatgtccacttccctgccgtccatgcaaatgcacccgcttgtcatgcgcacttcgccggtcataattttggtgagggtgcttttgcccgcgccgttgctccccaaaagcgcgcaaatctggccggaataaagttctaaattgattccggaaagcacgcgaatctcatgataggatttgcatatatctatcatcttgagtaccgcttggcgcatacccccacactccttattattcctgcgtcattctcccatcccgttaacagaggaaggcttgatccgatatgacgtaaatatcttgacaccatgctcaaagaaataggatttgtagtcttccggtatatcatcgttggtgatcactgcgtcgaccgtcgtaagcggcccgatgctcgtaagggaggtgtgagcaaatttcgtctggtcggccacaatgatcagttcttttgaaattttcttgattttatggtagacgttcgattccagagtgttggaaacggtgaacccgctgtcaaggtccacgccgcctacgccgataaaggctttcgcaataaaaatgttcttgaggaatttggcgaaaaggtcgccggtcagcgacatctcgctgttcaccatcgtgccgcccgtcaccacgacgttggccttggggttttgcgcaagcgcccccgccacataaaggttatttgtcacgacgttcacattctcacggttcaaaagcgccttggcgacgtaatagcaggtcgttccgggtcctaagaatatccactcgttgtcccgcaccatatccgccgcgatctgcccgatcatctccttgtttttgtcgtaatcgagcgacgcccccgtgatgttgtcctgcatggactgctgctttaagtgatcctcgttcagtaccgcgccgccgtacgtgcggtacacgaatttttcctgctcaagctgctctaagtcgctgcggatcgtcacatccgaaacattgagcaacgcgcttaaggtactgacgtccacctgccccctgtcaaggatcacttctttaatttttgccagacgcgccgccttaaacatgcatctatctccataccttgctttttatgtaaattataccatattttacagaattgcaatatttgttttttatttcttttttcttttcgaaaacaaatccgctaaaatttttcgatattctgtcggggtttggttatcctttgaaaacaaaacaggagactgacgctgccgccaatttcctgtttcgcgttaaaaggtttggaagaaagtatgaaccgtcgttatctgtttaccatttggatacgatgtctttcacgtacgcaagctcttttcgcgagagctcgaacggatcgtcctccatcgcatacagcgccggacgcgtataaatgttttcaaggatcatccagccgtcgaacttgtgttcccgaaggatgtccatctgcgctgagaattcccccgcgccctgccccaagagcatgccgccgttcgttcccccgtttgcgcgcgtatcgctcccgtcgcacaggtgcaactggtctcctaagtacgggtacagtttttctaaattctccgtctgagaatacccgtcgtaccacatgtaattctgcgtatcgaagaagcagtccaggttttcggcgttcaccgcgtcctgtagcttaatctgcttgtcccagttgagggccgtctccgcgccgatcttgatccccagcccctttgccttgccgcatatctcttggatgtacgtcgccgcgcgctcgaaatccccttccgtcttgatctccgactcgaagaagaacggcagcatcacgtaatcaagccccatcgcctgcgccgtctccaagatcagatcctgcgcgtacatgcagcttttgaagtcgtcgccctgcttgtctcccatcagcccgtgatacatcaggtcattgagcacgatcgacggaaactcgagcccgtagcgctccgcttcctccatatacacgtccctgaccttcttctcgcccatatagtagccgttgtcaaggccgcccagctcgacctgcatgccgtcgtagcctgccgccgccacatacttcatggcgtagatcccgttgcccggataactccattgtgtgattccgtatttcatggccatttctccaatcagtctttttcagggtaatagcggatatactcctccggaatgtcgatcgtttccggacaattccccagttcgtagttgaagcccatcacaggctccgtatcgatgtacgcatggaaatccggaccgcaccagccgctctggatcacgtccattcctttttccttcagctccgcgatatatccttccatgttttcgtccgtgatgtgctccttgaaatggtgcagccccgtccccttggtcgcgaggaacttgccgtaaatattcggccccttcaccggcatcatgagctcgatgttcgtatcgccgatatcgcttaaagccacttcgaattcaaacggctctgttacaagctctccgttcacgtgaaaatccttcatcgtctcgctggagaatttgtagatcgtccacgggcccaccttcagtttatctacccacagcctcaccgccttgtcgatgtcgtccgtcaaaaacgcaagctgtttgaccgtcctctttttgttgtgctccaaaagctcctggtatgtcattgtcattattctatctcccttccgttgttttatcattcatatctgaccgcggctgtgatgcggttattcgctcccgacgcctttgcaaacgcagtgcgcaggctcggaggcgaacctccatcaaaagtcgcggtaaatttatccggatatcgtttatacgctcgcctgcttcttgcggcggatagcgtcaatggaaatcgccaccaggaccacaagtcccgttactacctggtcccaataggaggagattcccagcaaactgatactgtaggaaatcgtagccatcaggaatccaccgacgatggtgcccccaatgccgccgctgccgccgttcatggacgtaccgcccagtaccgccgccgtgatggaaggcatgacccagttttcaccgatgtttacctgcgaagagcccatgcgcaaaaccatgagtacgcctgcgatcgccgataaaaaccctgcgaggcaataaacgcccattttggttttattcacgcgaatgcctacgatcttggacgcttcctcatttccgcctaccgcgtagatatggcggccgaaacttgtgagcttgagtacaaagatcaatattacagccagcacgatcatgatgatgacagggtacggcaggatgccgcccaaagagccctggccgatcactgtgaccgactcggggatgcccgttaaggggaagccctgcgtcgccacgtatacgatccctttgaaaagcgagcttgtcgccagcgttacgataaacggcgtaaggccgagtccgcagataaaaatgccgttcaacgcgcccatgccgatccctgcgatcatcgcgatcacaatcgcaacgaacgggtctacgcccatcaccagtaccagcatcgcaaaaatcatgctggcgaggccggcgatactcgcgaccgacaggtcgatcccgcctaagagcagcaccagcgtctgcgcgaatccgacgatgatcgtaaagcatgccgtgcgggtaaacgtagaaatgttataggccgtataaaaattaccgtccgtagcaatattaacgaacagcgtgatcagtatcgtcaccacgaataccacgcctgccgtcgacgtgaaaatcgatttcaccccttttcccagggtctgggaaaaacttttcttacctaattcttccattttgttttctcctttaatcaatcacggattattgcagtgcgatcttcagtatatcttcgcgttcaaccgtatcgtcaggcgtaatgatgccctttaccgttccgttgaacatgatcatcatccggtcggaaatcgtaagcagttcctcgatttctgaagatatgacgatgaccgtgatacccgaatcggccatttccctgatcaatttgtaaatctctccctttgcacggacgtcgatcccgcgcgtcggttcgtctagtatgagcagcttgaccttcttttccatccagcgcgcgaggatgaccttctgctggttcccgcccgataaacttttgatggggacgctgttcgacggcgttttgatgcgcagctttttgatgtactcatccgattccttcttgaccgcggcaaaatcgatcaccacgccttttttgtttttatcgtaagaaggcagcatgatattttcgtaaatggggatcacagggaacatcccctgcctgcgccgttcttccggcacgaggccgatcccgtgcgcgatcgcttcatgcggcgaatggatgtcgatctcccgtccgtccagtttgagcgagccgctgtcgcgcttggtaaggccgtaaatacaactgaagagctctgtacggcccgcgcccacaagacctgccacgccgaatatctcgcctttgcgtacggaaaagctgacgtcgtcaaattcccttttccgcgaaaaatgggaaacgctgaaaaactcctcttcgaagtattcccgctcctcttttaccgttttttccacatgctctcccgccatatggaaaatcatttcgtcgatgggcatctcggcggtattgcccacttttaccatctttccgtcgcgcatgatactcacgcggtcggaaagctccacgacctcgtctaaatggtgggtgatgattacgatcgatttccccgccgcttttaatttccgtatattattaaataagtgctgtgtttcattcaaggttaaagatgcggtcggctcgtcaaaaacgatgatgcgcgatcccgcgatcagtgtcctggcaatggatacaagctgctggtaagccgccgaaatctcgcttaccttcttgcgcgggtccatttccacatcgagctgccttagcgcttccgccgcccgttcgtatgttttttcccaatcgattacgcccttcttcttctgatgactccccaaaaaaatattttccgcgatggaaatatcgctgacgaggttcagctcctgcgggaccatcccgatccccctgtcgagcgcttccctcggtgttttgttttcaaccgtttgtccttccagcaggatctctccctcgtttggctggtggattcccatcaggacgttcatgagcgtgctctttccggcgccgttttccccaatgagcgccatgatctcgcccggccttatgctaaaatcgacattgtccagggccagcgttccggggaactccttgacgattcctttcatttctaagataaattcagacataagcgtcctccaaacatggttcctaaatcattttttcaggcttttgccccgcgtccgcagaaaagcggcgcggggcttcttgcctgtttcaaccgttatctcatttttgccgtactgctttaagactcaggatacagcatgtcgagaagatgctgtgcgccttccggataaatgatcgttgtcttttcctgtgtctgttccggatacgtcgtgtcgctcggctcaacgccgtctgcgatctggatcgctacctggatcgtatcaaagcccattttgaagcaatcctgtacgcccagtgcggagatcgtgccgtcccttaaatattccagggcgcgtttgtcatggtccataccgacgatgacgacttggccttctttaccggcgtctaaaactgcctgcgcagcgccgatcgggttgcccatgttgttgcagaagatccctttgaggtccggatatttctgcaagaagccttccgcataggtgagggcctgctctacctggtcgttgtcatactggatttcgaccacttcgatgtcaggatattttgccataacttctttgaagccttcgatacggtcttcgtggcagggagcgccgatcgtgccgcccagtgctgcaacctgtcctttataatcgatcttttcagccaaaatctcagcaaggtccgcgccgtcctgcttgttgtgcgtgttgccgacataagcgatacgcttacatccgtcttcttttgttgcgtcagagctggagaacgtcatgaccttaacgccctggtcgatcaggttgttgatggtgggcgtaacgatcttgatatcgtttacgtcaacgccgatcacgtcaaagttcctgcccgcagcctgctccagcctgcttacctgatccgttgcgtccggcgttaccggagctgtgtattcataattgaccgtgatgccttgttccgcatactgtttctgcgcttcttccaggcccaggcctacagcgtcccaccacgggtgtacgagcttgtacgtaagatagaagttatattccttctttgcgggcgtgtaatcccccagcttcacattcgtgctgtcgcttacgatcgcgccgttgtcagacgcggatgcagcaggagcctcggatgtttccgccggagcttcggaagtctgcgccggagcctcggacgtctgtgccggttcctgtgatgccggagccgaagatgcagccggagcagccgtgcagccggccagcatgcaaacagcgagcaataagcacactgctgcaaccatgattctctttttcattttttcttttcctcctcgtatattgaagttctattttatttgccccttcaagggcaatgcgcgcattgtataaaagggcactgtgacagcatatattcacaataaacggttgttttgagcaaacgaaatatcctagcaaaactgcgtcctgccaacctttcacctgcatattgaattcttttcagagcttgttcccgtaaatgtttcgttcgtttgatatttgttttttcttgtaaggtgaatatatcatttttgtttttgaatgtcaatatatttatttacatcttttttatattttttatttcttttttcgtttcaaaagtatttttctatgtgtttccaatttttgtatttaacaaaaaacgcctttatatcaacgttttatcaacaaaaataccgcaaggccaacgttttaattcccatcgttaatcttgcggcatttttcgttttgattttttattactttactatttcgtgcttctcggcgtttacatatggaagttcgccataaattcctgccggaactccctaaacgtccccgcttcgatgtgcgcgcgtatttcttccatcagccggatggtgaagcgcgtattatgaatggaaagcaagatcgcccccaatatctcgttcgttttgaccagatggcggatgtacgcccgcgtatggtttttgcaggcataacagtcgcacgtttcgtctatcgggcgaaaatcctttgcatattgccggttgcggatcaccagctttccgtcccgcacaagcgccgtgccgttgcgtgcgatgcgcgtctgcaatacgcagtcgaacatatccacgccgcgcgccacgccctccacaaggcaatccgccgtgcctacgcccatcaggtaacgcggcttttcttcgggcaatatcccgtttaccacatcgagcatttcatacatcatgggttttggctctcccacggaaagcccgccgatcgcgttgccgataaagtccatttccgcgaccgcctccgcgcttgccgcgcgcagttccggatacatcccgccctgcacgataccaaaaagcgccatatcgccgcgcgtctgcgcctccttacacctctttgcccagcggtgcgtacgctccatcgaatgctttgtataatcaaagtccgccggatacggcgtgcattcgtccagtaccatcataatatccggccccagcgcttcttcgatctgtacgaccttctcaggcgtaaacatatgccgcgatccatcgaggtgcgactggaaagccgcgccttcctccgtcagcttgcgcaggtcgcctaggctgaatacctgaaacccgccgctgtctgtcaaaatcggctttttccagttcataaatttatgcagtccgcccgcttcgcggatcagctcatgccccggccgcatatacagatgatacgtatttccgagtatgatctgcgcgccggactccaaaacctggtcgttcgtcatcgctttgaccgtagcctgcgtccccaccggcatgaataccggcgtcctgatctctccatgcggcgttttcagcactccgctgcgcgccttcgtgcttccgtcccttttttcaactgtaaaactgaaatccattttttactccgttctccatatcatacgggcttttacgccctctatacgcaatatatccgtttcattctatcagaaatccgacaggctgacaaaccgtgtcgcgatcctttgcgcaaaagccgcgtcatgctccacaaagaccatagccgcgccgcactgctccaaaagcgattcgacctgcatccgcgagatcacgtcgataaaattgagcggctcgtcccagacataaaggtgcgcctgctcgcacaagctcctcgcgatgagtatttttttcttctgtccgccgctcaggtcactaaggtctttttcaaactgcccgcgcgaaaaatccagcttgcgaagcagcgtgcgcatcagcgtcccgtccagcgcgtattgcgcgatgaacgcatcgaggccgcccttcaggaacgccgtgtcctgcgggatataggatatcttcaggttcgctccccgcaaaatatcccccgtatgcgggatctcttcgcccatgatcagctttaaaatactggatttcccgcagccgttccgccctgtgagcgcaatgcgctctccgcgcccgatcgtcatgtccacaggcccgcacaccgtcttttcgccatagcgcaccgtcactcccctgcattccaaaagacgctgcgcgtgataggtaagcggctttaacacgatccgctccgccctttcgatgtttttcaaaagccccgccttttcttctatcgccttttggctgcgtgtctccgccgtttttgcgcgtttcatcatcttggcggccttgtggccgatcgcgcccctgtccggccgcagtccggaaacgcgcgtcccctttttggtcttttccacgcgatccgaccatgccgctttctcccgtgccgttttttccagccgcctgatctcctttttcaatatgccgtttctttccagctcatgcgcgtcctgccgttccttgttttgcatccacgtggaaaagttcccgctttgcacttcgatctttgtgcggccgatagacaaaacatggtcgatgcacccgtcaaggaacgccctgtcgtgcgaaacaaggataaaaccctttttaccgcgcaaataccgcgccaccacgccgcgcgcacgcgcgtccaaatggttggtcggttcgtcgatcagcaggaaattttcccgcttcaaaaacaaagccgccaaaagcgccttggtgcgctccccgctgctcaggctgcaaaacggccgccacagcgcgtcctccgaaagctccagcagggacgtttcgcgcaaagcctgccactgctcgcacgccgcgatcccgcatatcacgtccatcgccggatccgccggatcatccgcttcaaaggggaaataatcgaatcgtgcatccgtgtggatgctccccctgcattccatttctcctgtgcaaagttttaaaagcgtcgtttttccgcagccgttccgccccgtaagcccgagcttccagtccgtatcgagcgtgacgctcacatcctcaaaaaccgtatcaaagctcccatcataaccaaacgtcaggtgggaaatactgatctgcgacatatcttcctttctccttccaacaaaaaagcctgcaagaaaattacttttccgcaggccatatatgccgcaaacaggactgcccgcgcgcatacgcaaaggcaggtatttttacaccggtttcgtaattttcttgcacaggtacagggaaacaggcagactgttttccgccttccgtacccctataaaatcaattatttgcaagaaatcttacgcaccgcacttatctccttctttttgatactgcttactatatcatccgcttccgccgccgtcaagcgtatttttaaccgtgcagctcctcgcagagcctccggtaatcctctgaaaaagcgctgccctgccgccagataaacgtcaggtcgtgctccacgcggaaatcgtccaatttgatccttcgcaggctgtgcgccgccagttctccgcgcaccgccgcttcgtacaaaaaagtcacgccgcagttttcagtcaccagcgtcttgatcatgcttagattgctgatctctacgatgttttcaaaatccgaaacctgtaggttcttttcctccaggcatttttccagtacctcgcgcgtgccgctcccctgctcgcggaccacgatgcgctcgccgagcaggtcgtccagcatacgcggccgcttcttaaaacggtaccccgcgccgcatacggcgatgtacggttccctgctgaaaacgatatggtcgtactcgtttttggcaaaatatccttctaccagcgcaaaatcgatgtctccttcgtccagcttctttaagagctgctgcgtattggccaccgagaccttaagctgcgtatccggatggcttttcaggtaacgcgcaacggcgcgcgggatcacaaattcccccaccgtcagcgtcacgccgaaatgaagctcctttttgtgcggtcccagcgccagctttttgcgcaggaaaaggtcgtcgtgcttcatggcaatgagcgcgctgcgaagctccgcccccgccgccgtcagctcgatcctcttgccgtttttttgaaacagcttcgtctgatagtgctcctccaaataacggatatgctgcgataccgccggctgcgtgatgctcaagtcccgcgccgcctttgtaaagttcaaatgcttgcataccgcaagaaacgtatccgtccgaaaatccaacataccggtatccttgcctttccgcacatatcataacatatatttatctaaatataaatatatataattttattttattaatctatcgtgttataataaggttcatacggatatgcgccaatacgtacgtccgttcatccgcaataataaagaggtaaaaacatggattttttcaaaaaacattggaaggggcttctgctgtgccttgtgatcgcggtcccctccttctttctggggaaactgctgcccgtggtgggcgggccggtattcgccatcctcatcggcatggtgctcgccctgctcattaaaaacagggacggcctgaacgcgggcgtcaacttcacctcaaagaagatactgcaatgggcggtcgtgctgctcggtttcggcatgaacctaacggagatcctgcgcgtaggcgcgcagtccctgcccatcatcgtttccaccatcgcgacgtcgctgatcctcgcgtacatcatgtaccgcgccatgaagatgccctcgcgcatttccacgctcatcggcgtcggttcgtccatctgcggcggcagcgcgatcgcggcgaccgctcccgtcatcggcgcgaacgacgaagagatcgcgcaatccatctcggtcatctttttgttcaatgtcgtggccgcgctcatcttcccgacgctgggcggcgcattgggcctgtcaaacgagggcttcggcctgttcgccggaacggcgatcaacgatacctcatccgtcacagcggcggcgacggcgtgggacgggatccacggcagcaacacgctggattctgctaccatcgtcaagctgacccgcacgcttgcgatcatccccatcacgcttgtgctggcgttcgttcgcacgcgcaaagaaaaaaagctggaagcgagcgaaggcgtcaaggtgagcttcaaaaagatcttcccctggttcgtactgttcttcgtgcttgcgtccgtcgtaacgaccgtattcaatctgcccgcgcttatcaccggaccattgaaagaactgagcaagttcttcatcatcatggccatggctgccatcggcctcaatacgaatatcgtgaagctggtaaaaacaggcggcaagccgatcttcatgggcctgatctgctggatcggcatcgcggccgtaagcctcgggatgcagcatatactcggcatctggtaaaatcggcgcaacaaaaaagcagggcgcgcgccctgcttttttttatcttctttatatcactcccagatttttcgcatgctgcacatggattccgatgtgtcccacgcctaaaatgacggcgaacaggatcatccagatgaccttgccgtaaataccgagcagaaggaacgccgataccggaaagaccgcgagcggcacgggtatgccgaaaaagctgcggtacatatcctttgcccgcttcctgcccttgaagtacttgaaccagcacagctcgtaaaggcccatcaagataaaggccacgaccagccatgcgttccacggcgaagcctctccgacgttgaagttgctgaacatcagcatgcataccgcgcagccaagctgcccgatgcgctccagcatcagcaaaataccgctttccccttcatcgttataatccgccggcttttgcctgctccaaaggatattcggaaccgcaagcatcagcagaaagatcaatccgatatacgaaaaccccaagtgcccaaacatacgaccactcccttatagaaaaaccttaggctccgccctgcgcaaaagcccttcttccagttctgttttatggtaaaggtatcccgcatcatccagatacttcgcttttttcgggcaccgcttgacgcatgcgccgcatttgatacatatccccgtgatctcacgcacatcctcatggctgatcgaccccatcgggcaaatatccgcgcacagcttgcagtcgtcgcaagcctcaccggtaagcggctttgccttacggatatcgatcggctttcccgctctgtcacgcggctggaaatatccacggtacggtttttccgtcccgtccacgcgcaatgcctttagcgtatcgcctgcctgcgcctccgacagcttcgccgccgctaaccgcccaaactcccgcgccttttgcatatcctgatcgtccggcctgcccgccgcaagcacataggaaaacgcatgctcccccacaaacgccgcgccggcgaccggcaaaaaaccgtccgctgtaaggatatcccgaagctcgatgagcgcgtcgtcaaaatccctgttgccgaataaaacgacaggaacggcaagcgcgccgtttcccttcaccgttgcaaggtatttcagcaaaacgttgggcacgcgccccgcgtataccggcgttccaaacaccacaacatcgcctttgccaaagcaaagcccgtcttcacgcgccgacggcagtgtaaaatcgaacgtcccgtattccgtttccgtctcctgtgcgatttcccgcgcgatcgcggctgcgacccgtttcgtcgtgcccgtcgcgctgaaatataccgcccaaaccttttttatatccatcataacaccagcatcgcgtccccaaaactgaaaaacctgtattccatgtccaccgcctgtttataaagcgcaagcgtttgttcccgtccgcaaaacgcgcttacgagcatcacaagcgtcgatttcggcaaatggaaattggtgatgagcgcatccacgacctgccactcgtacccaggataaataaagatatccgtatccgcgcttcccgcctcgacgaggccgtccttagccgcgctctcgagggtgcgcaccgaagtcgtccccacggcgatcacccgccgcccttcgcgtttggctgcgttgatcgtctccgccgcctgcctgctcacgctgtaatattccgaatgcatgacgtgctcttccactgtttcttccttcatcggacgaaacgtccccagccccacatgcagcagtattttgacaatgataacgcccttttcctccagcttttttaaaagctcgggcgtaaaatgcagtcccgccgtgggcgccgccgcgctgccgtcctcttttgcgtataccgtctggtagcgttccttcttttccagcttgtgcgtaatgtacggcggcagcggcatgttcccgtatttctccagcacgtcctcaaacacgccttcatattcaaagcgcacttcacaaacgccgtcctcttttttttgcagcagctttgcggcgaggtcgccgctaaaatccacatatccgtccggtttcagctttttgcccgggcgcatgatcacgtcccacgtatcgagcgagagccgctttaacagcaaaaattcaaaatccgtatccgtaccgcgtttttttccgtacagccgcgcagggatgaccttcgtttcgtttaccaccagcacgtcgcccgcacgcaggtaatcgggcacgtcataaaaatgtttgtgttctgtcttttcagacgcgcgctcatataccaaaagccgcgaatggtcacgcggctcaataggggtctgtgcaatcaattcttcgggcaggtcatagtcaaaatcagatgttttcatagtgtactacaaatgctagaacagctttgtttgccccttgtttgcgtcatttttcggcgcaggaatgcccatgtgcctgtaagcgttttccgtcgcgcagcgtccgcgcggcgtcctctggataaatcccaactgtagcaaaaacggctcgatcacatcctcgatcgtgcccgattcctcgcccgtcgtcgccgccagcgtctcaagccccaccggcccgccgccgaatttcatgaggatcgcttccagcaccagcctgtccgaatggtcaagccccagctcgtccacttccagaagtttaagcccatcggccgccgcgtctttggtgattaccccttccgcgcgcacgtccgcgaaatcccgcacgcggcgcaaaagcctgttcgcaatacgcggtgtcccccgcgagcggcgcgcgatctcctccgcgccttcctcatccacatggatgtccaaaatgcttgccgaccgcttgacgatcgtatggagctggctcgcgtcgtacatctgcaggcggttgatgataccgaacctgtcccgcaacggtgaagtcagcatgcccgcgcgcgtcgtcgcgcccaccagcgtaaacctcggcaggtcgatacgcatagagcgcgcagacggtcccttgccgagtataatatcgagcgcataatcctccatcgccggataaagcacctcttccacgctggaattcaggcggtgtatctcgtcgataaaaagcacgtccttgtccgaaaggttcgtaagcagcgccgcaagatcccccggccgctcgatcgcagggccggacgtgatgcggatattgacattcaattcctgcgcgatgatatgcgcaagcgtcgtctttccaagccccggcggcccgtaaagcaaaacgtggtcaagggcttccccgcgcttttttgccgcctcgataaagatggacatcttttccttcactttatcctggccgatatattcttcaaggcattgcggccgcagcgtcgcctccgccgcaatatcctcgttcattttcatccctgaaacaatacgggattcttcctcttcaaagctcaagtgatacccctttcagcttttcccccgcctcagcccatggggatcagcgccttggtgatgccggccagcttggccctcgtcgcacctgtggacatcgtcagcgaacacgtctcgtcgtcctccgcgttgtgccactccgattttccctctttgccttcattatagcttaccgtaaacggacggtcctgccatgtcaggtcttccgtcgtttcaaaatccacgaacattcctgaaatatccgtctccggcgttccatggaccatgcggaacgtatattggtccccgtcccatgtaaaaatgacctgcgcgagtttttcgctttccatcacggaataggaaatgtccgtcgagccatcgggcaccggaaccatcacgatccctgtcagttcctgcacctctgccgcatccgcagcctctttccatgggttcgccattcctgcggtttcttccgctcctgcgcttacctgcggctccgaaggagcgggcatttcgctcggtcctgccgtctcctgctgcgcgcacgacataagcgttactgcaagcaatgctgtcaatattaccgtcaatacccttttcatatacgtctccttttatcttcctattcgttttaaagccagtgcgacgagttcctccgcgctgtcccccaggttcttgaccgccgcaatcgccgcgaccgcttcctgcctgttgtatccaagtccgcaaagcgccgccacggcctcggtcgccgcatcctgcgtaaatacggacatatctactccgtccccgaccgcgtcctcgatatccactttttccttcaattccagcacaagcctctgcgccgttttcttgccgatccccggcacggacgtgaacgccttgtcgtcgctcgaaatgaccgccgccgcaatatcgtttacacgcatgacggaaagcacggacgccgccgccttcggcccgatcccattgatggaaagcagtttttcaaacattgttttctgctccgacgtcccaaaaccgtaaagcgtcatatcgtcttccgcgacctttaaataggtatatagctttccctgctgtccggtctttaacatgttgagcgaaaacgtgtccgtaaaaatttggtatcctacgccgttcacgtcgataacggcatagtttggcgctttctgcactacttcaccggatatatatgcgtacatgatttcctacctcttatttgatcttcgtatttaaaatacccgccgtcctcgcgctgtgcgcgtgacagatcgccaccgcgaccgcgtccgccgcgtcgtccggcctcgggatctcttttagggacagcagcgtcttgaccatcatctgtacctgatttttgtccgcgcgcccatatcccacgaccgcctgcttgatttgcaggggcgtatattcgtatagctcttccatgcgctccgaagccgctacaagagccgctccccttgcctgcgccacgttgatcgccgtagttacgttcttattgaaaaacaattcctcgaacgcgatgcaatcgggagtgaacatgtcgatgagctgcccgatcccctggtatatctgctttaagcggatgggaaattgctcccccgccttggtcagtatcgttccataatcgatcagctccagcttcgatttttcatcgcagcttaccacgccgtatccgaccgtcgcaagccccggatcaattcccaaaactatcactcattgcgctccctctgggtcgcttcgcgggcggacgttgcacttcccccgcgtgcccctttgctcaaagttgttttgcttcgcgttcccgcttgcaaaaccaattaattcctgacgtcctgatcagcaaacgggttccaccgctctctttgtttcaggcgcgcccgatccggcggtatgcttgccatcgccgcgcgcagcacgtgaacgccccctagtagtatacatgattctgccctgtttcgcaatttcccgtgcgcataaaaaatttttaactttttgcaaattacctattgcataattattcatttttatgtataattataaacatcaaatgaatgtaacgcctataaacaggcgcggtaaaaggagttttaaaatgaaacagtataacaaagtagtacttgcatattccggcggtcttgatacttccatcatcatcccgtggctcaaagagacctacggtgtcaaagacgtcgtcgcggtgtgcggcaacgtcggccagggcaaggagcttgacggcctgtatgaaaaagcgattaatacaggtgccagcgacgcgtacatcgaagacctgaccgaggaattcatcaccgattatgtatacccgaccatgcaggcggatgcaatgtacgaaggcaaatacctgctcggtacgtcgtttgcacgtcccgtcatcgccaaaaggctggtcgagatcgccaaagaggtcggcgcagacgcgatctgccacggcgcgacaggcaagggcaacgaccaggttcgtttcgaactgacggtaaaggcgctcgcgcccgagctggatatcatcgctccctggcgtatctgggatatcaaatcccgtgaggaagagatcgaatacgcacaggcgcgcaacatccccgttcctgttgataaagaacataactacagcatggatgcgaacatctggcacctgtcgcacgaaggcgcggacctcgaagacccgtggaacgaacccaaggacgacctgtatatgatctgcaaaacgccggaggaagcgcccgacaagccgtgctatttcacgatcgagtttgaaaaaggcatccccgtttccatcgacggcaaaaaatacggtccggtggaattggtcaccaaactgaacgagctgggcgcggaaaacggcgtgggcatcgacgacctcgtggaaaaccgcctcgtgggcatgaagagccgcggcgtatacgaaaacccgggcgggcgtatcctgtatacggcgcatgcggcgcttgaaacgctgacgctcgataaagacaccatgcactataaggaaggcgttgcgaccaaattcgcggagctcgtgtacgacggcaaatggttctgtcccctgcgcgaatcgctgtccgctttcgtcagcgaaacacagaaaacggtcacgggcacggtacgcatgaagctgtataaaggcaactgcatccacgttggcctgcaatctccttactcgctctacagcgaagaattcgcaacgttcggcgaggacgaagtatacgaccataaagacgcggaaggtttcatcaacctgttcggcctgccgctcaaggtgcgcgcgctcgcgttgaaggataaagagatttaaagattaaaccataagcggtgcaatgcaaaattgcgccgcttttttatatccaacacattgacaaccatctatgtattgtgtatagtgtcatatatagatatctatcgatgtgaggtttgaaatggaaacaaattatgcaggatatgcaaatatgttaaaagcccttgcggagcctacgcggcttaagatcgccgatatgctttcctgcggcgagctgtgcgcctgcgtgatacaggaaaaattcgatatcacccagcccaccctttcgcaccatatgaagatcctgtgcgaaagcggccttgtaaacgcgcgcaaagacggaaaatggatgcattattctttaagcacaaaacggctgcacgagctccgcgattttgtggatctgctggcggtcacggacaaagactgtatttgtaaggagaaatagctatgagcgataacatgaaagaagagatcaaaaaatactacggcggactcgcgagcggggtcacggccggcacgggcgaggccccctgctgttgctgcaagccgcaaaagagccggatcctgtatgacgacgaatatttggacggactgccggaggaggcgctcaaggcctcgatcggctgtgccaaccccatttttctggccaatatccagccgggcgaaaccgtgctggacctcgggagcggcggcggcatcgacgtgctcatctcggcaaaatacgcgggcgaaacgggcaaggtatacggccttgatatgacggacgagatgctcagcctcgcgaacgaaaataagacgagaagcggcaggaaaaacgttgagttcatcaaagggtatatcgaggatatcccgcttaaagacgatacggtagacgtcgtcacctcaaactgcgtgatcaacctgagcgaggataaaagcgccgtactgcgtgaagcgtatcgcgtcctgaaggcgggcggccgcgtagccatcgccgatgtcgtggagctgaaaaaggtcagcgctgaccttaggaaaaacgcacagctctgggtaggctgcatctccggcgcgctttccataccggactataccaaaaagctcgaggatgcgggtttcaaaaacatcgagatcactgtcgtggattcctatagcaaggggttcctgcgcgaatttgcgcaaaacaaagggctcgcattcgatctttcggatgcacaggcggacgagcttgacaatgcctttgccagcgcatacgtcaaagcgtataaatagcttgacaccctctttttcctttgctataatggcaatcagttgaataaacggggaaatatgcaccgccgggtgttccccaaaaaatattgttttcgtattgttaggcctgtggatacgcgcaggcctattttttatgcgggagggcatacgatgcaaaatatcggcagcgaaaatatcatgagaaccttctttaagtacgtttccttaaacgtgctcagcatgctgggcctgtccctttacgtactcgcggataccttctttgttgcgaatggcgtagggccggacggtcttgtagctttgaacctctccatccccgtctttaacctgatcaacggtttgggactgctcatcggcatcggcagcgcgacgcttttttccattaccatcggcaaaggcaaattcgggagcctaaaccgcatcttcacgcaggccttcgtgatcgccgtcataagcggggtggtgctcaccgtctgcgggttgattttcaaccgcccgatggcggtcgccctcggcgcggagggcgggcatatcatcgaaatgacgtccacctacctgaaaatgctgaccgttttcgcgtgcgcgtttattttgaacaaccttcttgtcgcattcgtgcgcaacgacgggaacccccgccttgccatgatcggcatgctcgcaggctgccttttcaatatcgtgttcgactatattttcgtgtttcccatgcagctcggcatcttcggcgcggcccttgccacaggcatcgcccccatcctgagcatgatcatcctgtcctcgcatttcctgcgcaaaaaaaatcatttcaagctggaaagaacgaaattcaacggcgtggaggtcaggaaatccatctttacgggtattccgtccttcatcatggaattttcgtcaggcatcatcatctttgtattcaataatatcatcctgcgtatcgcgggtgacctcggcgtggccgcctatggcatcgttgccaacctcgcgcttgtgtgtatcgccatcttcactggcgtcgggcaagggatccagcctgttttgagccattcctacggcgccggacgcatggatcacgtacggcatgtatatctgggcggcactgtccttgccgggcttctcggcctcgcgttcttcctggtcggtttcttctttcctacggagatcgcgtctattttcaacaatgaaaacaacttagaacttaccgccctcaccgtatcaggcctgcgtatctacttcttcggcttcatttttgcaggcctcaacatcgtgacgacctcgtttttcgcagccattgccaagccccgcccgtcctttatcgtttccgcgctgcgcggctttgcgctcatcattcccctcgtcctgctcctgccaaacttctttggcctgaacggcgtatggatggcgggaccggcgaccgagatcctcacgctggtcgccgcgctcatcctcgtgctgcgcttcttccaaaagcacagcgcacccaaaacgctttccgcggcataaaaaaacgggccgcgcttgctttgcggcctgtttttttatcgactaaatgatcgcttcaatatccttggaaagcatttcgcctgtatatgccggcgaataccgctctgcgacatttccctcgcggtcgatcaagaacttcccaaaattccacttgatatcgctgtcttttttcctgcgggcaagcagctttacctttttctcaaactttttggattgctcgtctcccttgtcctcaggcgcctgctccttgagccatacgtaaagcggagctgcgccttccccgttcacttcgatcttttggaaccgcgggaacgtagtattgtaattcagcgtgcaaaacgactgtatctcctcatccgtttccggcgcctggtgcataaactggttgcagggaaagtccagcacctcaaatcccctgtccttgtatttttcatataattgttcaagcaattcatattgcggggtcaagccgcatcttgtggcggtattgacgatcagcaaaaccttgccctcatattccctgagcgaaacatccttgcccatgttgtcttttacggtaaaatcatatacattcatttttgtgctcctttcggtttgttctggtattgataaacaatatccgctcccgctatgcaacaaaaaaggatccggaggctaaaaaccgccggatcccccttaaatttccctgtatatcaatcctgcgatccctgcacgaacggcacgtctgccggaatctcctcgatactccaattatccgttgaaggaatatcctgcgggtcaatatccggtcgctcgcttggaagcggcgcaagctgtagttgttcgcggatggaggccgtcttttcgtcgtctgcgtcccccgcgcggatcacgcaaaccgttcccggcgcgatatggtaccacatccatttagcgtccggcacactaaggcgcacgcacccgtgcgaatccgccgtccccatcttttcccatacttcgtcgatatatgtactcgtatccatcttgtcgtaaaggatcgtgtggaaataaaacgcgccgtatatctgcgtccaatattgcccgtacgtcttatcccgcgcaaactggctgaaccgcacgtggtagttgttcatcttgaacgtacccagcggcgttgcgccgtccttgcccgtggaacacagcatatagcgtacagggatagtatattccccatcgtcgtcttttgtatagaccatcgttacctggtgctccacgtccacgatgatcttatacgtccccgcctccgggaagcccttcgggtattcgtccctcgtcccgtcgtcactcatcaccagctcttcaaagctcatgcccaccgtgggggccagcttcaaaaacgtatcgcacgcctttgccttgtccgaattcaaaagcgtaagcgtctcttcatccgcgatccccgtggcattaagcccattctgcctctggaacgtctccaccgcaatcttggtcgccgaaccgtaataatccgtggccttttccgcatgcagataatcgagcgccattaacctctcctgcaatttggtgacttcagcagacgtcatgccttcctccagcgccaccggcgtcggtgtcggggtcggctccggcgttgccgtcgcagcgggcgtcggcattgcgcttggcgtttcggacggcgtaacagacggttctcccccgcccgccgcgcagccgcaaaccagcgctgcaaaaagcatcaacgccgccgccaaaacaaccgcttttttccatttatttgtcattctctttttgtcccttgttattctaattttttccgttttaaatgaacgtgcgttcatttaaagctctcccaacagacgttttgcctgcctgatgtgttcctcgacagcgtccggcgcaggtccgcccggtacgcttctcgtgttcacgcatgtctctaaacggatcgcgtcaaagatgtcctcttttgcctccggcgcaaattgcctgatctcgccgagcgtcagttcgtcgatcgcttttgcgttctgctcgcaataaagcacaagatgccctaccaccgcgtgcgcatcgcggaacgccatgccgtgcttgacgaaataatccgccgcatccgtcgcattggtaaagcccagccccgcgctcgcgcgcagcttgtcctttttccattccgctgttttcagcatcccacacatcaccctcaggcatgcgtttaaggtgtcggctgcgtcgaacacgccttccttatcctcctgcatatccttgttgtatgcaagcggcaggcccttcatcacagtaagcagccccatcaaatcgccgtatacccgtcccgttttgccgcggatcagctctgccatgtcggggttcttcttctgcggcataatgctcgaccctgtggaatatgcgtcggataaacgtagtgtgccgtattcgtttgtagaaaataaaatgatctcctcgcacagcctcgataagtgcatcatacacatcgaagccgccgacaaatattccaacgcaaaatcacggtcggatacgccgtctaagctgttgcgcgtgatcccgtccatgttgagctcctctgccaccgcctcgcggtcaagcggatacgtcgtcgcgcataacgcgcccgacccaagcggcaggatgtttgtgcgcttgcggcaatcgagcagccgttcaatatcgcggtaaaacatttcaaaatatgccatcatatagtgcgcgagcgtcgtgggctgcgccttttgcaggtgcgtgtaagcggacatgatcgtgtctgtgttttcctccgccgtatcgatcagcacattgcaaagctgtatcacgttttggaccgtctcgtcagccatgcggcgcatatacagccggaagtccgttgcgacctgatcgttgcggctgcgccctgtatgcagctttttgcctacgtcgccaacacgctcggtaagtaaccgttccacattcatgtggatgtcctcgtcgtgtacggaaaattccaccttgcccgcgtcgatatccaaaaggatgccctcaagccccgcgataatcttcgccgcgtcctcttgggggatgatcccctgctcgcccagcatgcgcgcgtgcgcgatgctgcctgtgatgtcctcgcggtacatgcggcagtcaaagccgatggaggattggaacccctccgcgaattcgtccgtattcccttcaaatcttccgccccataatttcggcatactgtttctccttgctttgtttcatacccgtttattataacataagcggcgtatattataacatagggattttgccttttcccctgacgggtgctataatgaacgcgaaaagaggtcgagggattatgctatatgagatcataaacggcgtgatgtccgaaacaaaaaccatcgacgacaaaaagaatgcggaatatgtttccgcatccaccatcaaggaattcgcagcctacatcacggatattccaaaagatacgcttcttagcgttcttgaaaacccgtctatccgctttgaatcgcacgacgattttgatttgttatgcatccctttttatgaatttgagcaccgtttgaaggacagcccgcccatttatattttcctgcacgcaggccatttgcatttcgtatgcgataagtgcggcgaactcgtttcccttttagagcgttttgcgcataccaataaagaggaagcgaacattgggcggctcgtgtgcgcctttttcgagtatatcctggacgacgacctcgcctccctcgataagatcgaagaacagatcggcgacttagaggacgacgtgctgacagaccagcaaaaaaactttaccaaaagcatcatcgacaggcgtaaacacctgatggtcatcatgcgctattacgaacagcttttaaatatattggaatcccttgccgtgaacgaaaaacacgttttcaataaaaattccgtgcgctttttgaatattatctacggcaagacgcagcgcctttatgataaaacaaaaagcctgcgcgaatacgtgtcggagatccgcgaggcttatcaggcggaggtcgatctgcgtatgaacaatatcatgaagatcctgactatcatcacaatgatcttcatgccattaacgctcatcgtcggctggtacggcatgaattttaagatgcccgaatacggcgcgccgctcgcttatcccgtcgtgatcgtcatcagcctgatgatcgtcatcgtgagcatcgtatttttcaaaaaacaaaaatggttttaacgtgcgtgctttgcgcgcggatatggctttgggtcgtccgtcagccctaagatgtaatccacgctgactttgtagtgcgcggcgagttttatgagcgcccaagcaggaatctcccgctcgccacgttcataccttccatagacgattctatcacaagttagaatagctccaacttgtttctgtgttaagtcatggtcaatccgcaaatcttctaatcgcttaaaatacatggaagtcacctcttgactatgttaccaatcggtagcataataaaacttatgaagaaactatatagtctcttcgcgagaggtgcttttatgaaatcgcgcaaagatatttcctatgaggaatataccatttccaagctaaataaagagcgcaggatcgatatcctgcgccacatcgacgatctgaccgaccgcctggaattgaaattggacgcggagggtcagcgcctcttaaaagaactcattttctacatgcagcttataacgcttccataaacacagcttaccgcagacttggatggtcatttgcgtgccgagcctgcgcgctttgcttgcaaaggcgtcgggagcaaatatcccatcgcgcttgcggatcaatcacgcttgcaacaagcgaatagcgcgtagcatcgtgttatttgccgtatgcgagttagacggcgcgaaacgcgtctgttgtttgagcaagtaggcagataacacatggcaagcgcggcattcgcatgagcgcgtaggccgtcattacatgccatacactattagactattccgtacgtgccgaatccggcggagtcgcgtcggtgcttgcaggagcgagttgcgaacagccgcaacaaccgacagaaacaaaaaccggcgggaaaacgcagcatgtttacatagcagccgcaaagaagccttgagctgctcaggcaatataagcaggtattgtcgccggatttcagcctgtataccaatatgccgtgtgccatgcagctttggaacacatttcgccgaagatggataagcgcgtactggcaagaagaaggccttacggtgatccccgccgtaacatggggcgatgcgcgcagttacgatttttgttttgatggaatcgagactggctccgttgtcgcggtatccacactgggttgtcgaaaaattaagttagatttcttaaagggttttttcgagatgtaccatagaataaggccttcaaaagcgttatgctattgtaagccattttccgaaatgtttgatttgactgaggtcattgagctttcttatgaaggaactaccgttcgtcagaaaaaaccttgtgcccgacaacaggagaacctttgatgggcggcgggggtggagtatcgggcaggagtagcagaacaacccgcagactacctactcgaagtgctcccaattcaaaaatcacaagggtagatggcagtggaaatccaattcaggaaagatactatgaccacaaaggacgggcaaaacgagatgtagactatattaatcacggaaatccaaaagatcatcccgatgtatcgcatgaacataactggaattggacagcccccagtaatccaaccagaacaaaataggaggaataactcaatgagggataaaaattatccttacgaaaatttagtaagtgatttgactatcgggcatgaatttgaatttgagtataatggcaatatgtactcttttagtaacagcaggaaaggctaccatctaatgaagtatggcgatgaaacatccaccacttttcagacccctcaagaactgctttcaaaagggagaatcgaaggtatgcggattcaaaagatatgggcagatgtgaaaaatttgaccatattttagttctacattcacatggatccttttaagcataaaggtatagaaaaaacatcgattaaaatacctataccaagagaaaggaactgtttcggaatacaaaccgtaacagtcccttttgttatttgcacggttatgtaacatcctttgtctcgtattgaccgccgtctttccggccatcgcttcggtgatccccgccgtaacatggggtgatgcgcgcagttacgatttttgcttcgatggaatcgagactggctccgttgtcgcggtatccacacttggtgcaaaacactacaaggatttgtacctaccgggcttcatcgagatggcagcgcggctgaagccccaaaaagtgatctgttatacaacgcctttccctgaaatggccgatttatgtgatatgatagaagtaccgcatgaatcgattacagtcaaagcccagagggagagcggttcctgatgggcggcggtggatacggctccggcggaaaaagcaggtcgatcaggctgcgcgtaaaaatcggcgttcaaaaaggcgatgcgccattcagcagtgaagctcaaaacaagcaagttagggacgtagctgtagcattagggggattgactaaagcgcaaaaacgagaattgtatgatgcaataaccggtatgggttacggatatcacgaaattataaaattaataaaggatatgtttggaaaataaggagaaaactcatgaaaaaacaagaaattcaaaagatcaaagataaggtgtctacactgttgggacagcgaatggtaaatgtggaacgttgggataattatgcagaatttggatttattcccgccaacagagatgacaaggttattcaagatcaacttcgcacaatggaaagaatcgaagaagattttgtgattgcggcattctgcacatttcgctggacatatcaagatcgaataaccctagccaatcaggatatgtttcagcccagtattcccatacttgaggcaaatggattaggaatcagggacggggaagacgtaccggatttcgattatctgaagtatggtaacaatcgttttgacgaaatcaacgaacaaaattttagacctgtttatgaacagacaaaaggtttcattgtcaaaaaaattaacatttccaaattcggtgatttaacaatggagtttgaaaacggctatcggctggaagtgtttctcaatgtttccgaccctaataattgctgggaattttatgaagttggcgtgcccaacaacattacggtcggcggcaacgccatcattgaagaggatatcgatgttacgcagacctgatcttgcacaacaaaaagaagctgccttttagggcagcttcttttgatttcccataatattttgctatctcgtattgaccgccgtctttccggccatcgcttcggtgagcagcgccacgcccgcgatcgcaaggtaaatcccgatcaccacggcggatgtaagcaagcccgtaaacggtaccaccacgatgatgacgccgaggatgatattcaaaatcccgcttgtggaaagccagcctgtgtccttttcgtccaggctgcgaaacctacggcaggcaaacatctgtaaaaatccgcgataaatcgtcacgaatccgagtacgatggtaaagatgttcatcatcgcgatctggctcgccgggtctcccagtgaaagcacgaggatgaccacgcccatgatcgcgaggataaatccgctcacaagcgttgccgcgtttcggtacgccgcagccgtgcggaaataaacgatcagttcataaattcccaaaagcagtatgccaagtcccagcgtgttgttgatgctcacgcttcccaaaaacggcaggaacaccattaaaagtcccataacgatcaggcatacggaaacgatcacccccgcgatcctgtgctgctttacgcgctttgcgatttcctctggttcaaaatccatttccggtatcaaatcctggttatccataataaagtcccctccgatgattatgataatgatttagcgtatctgtccgtccccgtctatcacgtacttgaccgtcgtcagctcctcaaggcccatcggcccgcgtgcgtgcagcttttgtgtggaaatgccgatctccgcgccaaatccaaactcgaacccgtccgtaaagcgcgtgcttgcgttcacgtagaccgccgcgctgtccacttcgtccttgaatttctccgcatttttgtaatcgttggtaacgatcgcctccgaatgccccgtgctgtatctgttgatatgcgcgatcgcttcatcaacatccttcacgaccttcaccgaaatgatgtaatcgaggaattcggtttcgtaatcctcctgcgtcgccggaatcgcgccgtacttctggctgatttcgcagccgcgtatctccacgccgcttttttttaggtcggcaaataccttgggtaagaactccgccgctacgtcggcatgcacgagcaagctttccgccgcgttgcataccgccggacgcgtcgtctttgcgttcacggtgattttcgccgccatacctaagtctgccgttttatccacgtaaatatggcagttacccgtccccgtctcgatgacagggatcgtcgcgttctgcaccaccgactgtatcaggcccgcgccgccgcgcgggatgagcacgtcgatcatatcgtttagcttcatcatttccatgacagcgtcgcgcgatacgtcgcggatcagccctaccgctcccttcgggagccctgcgacctcgcctgcctgtatcatcacgtccgccaccgcagagttggaatggatcgcttcactgccgccttttagcacgactgcgttggacgttttcaggcacagcccgatcgcgtccgccgttacgttcggccgcgcttcatagatgatgccgatcacacccatcggtacgcgccttttggcgatcataagcccgttcgggcgtttcgtcgcgctgatcacgtcgccgaccgggtcggcaagcgccgccacgtcccgcaacccctgcgccatatcctggatacgagctttcgtgagcgcgagcctgtcgatgagcgccaatgtgcgccccttttccttcgccgcttccacgtccagcatattctgctttaaaataaactccgtatggtttaaaagcccctgcgccatcgcttccaggatcttgttcttatcgatggtcgagagcttgcttaactctgtttttgcatccttggccgcctgcgcgacctttaacaccgaactcatgtctttctcctcgtctttcttcgctttttttcagtataacatcccgtttcgcctaaaacaagctataaacattctattggatcgtccggcgcgattcgcagatgccgtccgcttcttcccgtcggatttttttgcggtaatcgtgcctgtccgctttttccataccgaaccgctccgccattttttcatccgaagacgcgatcgtgatcataccgccttcctccgacgcgatctcaaagcgttccccctccaaaaccgcatagcttttcacgagctccaattttgaaacatccgcctttgcgaccgttttcacataattcccgtaaggggtcgccgcgaatccctccggcgggttttctccatcgtagatcagcttcaccccgtcccctgttttcgccgcggcatactccctgccgccatagactgcgtaaagcccgctttttatcatatccttacccttccacaggcacgaactgccccgcttccgcggtatatacgccgcgcaggatctccgtcccgtcctcctgtatctcaaaaagctgcgcgccgtcgtccggcaccgtaaattcgttcatgacccattccggcgaaccccagcgtccatttgtccctgtcgtaaagcccgcgccgccaaagggatacgggtcttccacatcccctccgttcgcgggggatttcggtacgaccgcctggtctgcgttcgccgcgtaaaaacggatcaccgcatagttttcgccctccggcttgaaatatgtcccgtcataatcgagccgcagtccgtaatacatatcctgcaccgtttcatattgcttcacatccgcgcacgccgaaatgaagcccttgggcgtcttatattcccctgaaaggtatttgtccatatcgtaaagcgtgatcaccttttgcatcaacgtcttgccatccggcttgatctgccggtcgcggatcgcgttcatcttcgcaagctcgtccgcgctcatatccgccgccgccttttcacacagcgtcttgaattcgtccaccgtaagcccctgtgcgtccgcgtattcttcgatcgtgtccgtaaacccgcccgtaagcccctgtaaatattggtggtcgtacagtacgtccggttcccctgccgccgtttcctccgttgccggttccggcgtttgcgtggccgcaggcgcgctctggcatcctgcaaaaaccgccgctgccaatataactgcgatcaaaagtcctaaggctcgtttcttcatccttttttctcctattcgttattcgaaataatccagtatcccctgcaatataccccgcgcgcactcctgctggtaatcgtccgataccaataattcttcctcattgccgtttgaaagacagcccatctccatgttgcatacggggaccgtgctccagttaaagcccgtctggtcgtcccgctcgcttacgccgcggtttttcgcgcccgtctcgtccacaaacgcgctcaggatcgcctctcccgccgcgcgactttgctttgcgatgctttcggtgtacggcccgctcggcacaagcatcagcgcgccatgcaccgaggaatcgtccacaccgtcgcagtgcagccgcactgcaaggtcgacccccgcgtcattgaaaagctgcgcgcgctgtttgttggagatatccacatccgagctttcgcgcgtcatgacgacctccgcgccgttttcctccaataagtcccgcagcttcagccccacggccagcgtgatcttatattccggcgtgcctgtgttccttccgtccgcgcccgaagataccttggcctttttcaccgaagaatccggcgcctgcggctccgtttccgaatttccctgcgcctggtgtcctgggtcgatgccgatcgtgacgcccgacaatggcagcgtacattcctttgcgtcgtccgcgtagatccgcgcgagcgtttcgcttcccgcgatcccgtctgcatcaagcccgttctgcttttggaacagcttaaccgccctttgcgttgccggaccatatttcgtggtgaattcgtctattttaagatatccaagctccgacagccttttttgcagggctgtcaccgcctcgctttccatgccgcttttcagcgtcgggtcgggtgttggcgtgggctcgggcgtcgccgttgcgcttggcgcaggcgttgcagtgggcgtcgcggcgctcgccgtgctctccgccgcaacagtcggttccgccgaaggcggcgcgctttcccctgcgcacgccatgagcatcatgcccgccaggataatacaaagtatcccaatgatccgtttattcatatatgtctccttttttttcttccttttattataaacgtatccgccgcattacacaatctcccgccatagtgttataatgaaacaaaaacaaatgggagacagccaatgaaagcattgatcacgggagcaagctcgggcatcgggcgggatatcgcaaggatcttgagcgaacggggttatgacctcgtcgtctgcgcgcggcgcgaagaccgcttaagtcagctcaaaagcgagttgtccaccaatgtggaggttttccccgccgacctgtcaaaaaaagatgagtgcctgcgcctttatcacaccgtatccggcggggatatcgatatactcgtaaataacgcgggttatggcgtattcggcgcgttcgacgaaacggaacttgacgcggaacttaacatgctagacctgaacatcatctccgtacatatattaacgaagctatttttaaaggattttatcaaaaaagaccacggctatatcctcaacgtcgcgtcttccgccgcgtttatgcccggtccgctcttttcgtcttactacgcttccaaagcatacgtgctgcggctcacgcaggcggtgcgcgaagaattgaaaaaggcgcgccgcaatgtttacattggcgcgctgtgccccggccctgtcaacaccgagttcaaccagacggcaggcgtgcagttcggcatgcacggcctttcttcggaagccgtcgcccaatataccgtcaaaaaaatgttcgcaggaaaaacggtcatcgtgcccggcgccattatgaaatgcgcgcgcttcttttccaagctgctgcccgacggcctcgtcgccaaaatggcctacggcttccagaacgcaaaaaagggctgatactcctttcaaaagctgtttatcaatagtctaaagactttggaaagagggatcgtgctttgaaaatcgcaatcgttacgggcgcttcgtccggcatgggcaaagaatttgtaaaacagatcagcgcgcaaaaatgcgtggaacagatctgggtcatcgcgcgcaggaaagaacggctcgaacagctcgcccgggaagtggatacgcccttgcgtatttttgcttacgatttgacggatatgtctcacatcgaggcgttaaaacaggtgctgaccgaagaaaccccctgcgtgcagcttctcgccaattgctcgggctttgccaagttcggcgatttcgagcaggtgcgcgaacaggatgcgctcgccatgatcgaccttgacgtgcgcgcgctcgtcagcctcaccatggcctgtattcctcatatgctctccggcggccatatcattcagatcgcctccaccgccgccttccagcccctgcccgacatgaacgtatacgccgcttccaaagcctttgtcctaagctattcgcgcgccttaaaccgcgagctgggcaggaaaggcgtgtccgtcacggcggtatgccccggctggaccaaaacagaattttttgatgttgcgcaggaaaatgcaagtaagggcgcagtcaaaaatttcctcttcctttccaaacccgaaaacgttgttgcgcgcgccttaaaggatgcgcggcgcgaaaaggatgtctccgtgtatgggatatttaataagctacatatgtttttcgcaaaaattttgcccgacagtaccatcatgaccttttggaacgccatgaaataattgcttttcataaaaaatcaaatggatatcaaacttattttggcgatcgtcacgatcacgcttgcgcttgccttttataccgtcggcatgggcgcagcctaaccttaaaacctgaccttagctcttgacgaacgtcccgccgtcaaggacgttgtatgttttcccttccgttgttttcgtgccgatgcacattgtgcctgtttccgtcgcgcccgacttggtttggtaacgcgttaccggaaaacgttcctcatccgccggatccagccctgaaatattcaagtttgcccatgtgatcgtaaaatcatcgtcgccgttcttatagatccgccaactgatatttgcggcgtcggctccaaattgctcctgcaatagcctgttgacctcacccgcgatcgccgatccgtgcgaagcgttcgaatccagcgtggaccttacgggcttactggtaaaatagtccttaacgatatcgagcgaccataagtcctgtatatattcgtcgtccgttttgggcgcaggcggctccggatcatccccgccgccgcttttatatgtgctgcacacacataccgcgctcccgtcagccgcaacagcgaccgtatatgtgccgtctcgccggtcatccgcgcgccctgtttttcctttagcccgcatgcaaaaagtctcgtttttcccatgtctaagctaaaaatagtatagcaatcttacctatgcaaattccaataaaaaacaaaaggggcaggcgatcctgtccctttgttttaaatagaaatttatctctgttgtgccgtccttattcctcctccggcaaatccgcattgtggaaaacattttgcacatcatcgttatcctcaagcatatcgagcatcttttcaaacttcaccagttgctctgcatcaagcgaggttgtagtctgcggaacttttaatatcatgtatatcattattcaattatgggtgttatttcatcacccaatgtcagtatatcatctctcaaatcgctttgtaaaggtctgagttatgacgtacaagacaaaattttgtgtaagggaatccacctactaaaacctcttttggcataaccaaagaaggggcacattgtttagtacccccaccgcttttatccattttcctcttaacaacataaatcatatacaccgataaagacagaaataatttcatcgctatctatacttttttgaaatgtgcattgccattcatttttgtctctctcacatttagacctgcatgaagggcacgtttccaaataattttcgatgaccgataaaacattgacaaagtttttattctctttgttaaaaacgattagtgaagttttgacatcgcgccatgtagtataactaaataattgttccaacgcctctttaaattttttctctccatgccaaattttacactcggcaatataagccgccttactatcggataagatatgtatatccgtttttccgaccttgttaaatgtctcgcccgttacatttgaatagtgtgtattcaaatgagaaatgataatatctcgcaattcttcttcctgcaatttgataaaagtggatgccgctttttccatagaattacaggacatactaattatgttgttgatgttcacataattttcatcagaaatagcatattcgggtttttgtggtttgaatgttggtcgcggagatattgtcttgggtttcttttttagcatgattggtactgtgtttggtgcattaggattaatgtttagtggcaaatctaactttgagcgcatggtaatataatcttcagtttttttacgccgcgtctcgagagattcctttacagatgcactaagagaatcgttaaacctttccacctcaatatttatgtagttaatattttttagatacttgtcaaatttacctttaaattgggaaaggataaattctttctgattgtccttactttctaattctttcttggtgtattctaaagaatatctgattttcccaagttcgtcgctagttggactcccaacgaaatcaacctcaaaacgactcattatatacgttgatgcttgaagataaagtaatttctcattaccgtcaaagggaatggtaaatgtcactctatatccatccatagaaaaatattcagattcatatgggttatgattataaaatgaattatattgcttaacctttatttcctttaactcatgagcgacgttttccatataaagagaaataggacttatcgtatatttactacataaataatttgcccattcatcaatatcggtatttaaaatttcttcatttgtaattttctcaatatcagaactgatactttcattccaactccgtaaccaatctgacaaactttctcgattaaaaagttctggcatattttaatcctccatgttttccctaatattattttaattatatcactttgttgagacatattgagtataatcaaaaacgattgtttatgataagattccttctccctcaaaagtgtatgtatttcacagtattttttgtgtcaaaacttttttcaaaatcatctcgacaataaccaccctttctgatagagtactctcaacaagagaaaggtggtttttatattatgattatcggatatgcaagggttagcacggaacagcaggaattagcacggcaaacggatgccttgatcgcttatggcgttgatgaactatacacagaaaaaatgacaggcacgaaagcgagccgccctgaactggataaagtgaagatgatagttcgtaaggatgataccgttgtcattgaatcactttcgcgcttagggcggagcagtaaagaccttttgaatctgattgatgaatgggatgccaaaggcgttaaattggtatcgttgaaagaaaatatagatacatctacccctacgggcaaactgcttttaaccgttctttccgctatctgccagtttgaacgggatataacagtacagcgcacacaagaaggattgaaagcggcacgggcaaggggcaggaaaggcggcagaccgaaagccaatttaaaagccgtagaacgcgctgtacgcctttacaattcacagacacagagcattaaggagataacagaaataactggtatatcgtccgctacgctttacagggcgatacgggaaagacagcaaaccgccaattaaaatacatcaaatcataagtgtcaaaacgcgcaaaaaacaatggcggggcggcaagcaacacataatcagtgtttctataccaccccgccatatcttcaatcaaacctatctggcatgaaaaatcacatttttctatataagtaaacctgtgaaaatctatgtcaatccctatttatggcgtttctgtattgcctgttcctgttgcgctaggcgttggtgattctgttgctgtttcttttgctattggtgtttgcgacggtgacggtacaggaacagaagaggtaggcgttgtttcctcttcgctatctatggatgactgttcagcaattccgcttgctccgaacaagcgttttccgcaaataaacttctctttaaaccaagttcccatttctctcattacaactttatccgcactcgatgaagcatcaataaccatattatcacctaaacatattgctacatgtcccggcaagcagataatatcaccatactgtaaatcttcaaacttatcgactgtctcataggcgctgcttgcccatccgcttgatgtcaaaaatgtataactaccatttccactgttattgagtgcataatctaccaatcctgaacaatcaaatcctttatctggcgttttgccacctaacgcatagcgtgcatccaattgttcaaacgcttttgtcacaaatcgttctgcctgcacattacctaaggatggtggcaatgtcaggttatacaagcgtttcccgcatattattgaatttctgatcgtgtcatccatttcagttatcgctactttcccttctgcttgtgatgcttcaatcatctgattgttgcctaaatagatagccacacgcccagacatacatagaatatccccacgcaaaaatccaccttccgcattcggataattactgtttgcccatcctgatgatgtcatatatcccacagcactcccactttgtttaagcacataataaatataccctgacgtatcaaatgaatcgggacctttacctcctaatacatacagttttcctaactgtgcttttgccgtatcaataaatacattcacatcaggtatgatgggttcaggcgttggtgtaggagaaggtgtcggttctgcgcctacggaaaaactctggaaggaacaatttttgactatatatccttcatcccacgaaccatcacttccagtaaaaaacgcaccacctgtaacggtgaaagttccatcttgaccgatacttacatttattccaccaaattcactatgaggtagaaacaaaccacttaaataaatcctgcccgttcttcccgctagtgaactgtctgccttaccagttatcctaacattaagtttataggcaatcccttgttctaaaacaagtccgctaccccaacccacgctatatttattgtcgatttctttcctataatcaggatttgaaacccatttatcaaaatctatagattccttatctgtcaattcaatatcaatagaactgatatgcacagttattccatcatccgtcacccaatcaaactctttgtttggatagcacggaaattttgtacctacaggaacgtctgctaaagatgtacctacgttcccgcttgaaccttgccctgtagcagatacgcctgtatcctgattaccaatccaccaattaccattagaaccgatgtatggcgtttgtccatcacttccatctgcaccgttttgaccatctgcgccgtcctgtccgtttctgccatttctgccgttcttgccatttacaccattattggattttgatgtcgttgctgttggtgatggagaaggtgaaacagacggagaagcacctggcgttggtgatacacttgcggatggcgtaaccgtagatgtagattccatatcttgctgttcagaatttgatataaccgttcctgttggttctgctgattgctgttggttgttttcgccgcatccaaccacagatacaattagcataatagatataatcaataacgaaataatcttcttcatagcccatctgaccccacttttttttataattatatacattatatacaaacagaaagattttttcaacaataagcgtatttatatacgcctaaaataattttttaggcattacactatagtagaggtgttttaatggcaaagattggcgatacattaggtaataacctacaacaactacgaaagaataatcatctaacccaaaaacaggttgcggaacgtgttggtgtttctgtatctgtaattagttcatatgaagtcacgcaccgcactccatcatatgacgtattgataaaacttgccaacctataccacacgaccactgactatcttttgggaagaacccaaattaatgttttggatttagatggattatcccctgatgatataaaggtagtcacagaaatggttgaacatttacgaaagagatagcagggcatccatttctgaatgccccacaacccatctctgacataaaaaatcacaaaacttctaataagtcatcctgtgaattttcatgctgtcctttcgtcactttccaataggtcttcatataatgttctgaatttctgcaccagttttgcctactttctatcctgtattttcccaaaccgatatatagcaaatatttatttatcttgttttttcctgtatatcttaatgacatgaacaagtttttgctatgcacatcattttcaaagaacctgctgaattgttgttttgtttccccatacatttccatatacagccactcattcaaatattcctcaatggcttctatgtcatagtccaattccaaatggcggaatatcccaaaatcaatatccacctctttacagaatctttctatgaacgacgcatactgcgttgacacaacttcatcaaaaatttcaatgtcatattgcaacttttgatacaatgcgttgattactgtaaatggttcgctatgttccggctcatcattcaaccgcaatccgacactataatagtcatccttatagttaagggaaaactcatcccaatccatttcaatataatcccttatcgtcctgattttttcttttttgcgatgtagaaggtaatgaatcaatcttggattattttttatgtagatagtgattttatcattctcatctataaaacgctttcgccctatgcattgaataatcgtaataatatcagtaaaatcacagattatatgccttacatcacggtcaataatattgaccccgcaatctaaaacactggtagtacaaagtacccgttcatcaaatttctggcgttctatcatcctatcacgcttatctttatcaacatattcaaaattcttatgtgattcactacaaacaaacagcccatcaaatttgtgtgcgattgctattccccttgttgtatggcggcaaaaaacaatcgctttatcattcggcggcatattttccagaatacgttcaatgcatgcatcattcgtgtagtaatatgcgttttcaacctgtggtggtttcgccacacgatagatattttcatcatcaaaatctactactcttttcaaaatctgcggtgttgccgtcatgaatataacgggtttcgccacattttcagaaagtgtggtaagtaatatgtccgaggtgcttttcttcagttcgctatccgcgaagaaataatgcgcttcatctgcaacgataaaatcatattgattcagttcgtgtcctaacgcacattgccgaaaaaattcctgcggcaaatagccaaaatccgccaccatcttttgataattgattagttttatgacatcccgtttttctgctatctccaattcaatctgccgtttcaggttgttacggttgcagaaataaatcatctttttcccgttccggcggcaatagtcgtataaatcgtttaagataaaatatgtctttcccgttccacaatctgcgtgaatcaatatcttcttttcgcctgtccaattttcaatattcttttcagttataatattattaactcttgtcatgttttgttctcctttaatatatacaggcgttcttatttttcacctgtactgtccaatgccatccaaaaatgggcgcacaaatatttctttgcacaatatctgccaaacgcaaatagaaacccattaaaggtttatcgtcttttaatatgttttgacctaaataacattgaactggctatgccgatatgatttcgcataaccttaaaaaaggaaaactgtcgtacatattatcgtttgtaatcattctatcaaaccattggcttgccctccttcatcattattacggctttacgtcattctgaccgcaaatgcaaaaattccacccacttaggatgaaattttgtttattataccatacttttaattgtttgtcaagtgcttttgcatagtgcgcacccctgaaacccgcataaataaagggttttcgggctaattccatgcttgaaattgaccgtccatttggacgcaacccccattttcccagaattcccctccctaccgttccaccttgacaccatctaaagcggcaagggcgcgcaacattcccgctatcatatattcctgttcatcttccgtcaattttttaattattattttaagcgttccagataccctatgtggcattttcctgtcattgactgattgagatactatttcaatatggtttgccaattctacctgttcccgcgccgtaaggcgcacctgcttatattctttccacgtcataacatccaccaccttacaaattcatcaatggacttgtatgaatgctgtttatcacaatatctttatctttcatagaatcaagatatatctgcgttatcttcacatggttatgccccatcagccgcgataatgaatataaatccaatccgttctttaactgttcctgcgcaaaccaatgacggcaagtgtggggcgaacatcgaatatcatctgatatttttgcctgttcccctgcaattttcacaatgcgttccaccgcttcaagtgtcagcggctttcccgtcctactcagaaaataattggttggtattgttatcttatcgcggaaataagcatatctcgctgtggtgtaacgcaacagcattttttccagatatggacttttcccaacggaacgttccttgtttccttttccccataccgttatgtaattatccttaaccgcattactttggaggttgcacaattcactgcaacggattccggtatcaaataacatcgccagtatcgccctgttccgcacactaagaaaatcacagccgttatatgtctttatcatccctaccacttctttatgggtaaacgtcttaataatcggcttattctgctttccccaacgcactttttccatcggggatacctgtatgtattcttcttgctttaaataattgaaaaacgacctgaatgttttaattaatccattggtatatgttgccttgcgtccattcttttgcaggaacataagaaacgcttttatgtgtaaatgtgtgatttcctcaatctggataatcccgtattcccgttcaatgaaatttaaaagataagcattattatttttataccccttaattgtctttactgataatttgcgcacctcgcaatccagaataaattctttcaataccgcttttgcttccataataaaaaacctcctcattccttgcagacatacaagatattaagaaggttttatcgcacatcgcagttcagtaagtatcaaccgcataccgcacgtcgccgcctgttggcggtatatcatagcccgcgctgtaccacttgcgcatcatacggctataacccgcatggttacgcggtttttactcttcgtccggcaaatcagcattatgatagatattttgcacgtcgtcgttatcctcgagcatatccagcatcttttcaaatttcacctgctgctcttcgctaagggcagtcatcgtctgcggcaccatgtcgagctccgcagaaaggaattcgtagcctgccgattccagcgcttcacgcactgcggaaaaatcctcaggcgcagttgtgatctcgtatgcgccgtcctccgccgaaaagtcctccgcacccgcttccagagccgcttccatcaccgtatcttcatctcccgcctgcgcatcgatgacgatcataccctttttatcgaacataaaagatacgctgccatttgtgcccagcgaaccgccgaacttatcgaacgcatgacgcacctcgcccaccgtacggtttttgttgtccgtcatcgtttccacgatcacagccacgccgccgatcccatagccttcatatgtcaattcttcatagttgatgctccccagctctccggatgcttttttaatcgatctggagatgttgtcgtttggcatattgttggccttcgccttggcgatcacgtccctaagacgcgagttcatcgacgggtcaggtccgcccagcttgaccgcgaccgcgatctccctgcctatttttgtaaaaaccttaccgcgcgcggcgtcggcttttccctttttgtttttaattgtcgaccattttgaatgtccggacattattttctcacctcaaacccataataattactgtacgatagtaccataactcggcctttttgtaaacttctacagcttttgttctgtgaatattttgtgaaaaacatttatttgtaatgtgaattatgctagtattgttgtatattgctatatatagatgtagctattcatacggaggtacgcaattcaatggctcccaaaaaagattttcgggatacgataaacaatgccggaggaaaagttaaaaaattcttttcttctgcggccgataaaataaaaggcgccttctcgggcgcggcaggtaaggtcaaaaaggcaacggctgaaaacgttcgcaaattgcggcgtcctacgcccgtgccttccgataataagaatatgtctgaaagtccggttaaaaccaagacctatgtctctaaaccgacaaagtccctgcccgaaaagccggccgaccggaagcctgcaaaggtttacgcccccaaagcgaaaacagcagcggaaaaaccggggcttcccaaacagaaaacaggcgacgttcccgtttccgatgaaacggtcattttttccgagccggccggtaaaaaaatcaaaacggctgccacgcctctaaaggagcagacgcagtctattcccgtgaccggcggtaaaaaatcgctttttaagccgcgcgaaaaaaagccgaattttgtgcttggcgttatcttgacgacgatcaagttcactttcgtcgccgtcatcattgccgccgttatcggcgtcggctcgctgatgggcgtagcgaacgcttatcttgataccacgcccgagcttgatgtggaaaaaatacaggaccagagtttaagttccaaaatctattaccaggacggcgataccacaaagctgcttgcaacgtatacgggcaatgaaaaccgcgactatgcaacgcttgatgaaattccggagaatttgcggaacgctgtcattgcggtcgaggatatccgtttttacgaccataatggcgtggatttccgccgtcttgtcggcgcgttcctctccaatatgtcctcaagcaaggtagagggcggcagtaccatcacccagcagctagtcaaaaataaactgctttccaatgagcgttcctataagcgtaaactacaggaagcgtaccttgcaaccgagcttgaaaaaaaatataccaaggacgagattctggaagcatacctgaacgcgatccctctgggcggtacggtatacggcgtgaaaactgctgctaaagattattttgccaaggacctatccgagctgaatttacgcgaaatgattctgattgcttcgatcacgcaaaatcctacaaaatataacccgcgccttgcgacttatacctatcccgagcatctgccggacctcatcaaccgtatgaatatcgttgcggaacgtatgtattgggcgaatatgatcaccgaggagcaatataacgatgttgtcattccttcctcggaatacctcgctcccgagtgcttggagcccggctatacaggcgataagatcctcaaggacggctatatcgatacgtggaaggaaatgatgcagatacagcccgaatcccccacgaacgaactgtaccaatatccgcatttcgtggaatatgtgatacaggatgtgcagaatttcctgctgcaaaaggagggccttgaagatacggaagcaaaccggcaaaaggtagaccgcgaaatgcgggcgggcggctatgagatctatacgacgctcaatccgacgatccaggaaaccgtacaaaatacgcttgcggattacgacggctatcctacgctgcctaacgatgtagccacagaaatcacggacagcaacggcaatgtcacgccgcagccccagtcggcggcggcagtgatcgataacgagacgggatacctcgtggcgatcgtcggttcgcgggataccccgaccattcgtcgcagcatcaaccgtgccgacgagggtcttcaggtcggttcatccatgaaaccgcttgccgtatacggccctgcattcgatatcggttacggtcccgtttccggcgttccctatatcgacgcccccattacgggctggctcgtcaaggacggcagcgaaggcgcgcctaaaatgcaaggcggagccgatcagggccctattacgatgcgcaccgccattgtcaaatccttgaacgttgccgcagcgcatacgctcatggactatgtcaccatcgatacgtccgtcgaatacctgcataagctgggtatctccgacgataatattacgcccacgggcgttgggctcgcgctcggcggcagcgaggtcacgcccatccagatgacggctgcctacgcggccatcgccaacgagggcgaataccgccagccggtttcctttacgcaggtacgcgacgcaaacaaaaacgtgatcattgatacgactacggaccgcgacgtgcacgaagcgttcaaaccaagtacggcctatatgctcaccaatgtactggaagaggccgtacgcgaaggcacaggcacagaggcaaggctcagcgatatgacgaccgcaggcaaaacgggtacggtcggtgaccacaaaggcgtcacctttgcgggctatacgccctattacacgtcctttgtgtgggtcgggcaggaccagaacaaatccatcggcaagtattatggcggcggcgtagccgctcccttatggaaggaatatatgcagaaaatacacgagggcctgccggataagcagatcatcgacggtacgccggaggatttcaatatcaatacggaggcaaaggtctgcgcctacaccaacctcgcgcccggcagcgactgccttacgttcacaggctggatgctgagcggcacagaaccgaccgaggtctgcagcggttatcattccgttaccgaaatcaagatgtgcggtgtttcagggatgcgtttcattgaaggcgtatgccctgaagaatcggcatattacctcaagtcctattcgttcccgtcggattccccctacgccaaatggagcggcgcaggcagtctggacgcaaccgatccggcaatgtcggaaggcgctgagacctattcgtcgggcggcgatccaaatacggattgcaacgtgcacttccctggatgggatctgccgtccgaatccccatcgccttccccgaccgctacgctgcctccgtccccgtcgccgactccttcaacggttcccgagccttctccctcacaggagccccagccgcccgcaggaggctgaccggatccattgcccaatcaaacaaaacgcaagcccccgcgccgacgcgcacgggggctttttgtatgcacaaaaaaaggtccgtatgcttttccatacgaacctttgaatgtttgctttacttcgccgcctgcgcgcccagcttgagcgcttcttcgttcatggggatcaggtgtgcttttttctcgcccatgatcttggcgaggcactcgatgatcgtcttgttgtcgaccacgtgcgcgcattcgttgtacgcgcccagcatgaccatgttcgccgctttgacgctgcccgccttctccgcaagcgtgttcgccgggaccttgattaccttgatgtcgctgcgctgcggctccacctcgatcaggtcgctgtctaaaagcaacacgccgcccggcttcaagtccttctcatatttctccagcgacggcctgttcatgacgatcacgcagtctgcttccacaacgacgggagagcccacctcgtcgtcagacacgaccacgttgcagttcgccgtaccaccgcgcatttccggaccgtaagagggaagccacgatacgtttttgccctcattcatccctgcataagcgatgatctgtcccgcgagcagtacgccctgtccgccgaatcctgctaaaataatctgttctgtcatgattatctgccctccttcgttacacccaaaggatattggggaatcatgttatcctcaagccatttcaacgcttccaccggatttaacccccagtttgtcgggcaggtggaaaggatctctaccatagagaaacccttgccctccatctggcactcgaacgcctttttgatggcctttttcgtcttgatgatattcggtacattatgtacggacgtacgctcaatataatacgcgccgtcaagcgtagcaagcatttccgccatacgcacaggcatgccctgcgtttccgcgttccttccgtagggagaagtcgtcgtgacctgtcccacaagcgtcgtgggcgccatctggccccccgtcatgccgtagatcgcattattgacaaaaatcgtcgtgatcttttcaccgcgcgccgccgcatgtacgatctccgccgtaccgatggacgctaagtccccgtcgccctggtaagtgaacaccaggtcttccggacaagtgcgcttgatacctgttgcgaccgccggtgcgcgcccatgcgccgcttccatcatgtcgcagttaaaataattgtatgcaaataccgcgcaaccgaccggcgcaatgccgaccgcctgatcctgcatgcccatttcctcgatacactccgccaccagcctgtggatgatgccgtgcgtgcatcccgggcaataatggaagggcacgtctgtgagcatctttgttttctggaatacctttgtcatgattatttgccctccttcagcttaagaagcgcttttacaatagcatcgggagtgggaataaagccgcctgtcgttccgtagaactccaccggtacttttccgtttaccgcaagtttcacgtcctcgatcatctgtcccgtgttcatttccacacacagcatgccttttgcatggtccgccgcttttgcaaacgcctctgtggggaacggccacagcgtgatcggacggatcacccccaccttaacgcccatttcgcgcgccttaagcgccgcgttcttggcgatgcgcgccgtcgtaccgaatgccgcgatgatgtagtccgcgtcgtccgtcatgaattcctgcacgcgcgtttcgttctttgtgatctccgcgtatttcgcctgcagttggtcgttgacttccttcatcgattccgcttcgatataaagcgaattgataatgttgcggtccctggatttatccttccagccgtttgccgcccatgtcttttcaggcaggtcgcgccccccctttttctcgctgaactcaaccggctccatcatctgcccgatcatgccgtctcccaaaatcattacagggatgcggtactggtccgcgatgtcaaagccctccgcgacgaggtccgccgcttcctgcacgctcgaaggcgcaagtaccaccaaatggtaatcgccgtgcccgccgcctttcgtcgcctggaaataatccccctgcgacggcaggataccgccgaggcccggtccgctgcggatgatatttacaataaggcagggcagctgcgcacatgcgatatagctgatcccctcctgcttcaaactgatccccggcgaagaagaggaggtcatcacccgcgctcccgcgcccgccgcgccatacaccatgttgatcgcggatacttcgctctctgcctgaatgaatgtcccgccaacctgcggcatacgcttggacatatattcaggaacctgattctgaggcgtgatcggataaccgaaaaagtgcgtacagcctgctttgatagcggcttccgcgatcgcctcatttcctttcatcaataccttagccatttatcttttcacctttatcctaaaaatttgattgaaattatttgtccacttcaagagcgcaatccggacacatacgcgcgcatgacgcgcagccgatgcaatcctccggcttttcaataccgattggatgatatccttttgcattcagatgcgatttatcaatcgccagcaagcttttggggcatgccgcgatacacaggccgcagcccttgcacgtatcttcataaatcgttaactttgccattttctcatcaccttttatatgttaattttttagccttttcgcttcgtcacgcccaaaagggcacccttatagagtatcacttttcactttcagcgtcaacaagccaatcggggaaagtgtagatgctgagcgggatttgcggaatcctgcatcctgtgtcgctgaactctgccaatatttccggtttgcccgaaacatagagaatcggcactcccgttttcgcgctcacttcttcgcatactttttgaccgtccaaaagatcggttatgctgctttcacgtcccaggttggtgttgttgatcagtccatcgattttaagacgtatacgcccgctgatctgtatcatcatctccgcaatttcttctgccgtttgctgcaacggccggcgtgcgttcaccacataatagagcatcacatcgccgcgtaccgccttgaatttctggagcaggccgccgagcgcagccgcgccaaccggatcgccgcccgcgtcaaataccgccgtctcgctctcaaaggcagccatgacctccgccgaaagcacaggcacgtccacattcgtattcgcgtacggcggcgcgatcaatttaacgccgtgattttttaacagttcttcgctttccgcgctcctgaaatatggattgacaacgtccatgtcgacaagcgtcgtctgcttcgtctccgcaagccgcagcgccgtattgagcgaaatctccgttttgccgcttccataatttccggcaaatatattgaatcttttcattttttctcctatctgaaacggcgcgttatacgcgccgccattgccttatttccacctgtgatatcaataaagtctctccctgcatatgttgccggcggcgagctgcataggccaccttcctttacgatatggtcaccttcaccgtcgccggactcgccgccaccttgacgccgaggtcaggctcgttttcaaacttaacgggaacgttttcatgcactccctttgtaagcccggagaggtcgacaaacggctttaatttggaagcggagaacgaatcgaaggcctcctgtgtgcccgtaacatcgacgtcaatgttggccggctcaatcttcacgcttgtcccatcctctaagttcttgtacgcgatcttcaccgcggaataggtttgggtttcctcaggctgcgcgatcgtcaactgcacctgcaccgtagacggcactgccgccacgacgccttccggcagttttacagtcgcttccacaatcgtatccccggatgcgttgtcaaggcttaacggttccagcgtcgcgctgcttaatgcctccaatatttcctgcttgccggccaggttcacgttggccggttccacgcttacgcccgtaatcttgtatccgtctgccagtcctgttgcagacgcctggatcgccgccgtatcgatgggtacggacttctgcggatagatgggcatttccacgatgaccgaaggaacgccgctaaagaggctgttgcccacttcattccctttgtcatccacatacgttaccctgtagctcgcctttgcagactcggtcaggtccccgatatcgacctcgcataccgcctttgccaccttttccacattggattgcgctcccgtcaccgtgacgaacgtttccgaaagcactggttccccataatacagccaatctttttcgtcgcccgtggtttttacttccaccggcacttccttggaaacgatgtcctccaccgtaaccgtgatcgaagacggattgacggtagaaacgctgctttccgtgagtgtcgtttttccctcgatctgcaatgtatattcgcccggcgccttgatatcggaaaggtcgacgctcacctggatcatattttcattcaaatattgcaatgcctgcgcccgcgcggaggccgtcacctccaccgactttacgaggtcggaaataggcaccgtcgtggtcaggttattttgcttgagctgctccgagccggtataggtgaccggaatatccgaaaacgttttggtcatgtacgggttggtggacgcgatcataaagctccacaggataaacgcgaacacgagcgccgtcagcttcattttccaattatggataaaaaggcgtttcaatatctccacaaacttgctcatttgtcgtcacccaccttccttttgaatttggaagcggtgagttttttaggtttttcctcagcctccggcgtgtaaagctcggagaggatgtctttcagcatttttgcatcaatataacgtttcaacacgccgtcatatacgaacgaaataattcccttttcttccgaaaccaccagcacataggcatctgacacctcagatattccgagcgacgcacggtggcgcgttccgagttcctgtgcgatctgtttattgtccgagaggggcaggaagcatccggccgccagtattttttcgccgcgcaaaatcatcgcgccgtcatgaagcggtgtgttcgggtaaaaaatattttctatgagttcgctcgaaatatcggcctggagttctgtgccggattccataacgtcgccaagccccgtttttcgctcaaatacaaggatcgcgccgactttttgtttggacatattaagtacggcgcgcgaaatctcttctatgatatactccgcctttcgcacgtccacctgcgccttgctggcaaagctgaaaatcttgccgcgccccaatgtttccagtgcacgccgtatctcgggctggaacagtatcacgatcaataccgcaccggcaggaaggatcgcgctgaaaagccaggatgccgtcttcaaatcaaacgcgacaaatacgcgcgacaaaatcaaaatgatgccaagcccgatcagcaccctgatcgcccgcgttttcgcaagcagcttgatcaaccaatatagtatgactgccacaatgacgatgtctaccgcatccagccatgtaaacgccatgaaactgttaaacagcggttcccagaagttttccaaattactctcccttgtattccttcttttcgcacagcagcatcgtcaggtcgtcctccggcttactgtgcaattcctcacgcacttcctcgatgaatgttttactgtcaaaatcctttttgcccagcatctggaacaactgctccttgacctcggggtcgctgtggatattatccactccgtccgaataaatcaaaaagcgcataccctcttcaaaggtaaagttgccgtccgaaaacggcgtatccaaaaaccagtcgcataatgggtgcgacggcatatacaattctttgaattccccgtccttatagagcacgggcatgactgaaagccccgcgttcgagtaggtcgcttcatttgttttcaggtcaataaccgtaataaaagccgtgatgtagatcgcgtccgataagttgaggtccaaaaactcatgctccgcataattcagaatctccgacggtttgaatatacccgtcaggcaggctgcacgcacaacccttgagaaaaacaccgccagcatcgcaggcatcacgccatgtccggaaacgtccgccaaatagatgacgagtttatcgccgtacaccgtgcagtcgtaaatatctccgccgaccgcctcgcacggaaaaaagcccgccgtcagttcatagccgcagcccaccttgggcatcgtgcttttgacaagcgcctcctgcaatttacgcgcaagctgcagatctttctgcatttttgcgttctgcatgagcaggttttgtttgatattataatccaaagtgatatcgcggaatacttccactgccgcgatattgaggtcgtttttatccttgagcggcgaaacggtcaccgaataaacgcgtccgcctactttgcgcgtcaggcgcttagggccgccttcttccaagacttcccgtgacaggcagtgctcgcacggctcgtcctggtggaacggctcgtaacatttatgccctgccgtaacgccaaaccgtttttcaaacgccgcattcgccaaaatgacttttccatcccttgagatcacgcgcaccatatcgctcatcgcgcctaaaatggatgccagatattcggtctcgtttatgatcgtattcatagggttatttgtcctcaatttcacctaaatattcctgcaatttcataatgtccaggctcatatcgctgcaccgttcattctgccttagtatttcgccgtccgtaagcggcttgccaagcgcaatacgctgcatactcatcttgttgagcttatcacgttccgatgcgaactcctgcatcatgtgatccagcttacgcaaggtgtcctttttattcaggccgccttctttgctatcttccttcatcgcatccccttatcactcatcggcgatcttggccgataaaataccgtctgagcgaaaaacgcggagcccttttttctgcatacaatatactgtcacactctgttccgtgatttttcttacataaacacgccgctgcgatattcccttcgccccttcgtaaatcacgatagcgggcttatcctcacgcaagcaaagcgtcagcgtttttaaaataatatcgttcatatcgttgtccttacatccttatactaccatatatgccgtgttttgttaaccaaaaaacgtaaattttttgtgtctaagcaggcttcatgctataataagtgcaggtataattttatggatggattgtttttgacaacaaacagcctgatcggtaccatcgcgtttttcgcgggcgtggtactgcttgtgtgcgaacttcttaaaaaagggttgtcgcgtctttcttttgtcgcgtacgcctgttttgtgctgagcagtattttcctctcggataacgtctttttttgtatactcacgatagcaggcctttccgtcctgttcctggtattgctttatttttaccggcgggagcaaaggcaactgaaaaaaaacaaggaagaagataggaaccagccatgaagatatgtcccctttgtaaaaccaaatttgaagacagcgcccagttttgccccaaatgcaaagcacagcttgaggaattgaaaccggccgataaaaaagaaaaggaaaaaatcccaaaatccttctggtttaccctgctcggcgttttcgggttcatcctgctcgtcattttaatttataacatcatttattcaggcgtacactaaggcgcctgcaacggaggtttcaaatgggtaagctcaaaaatcttgcaaaggtagcgggaaaactgaaaagcaggaaatggaagcgcgtgcgcgcgatcatacgtgattacggcatgcgtgaatttttgcgccgcgtgaaagaaaaaatgcgctacggggatatggcgcgcagcatctaccagcgtatttccgtgatcaccaacgaatcctatatcaaggatccgcataaccccgccggcttccttgccgagcaggaagtcagttttaccgttattcccgcgtccgtcaacgtcggccgtgtcgatatcctgacagccagcaaagacgcgcaggacagccttacactgacgatcaaaaatgccaagggcaagcccctgcttgaaatggtctccagtgaaataaaggataacgattatactgtttttaccttccttcccctcctgcggacggtgaatacgccgcttacttttacgttcacagcttcttcacccaggagcggcgtttatgtaaaccggcgcaaaaagaaatatggctttgacgtagcgggcggcggcagcgtagcgtgcaggatctatgtccagttcgatgccgaatacctgtactggatgaaaaacaatacgcccacgcccgatgaatacgaagcgcagcgctcccactcgttcgattattcccctaaaatcagcattatcgttcctttatacaatacgcctgagcggtttttccgcgaaatgatcgattccgtcgcggcgcaaacctatccaaactgggaattatgccttgccgacggcagcgctgagccaaatgagttggaaagcatcgccgcttcttacgatgatgcgcgcatcgtttacaaaaagctcgagaaaaatgaaggcatctccggcaactccaatcaagcgatcgaaatggcgaccggcgattatatcgcgctgcttgaccatgacgatacgctgatgccgcaggcgctttacgaaaacgtctcgctcatcaacgcggacagggattatgaattcatctactccgacgaggacaagatcacggaagacggcagccggcggttcgacccgtttttcaagccggactgggcgcccaacatgtttctcgcttttaactacatcacgcatttcgtcgtcatgaaaaaatcgcttttagacgagatcggcacgttcaacgcgcagcttaatggcgcgcaggactatgatttgtttttgcgcgcaaccgaaaaagcaaagaagatcggccacatcgcggatatcctttatcactggcgaatatctgaaacgtccacagctttttcctcggacaccaaaagctatacggtggaagcgggcaggaaggccctcgaggcggcttttgcacgccgcggcctgcaaaacgcgcatgtaaccaacaatacgctcgataattattacgtcacgagttacgatatccccgagccccatccccttatttccatcatcatccccaataaggacgagcccgcgacgctcaaaaagtgcatcgattcgattttgtccaaatcgacgtatgatcattatgagatccttgtcgtggaaaacaacagcacgggtaaggatatctttgcgtattacgacaagctgaaacaaaatcccaagatccgcatcgtcacatgggacggtattttcaattacgcggcgatcaataattttgccgcagggcaggcaaagggggaactgctgctgttcctcaataacgacgtagccatactttccgccgactggctggaacagatggccatgcacgccgtgcgcagcgggatcggcgcagtgggcgcgaagctgtactaccccgacgataccatccagcatgcgggagtcgttttgaagatcggcgcggtcgccggacattcgcataagcatcttgaccggtgggatgtcggctccttcggccgcatgacgtttgcccaagacgtcacgggcgtgacggccgcctgtctgatggtcaggaaaagtgtctttgaagaggtcggcggcttcgacgagcaatttgtcgtcgcctataacgacgtggacctttgcctcaagatacgcgaaaaaggctataccaacttgtttacgccgtttgccgagctttaccattacgagtccaaaacgcgcggttatgaagaaacgcccgaaaaaatcaaacgattcgaaggagagcaaaaaaagtggcttgccaagtgggataaaaaatatccatacgatcctttatacagcaaaaacctgacgcgtgagttcgaggattattccatcaacccaaaccgcacccgtgacgactaaaaccttgtaatcaaaaaagctgccttacggcagcttttttcatctcgataccagcctgtatacggtaaacccacccaggaatccggattcctcataggctgcatcctgtccggccttttcaaaaaccagcttcccgttttctgacggctgcatggtccatccgtcctccagcatcttatctttgaacgcactttcctctcccgaacgcacgaggtaatcccctccgccaagatcgtataccccgccgaggatcatggtggtgatcgcgccctttgtctccatcagcggtaaatattcgtcaagctcgctgtgccctgcgaacacaaacacaaaaatgatcaaggcgatcagcaatattaatatgttccgaagcgcgcgcacacatctcacccctgtttttggattttctgcccctattatatacaaaatcgtatggcaatgcaaaagatatacgcggcttaccgccgcccgctgcctgcatctcttgcctccgtcagtcctgtgtcaaatcaaagcgcccccgccattgccaaacagcgcgcaaaatgataaaatagtagcgttatggatacgagcaagataacggtccttctgaccggcagcgacgaaactttatctcggcaactgaaccaggccggcttccgcatacttgagccacagccggacatgactgtgcgcgcatttttccagtttgcgctcaaagagtcggacgcgcctctttttgtgcgtcttcatgccggcgaaggctttgtcctggaagatatcgaaagggtcgcgcaggcggccttggacgatcctgaaaaggtctatgtcggttcgcgggagcagaccgtgaaaaaatcccttgcacagaatatttatggcttcctgtcggggatcgaggcacaggacgtgtgtccctcgctgtttgccatgtcacgcgggaatttagagcgcatgacgcatatgaaaagcaaggataaggcgttttgctccgatatccttttggaagcacgtgagaaaaacctgacgatcgtggatattcccacacaggccaaaaccgatacggctcccggttttgagctcctcacttcttcgtttaagctgtatcttgtattcatcaaattcagcatcgccgcattcgttgcgtatctggtggatatcggtaccttttacctgtttcaaaagcttttttcgtttctggacgacgaatttaaaatattgacggcgaccgttatttcaaggatattgtgttctattgcgacctacttgctgaacaaaggcgcggtattcaactcgcaggcccgttcacgcggcaccgtggtccgctttattatcctcgcaacaggacagctcattgtttcctggctgctcgtctggggcatcggttcgctcctcggcggcggcgacgaagtcaatacgttactcaaggtcgtcgtggatcttgtcatcttcatcgcaagctttaccatccagcgcgactgggtgttcaaggaatccaaaggcctcttaaaataacagtatcgttggggcaaagttatgtaccaggtaaaaaaccttgtttaccgtgacatcctgcatattggggacctgcaattttccaggggacggtcgactgccgtcaccggtccttcgggtgcgggaaaaacgacgcttttaaagctgctcgacggcctttacctgcccgacagcggccatattttttttgacggacaggatatccgcacgataaagaacctgcggcggcgcgtcacgatggccgcccagtctcccgtgatcttcgagggcgacgttggccgtaaccttaagatcgcctttgatttttcagagaagcccttgccggacgattcctttttcgaggaggttctcgagtgtgtgcagcttcccattccgctcggccacgataccaaaatgctgtccggcggcgaacaatcgaggctgtgccttgcacgcgcattggcgctgaaaagcgaggcctacctcatcgacgagccgacaagcgcgcttgacgaggagacacagcttgccgttatgcgaaacatccttgcattcgccgggcaatcggagagcacggtcatattagtcacgcattcgcctgaaagcgcccaactgtgcgacaggcatgtcgagctcaaaaaagggggcgggccaaaatggattcggtagtcatcaccgtatggcagcttgtcgccgcttatatttttgtcctcctgctgctgatccttttcaagatacgcggcatcgacaagaaaaaacaggtcgtcatatccgcgctgcgcatgacgctgcagcttacgctcgcaggttacctgctggccctcgcgttcaataacccaagctggtggcttaccctggcgattttcgccggcatgctcgtgttcgcggtcctgaccgttacacaccgcgcccctaaggagctgcgccccatcgtaaggcgtcctgtcgctttggccattatcatcggttcttcctgcgtcatggtttatttcctcgcgctggtcatcggtgtaaagccgtggtacgaaacgcgctatttcgtcagcatcgccggcatggtgctcggcaattccatgacaggcgtggcgcttgccatgaatacgctgatcacggagttcaagcaaaaccgtaaccggatcgagcaagcgctcatgctgggcgcgagtcccaaacgtgcggtgcgcgacagtatcaacagcgcgtttgaaaacgcaatactgcccacgctcacgtccatgctcacaatgggtatcgtcacgctgccgggtatgatgaccggtcaaatcctcgcgggcacgccgcccgaactcgccgtgcgttaccagatcggcgtcatgctggccattttaggcagcgtcgccatctgcgtgctcatctttttgtctatggccgcgcgctgttttttaaagcgcgaattcagcggcgtagaggcataaataatttgtttaatgacgcccccacgggttaaatatattttaataagccacaagcaaaaataaggagtgtgtattagtatgagtatcaaacatatcaccgaaggacagttcgacgcagaggttatgcaggacaaaaacatggtgctggtcgatttttatgccgattggtgcggcccgtgtaaaatgcttgcgccgatcctcgaagaaatcgacggacaaatccccaatctgaaaattgtcaagataaacgttgacgaagcgcagaaccttgcgaaggaatacggcgttatgtccattccgaccgtgtatctctttgacggcggtgcaaaaatgggccgtttcgtaggcgtgaaatccaaagaagaaattatcgacttcgtagaaaacgcttaatttccagtccgacagggttccctcacgaatccaagacaacgctccaagcgcgatgcatttcgcgtttgcatatacccccaatcataaaaagaggctgaccgctgagcggctgcctctttttatgtgtcatatttttaaggagtttaacgattctgccggttcattacatgtggatcgcgccgcggcttgcgccgaggaacgcttccatcaatgtttcgctgagcgtcggatgcgcatggatcgtgcttcctgccgcctctgccgtcgcttcgcagcgcattgccataacagcctcttcgatcatgctcgaagcctccgcgccaatgatgtgcacaccgaggatctcgccccagcgttcatccgcgatcacttttacaaagccttccgtctcacccagtgtcagcgccttgccgtttgccgcatacgggaatttgtaggttttgaccggaatgccctgctccttggcctgcttttcactcatccctacaaacgcgatctcgaggtctgtaaagatacacgacgggatcggctgctcgtctgcggattcgatttcgccgaacatatgctctaccgcgaggacgccctgctcggaagccgcgtgcgcaagctggaacttaccgttgatatcgccgatcgcgtaaatgtttgcaacgctcgtacgcatgaggccgtccacttccacgcagccctttggcgtacgctttacgtccaatttttcaaagccgctgccttccgcgctcctgccgaccgcttcgagcatcatttcgcattccatcgtctcgccgttggaaagtttgatcgtatattttccgttcccttccttgatctcgtcacatgtcgtgccggtaagaaggttgatgccgctcttcttcatatggtctgcaagcgttgcagctacttcgtcgtccgtcatcggcaggatctggtccatcagctccacgaccgtcgttttcacgccgaacgcgttgaagatacacgccatttcgcagccgatcacgccgccgccgatgatcacgatggaggccggcagtttatcgatatcgaggatctggtccgtattcaggagttttgcatctgtctttaccacggaagccggttttgcgcctgtcgcaagcagcgtgaacgcgcatgtatatgttttgccgcccaccttgacttcattggccttctcgatcaccgcttcgccctggatgagctccactttgtttttggaaagcaggcctccgactccgtttgtcagttgctttacgaccttgttcttgcggtctaatatcttcttccagtcaaacgaacttccgctcacagaaatgccgaattcatccgcgttctggatatctttccaatgctttgcgcttgcgtaatatgcctttgtcgggatacatccacgattgaggcacgtaccgcccaccgtatctttttctacaatcgcgacctttgcgcccagctgtgccgcacggatcgccgcaacatatccgcccgggcctgcaccgatgacgatcaggtcatagtcaaagtttccttccggacgctgcgctttttcttttaccgcttctttttttgccggggcaggcgctatcggagctgccgccggagccgccgttgcttctgccggagccgtcgcaaccgatttatccacttccgggatttcctcgccttcctcgccaatgaaagctaccggttcgttgaccggagccgtctcgccagcgttataataaattttcaaaatcttaccggaatacagtacatccacttccagggaggttttgtctgtttccacttcaaagatgtaatcgcctttttctactgtcgctccctcgtctaccaaccattttatgatcttgccctcagtcatcgtcatgccgagcttaggcatcgtaataaaattacccattttgtccctttcttttttctcatacaaaaattgtcaattttttccgtttgtcttctacattctggcagtaggctgtttccactctcacttcgcccttggctcgtgctcatggacatcccttgccggggcatcgttagccgaaccataggttcggacgatgctccctcctttttgctattcaagctgctttagtcaagcaactgatcaggattctcgataatatcgcggaaatccttcaagaatttttcgcctgtcgtaccgtcgatgtgcctgtggtcaagcgttaagctaaggcccagcatcgggcggataccgatatcgtttccaaccgcaaccggtttgttggtcatattgccgatcccaaggatcgcgctttccggcacattgatgatcggtgtaaagtactgcaccggcgtacgtccgtaattggagatggagaaggtgcctccggaatattcgtccggcgtcagcttgccgtcccgcgcacgcgtcacaaggtcctcgcgcatcttggtgatctcatataaggacatcatatgtgcgttcttcaggttcggcacgatcagcccgtcctcgccaagcgagaccgcaaggccaatgttgatgttgccctttacaaggacatgatcctccataaaggaagaattcaacatcggattttctttgagcgccatcgcgaccgccttgatgaacagatcggaaaacgtgggctttacgcccgttttctccaggcagtccgccgtatattgcttcatgagcggcttgagtttggagcagtccgcctcgcccatgatcgtatactgcgccgccgtatcgaggctcgctttcatctgttttgcgatcgttttacgcataccgttgagcggtatgatcctgtcctcgcccatcatcgccttataagcaagcacgtctgatttgcgtaccacgtcgccctcggccgttaccgcgtctaaatcaacgcccaggtaatccgccatcgcacgggccaaaaacgtcgctttaccgcccttgaaagcaaggacgtcactaagctgcacatagcccagaatgccggttcccttgaccttcgcaaggtcaatttttcgttctcccgccacgcgttttgcggcgggtgtggacatcacttttgtcatttgcgcgtccccctatttcagcaattcttttgctttttcgtaaatcgtttccgcctgcggaaccaccatagcctcaagctgcggagaatacgggatcggaatatcgtccgcaccgccgaatcttctcactggtctgtcgagatagaagaacgcttcgctgtcattgatgacggaagatacttccgcgcctacgccgaacttctgaacgccttcgtgtgttacgagtacgcgtcctgttttctttgcagaagcaacgatcgtttccacgtcgagcggcgaaaccgtgcgcaggtcgaccacttccgcgtcgatcccgtcagcttccagcatttcagcagcctttagggccttcaaaaccgtcatcgaatagctgatgatcgtgatatctttcccttcacgttttacatccgctttgccgataggcagtacatattcttcttccggaacctcgcccttcgtgccgtataaaagcttgtgttcataaaatacgatcgggttatcctcgcggatcgccgctttcagtaaccctttgacgtcataaggtgtcgacgggcatacgacttttaaccccggcacatggcagaaccacgcttcaaggctctgggaatgctgcgccgcagcgcccgtgccgcttccttccggcgtacggatcacaagcggcatttttacctggccgcccagcataaagcgctgcttagccgcctggttgcaaataaggtccatcgcacacgttacaaagtcggagaacatatattccacgaccggacggtaacccgccattgccgcgccgactgcgatacccgtgaatccgccttcggaaatcggcgtatccatgatcctgtccgggccgaattcttcgaggaagccgcgcgtcacaccgaagcacccgccgtatacgcccatatcctctcccagcataaagaccttctcgtcccgtttcatttcttctcttaaggcgtctgaaaccgcctgtacataagtaattgtactcatttaataacctccgttatgcaaaaacaagtttttttgcttcttcaagagtgatcgtctccgcagcctgcgcatactccacagcctcttcgcattcctgctccaccaaagcgcgcaggtcgtcgatgtccttctgcgtaaaaccatgctccagcatatacttcccaaaggaaacgatcgggtcttttgccttccactccgcttcttcctcgcgcgtacggtatgcgcgcttgtcgctcttggagtgtcctaaataacggtaggttttcgcttcgataagcgtcgggccctcgccgcggcgcgcgcggtcagccgcttcttttacaacgtccataatcgccaggacgtccgtcccgtcaacgatcacgcccgggatgccgtatgccttcgcccgcgtcgcgatatccttgacggatacgctgttttccaccggcgtggacatgccgtaaaggttgttttcacacatatatacgatgggcagcttccaaagcgccgccatgttgagtgcttcatggaacaaaccggagttcgtcgtaccgtctccgaaataatcgaggattaccttgttgctcttatcctttttgatcgcgagggctacgcctgtcgccatcgggatcgcaggcccgatgaccccgttcgccccgaagttgcctacggaaatatcaacgatatgcatcgaaccgccaaggcccttgcagaaaccgtcttttttgccgagcaactcgcacatcatgcgctttacgtcagcgccctttgcgatacaatgcgcatgtcccctgtggcagctcatgatgtagtcgtccggctcaagggcgttgatgccgcccgctgccgtcgcttcctcgccgaccgcaagatgcgtcgtcccgtggatcaggcccttcataaacatttcgtttacgcgttcctcaaacgttcgggaactgaacatctgataatagattttcctcatttgttcttttgttaattccattttttcacccgcttatttgatagttttgtgtttctcccgctcgaaattttacatttgtaaaacttctttgcaaaagttatatttcatgcttttatgatactatttcctatgcttcctgtcaatcccatttccttcataaatgtaaaatttattgtattttgtaaagaaagttgtacggttttccgccaacaaaaaaacagccatacatgtatggctgtttttaagctttttaaagacttctgtaatagcggattcccttttcgatttgctgatccgttatgttgttgccggaaaatacggaagatccgacgatgagtacgtccgcgccgctttcgagcaatttcggagccgtttccttattaacgcttccatctatataaatgggaatatccagcccctgctctaaaagcatctttttagccaagcgtatcttagcatagatcgattcctcaagtttctgcccgccgaagcccggctccacgctcatcatgatcaggtagtcgagatggtgcgcaatatattcgatgctttccacgcgctccgtgggctttaacccaatgcctgccttgagtcccaggtccttgacacggcgtaccgcctggatcgggcaagcgcacccgtccatctgcacggttatcatatccgcccctgcctgtgcaaacatatcgatataaagctgcgggtcgtaaagttcaaaatggacctcaatgggaatgtgtacgacctcttttaaatccgcgatggtcttgggtccaaacgaaaaattggacgcatattttccatctatgatatccacgtgcaattgatccgcgccgccgcgctgcgccgccaaaacggcctgccccaaaaaggcattgttacaattcagtattgtcgctgctaccttatgcattttttcctgcttcctttccaaactcaaaacggcttatacagtccttctttcgccgcatattcttccacctcgaacgccgtcggctcgtctgttataagggcgcttaaatatccgcccatcagcgccgagacgatcgcctgtaccttttgcccacctaccgcaataccgaccctgatcggtatctgcttgaaatcgtttgcgttgattcccactacgcggtcattgaattcatttttgaccagcttgccgcgaatatcgatatgctgccctaaaatatgggaataaagccccgcgtcgtataactctttcgactgttcgggcgttatgaagttcgcccataccagcgtattcttatccggcttattggtccccagcgtgatcactgcaatatccgcctgcttcgccatctcgagctggtccttaataccgccttcctccaccaggaggtcgcgcaccttacgcgtattgaccaacagcggcgcgtttaaaatgtacggtgtgccgcccgttttttccgcaaggtccgtggtcagcttaacgccgtccttgtatacctcgcgtatgcgtgtaccacccatcatctgcaatattttcacattattgaggaccacaggcgaaaacgcattgaccatcttatagacgctggcgccccagccgatacccacgctcatattgtcctgcaaaaggccttccacataccgcgcagcggcaagccccacgttatcggaactgatctcgctgtccgcgacacgcggggtgatgatcaccgtttcgatcccaaagcggctcatcagttttttcttgacctcgaaggaacggagcgacgcttcgtgtatgcgcacctcgacgatccccagccgtttgcaggattttaaaatacgtgagatattggaccgcgacatattgaccttttccgcgatcttctgctgcgacatatcgtccatataatacattttggcgatacgtatcatctgttcatactggttcgcttttttgcctgttcccaagtctatgtttccaagctccatcttagaacccattttacttccccccgatggtttccgcacacaagaggccgcacgatgcgccttgcgcgcgcgtccggatgcgatgcagtaaaatatgattcttattatagcaaaaatgcctgcgcagtgtcaattgatatatatgcatggcacctattcacatttgttactttctagccatatccagccgactttatctcaccgtgtgcgtcgtcaccgcgtgcatccatcctttggaggtctggtacgcttccttgtacttctcgaaatagaaccggaattcttcatggcgtttcctgtccggatccaccttgcccgcgatcgttaccatactgtgcgccgccgttttcaggtcgctgtacgcgcccgcagccaccgcgccgatgatcgccgatccaaggcacggcgcttccgttaccttagggatataaagcggcaggttgcaaacgtccgcatgcgtctgcatccagaacgggctcttgaccgcgccgcccgatacgaaaataccgtccggcgtcataccgccgtccctgaacgtctgcatgatcgcttccgtcccaaagcagatcgattcgatgatcgccctgtataaatgatacggcgtatggtttaatgaaagcccgtagaacatgccccgcacgtcggggtcggcatacggcgtacggttgccctggaagtaatcgagcgccaacagtccgtccgcgccgatgggcagcttttccgccccttcgtttagcaggtcgtaaatgctccgtccctgttttttcgcctccacttccacattaccgcaataattggtcttgaaccagttgacgaccgcgcctgtcgaggtctgccccccttcgatcatttgcagcccgggaatgaccgcgtccggataagacccccacatccccttcacgtgcatttcccgttccgtcagcccaaggtgcagatgtgacgtccctgtgatcatcgcaatactgcccggctccactacgttcaggccgagcatacccacaaacgcatccgcgccgccttcgccgacgggaatgcccgcggcaagccccaggtcgtccgccgcttcttttttcaggccgcccaccggcgtccccagatcgagcacatctttaggaaacttatccaaaacgtcccccaaaccgatctcttcatacagcgaaaccggccagcccccgttcgggcggtcgtaataccagcgcggcgcagtcgtgtcgatgcttgccgtcagctctcccgtcagcttgtgcatcagccagtccacgcattcgaatatatattttgctttcgcgtacagctcgccctcgttttgtttgagccataacgcctttgccggcatggattccgccgaaacattgcccgttccgttgccgtttattttcagcgcgcggttccccgtcgccgtgatttgcttcgcctgcttggaggcgcgtacgtccatccacatgatcgccggacgcaggatattcatgttctcgtccgccatcaagaccgtacagcatgtcgtatccacgctcattccaatgatttccgacggacttatgccgctttttgccatgagggcgcgcgtcgccttacagatcgcgttccaccactcgtctgccttttgttccgcccagccggattttggcgtataaagcggatacgtttcatccgcaaaagcgaccggcttcccctgtaggtcaaacaatcccgttttgacgctgctcgttcccatatcgatcccaagtacatattccttcatatccgcactctccctgtcttttatctcttttatcttttttatctattttaccataaccacaccgtttgtttcaaaatctcttccaccgattttttcacgtttgtgcatcctatgtccttgcatcagtcttcactccctgcacattagactttgcaagaataagatgctataatttcatttatagaaaggtttgctttcgaggtataatgaatggaactgcacctgaaaaatacattttctgattttcgcaaaaatttcataacctatgttcctgtcctgattttttttccattattgttctttactatcgtgtttttctttggtacgcaatacgcgcttgtcatcacctttatcacgaccgcttttaaattcaggttccgaaaaaagcaaacggtccgttctttgttgagtctcttcctcgtccagatggcgctatctgttttggcattttttgcagcattgaatctttttctttgcatattattgaatatcatcgttccttttatcctgatttacctgcaaaccacgcagttcaatcagcagggttatttgacaaacgctatgctgttcgtattcctgcagctcgtttccgtcgattggagcaagtttttgcccatgatgggcgttatggcgtatgcttcccttttcctcgtcgcagggcttgccatatattatgtactgttccgcaggaaacagccaaactatatgcaggcgtgcaaagggcttggtatccttgcacgtgaatttgaaatgatggcggacggcagatgcgacctttccatgaaaaaagatatggttatgctccacacctctttaaaccgcatggcttataccagccgtgatctttcctatgtcgtacgcggcgaaggtaaagtccattatatgtttgcattgctcttccagcgttctgtttatttcatgaatgatttttcgcagtcgcagcagcgctgcgttccggacgtgcagcgcttgcatatcctcgccgccttccttgagaatgtgcagcaaaatatgagtaccacagacaacagcaagctgatcgccactgcgaatacccttgccgaagaaaccgacgggctaagcgagcgtttcgctgtattcatgcggaattttatgcatctgctggcgcttaccctgcaggccatgcagcaagacgattcccgtccagattggaaacttcccgcccatgcgcatcccctgtacggtctcaagcgccgcctgcgcctcgatacattcgaagttcgttttgcgctccgtctgagccttgtttccacgatcagcttcgccgtatgccggatcacacaaagcgaccatgcctactggctgccgataaacgcctttatccttttgcaacccatgtcggaagaaagcgcttaccgcatgaaaacccgttcgatcggtacgctcatcggctgcgcggtttcctttgccgtattgcccctattgccggtcggcctatttggccatatgctgttcgctgccgctatgctcactttgatgtatgtctttttcaggccaggcacatgggaacacgcagcctctgcgacctgctttgcgctttcccttgcctctatcaccatgagcggacaatcggcgatcgaactgcggcttttttattttgcattggccgttgcgctggttttcatcgtcaaccgctttttcttccccaccagcaaaaagggacaattcaaaaacaatatgaaggaactgttccatatccagcattcttatctttccatgctgcagatcagtacgcgccgcctgattgattacggcgttgtgagcgacgcgctcatttctttccatatgttctacgacgaagtacggaaatatttgaaggctccttccgtgcccatggataccgccccctatgaaaagatgctgcctgtcatgtggcgtatgaccgctgaaacggagcaattaattttttatgtgcaaaacgagcagctttctcctgctgagcgcgccgagatagagcggttttctgtccgcatgggagaccttttgaatggcttgtgcgggatacaggctcctccccgggcatcaggcaagcaccttaccgcttcctctccatatgcgagccatcttatgcagcactatcaatccaatttcgctgtgctttccggcctccaaaacgagattttatcattataaaaagccgccccggcatgcgggacggctttgctgttccttatatttttacgcatatgcggctacttcatttatcacagtgtccatatccagcttttggatacgcacgtcgacctgctttacgttaaggcccgtcatgctttcgatcgcgcgcacgatattgctgcgtatgctttgcgcgatcaccggaatggattttccatattccgcaacgatcgccgcttcaatggcaacttcgctttcaccgaccgtcacacggatccccttcgacatattttccattcccaaaaattcgcccaccccgtcgatcaggctgccgctcattttggaaacgcccggtacgtccgccgccgcaaatcctgcgatcgccgcaagcacttcgtttgtataccgtaccgtcccatagctttccccgctcctgggcttcagtgtattttcataggttgtaatcatctcatttttaagcatcgaatcacgctccttccatgtcgttccttgtttgttttgattcctgtcgaacctctgtccctcaactattaaaaacagcataccacacataggcggatcacgcttgatttgtttacaaattcttttcatttttattacatttctatttcttggcatacaaaaaaagcctgtaccaaaagacacaggcaaactttgatccgttttaatcgtccgttttcatactgctgccaaaagaccattccatgccgcttcccatgctgctgttgtaaatatatcccctgtcttttcccgcccgcttcgcctcgtaaagcgcaatatctgccttttggtataactcgtcgaaggccgtcccgtcgttcgggaaagacgccgcgcccacgctgcatgtagcccgcgcgatgatcccattatgctcgaagtccgtccgaaacgactcgcatacggcctgcgcgagctccgccatctgtgtatccccctggatatcccgcacaaaaacggcaaactcgtctccgccgatccgtccgatcacctgctgcgttcccacaacctctgtcatcttccgcgcagcctcgatcaacaccatatcgccaaagatatgtccgtacttatcgttgattcccttaaatgcgtcgatatcgatcacatacatcgcgccggagcttttcccccgcgcttctttcaggttctttttgacatatctctccgtcgccctgcggttataaagtccggtcaggggatcgcgttcggattgatcccgcagtttttcctcgcgcaatttttgctcttcgatatcctcgagtatcccgatcgcgcgcaccgcttttccctcattatcgtaaatattggtcatcgtgatcctgcgccataaataacgcccttccgccagtcttgtctgcacctcgcacgacgcctttgcttcgccggagcgtatcctgcggtacatttccaggaaaacacccaccgaatcgggatgaatggttttgttttccaccaaagcgtccggcacattttccattctgttgtcaaacccgtacatactggcagatttatacgcatgtatcatgacgcgcgttttgatatcgtaatcaaagatcgtattgtccatttgcgcaagcgcgatcctgaaccgctcctcgttgatgcgcagctcctcttcgatcttcttacgctccgatacgtcgatcaccacgcagaaaaaaacgtcccgcttaccttcgcgcgcaaaattgccgcgcacaagtatccaggctgtttttccgtccctgcgcgccatcctgtgttcgctctcaaagaccgttccttgttccagcgcttctttcaggctgttcctgacagccggcaggtcctccggataaatcgtctttgcgattttattatgcagttcgcacgtcatttgttcggaagtatacccgtaaaggtcataaaaatccttatttccgttcagaagggtcaggctcttgttgacctgtatcttacaaataccaacgggaatatgcgacagcatcccatccatgtcgccgctgcttaagtccatttcacaaaattgttccgggaattctattacggttgctttggaaactctattccgtttccagcttaatttttctcccacaatccacatctttcatctcataccaaatgagtcatgtatcttttctcttcattgtaacagcctgtcccctgttcgtctattaaaaagtcacactttttttgtttttttcatacgtatgaggattctatgacctatatgctcaattccgcatcaattttttccagccattccgggatcggtatcgcctgcggacatttttcttcgcactttttgcactgtacgcatttagaccccggcctcccaaaaaaattatacctgcgctgcggttccttcaaataatcatagacgatcccgtcattatagatatccatgatccacgggatatctataccctgcgggcacggcatacagtaagaacatcccgtgcacgggatcccctcccgctttccgtatatcgccctgatcccctcgaccagcttctgttcttcctgcgtaagaggtgctcctgcctgctgggcgcaccggacattttgccgtacctgctccatgtccgacatcccgcttaggactacggatacctcgctctggctccagacccaacgcagtgcaaggtcgctgagcggtttctcatagccgctgcgcgccatcagttcccttacctctttgagcgggtttgccagctttcccccgcgcaggggctccatcacgaccactccaagccctttttgcgccgcaagcttcagtcccttcgtgcccgcctgcgagtgggtatccataaaattgtactgtatctggcaaaaatcccatttgtcgtagccgtttacgatctcttcaaaagcttcatacgggccatggaatgaaaaccccacatatcgtatctttcctgcctttaccgccgcttccgcgcgggataacagaccctgctcacaaatcacgtcccatgtttttttcccgatcccgtggaacatatataaatcgatccggtctgtatccagtttttgaagctgctcgcctaatatcctgtcgtagtccgccgccgtcctaatacattgcataggtgctttggtcgccagcttcactttttgccggtacccgtccgcaagcgctttccccaccatccgttcgctttcgccggagtggtacaggtatgccgtatccacataattgacgccatgatcgatcgcgtagcgtatcatccccaccgcttctttttccgtgatatccgggcttaagacactgccgtccttcgtaggcagccgcatgcatccaaatcccagcgccgaaccttgccagtcaagttttccaaatttcctgtactgcatatgttttcacttcccgctcattttcttattcccagtatagcccgcccgcctgcacttggcaactgcaatatgcggtccataaaaaaacagtccgcgggattgtcgcgaactgcattttttaaagctttatggtttatgcttcccgttcttcctgcaatttcctgagatgcttctccatcgctgcaggcccctgctcatagtgcgcaatcttatcattcaagcgcgcaagagatgcctgcatatcctccatacgctccaaaagcctgtttcgctgctcgatcaacaatagcttacgcgcctcggccgtgccctcccctttttggaacaacgcgacatattcaatcaatgcttctatctgcacgcccgctttcctcatacatttcatcagcccgatccaattgcacgattcttcaccataatccctgataccgcttttgttgcgtggtacaggcgggatcagcccaatgcgttcgtaatagcgcagcgtatctgcggacaactcatatttcctgcttacctccgtgatcgtcatacgtcctccgcccctttctcgaacaccgccgccacctcccgcagccctgcaacgatccccaagtgctgcggacactgccgctcgcagtttttgcagccgatacagtcggaagccttcccatgcgtcttcatatagttctcataatatgcgccctgcaccgaaaacccgctgggctttacctgcttttccagattatacagcgcaaaatatgctgggatcgggatgtttttgggacatccgtccacgcaatatccgcaagccgtacacggtattgcgatcgtagcgttgatctcgtccaccgcctgcttcacgatcgcccgctcccttgcctccatcggcacaaattcctgcatataacccgtattatccaaaagctgtcccatgtcgctcataccgctcaaaacggtcaatatcccgtcatggcttgccgcaaagcgtaccgcccacgatgcagccgacatgtccggcgcatattccctgaataaccgctctaccttctgcggtacgttcgccagcgtaccgcctttcacaggctccatcacgatgatatcttttccattcctgcgcgcagcctcataacatttacgggattgtatactttcgttttcccaatccaggtaattgagctgcaattgcactacgtccacttccgggtgctcggccaggatcgtatccagcagcgccgcgccgtcgtggtacgaaaagccgatcctgcggattttcccctcttcttttttcttgcggataaaaccgaagctgtcaaacttctgcgcaatctcatagtgtgaaacattcaaattgtgcagcaaataataatcaaaatagtccacgccgcatttatcgagctgttccctgaaaatccgctccatatcctcctctttttccaaaaacatggttggcattttcgtggtcagtgtaaagctgtcgcgcgggtaacgctccacaagcgcttccctcacaacgttttcactggtaaattcatgatacatatacgcggtatcaaaataagtgaagccacgttttaaaaactcatccaccatttgctttacttgcgctatatctacgctcttctggtcgtcgctgtcaagaagcggaagacgcatcattccaaaccctaattttttcatgctcataccttttcctcctttttgtatcggtgtgccaccacttttaggttaacacctggagtgaactccatgtcaagcgctttttttaatatacagaaaagccgccttgcgcaccaaatgcgcaggacggcctttcacagtattcctaattatttttcagcgggcgtcagtcagtacaggcatcttccattcccccgtcagcacctcttcttccggaagataaatgcgcatggtcagggaaaatatctccgggcaaatgggaagccagttcgcttccttatcttccccggggcggcctggctggatgtaaatatccaccgatccgtctgcattatgctggaaaccgctttgctcgcttatattgtagcggttaagctcattggcgatcacatgtcccagcccgtcataggccgtaagcgaccaccatccgccctctttatgcggcggcaacatccctttctcgaaatgcaaaatataatctttattaccgcgcagcaatcgtccttccacatcatgggacatagacggataaacagccatgctgactgggtttgcaaacccaccgaacgcgaccaccgcccggaacgcataatccgtaccgaacgttccgacgcttttatccatagacatccagccgtttcctatcgtgactttcgcatgttttgccgagaattcctggtccagcaactggttaagcttttctccctgcgcacgcacaccctccggaaacatatccaggcggaacgtttgccccgcgccgaccccaatttcttcaaaacatttgactgccggtttgtcttcttcaagcccgggattccgcagcgcaagttcgttgaacctcttaaagaactcccctgccggcatctgcgctattttttgcagggctacaaaatcattttctttttggtatctccctttcggcggcacatattcctttccgtacgaagacatgggaaacagcttcattttttcctggacggcatatacctgcggcaggtcgctttccccaaaacattttgtgcgtatcaacagccagagaaaatccgtcggaacgtctacgcgaaccactccgtcaggcagcgttcctttataaaacggtcccgcaaacgcataggtatgttcgtcgcttccgccgagcgcgccgctcccaagaaccgccggtgtcctggaatatccgtcaaacaactggatggaacaatatctgtctgttgcaggcttatgcaaaaaatacggttcttttcccagatcgatatatgcctgtgaatagaccgtatccacattcgggcgcgtaaggctcaccatttccggcgtagcgagcgtcctcgcatgaaagatttgtccaagcggcgctttggtgtccgtcgcccgttccgtatttgttgccatatccttgaccaggtcgagcagcacaaggggataagcgtataaatacgcttcctccaaaagcttacccatgtctttgtccgtcatcccaatggtcccccttattttatcattccgcccccgcaagcaatcaggctgtatattataaaatgctccgttccggaaatatgcgcgtcatatcctgcaaaaacaagcagccgccgtcttacctattttatcgcacataccacttccattcaagcttaataaaacgcaagtctttccccgccttatacctggatggcgctttcttactcgaacgctcctgcacgcattcaaagaattgagataattacaggtatcccgcgcggcgttacgacgaacgcgtgccttttatgttagcctgcctgcaagctttttcaatgtgtattttgtatattatcagttttaaatcataatattccgtacacgattcttttaaggtcaaccatttgttccttccatatttgtatagcagtagtattgaaaccaccggatcaaatgccgcttgcggaataacaatttgaatacccctgtttccatgagcatatcgtgacaaacaggattcaaataaataaaataaatcttgcgtggattttttgcgaggctatacaagatatgattgagcatcttccggaaaacggcgcgcgggaaggaattaaaaatatagaaatagttgcaatcatcatagcgttcaaattccgccgcatctgcctgcatcgctgtgcattgcggcaactgaagtgttttgaagttctcttgcgccacctttaccagatcatttgaaaattcgatcccgtcaatatacgcaaaggggaagtggctcatcagatacatcgcctttccttttccgcatccgatatctacaatcacatcagtgtctttaaccggaagcttgtccaaaacttttttcaatccatccgtagacggctgatatttatttccgtgcagggatgctgagttttctacccatgcggcaaaatccactccgagttttcgatcctccatccgcgctttcttcatccataaattgcataacgcgtggtatacttttgtttgttttaatgtctctgtcttcacaatttcctccatcataatttttatcgtaccatgcctgtgctgtgcagccattcggatatcattttcctggttgtttccttattcgcgccatccccgtaaacttccaaaagactcataaccgtagcctccgggcataatttcgcaatatcttcctttatttgttctcctccgctgccgccgtgggtacaaaaaggaacaatgacctttcccgaaaaatcattcattgccagaaacgctgcaaccggcggcgcgatggttccccaccagtttggcgacccaataaaaacagcatagtaactatccatatgcgcaggggaaaaccgcaaagaaggaaaatagccggccataatttcatccttcgcctgtgccacaagccgttcatattcctgtggataagcctgttccgtacggatttgaaaggtgtcgccgcccgtaacccgccgtattgtttctgccagccggtatgtgtttcctgaaatagaaaaatatgccaccagtatagaatgcaaatcctttttcatcatatcgttctcatcaaacattataatcgtacctcctgatttctttcgcaagagcgttatagtcctttccaaagcaacaacagcctcttccaccatttcaaagcggataatatttgccgtcttttttcttgcgtttcgttttccatgaaacgcacttttccggcaggtacgggctgggcgccaaaccgtgcctctctcgctatcccgacggctgcctgcgaaacaatatcttgcccataagcggaaagttcgcaaagataatcgtacataaacagcaccgcgcggcaatggtcgggctgccggaaagagcggacccgttttattcggcggcaaacaggaatcaaaagcaacatcccgccaattaccgcaatcacatatggtaacaaggttatatcatcccttccggttggagtcgggatatctgtttccattgcgaacagtatagcattcctttccactacagaagatgggacttgttcaggattttccgttggtgttgccggttcttctgtctgttgctccggtatttcatcctgcatttcggcctcgttcccgctgtccctgccttcctccgtatacgcagtccatatctgcggaacggcgtccccgccgggggttgattcaacaggcgtccatcccaaatcgggaatccatatctccgcccatgcatgtgcggttttagccgacacctgtgcctgcccattgccgtcgaaatcgccttgcctaacaacatacccctctacataccgcgcaggaacacccaaagcgcgcagcgccacagttgttgcactggcaaaatgtacgcaatatcccttgttgctttccattaagaaatattccacaaaatctcggttctgtggttgctgtcccggagtagtcgtgtaagtgccggagttgcgtaccacttcagcgacctgtcctgcaagccctgcccaattgtaataaggggcgttgccgttggaagcgttccccgattgctcctcccaccatgtaagaagcatttcacgcaccccatcgggaagttgcgtatattcgtccgcgatataacgcaaataaccggcatcagtattctcctgcggatagaagagtgagagcgtatccacatttgtaggcgggtcatagaaatattcttcagccctttcagaaacttcattcgggatatcgccgctctcattcagcaacagccctgccgcagtactgataaacccgatgtcgtatccctcaaatgatatactgccccgcctcctgtttccgttttcatgcatagcgcttgttagccattccggaaccgaatgatcccctcccgaaattacgatagtctgttccgcgtctccataagtttcataggtatagatatattccccggcaaaaggaagatggctatctccgatccagcgaggctgtgcggcggtattttgcatctgcgcaaagcgataaggcgtaaacatccacggcgaatccgtccttttcggttcaatgcttatttgggaacgtttccccgaaaagtagtctgccccattttcttcgagataagccatcggttgtatcccgatgccgctcccttcaaatgaagcggcatcggcttgcagccattcgtgtcccgtatattcggaagccgcatagccgcgcaggtagatatcctgaggatcgcttgcgtacacactcaataccgtactgtccgcaagcactgtgctgcccgttgcgttgagatccgtgcttccgccacggtttccgattgggccgcctgaacctccggtgaacgtataactaatgttcgctgccgcttcctttaattgttccctgaatgcgatcgtcgtaggcgacggcgtatagctttcctgtgggaacgctgcaaaaactgtcaggaaaacagccgcgcataacgcaatgcacattaccctgctttttgtggctcctttcttttccggtttgggcaggcgggcctgtagaagcagcgccgcccaaaaaacaaataaaattgccataaagatatccggcggcgtatccgcaagcatatatgcgaagacaaacggcggaaccgtaagcaaaagagcgaccggagtatttctccgcaccgcgattgtccaggtcatccatagggtatagggagccagcgcgtagactccaaaccaaaggtataatgtttcggcgtttgccgccaatggccggaaagttgcaagttcataatgcatcgctttcatgaaataaggcgcaagcacccgcgaaaaaacaatcgctccataggcgatttgctcccggaaaacgaatccgcagacaatccaaaaacacaggaagcagaacaggataaagcgtcttttccttcctgcaaatacagtgagcagaaagaaaaaaacgcagcatgaaaggactgccgtaagcacaataatcgtgcaccccggaagagaaaacgatgtatggaaaagtcccgctacggcaacgactcccgcaatagatagcccgagagagagtagcctgtctgccctgtatttgatccccttcatccatacacccccatcagctccgagaggccgatgggcgaagcagcatccggcgaaacaaatataacggacgtctcttcataaaaaggccgcgctgccggaacgcccgtcgataaaagacgatccgcaccggacgcatcgcgcagggcttgccacagtacctcttccaattcctctctttccgcgatggttcgtatttcgccttgttctatccaaagtacacggaagcgatatccctccatctcgaatgcatccagtactccaaacaaccggccgagggaacggtggagcgcatggggatttccattccagataagggccgcgccgacacaacgcgtttcgcttacctttgcatattcccgcacgactgtttctcccttccttgcgctcaacttccaatgaatcatccgcaaagggtccccatcccggtattcccgcacgtcctgccattcaccgccagcataaggcatatcttctccaacatgttccgtaagcggatccagtttacccgcaaaggggattttttccggcgtaagcagtgtctctacagattgcgctgctcgaacagggagccagagaattcccagcaaatccatgatatgcgcacaagagatcgaactgcggattactccgcaaagctctccatcaatgtgcagggaataggacttttccgtggcaaggtatatttcatatccttccctttttccactaaacagattttcaaccattagctttattcttgtcatcgccataggctggtttggctcttcgatatggaaaaaaaggtcaaatccttccccttgttccgcttgatggacgccgcattccattactacgcggcatccgcgcatcagtataagagtaaggagcacgctcaaaatcggcagcagcaacgcaaaaataaaaacgatccacgatacataccacgtatagaacacatagtacagaaaagaagctgcgagaaatataagatataaaaccctgcgccacgccatattatcgttccctcaaaacaggcgccttgacagagtgtaatatatccatcaggatatcctttgccgatttcttctgctgtttggcctgcggtgacaaagtcaagcggtgtgccgcgcacccggcaaatacttcctgaatgtcttccgggatcacaaaatcccgtccggaaatgtaggccgctgcctgtgcaagcgccgcaagcgcgacgctgcacctcggactggcgccgcgcgcgatcagttcatgcgtccttgtcgcccgcacaagccgtatcatatatgcgtaaatatttctgtggatatatattcccgcaacatcccgccgcatatctgcaaggcccgccgcatctgtgatccgcacaattggttccatgtcataatttccatgtttcctccgcagcaattcaagctcgtcctgttcctcaggatagccaatggacaggcacatcataaacctgtccatctgtgaatccggcaggagttgggttcccgatgaaccaaacgggttctgcgtagcgatcaccataaacggctgcggcaacatatgcgttatcccatccaccgtgacggcattttcctccattgcttccagcaatgccgactggcttctcgcggaggcacggttgatctcatccgccaaaagcaaattgcacatcgccgcgcccggtttatactccaacgcatgggtacccttccgcagcattgtgaaccctgtgatgtcagaaggcatgatgtccggcgtaaactgtatccggttacaatgcaggtccagtacctttgagaaggccgttgccaacgttgtctttcctacgccgggaatatcctccaaaagaacatgcccgcccgcgagcagcaccatcaggactctgcgcaccgtttccctgtttccgaggaacgctttttccacctccataatcatttgttcgcattttgatgtatattgaacggatggaatcgtattcatattcttcacctcatttataagcgtatggaatttatgtgaggattttgtgaggaaatcctcagatttttgtcaggcaatcatgccatggcgctctttttgttttgttcaaagtctccgccccccaaaggccccgattattgatagatgtgctttgcaggcaatagcgatgcggaaaaatttttgaggattttgtgaagtttataccgtcctgaaaaatatatgatataatgcatttaccaaggaaaaagaaggtggagctgtgcaaaagcttttgattgtcgacgacgacccatatctgcgttctcttgtcaggacatatgccgaaaatgaagaattcgaatgcctggaagcggaaaatggatgtgttgcgctcgatatcgcgggtttggagcctgtcgatattattgtgctcgatattatgatgcctgaaatgggcggatacgaggctttggccaaactgcgtgaaacaagcgacgttcctgttatcctgctgaccgcccgctccgaagaatacgataagctgtatggctttaatctcggcgccgacgactatgtgccaaagcccttcagtcccaaggagcttatggcccgcgttaaagcggttttgaagcgcggacgcgctatccaggatgaaagcatggaatttgggttgctgaaaataggaaaacgctcccatatcgtaacggtaagtggggaaacgattatcctgacgccaaaagaattcgatctgctgatctttcttgcagaaaatccaaatatcgtcatggatcgggatactctcctgaaaaaagtgtggggctacgattatttcggtgattccaggacggttgacacgcacattaaatcgctgcgcgacaggcttggggattgtcgcaggatgataaaaacggtatggggagtcggatacaaatttgaatacgaaacgtaaaaatttcatttcctttttaaaaagcaaattcaccgtccgcgtatggcttgcgatcatgcttttggttgcggtcagcatcgcttttttgtggacgatccaacttggtttgtttgaacgcaactatatcgatgccgcgatcaacgaaatggaaaaccgtgtggagccgatcatcgaagacatcgacagctacggcatggaggaagcggtcagctatatcagcgccgcggtgcatggcaaggtgttcctgctcgatggggacggtcatttattatacgcttatggcatcggccttcctgcgattttggacgaagttgatgaaaacatgatgcattatttccacgaaaacctggatcaggtcctttcggggcaggattacgaacaactgatccgcgacgaccggcaggatttaaagcttgcgcagggaatccctgttgaataccaagggcagaattacgcgttatttacgtttacttatatggatgaaatcagcgcgatgcaggtcgttaatttacagcagctcttcgtgctgtccgtcgtgcttgtggtcgcggcgggctgtctcgcttttttgctggcaaggcatttggtaaagccgttaaaaattattgaaaaaacagtcaaccggatgacggagggtgacctcaccgccaagccgggccttaagcgcagcgacgaactgggccagctttcagactctgtcgaaaagctgggcatatccctccagcgggtagatgttttgcgcaaggatgtcattgcgaacgtatcccacgaactgaaagcccccctttccgtcattatcggatacagcgaaatggtacgcgatatttcaggaaacgacgaagcgaagcgtacggagcatatggatctcatcatccgggaggcggagcgcctgagcggaatggtcagcgacatactggactattcccagttccaggctggatatattgtgctgaaaaaatccgaaaccaatctgcatgcccttgtagaatctgaagtggcatacgcaaggacagccgccgcgccttaccatatttctattttactggaggacagtagcgggaatccctccctgtaccttgacccaatcaagatgagccaggtgctgcgcaatcttttgaacaatgcaatcaataatacaaaggatggggaaacgatcactgtttccattgctgaaaaaaatggatctgtgcgggtggaggtaaaaaatcccgggccgccgatcccgccggaggaacaggaaattatttgggagcgttaccgcaagagccagcatcagggcagccggagggaaggtacgggcattggtctttccatcgtcagcacgatccttgaagcgcacggtatgaggtatggcgtcgggtctattgacggagtcaatactttctggtttgaaatataagcaggtgaaattttttcttttgctcgaatatttccaaagaaaacgctccgctttccagtggagcattttcttttggtacaaacgctgaaaaatcgattttgtttatattcggtttttttatttgatatatcccaattcatccagccaggagacgatctccggctgtgcatcctgcacggtatccctcgatacagaaaatccgttttcatccacaacagcttccggttccatctctttgatcgtaccgatcgaacccgaaaaaccgcttcctccatgcgtattgaatggaataattgcctttccggaaaaatcgtattcgtccaaaaatgaataaaggatcatcggcatgtcgccccaccagtttggatatccaaggaataccgtatcgtactggtcgaaattttcgatctgcccactgatggacggccgcgcgttttgctcctgttcctcggacgcaagctccacaagagtatcatgatctgtcggataaggcgtttccggctcgatccgaaaaatatccgctcctgtattttcctgtatcacatatgcgacatactgcgtatttcccaaaacctccccgtcaatcactacggcgctattctcttcttcctccgtcatattttccgggtcagccgtttccggcatcgagaaataaaccaccaggatgtttgaggctcctgccgccgtccctgacgcattttgtttttcatccggaacctcgcttggttccgtcgcatcggattccgcgggttcctctgcgtcagcggaggcggactctatcggttcagcagagacgcttctctgcgcttccgagtttccactgcaagcggtaatcgtgcagattatcaatgtgcaaagtacaattatcaatatttttttcattgctctctcctaactattttctatttggactttttcaagcctctttacagaacataatcataatggcattttgtgatagatttgttaaaaaaacggcatatttttgttaggatctccgccaataaaccttatatcatactactgtccgtcccttttaatctcccttttttccggaaaaaattcgaggcgtaatgggccagaaaaacgaatagccccatcaatgccaagtaatcaaggtaaaacagtaaccgcggttcatcataatcgagaagcacgaattccgtttgcaggaacagataatccgccaggttgcgtgtgataaaaacagatacgccataccccgcaaccaccgcccctgccgcaaaaaggagcgcggagcgtactttggaaggcttttgtttgacgcgcttttttgccatgccgagcaccatattccaatgcagtccaagatgcaggctcataagtacaaacccccagtatgctccgagaatatgcagccgtcttgcgagcgccatgcctccttgtgccggaagaaatgcgaacacatggcgcgaaagcgtgatcccgctgtatatctggatgacgattgcagcgaacagcagcatattcacgcataacccaagaatacgcatcggggtatagcgccctttgggtagatttttataccagcctatattcaggatatggtgggcgacaaacaatgccagcatccccgcgcctgcccattcatgcgcttcgccgtcccaaaactgatagcccatcagaaaaagaagggcaagcgtcatcagcacatcgatcagcatctttattgttgcttttggcttcatatgtatgcaactgccctttcttccggatccataggtttttctttttcctttctattccagctttccgtaatattccccgccgacaggttccagccattcattcgtcgtattgtctccgggaacttcaactgccaaatgtgaaaaccacatatccttcgctgccccgtgccagtgcttcacaccggcagggatgaccaccacatcgccgggaaaaagctcccgcgccgctttttcccattcctggtaccatcccctgccgtccgtacaaagcaatatctgtcctccgcctttttccgctttatggatgtgccagttattccggcagccgggttcaaaagtgacgttcgcaatagtcacgccttcagtggtaagcatattcagatagctttgccctgtaaagtactgtgcaaaggcatcgtttgccccgccgataggaaaaaccgttttcccgtatactgtttctttcatttgtatcatcctcctgtttttaatccttccatatttccttcgcgatccgaaaggcagcccatgctttcggccagccactgtaaaacgccaactgggtaagggcttcggcgatctccgtttttgtcacgccgttttcttttgccttaccaagatggaaggcaaaagatgaatcgaacatcccgctggtcatgagcgccgttatggtgatcaagctgcggtcgcgcggggaaagctgttcttcccgcgaccatacctccccaaacaatacatcgtcgttgatctgcgcaaacttgggagcaaaccctcccagcgcttcttttcctgccgttacttttttatttgacatcatatcatcctccctgttaccctgccataccgatgctgcttaaccattgcgcgaccgcttcccctgagtccgccgcttccgaactgcctaggggaaggccttccaatcgttttgcgaccgtctgcgtattgccggaccacgaaaaatatacgaccaaagaatttgcggcgctctcttgcggctctatggttgcgcttgcctccgctgtaggcgtatccgttggctcctctgttttgctccttccggcttttgcctgattcgtttttaccaattggtttaaactttccatagtcgatttcccccgtttcaccgaggatcttttcatccgcataggtatattcgatctttaggatgaaatgaataaatgtttcggtttcgtagttatctgcaacactacatgccatgattttctcctcattttttgtcctcctgattgatatttatgatttcttttcggcgttttgtatcttatacctgaggtagtccagcctgtccagttgcttttgccgcaaatgcagttcgtcaagtgcgttctcacgctttttattcagcatatgcaaccgttcttttccggtcgattcgccttccaacagcaatttcatgtattcctctacttcattattctcaaaccctacgtcatgcagcgtcataatcatgctcaatcgctccaaatcctgctcgtcatactgccacgcacccattaccttttttacctcgccgcacaagccccagctttcgtattctttgagaacttcaatgggaatattatacttcgcgcttgcttcatcgatcgtcattttcctgcctcgctttttctgcttcacaaaataaataaaggcgccccccttcagaacacctttatcttaaatcctcatccgtcctatgtctaatgcttatattttattatttgaaatgcctttcaggtataagcttgcgtattcaataaaagcagccgtcgttggtgagaatacctgatccttcttccataccaacgctgtctctgtttcaacaggcggatatagtgggataaaccggaggttttcataggtgcaatccaactcaatacaaacaacgacccctatcccgctttcggccatcatggcttcattgtagagcaaatttccacaggctgcaatattcatccggtcgtatgttcctccaaaccatctgcccaaatcgttctgaatatattccctcgatgatgtaatcagtgggattcccgccagatcttccggcgttatttcctctttccctgccagattggaatccctcctcgccaaaacgccccatttctccttcaccggcataggcgcaaaattatattttcggatatctgtcggccctcccattacgcccatatcaagcaggccccgttctatataatccttgatattgtctgcattcccactgtaaatctgataactgaccaatggatgccttttttggaaatccgccatgatttgtgagaatacccgagtgctgcggaattcaccgctgccgaccgtgatttcccccgacagattttcctcctcccggatgaaatcccttttcgttttatccgcaagcgcaatcaactcctgcgcccggcgctttaaaaacattccatcttccgtgaggacaatattatgcttgtttcggataaacagctttacgccaagctcttcttcaagctgcataatctgccgcgaaagcgtaggctgtgtcacatgcaaaaactgtgcggccctggtgatgttttcttcccttgcaatcgcaagaaaatattttaatacgcgaagctccatatggtctccccctttatacagaacatacaatttatacttattttatatcattccggacaatctttttgcaaattattgaaaaatacttcacaattttttcacaacttattcttagagtagtcctaaggtgtttcatcaggatattgaaacaaataatatatgatcggaaaggacatcgctttgaaacaggttgctattggttttattttaatgattaccgctatgcttatggtaatcggcatcatattgcttggcactgctcccattctttaatatactcctatttatttctcactgtcatggtttgtttttctcttcataggctttaccggcctgatactcttaggtatcaccgtcggtatgatgtccggcggtatatttttccttgcgccgggccggatgtcggccaacgtctttctgcgtgcggcatataatcctcgccgccttcttctccgtccaaggtttaccattcgtatcaacaaaagcgtcagaaatatccctgccggaagcacgatccacaggtaccatcgctgaaagatgaatggttggctttcttcctcatttccggtttctccagcaggataatctgtagtctgcaacatccctgtagcgacaagccgggcagactcggaggtgatctgtgatcggtccatttcaggtgcggcagcataatcatccggcgcctgtgtccctgctgcctgtccgtttaaagaaacgatttcaccggaaaccgtcacgctttcttccggcgatgcagaagtaccgtcttccgcatcgtccggagccgcaaaggcggcaactggcatggaggccagaatacagcacactatgatccatacaataaattttctcacgcgaatacctctctgaaatcaatctctttgtaatataacaacaccatattactatgatcattttatgtgaatttcgtgaaaatttttcgaacagctaaattcctgaaaaaagaaaaccagaataatctgccggatttctaacaaaattatacctattttctcacaaatccctgacaaaatatcgttatgctcttctaaaaggcacatctttagcaggacgccttttgagcatccatatattaccggtgcttcaccgctaatataaatttgacacgaaaggatggcatatgaagaaacataaattattggttatggcattgtgtatagtcatgatgctgggaacatggaccgcaaccgtccaagcggctccggctgatgaaacggcagtacaagaggaaaaaaccggttccgttgcctatgccccctcgctggatacagaagaaattacagaagtccggtacgcgggtgccgaaggcagcagcctgcgccagagctccgacgtaacggccgccgttattgggtatctggagccggatactgtcttgtatctgttcaaagtcgtgagatcacaggacggagacctgtgggctgaaaccaggatagacgaaacggattccatttattatatcccatttgaggaaacaaagatggaatctgccgtgggaagcggttatgtgcttcccgaacctgatatggacgaagcagaagttccttccgccagccacaatacgccggaagagtccaatgaccgtgaaggtaagagcgctttgcccgcaggggaacacaatgcaggctcacacggcggaatgtttaccattacaacctactgcccctgcgccgcctgcaatggaaagtgggccgggatgcccaccgcttcaggaacaacgatcactcccggcaggacgatcgctgtcgatccgtcggttattcccttgggaacgtctgtttatatcgacggcataggaacgcgcattgccgaagataccggtggggcaatcaaaggcaatcggatcgatcttgctgttgcaaaccataacgaatccggcacatggactgcgcaagtgacatggtaacccaaatcgttattgtgtaactgaattgccccatggaagaatatttcatggggcaattcagtttatttgatattgcagtccatttttacgcctccgttgaattgtttttctatgattagaaggcgctaagaaaacaacaaatccgaacccatctccaattggaatcaggttcggattatcttgattcggtgtgcccgggaggatacatcgcgcttcgcctatagctcgcgctctgatgaacctcttcggttcgaatctttcgcataaaaaatacagtccatgccttcggcataaactgcattttggtgtgcccgggaggattcgaacctctggcctcaggagtcggagtcctgcgctctatccagctgagctacgagcacatatatagctgcaaatggcagttattattataatacatttagagcactttggaaagaaaatccttaagtcttggatttttcgggttactaaagaactcctgcggcggcgcctgctccaaaatctttccttcatccataaacaggcagcgcgtcgctacctcgcgcgcaaagcccatctcatgcgtcaccacaaccatcgtcattccctcgtcggcaagcgtatgcataaaatcgagcacctcccctaccatctcagggtcgagtgcagatgtcggttcatcaaacagcatcacatccggattcatcgccaatgcgcgtacgatcgccacacgttgctgctgcccgcccgaaagctgcgctgggtaggagtctatcttgtctgcaaggccgatccgctttaataaagtttctgcccgctcttgcgcttgatcctctgtcatcaatcccagcttcaacggcgcaagcatgatattctgccctactgttttatgcgggaataggttgaactgctggaataccattcccatcttctggcggatccggtcaatattcgtcgctttatccgtcaagagtttttcttcaaaccatatctcgccgctcgtcggtacttccagcatattcaggcagcgcaggaacgttgatttaccgcttcccgacggccccacgataacgaccttctcgccccgttcgatatgctcgtcgatccctttcagaaccttgtttccattaaattccttacataaatccttgacaataatcatatccggctcctatctggcgtctgaaagtgcaaggcgtttttccagcttccgcaatacccaggtgatcagcataacgattccaaggtatacaagcgcaatgaaaataagcggtacaaacgcatccagtgtccgcgaacgcacaagttccgccgcgcgcgtcagatccattaccgccacataaccaacaatagacgtttctttgaataatacgataaattcatttccgagagccggcaggatatttttaatcgcctgcggaaacacaatggtacgcatcgtcatgccgtttgtaagtcctaaagaccgtcctgcttccgtctgccctttcggaacagccataattcccgaacggacaatttcggccacatatgcgccgctgttgataccaaacgcaagcgccgcaacatatggtgccatttcaataggcgctgccgcaaaaataatatagtacatgatcagcaattgaaccaatacaggcgttcccctgatcacagtcaggtaaatatcgcagattacattcagccacttcagcctcttgttttgcatcgcattgaccttcgcgatcgcgaccgcagaaccgatcacaacgcccatcaaaaccgcgatacccgcaatcatcagcgtaaccagcaagccgtcgagaaacatcagccatcggtcatttaccaccaatgtattataaatttgctgccccagattatcaaacatactgttctccccacagaacggcctgttttttcagccgcctaccgaactttctgctccaaaatgcataagcattgtatattataccatattttgaaaaaaaaaaaagttcgcggagtaaaattctttccgcgaacccttatttttatgcttatttatgcagcaggcgttcctgcatatgcgtcaaagtgcttctgtgtaaggtcgctcatgccatccttcatctcacccagcactttgttgatgacttcaagcaaagacgtatcgccttttttgacagccattgcatactgctctgttgtcagcacctcatcatatacctttaatgtatcgttgcttgcgacgatgctctgcgccggcaactgatccacaacgactgcatccagccttccgtttgcaagatccatacccgcttcgatcgcgctcttgtatgtctttacggttgcgccttctacttcatccgttacaaaaatatcacccgtcgtaccaagctgtacgccgactgtctttccggcaagctcctccaccgttgccgccgctaccttcggatcgtctttcgtcacaataaccatctgtgtagatgttgcatacgggtcagaaaaatccacgctctgtttacgctcttccgtaattgtgaatccagccgcaacgaaatcgcccttaccgccattaagcgccgggatcaaaccgtcaaagtccatatcgacaaccttgagctccacgcccaactcatccgcgattttctgcgcaatgtcaatgtctacccctgccggcttattatcgtcaccgaggtattcataaggcggaaactgcgcatttgtcaaaagtaccagttgtcctgcctctttgatcttatcgactgtgcttcctgccgctgcgtccgtagcttctgcgccgaccgactcagatgccgccgattcggacggagcaactgactcgcttgccgccggggccggagaggagcatcctgcaaaaaccgcaatacacataactaccgccagtactaaacctaaaatctttttcatcttttcctccaaaatgtatcaatatttaaaactcaatatgtataattatacatgtattttctgataaatcaagtgtttatgcaaaattaatgcatacactcttagactcctaaaatatcatgaatatctctctgtatcctttcgaaaatgctccgtacctgcgcctcattttcgcaccgcaaagaatagtataccttaatcttcggttccgtccccgacggccttacaacaacggaacttccgccctgcaatccatatcccattacatctgactttggcaaattgatcttcttttcgccatcctcgcttttttcaatagatgacagataatccgaaactttccagaccgggctatcccccaatacagcgggtgcattcacgcgtaatttctccatcaactcctgcatatgccgcattccgtctgcgccttcaaagttaaagctttcaagtcgatcatagaaatacccatattcatggtataattcctgcatacgttctacaagtgtttttccctgcgttttatagtaggctgccatttcgcaaattaacatagacgcatccacagcatccttgtcgcgcgcatatgttccagacaaatatccataactttcttcaaaaccgaaaatatagcggtcttcttcgcccttttcttcaagcagcccgatctgttcaccaatgaatttgaatcccgtcaaaacattgattagctgtatgccataccgatccgcaatacgttgcgccatttctgtagtgacgatcgttttaaccgcaacaggcttgcggggcaaactacctgcctgttctctcctgctgcatacgaaatcaaacaataatacacccatttgatttccgttcagcagtacgtactctccattgtgccggacagctgttcctacacgatcacagtccggatccgtccccaaaagcagatccgctttcagactcctgctcaattctacacccagtttaagcgcttctttctcttccggattggggtaaggacaggtcgtaaaattctcatccggctgttcctgttcggataccaccgttatatctttgacgcccacctcgctgagtattcgtaaaacaggcttcagtcccgtaccatttaagggcgtataaacgactttcaaagtcgcctcggcgctttttccatatacgctgcagcgcttcacttcttggaaataatcctcgactgtatcctgctgaatatatttgatcattccacacgaaagcatatcctcaaacttggcatgctctaccgcaaacgtatcaacctgttcaatatatccggtgatcttctccgctgccgcaagcgtaatctggcaaccgtccgccccgtataccttatatccattatatttcgccggattgtggctcgcggttataacgataccaccgctgcaggaaagatatcgcaccgcaaaagatagcattggcgtgggcattagttctttaaaaatataaaccaaaatacccttttgtgcaaaaacctcagccgccgctttagcgaatttttttgaattcttacggctgtcatatgcgattgcaatagatggcttctcatattctgccttcagataatctgcctgcccctgcgctgctttgcgtaccgtgtaaatattcatacggttcgtccctgcgccaatcacgcctcgaataccacccgtcccgaaagcgagatcacgatagaaacggtctttcaccgcttcctcgtcacttccgatttttttcagttcagccgcaacttcactgtctcccgttgctttttccagccactcttgatatacttttttgatttccatatatactctcaatttctatatattataattgttccaacttctccagtcgtttcctcatcacgcttccgcaaacttcataagaaaattcagttgcgatcacattcttggcgtttttgctaatcaaatcataatactgtttgtcgtcaactagatttttcatataccctgctgcgacatcaatgtccggatccgcccaatgcatgccctttttatatattccaaaatctttttctacctcaattagactgtacggcacagaacaacatgcaccatcgcgcatatattgtgtattcccgccaaaatctgtaatcaccgcaggctttccaaatgccatcgcctccgccgggcccagtccaaacccttcgcttctatgtagcgataaatatgcgtcgcaaactgaaatcaggttgttaatttctggcttcgacatctgccggtcgataatgagaatattttcattttgcttcatggcatctctcaaaactttatcatgatcccatccaagcggcgtattcagtttaatgagcaggcaagcgtcttttcgattttcaaaggctctgcaaaaagccttgattgccgccgccggattctttcgttcagagatactgcgcgtatcataggtgagcagaaagataaacttatcctccggcaatccaaaacttgcccttgtaagcgatccgtcctttttaggcgcaatcgcatacgaaactgtgtgaacagggatcggagacttttgcgcaattgattttgtcgtaaaatctgaaagagtccatatctcatcaaaatatggaaacgctttttcccacccgtccggaaattcaggcatttcccacgcccaataaccaatattatgtcgtccttcaaagatactcttgtcaaattccctaatcgtatcttcaaagcaatcgggattatacgcaaagatatttgtattatattgaaattcattcgaaatcttatcctcaaattccatatttgtaaacgtatgcaacgtggaatcctgtacttcaatgatcgtgtatgggacacccgcatgctcaagcatccttgccagaatcctgatgctctctcccagtccaaaatctcctttgataaaaccacataagtttacgccaaatgaatatttaggaactgcttgtaatatttcttttcgcttaccaataactttttttgccaaacgagtcaggcgcccttcttttattacgtcacgctcggcaatatattcctcataaaacagccttaaaggttctatatacgcttcttgcaaatcatactctttggaggcatactttaaaaaccattccgtaaaatacagccgtgttgccgcatccccaatattcgcaaaagcagcgcgcaagtccgcccgctcatcgtaaattgctttctcaattgcagtaaatgggacaggatgattatctccaacaataacagagtcctttacaaaaaactctggatgggcaaaaggccgcctcttacatttatgccgcagacgatagtcatcaccatagtatttacgcaaaacatctgggataagcgttccatccgcgaaacttccgcattccttacttacaatatccttttgctgcacattaggtagcgaattgatacggcattcaaacagcgaagcataggaaagccatgtactaaggaatcccctgtgccctccccgatgaaataatatctgatcatatcttttttcagcccacgacaaaaattctatgacgtgattaccaccgtgaactgcaaaagaatcgttacaatataacggctgtgaatccaacgtaatgctattaatatcttctctgcattgttgcgccagaacatatgggaacatattgatggtattttcacgatccggtatttgcggaataagtccctcattcgagatgatcgcaactgagacataatttttcaaaaaatatctggtcaatttaagcgcaagatggcaaagcaattcccctggtcttagagcaaaggcatactcttcatattccggaccaatcagttccgcaggggacaggatattttcttcaaattttgctgttgcacaaacaggacagacaaaaacatcgctgttttcataacgatgtttcataaactctaaatccgtttcactatttttattcgctatataaatgacagcagaattctccaatggtcgactcctctttagcccgtttgtattcattttatttcacattaaattgtttggcaattttccctatttgctccgacatatccttttttgaaaccaaaatcgcatcttccgtctccacgaccaccaagtcatcaattcctacacataccacaggttttttgcaattcacataacaattatgtgactgttccataatagcatctccgtccgtcacattaccattctcgtccttttcatgttctttatgcaggctttcatatccaccaacgtcactccagccaaactccgaagggatacaatatgctttttttgttttctccataaccgcataatcaattgaaatactttttgcatgttcaaaagcatatgcaatttgcctttcatcatcgggatcaatcttttcaaacaatgcataaagctgcggctcatatgtttgaaactcttccaacattgtatctatgtcaaaaataaacaaaccgctgttccacataaagttaccggcagacagatacttttctgcaagcttttggtccggtttctcatggaatgatatcaaatttaccgccgactggtttagttcaaaatttctagtatcaatttccaggtatccatatcccgtttccgcacgcgtcggcttgatcccaaacgtaacgatacaaccttgctttgctttatcaacagcagctataagcgccttgtgaaaagcttcgccgtctttaatcgcatggtcggaaggcataacgacaacaatcccactgcccagttgttttttgattttaaacgctgcccacaaaatgcacggtgccgtattttttgcctgcggctctgccataatattgactgcattaccaaattcttcttttacaagcggcgtgtatttttttccggtcaatataaactggttttgaagcggaaccacatccgaaacgcgttcacttgtttctcttatcatacttttttcagaaaaaagattcaaaaattgcttcggcttcgccgaactgcttaagggccacaacctcgttccacttccgccagctaaaataatactacttaccatttatattttcccttcttcttttttgcatgcctcttgaatatcctgccaattttcgcatacgcccatgatcacaaaacacatttttgcgattacatctttccattgatgccgctccattgcgtatttccttccattcgcttccatactttgtcgaagtctggtatccgtaaccaatctttcaagagtcagcaggaaatctttctcccctcgaaaataaagtccagcattgcttttcaaaatacatcttttcgttatttcgtcacatccgtatgcaaggaccggaatcccaattcccattgcttttagtatgtcaagatagcctcccttgctttgcggtgcaatatagcagcatgcgccctgtagcaattctctttccgcgtcttctcttagcccatctatgcaaataatatcatcacgtccatcaatatcgatcccacacttccctaccaagacaagcttaagctccgaatcatatttcatcttatagtggataaaataatgggccagcgcttcatattcgttagagcaatttgttattccaatagaaataagataaggagcatctccaatcttgtaccgcaagtttatatttgcaatttcttcttttttacgccatttagagatctccactccttggccacccaccatgtttgctactttctgatttttaaaaacggattgtaccaaatcccgttcctcttcactaaaataaagaatcgccttcggcatctggtacagatactgaaaataattacatttcctaatcagttcatcaccatacgtaaccggtacaaatacagacttttctgctaccaacggcatacaggctgtggtgctgtaatagcgatgccccataaacagaaaagcatcgtagctgtgactattgtctctgatatatttcataagccctgtactatatggccccatttccttaagccaacaggttgctattttcaaatcatgataaggattactatacatctgttgcgttaagttatcaaatgcctctttatctcgcggatgatctgtaagaaaacgacgaaccgtgatctccccttcattgtattcgccctcggggcaaccgttctcccaactgctatggtctgccgcacaagtggtcaacacttccacatcaaaatatgctttcaagcgcatagcgtactgcacgcataaagcttccgcctcatcaggcatcttccctccataacgcggaacaacaaaagcaacacgttttctacaattgtacatcttgtgccgtcctttcgatgaagtccgtcattttgcggtcgatcatatcccaagaataatattgttcgacatattgtttcccattattccccatcatacaccgtatatcatcgtgttccaataagtaacgaatcgcacctaccatatcctcttcctgatagaagtaaaggccaccgttgcttctgtcgatatgtcctttcaaaacatcgcaattcgcattaattaccacaggtattcccgatgccatcgcttctaaaacgaccaggcttagactttcgttctgtgacgaaagcaccagcaacttagcatacttaagcagcacgaatttttcctcttcgctcacaaatcctacgggaatgatatcctcgcgctgcggaactgccatgctcggtttccccgcgagaatcaacttggtatcacctccataacgatctttatacgcaataaagctatcgaataacaaatcgcaggatttcccaagttcgatcctgcctacatagataatatattcgtcatccttgcttatcccgtgttgctcaaaaatggtttcctgtgcctccataacattttcatcgggcaaacatataccagcaccggttataatataaggaatatgcccgttcccaaaatattcgtgaacaaaacgcctctcctcctccgtcagaaacatgaaacccgccggcagttgaaaaagcgcacgtaacacatgacattcacgcaataccaattcatcatgtgctgtagggatgaaaattgctttatccgctacctcctgcaaacaaaatgtcgttggataatacatgtatcccataaaaagaaaaacgtcaaattcttcctttttctttttgacaaaacggtatagttccggacattccggtccattttcggctaaccacgcaaagtcgtcataaaaatcgcgcttgtcattgttgaagtaaatctgcatattttgggaaaatcgctccatatcacgttctgctataaccggaaatcgcagcacctttacaccgttcagcgtctcttccccttcaggatattcatttttccatgtcacatgatcgatcgcgcagctagtaatgacggttacatgataataacgcgccattctttcagcatagatgcggcacaaatattcggcgccgccatttacctccaaaccatatctctgtacgacaaaacatatctttttcaatcaatctgctccctcaaccgtaacgccgtccctgcgcaaattagcataaatttcttccatgatttgtcgtgagtcaactttcacattttctcctggcgataccatttttttctgtccattatcgttcttatttatcagataagaaagcgttcctgagattctttccatctcgtactcactcactactccccttgggagcatctcgcaatcatatatcatttttaatgcatcttccgtcaaatatgatctggattttgcattcagaaaatcataatactcttgtacgatttttttgatatccaggtgctccgacgcaaatttatgtgcattttctcctatctttttcgcatattccggctcctcaatcaatcttcgaagcgcagcggcaatctcagcctcctcgctgcctggctgatgccccactttcaagcagcagtcatccggcatttcagaaaacgccccgatatccgtgacaactgagggcttccccgccgcaaaaatgcgcattaaacttgccgaggtttctccatgataaggatacctcaaattcaagcatatatcggccatattaatatagtcctgaaaagtatcaatatcctttataaatccagtaacaatgactttatcttccattccgtatttctgaatacaatccatgatttcacgatcgtggacctttccaataatgtaatattttatgttgggatactcttttatgatatcctttaacgccttcagtgactgaataatccgtttagcaattgttgcatgcccaaacgaagctatcatgatctcgtgtttaggaatctgatattttttacgcaatacagcactatcttgtgcttgctgctgtgttgcataaagaccgatttttttaacatcgtatccaatatttttcgccagtaattcctgtctcccccactcactatgtacgatgattcttttcgcataatctgctacgaaccgattggctgtgatttccgtaattgccctctgcgcaagtcccccatccgcctgcaaaagtgcgacaaatcgttcctcgtcatttacttcgccgcgaatatgttccttatacctgccccaatctcccgccatggcataaatataatatagaaaatggtgcatattcagatcatgtatttccactgtccccgggtaattttgtatataaggtatcatatacttgtgaaacgcgctgtttcccatctgataaatgacatctgcatattgataccgtttcgtttcatacacatggtaattatatacgtgaacattatccgcaaatcgttttgaggcttcatatccatcgtcaataaatacgtcgatatcataataaccgcaaagttcgtcgatcagttcttcgctataatcggatatccccgatcctataggattcaacggagtgaaaaacgcaatctttcttttgggtccatccttatcctcgatggtcggttcagcaggttgctcaagtgaaaaaatagcgctcatcgcagcgttcgcggaattttcccatgtatacaactccagcttatgctggatctcttcctgaaatgcagaaaaatctgtgtgcatcaacgccctttcaaatccccttgcaatatcttccggattgaacgggtcgacgagcaccgccgcgttttgtgctacttcccccaaactcgaattattggaagtcaaaacatttttcccacaggtatacgcttcaacaataggcaggccgaacccttcatagagggacggaaaaacaaccaactctgcgcaattataaagcaaaagcaaatcatcatagggaatatgtcccgtaaaaatcaccctgccttctactccatgctttgcgctgaaaagttccatttcctctttgtacgaatcagaggcgctccctgtaatcaccaactgatattggtcgatcagttcttgcggcattttggaatatcctatgatcgtcccatctgcgttctttctccagtcctgtccgctgggaaaaatcataaaacggcttgtgatcccgtacttttgaaaaacagctcgttgttgctctttggtaaattctttcttagaaaatccgctgcttacgcctgaatgaatgaccgttattttttcttcagggatactcgcatatgtcatcaagtcgtcctttacactatttgaaatagccaataggcaatcggcatttttcaggcattccaaattagtatcataccattctttcctcactccctgcaaatatgcagtctgaaaaatcaacggaatcaggtcataagaaatgatcgccagctttacgccggtaaaccattcttttttatagcacatccaatcgtcaaaaagcgaagtgatccaaaagacatcaatattattccttttaataaaggtttggaacattccctgcaatattgtttcgtaacgaatttcaaaattaccattctcatcttgataacgcaataaataattatcttcgcccatgtaaaatttttcatagtggacattcgacggaaaatccactccgtcgtaaatacaatcaccgtacatattaaaaagaaaatattcgttctcttgatccctacggaatatttcttctaacaaatccgcagtataacgccccataccccgcatatgcgaaacggatgccaacggctgcaaatcgactgctatattcatgattttctttctccaaaaaccttatccagataacgcttatccacaaatatactattgattcccgtaaatgcgtactcaatatacccgcgatcattaagcatctccagtattcccgcgttcttatgctccgccagtctcaactcgtaatcgatcatttccgaaacgataataatcggacggtacttctcaaaatcaatagaccgaatgatctgctcctccataccttcgatatcgatcgacataagcgtaggcgccttaccctccaaatagttctcaatgatgtctgtcactgtgatcgtttcgactacaacttccttgtcgatcctaagcgttgggttaatttcgcaaaaatgctccgccgcctgcttatctgttgttgaaaggccatctccactcatgatatagaatgttactctttctcccgaagtagtaccaatacatttatttatcacaatgtccctgcgccgcagcaaggtcaattcatgcactaattccgggttcgcttcgactaacacgcctttcgcatgatttttatatagaaaaaacgtattgctcaactctttcgcatgatttgcacccaagtccaaatacgtgacctggtcataagggattgttgccactcgcaggatataatcgataatcgcatcctctcccgattgggcatatacagttttaataaacgacgcgcgttcttctgttggcgtttccttcagtcccgcatcttcgagagttttcatcatcttgcggacggtttcctgcaactcggccgtcttcgctttttcttcctccaatgcgccttttatctcatctaatttttctattttcttaagcttggagttcatttccgcttctctgctataaattccctgcgctagaagcgtcaaattcaacaaagaagccgatgtcttttcattaaaaactgtttgctgatcaaaagccggcttcataaaccatgcgatgctttttcgtgccgcacgtttcaaattttttttgatccgattttccggaaccaatggctgataatagttgtgcgcaatattatgctgcaatacgccgatatccgcatgcagactggcaatacgtctcttcggcgattcgctgtcttgactcacgcacagatttccgccatccttccttttaagtttttctaaaatgatttcttgctcgtaagaaattttatcttttcccatgacatatctactaccttttctaatttggtaattcccattcatgctcgacagaagtaataccgaccgactgatcttccgcaactaccgtaaattcggagaaatacctgatgaaatcaaggggtgatccattttcatctaccacagccaaatttaatttatattgtcctgacagcagtcgtaaatttctaattttatatcgcacgataccttcttccggcatctcttctatcttgatcccgtcaagactcgtattgttcccataaataaatatgccgtccatcgtataaaaccccattccaaacatatatcctttcggagcatttttgacacggtaatgaatattgatcgtcgcatcctgccctcctcttaaaacatttgtccgcttccctgcttcgtttataaaatagcccttcgtaataataacatcctttgttccaaaacgattcgccgtctcatccgcttccggtaaactatcttcttccggcgtctgttcgccctcttttttttcttcctcggcttgcatccgctggatctgcttgtcattcatatacttacgataagcatcgaccgtatcgtattgatttccatctgccatgatctcgccttcattcagccagattgcacgcgtacaaaacttttctaccgtacccgtatcatgtgtcacaatgacaatcgtgatccctttatccttaagcttatttaaacgttgataacattttgtttgaaagttagtatctccgacggcaagaatctcgtcaatcaacaatatttccgcgtccacattgatcgcaacagaaaacgcaagacgcatatacattcctgaagaataagtccgtaccgggttatcaatgtattcttccaactcagaaaatgcgataatatcgttaaggcgcgcatccgtttcttttctggataaaccaaaaatcgcggcgtttgcgtaaatattatcccgccccgacaaatccggatgaaagcctgctcccagttcgagcagactcgatacccgtccatttactgaaaccgtccccttctccggatataatatgcgcgtcattaatttaagcgacgtacttttaccacaaccgttctgtccaatcaatccaactacttcgccctttttgatagacaagctaatcccttttaagacttggtgcgcagtatggttccgccgtttcctaaataaagccttttcctttagcgtgaccgcccgatccgcataaaccttaaaacttttatatacattatctaagactattacatctacatcttttcccattttaccactcccttacagttcttctgcaaatcttttttgtagcttctggaaggtaaaatatcctatgaccataaaggctaccgcaaagcatactgtggaaaccaatgttgacaaatgtggcgcctgtttatagtacagaatatcccgataagcaagaacaacgctggtcataggatttgcatacatcaaccccagaaaacgttcaggaatcatgtcgatcgtataaatgatcggcgttaaataaaaccatgcatttacaatgattcccaagatatgttctaggtcacgaaaataaactgtcaaagcagaacataagagcaccagacctagtacgaagaaaaattcaataaccataatcagcggtaaataaatcactgtcgggcttattcctacccctgtcaaaaacaaagctaaaaaaacaatgataaacgaaaaaaccatgttcataaaattactgcataccgttgcaatcggaatgatgattcgtggaaaatatactttctgcaccaatcccgctgctgccataatgcttgtcgaccccatttggattgatgaggcacaaaaaagccatggaaccaaggctacaaaaaggtacatagcatagttgtccacctgcactcgcataatgactgaaaataccaccgaataaatcagcaactgaaataacggattgataaaagtccacaaaaagccaagaattgatcctttgtatctggtcgtcaaatctttttttaccaggctatgaagcatctcccgataatcccataattcttttaaagccctcatatattctcctcgcaaaagcgccaatatttcagtgtatcgataagcgtctgccttatttcatactgaggacgatacccagtatgcgcttccaacttgctgatatcactttgaataagcggcaaatctaccgggcgcattttatctcgatccacgcatatcttgattttccgtcctgaaatttctatcagcatgtctagaagctcacgaatactgtaggctttccctgatcctacattataaatttcgccgctttttcctttctctataagattgcgatatgcgcgtacaatatcccgcacatctgaaaaatctcttttcgcttccaaatttcccactcctatgcgttctattccttctcgttccatagcaacaattcttgaacaaaagtcaggtacaacaaagccccttttttgtccggggccggtatgattaaaagagcgggtcatgatgatacgcatgttatgcgcttgtacataaagcttgcataattgctcctgcgccaacttggaaatagcatatggattacacggcgcaggcatcaaatcctctttgattgggcaatcttcttcgctcacccttccatactcgtcagcagaaccgataatcaataccggaattgcaattttggtgcggcgtattgcctctaacaggttcaaagtaccattcacatttatggcaaacgtcttttgcggtttttcccaggacaaacctacggatgcttgtcctgccaaatgaaaaacacattgcggagacacctcttcaatcacacgcatcaccgcatcatagtcctctaaatccgcacaatggacatcgccgtttccaacaatgtccatcccagatacatggtatccattttttttcagttcatcttttaaatactgtccgacaaacccatttattcccgtaattaatgctctcatatagaaatgtcacccaaccaattgtatgtcattttcgaccattcttgaaaccagttcatcgaatccgatttcgcgctgccagcttagctttttctcagctttttcaggtgtgcctaacaaaagttccacttccgccgggcgaaagaattttggattgactttgactaccgtattccccgtcttgcagtcagtggcatattcgtttacgccctctccatgccattccaactgaatccccgccgctataaaagctgcattgacaaaatcccgaaccgtccgcgtctctcctgtagcaatcacatagtcatccggctcattttgctgtagcatcagccacatcgcacggacataatctttggagtgtccccaatcgcgttttgcatccatgttcccaagttccaagacgtcttgtttccctgcacgaatcattgctacggcatgcgttattttacgggtaacaaactctaatccccggcgttcgctttcatggttgaacaaaatccctgagcaagcatataagtcaaagctctctctatagttcttcgtaatccagtgtccatacagcttggccaccccataagggctacgtggataaaacggagttttttcactttgcggtacttcctgcacgagcccaaacatctctgatgtggaggcctggtagaaccttgcgtcaggcttgataattttaattgcttcaagcatattcaacaccccgaccccatcgatatctgccgttgcaacaggttgttcccaagacgtcgcaacaaaagattgcgccgcaaggttatatacctcatccggcaacgcgatcttcattgcattgatgagcgatacgccgtctgtcatatctgcataaataaactctatcttatctttgatgtgttctacatttccataatcaacaacgctcttccggcgcataataccatatacctgatatcctttttccaaaagcaattccgccagatacgatccatcctgtcctgtgattcctgtaataagcgctcttttcacaaaaaacctcccatggtaaccgttttttaatctttttacatatagcgatattataccatttttcgtgtaaaattcaagtgaaagactatcctttgtagataaaagcggaatttctcttatcaagaaattccgctttagttcccttatagccccttcatctctgaaataatgtttgccacagtctcgccaaatcccggctctgtataacccattttagctatatcagttattttctgtacgctttgcctgactccttctgcccataaagggtcgaccacatcattggcgcactcctgcgctgaagcataacacttcaggtgctgcacatgcgcgcgtactcccaatcgcaaactatcaaatacgtatttccgcccatctttatctgctaatccgccgggattattcgcatcttctgacaaatcttggccgtatttcaagaatccggtttcctgcattgctatcgcaaaggctacctcaggtctaacgccctctgtctttgcctcttcccaatacaagtcgatcaaggctcctgctgttgccgtatccgcatcctctcctgcatactgttgataaagcgctattgcctgttcctttgttatcgctccatcctctcccatgatctcgttctccgccccggctggctcttcggacggttgtgccgtttccgaaggcgaaggctccgcagttggcgtcgccgatgccgatggctcagacgttggcgaaggagtaggcgatgcctctggcatagtttcttcctgattctcaattgtatccggttcagtcaaggcggcctctggcacttcatatacctctgattcaatcatcattgccagcgcttgttttgaccccgcgataccctgtagtatggtcagtattttgtctccatactgtccatcatccgcagcccacttccggctcaacagttcaacagacggcgcactcgcttttccatatgccttaataacaatatcgtatcttgggtctacacatgcattctttaatggttctgccgaagcatacgccttcagatgctggatctgcgccctgacccccgttctgatatccgcaaaggtatgaccgggcactccgccgcccgtagcgccgattcccgcaaagttgtattgattcattctcacatcgccgctaaaccgcaaatttcctgtttccagtaacatttgcgcaaatgcaatatccgggcgcacgccttcttcattgccctcttcgatatagatatcaattagcttctctaagtccacacccgcaacctgtacgtaataattcgggaacccatttgcatcaacgccataatttctaaggaactcgtcttttgcccctgcaatatatgccggtgtgctcgtcgatttcgtcacgttcgtataataattaatcatctgctgcttgctgacctcggacgtacccataatggcatgtcccagaacctcaatactttgcatagacgaatttgtcaagtttcctttcttatcataagcagctacattaaacacatacgtccctgcttttccgccgaacagactcgtggaaaaatctccccaccatgtgccgtttccaagatctctgccctgaatcatccggtaacttcctgtgccatcttcctggcggtatacccagaactggacatctttcactccagacatatcgctgacgttatacgccgccagagcaaacgactgcatcgtggtaagactccccgttccgatctcaaatttgccgatcaccgggccttccttgtcgttgattatctcgactgtcctaactgcagaattggtcaaattcccttttttgtcataagccgcaatattgaagacataggtgccaaactttccgccaaacaaactcgtggagaaatctccccaccatgtgccgcttccaagatctttggcctggatcatctgatagctgcctgttccatcttcctgacggtatacccaaaactggaccgtttcaataccagacgagtcgctgacattataggctgccaatgcaaagttttccaaagtcgttttcggtgcggctcccatatcaaacgatccaatcgtcgggccttcttcgtcccctttgatacggatactcctcgtaaccgaattggtcagatttccttttttgtcataggcggcgatgttgaagacataagtcccaaatttcccaccaaacagactcgtagaaaaatcgccccaccatgtgccgtttccaaggtttttcccttgaatcatccgatagctgccggtgccatcctcctgacggtatacccagaactggacatcctttactcccgaaggatcgtcgacattatacgccgccaatgcaaagttttgtaaatttgttgtcggggcagcgccaatatcgaacgatccaatcgtcgggccttcgatgtccccaacgatctggatactcctcgtagatgaatttgttaagtttccggccttatcatatgccgctatattaaatatatatgtccctgcttttccgccaaacaaactcgtggagaaatctccccaccatgtgccgcttccaagatctttagcttggatcatctgatagctgcctgttccatcttcctgacggtatacccaaaactggaccgtttcaataccagacgagtcgctgacattataggctgccaaagcaaaattctccaaaggtgttgtcggggcagcgccaatgtcaaatgacccaatcatcggaccggtttcatctccggtaatataaatactcttctcagatgaattggttagatttcccctcttgtcgtaagctgctacattaaaaatatatgttcctgatcgattattgaataaactgagtgagaaatcgccccaccaagtaccacttccaagatctttagcttggatcatctgatagctacctgtcccatcttcctggcggtatacccaaaactgaacattccctactccagaagtatcactgacattatacgcagctaatgcaaaactctgcattgtcgttggcgaagacgccccgatgtcaaacgttccgatcgtcggaccttcctgatccgtcgattgaaacctaccgaccgcttttacaagggaatcaacaagtgcattctgatttgcggaactgctaatcgccgataactcacttgaattgctcatgtatcctgcttccactaaaacagaaggcaccgtacaatttctgcaaatagaattctttacccctgacgtgtttttaatatctataggcgaagacttaaccgaaatataattcaaatcagattttaactggtcattgataatacttgccgcctctttggaattctcagcatccaattcagtcttcccataattcatatgaggatagtccacattaggcgtgcacctagagtcataataaatctcaatcccttttgccgatgcagagctgctggaattatgatgcatcgaaagaaccagattcggtttcacatccacatcatactctgccttcgtctgctgtattgcagggagaatttgatctccataactatattgtcccgagctgtctgtaggcccttcagaagccggtatcacagttttcagagacgttttctgtatcgtacggtttgtcaaatatacggtatatccttgggcttgtaacttttctcccaatttgattgaaactgcttcatttaatgtagcttcctttattcctccggccgttgcaccacttgcaggcgtatgcccaggcgcaataaagatcacaaatgaactatttgtgtttgatgcagcctgcgcagtttgtggtgcgaaaggcaaagaaccaaataccagtgccaaaactaccacaaacgccaaaatcctatgctgccatccagtcttttttacatactccatccaaattcccccatttagccttggtttagcgctgcgtgtgccgcctccatatatttgttttcaccttgcgacgcactatcataattctttattttttgctgcattgccgccggaaccgcacctatttcctcgctcataccggcagaaaaactttctatattgaacgtaccgctctcgatatcaatcgctagtgaatcgattgccgacaaaacttcctcatcactcggaaccaatgtatcatcttcttgtatcatttttgcaaaccgcaaaaaataagtctccgcatccatcgcttcgacttcagagccataggccttgagcatatcaggatatgcgtaaacataaactaattccgctgcgcttagagtatattccgcttgttctcggatcccctctgccgcttcgcttgcctgtgattgagaaatatcagtttttatctcgctttgggctgtttcggtctcgcttttttgctccgcattcgccggagcacaagcaatcataacacacatagctaagcatatgataaagcctaataggacaatttctttcaatttctttttcatgattacaaaaaaccaatcctcttgaaattttgtgtaattataacatctttttttaactttttcaatatttgtaatatttttttcacatttatatcttttcccgtcaatcaacaactgtcatttccaccggtgtcatccgtatcgctgcctgactgtagatgcctccatcattgatcgttcctgcatccgacgaaatggtaatttttgtttcacctagcggcaatgttatctccgtagagtatgattcaaaatctccggacttaatctccatatattctgtccttccatctacagaaacagatatattatatggccctgccaagtgtgactgcaatgcaaattctatacgtactttccgctcgtcttccccaaaatttgtaagtcgaatattaaagttgctctggcaccagtaatattctactgtctcatccggcgcctctggcaatcctttgatctttgtcaggctctccttatagaccccctttccatactgcataatgatttccggcactatttcatcttttaacgcttgccactcctgctgcgtatatttgccttccaattgcgccgcatattccctgatatcataaaaagcataaactccgtcggaactttcgatcaatggcgaaccaaccaacattttcaattcactttccaattcttccaagttttttgagtcttcatatccatttctattaagggaaataccagaaaaccctgcaatcgatatatcctgcagcattttttctgctttttgatttccaacttcatattgccattcgtctgaatatgttcccaaatcgcttaccatactccattgcaaggttgtagaatggtaaaaaggtctccaaatttcatatgccgccatcttatcattatattcaacaatattttccaaggctgggagaacaaagaccatagcatcatccggcaacacttcttcgattcttttgacatagtccttatcgctataaaattgcgccttggtacgctcatagttttctttcaatggatgaacctgatcttcatagtcaacgccttctccctgcaaactaatttgccaaaaatccgaaggaaatttaccaggtgtttgatcataaataccaaaggctcccaacaaaaccacccccgccataaacaatatcagatattttttccctttttctttcttggccagatatttagctgcctcatttaaaagcaatgctactgttgccaatgccaaaaaggcaatccaaacgctcattctcccataacagcgaatcaccgtggtcaggaacattccgattggaaaattcaatccacccactgtcgccatcaacaaaataaagatcgtcatactgccgaagcaaccaaccgttttccatacaccctttcgccgtccaaacaaaaacgcaaaaaccgaacaaaagaaaccgccgattccaatcagacccagatacatatattgcgtatcaatactaaccgaatgcgaattgaaatattcaagcgcaagatcattaaacgctggtatcctgtgtcctacaaatggaaacagcatatccgatatacgcagtgcaaaaacatcaaaaatagcaatagatctgcttcctgcgagctctcctatctccgaaccaccagcgtttgtccccagtagccatacaagaaggcaaatcgcaattcctattcccgcagctacaataaaagaaattgccgataacatgcacctgaatttcttattggcaatccaaccgtatattcctgcaaaaacaatcacgatgcatgcaaaaaacgcattgtaaatatcgctgagtcccaaaagcaaaaaggcaatacatcccaggagtattttgcgcgtacaaaacgttctcagcttttgactgagacttatgcctttttctatttgctgttcgcatatcacaccacttataatccaatatgcgagcaaacatacgattggtaacaggaaataattcgataatggaagatgcctttgaaaacgaaaaaagtggatcggcagaaatgtatataacattgcaaataccatagctattatttgcgaaatacgaaattgccgtaacgcaaaatatgttgcaaccgcaaccaatggaaacgttgccaaggaaagcaggtttatgatcaggccataactggatgaaaataacgttccaaaccacattgccaaagtatataacaaagagaaatcagggactgtagtatccactccatcgctataaggtgcaccccagtttggatagtaatatggatttcctccatctataaaattggcggtcaaccgactgattcctactgcatcgtctccataataaaatggaacatataaatccttataccataactctaaaacaataaatgtagtgaaaatcgcaacaataataacaatcagataacacaaccattcttttagttgtctgtctgacgtaacaaatatttcattttttttcatctttttatgccctttgaataatacttacggatatacattcgataaaacacagccaacgtatcccacatcgccccgaacatatccttgaatttgattcttccccacgattcttctcgtctgaattcaagcttaatgggcgcttccgctattttatatcccgcataatgaaacaaggccaacacctcaatatcaaatgcaaaccgctttactaatattgtgctcattatcggttttaatttatccgccacaaacagcttcattcccgtttgcgtatccttcactttcagcctgaacaacaaaaataaaatacttgcataacacttacttacaaatcgtctgctttttggataatcaagttctgactcaggatgctgcttagacccaatcaccgcgtcagcttgttcgtcttgcatgactataaaaaagcggcttaattgagaaggatgcaaatcaagatcagcatctacaaaagcgatatagtctcccgtcgcctctgctactcctgtttttaaggcgaatccctttccggcattatcatgatagccgaacactttgatatgctggctcccatctgccgcacgtttagcttctattacggtattatcggtacttccatcatccacgaaaaggatctcaaagtcctcggccatttttccgatttcccgttcaatctccaataggttactgtatataattgacccttcattgaagcctggaaccacaacggaaagttttccgttcaccatactttcatccccaatccatcgccatttgtacacgttttatatcataacaaattatagctactacgtcaatttatccttaggctaacattgaatccaccttcattttatgttacactattaagaattaaaaacaacagaaatggattttttatggcgaaggaactggaaaaaagcagttttatcatattctcgctttccatggtggctaacgtcctgaattatgtattccaaattgtcatgggacgtatgttgcctgtaggtgattttggcgcgatgaatgcgctattttcgattactatactttttggtacgccatgtgctgtgcttgccctcgttgttgccaagtacagtgcagaattcagtattcgcggcgaatccggtgtgattccttattttataaaaaaaatgctgcaatttggaagtattatctgcggaattctcattgttggcattcttattttttcctcatccatttattcatttttaaaaatcgagccttcttacgttattatactgttcgcaatttcgattggccttggtgctatcagccccgttattagcggtggacttcaaggtcttaaacgctttacgcagcttggaattttcaacgtgcttgtctctgcgattaaattattaggaagtattcttctcgtatatttgtccttccacctatacggtatttttgccgcactcattttatcatctttgatttctattttgtatgggtaccgggctatcaagcggagcctgtccggcctaacccctgtgccaattcatattgacaaaaaagcaatgttgcagttttctgttatctctttgattacgagtatctgcatcgccctttttactaacattgatatggtacttgtaaagcactttttttcagagacgcaagcaggcctctatggttcagccatgcagtttggcaaaatccttctttatctccctgcggcattagtactggccatgtttccattggtggccgaaacacatgctatcaatggaaataccttccatttattgaggaaatcattgctatactgcggcatgtttgccctggcaggcacaatcgttttcaatcttttcccagaattctttattcacttactttttggtgaaaaatatttggatgccgccccattgatgcttccttcttgtcttatggtgatccctgtcgtgttaaataccatcctgatgaacttttctcttgcgatcaacaaaggaaaattcatcatgtgctctatgctgattggctgcaccgccgattttctcctgattttcggtttctttcacagcacgatctcttctatcctctataccttgacaataatcggcattattgtattcgctgcaaacctattctacttaagccgtttacgcaaaaaacaagcgtcttctcaacctaaatgtgcagtttgatctgcaactgttatttccacgtcgcttaattgaagcactagttcatattccgctccgtcaaccctaggcgcgtcggtttcaatatgcaatatcgactgattcgctggtaacaaaaccgtcttttgataaacagccccttcatttgtcacttgaagggtatccttttcacctgcaatttctaaatcaacatcatatgcctctggggtatttgtttttatggtcatacgaatcgacacttcccgttcctcgtcttgagcattgattgggtaaataccaatatcaaagctgcctggtgcccatctccatgtatatcccgtgtctgaatctgattgcggcggaaaaacattggaatcataagtaactccgacgatttgcgccgtatcctggagttctttccacgtagcttcctgataaccatcccgcatccgttcgccataacttgtcaaatcaaagaacaaatatcttcctctctcgtctgatacaggttcttgccccaatatctttgtcaattcgcttgtaagacttttcaattccgcttccgtatacccctcccgatctatggtaatgcctttaaaatcatatattacaagagtctccagcatctcttcaatcggcatgtcccctactgtcgcttgccatacatcgcttttgcttccttcatcgcctccaaaactccaccgtaacgtcttcgaatgaagaaatggcttaaaaatatcaaagggttccattttctcacgttttatttccgctcttggaatagcaggcaacgaaaaaaccattgaattctcgggcagcattcgttcaattccttttacaaattgctcgtccgattgaaattcttctgcaattttttgtggattaatatcttcaaatatctcccatccttttctcggaactgcctgatcataggccccgaacaatcccagtgcaacaatccccgccataaaaagcgcctgtaatctttttgtgcggattttcccctgtaaacgcgatagtaatatacatataactgcaatagaaaacatcgcaataaatacacttgttctattatatgcgcgaatcggtgtaaagaaaaaaccaatgaacgccccaattccacctgccatcgataaaataatcgcaaaaatatttagttttccaaacaggtcaagcttcccgtcatcatcccttcttcctttaaataatacaatgcaaacagaacaaatcgctcctactgaacaaatcaatccaattggcgcaaaatagctatctgtatcgaacaacgtaggattactttcataatatgaacgcgttatatctcccagtgccgaaatacggtggttgataacaggtaaaaacatttgtgtaaaccgcaatgccatcatatccatattccctgcgtcacggaactgcatcaatccgctgccagacaagctgtatgcttcccgttcgggaaaccatagcaaaatacagatcagcaatccaataacgcaaaaaagcaaactcgccagtgccggcaatatattcctgaattgttttgacgttacccatgaatagagacccgccgctaaaagaaagcagcatgtaaaaaatgcataataagcatcgctgatacctaccaagaaacacacaacgaggcaaaatatcatcttttttgaaaacaaatggagcttcttttttgtttggataattttctcttgcggctccagaaccattctttgtgcaatccagtacaaagctacacaaacaagcggaataaaataataactgattatcaccagatgttgttcgaatcgcaaaaatcccatcgggagcagcgaatagacgaccgcccccatcgccgctacaaaggagttgctcccaaattgtcgcaatgcgaaaaaagcggtcacggcaattagcggaaaagtcaaaaatgcatatatattcagcacaaggccatagtgatcagatagtaaacttcctatgccaaaaatgatattgataaaaacgctcgaaatggggaaactggattgtaccgcaacaaaaggcgcgcccaaattgggatatgtatataatgtgccgccgctcatataattttgtatactcatgctggagcccataacatcgacgctgtattcaatcggtatgtttaaatccagattccatattttgaatacataagcaacaatcaaaaaggagcatagcgcaacaacgatataccacacccattctttctgggatgcaactttccggctggaggaaaatctattcaacaagactactcccttcaattacccttcccgcttaacacatttcccacatttagaacatcgcccactttcatcaagtctatgtccacattcacatacgtacccgatgacgcgtgccggatttcctaccactaaggcgtgaggcggcacatctttcgtaacaacgctgcccgacccaaccatgcagtattcacctaatgtatgcccacagataattgtcgcgttagccccaatcgaagcgcctttcttgatcacagtaggacatacatcccagttatctccactgaaagcccgtggataaaaatcattggtgaaggctgcattcggtcccacgaacacaccttcttcaagtatcactccatgatatagggaaacgccgttttgtatcttacatccatctccaatttctacatcaaagtcgacgtatgtatctttactgataatacaatttttgccgattatcgcattttcccttatttggctgttgatccagatttttgtaccacttccaatttccgcttcatctgaaacatgggcggtttcatcaatataaacattttccctcatacttacatatcctttatttttcaaaccgattggcacactccacaacatattgccgctcttcgcttgttaactctggaaaaacgggcagacagactgtctctttacaaatctgctccgccatcggcaaatcaccctcctgatatcccaagtatgcaaacgccttttgcaaatgcaatggtacaggataaaatgctgctgtcgcaacattattatgcgctagaaattcacccaacgcttcctttttatttgttctcaacgcatattgatgccatatcatttttatacttgcatccggtctaaagcattggaatttctcagcgtcaagattttcattgtaatactttgcatgctctgcccttttggtattaaattcatctaagtgttttagtttaatactcaatatctttgcttgcatagcatccatcctggaattgtatgcaatcatgtagttataatatttataggggttatataaagcgtccactgcaatatcttttgcgaattcgtccttaatcccttccgcaatccatctggcgtctgccccttgttttcccccggcatgttctctcattgcgcggcatacagtcgcaattgcgtcatcgtttgtggtaatcattcccgcgtccccaaatgcacctaaattctttgtcggaaaaaaagaaaaacatcctgcatccgccaaattccctgcttttttacctttatattcagccccgatcgcctgacaagcatcttcaatcactttaagcccatgtttctgtgctatcgtattaatctcatccatgtcagcagggcatccaaaaatatgcaccggtatgattgctttggttttatcggttattttcctttcaatatcttgaggatcaatattgaagttcgcttccaagatgtccgcaaacacaggtgtagcaccaaccgccgcgattgcttctgctgttgcaaagaaggtaaacggtgttgtaatcacttcatcgcctgcgtgaatcccacaagaacgaagtgcaatcatcaacgaatccgttccattcgctgtagaaataacgtgtttgactccaagatatgccgccatttccctctcaaaacctgccactgcctcgcccattacgtacataccactctccatgcacgcacaaatcgcttgttccagctccgcctttaatggctggtattgcctttttaaatcaagaatcggtactttcattttcttctccctatccttatatttttccatatcatcttaatatttcgcataatcctattaatcacaaaattattattttgattctctctcattgtccataggctgctaatcttggcttcttcccaagaattttcaacgcatattgtccaataatctgtcccagaacataatagcaagatgcaaaatgcacaattccggcatgccgcttggtttcccttgatatcttaagcgcatctatgattggcccgacaacacttaaacaatataacgggtaaagatatttttttcgtgctatctttttttgcccttttgaataagccatatatccggactcatctgcataatgcacattcgtcacaactcgaaatttcagtttttttaataaggttctaaagtcacaatacatatcatgacatattgtctcgttttttacgaagcccatgcatcctgttttgtctataatagcatgggaatagctcgaaataaattccaaagcatttattctttctggaaattcatgttttaaatattccaaatcaaaaatacaacagccgtcagcaattggcaaaacatcccctttttcaaactttatcttatagaagtccccgtgctgttcgaattgttgcgatttgcataaacagtccaccatatgcatagagctgcggcgtaacacaaaaaaggtaaacggatccccacaataattataatatacgcttgataacggacgatctacaggtgttttcagacgatcaaccaccgatacttttacttccgggaaaagacgaaacaattccatcgaccggttcaatttctccggatcttcataaacttcatccgctcccattcgcatcatatactttccttgcgctgcttgcaggccaaccaaaatcccgtcgtttggccgaacattggggttttccaagacacatgccccatatttccgggcaatctcgcgtgttttgtctgtagatcctccatccgctaccaaaatttcgatctgctcttggtcaaaattctgatttcgaatagcccccaaacttctctccaaatatttttctgcattcaacgtaggaataacaaccgatacctggtatttacattccattttttgcattaccaccctaacttatatactgcttttcaaacttttgtcagctttttccagtatattcaacacatgaattgcctggtctggacctgaattcgattgctgcccattttcaatacaggcagcaaaatgattgaggccattcaataatgaatcctcgaacaaaacattcggaacgtacaaatcccccatcctgatacgcgcttcatatttcccatattccgcaaacaattcttcgttaaattcaacgcctttatcataaatcatcagtttttccgattctttgacatcatcaaacacgatcattttcttggtacctccaattacgatcctccgctccttaatcggagatatccaactggattttaaacttgcaacaaaatcaggatactgaattgttaaatatgtaagggattcttggctgctgaagcgtttgattcccatacaattaatatttgtcggtgcttttgccccgcacaaataatccagcacggctaaatcgtgaaccgccaaatcccacattgcattcatgtcattcttaatatgaggtccaagatttgcccgtgcacattcgaaaaacatcatgtctccgagctctccgctttcaattatcctctttatttcgcgaataataggatgatacaccaaaatatgatccacatggatcaaaaccttattttcttctgctaatttttttaacaaaagtgcatcttccattttagttgccatgggtttttccataaaaagattctttttgctctttaagacatctcttgctactatttgcgccacttcatttctaagtgcgacagcgcacatttcgatggatggatcttcaattatttttctataatcatcataatatagaacatcctcaccgtagattccctttgctttttccagcttggcttcatcagcatcacaaatagctatcaattcaaattgagtactattctttaggtttctagcaatattcggcccccaatagccgaatccaatcagggctgctttcttcatttggtttgatcctttcttatattccttcaaaatctgtatatatgcgcttcattttttacattctattacaattagaggcttcttttgattgcatagactgtctcatgttcatccaagatcttcaatcattttctcgaattccagcgccgttttttcccaatccaatgtacaagtataacgatatgcagcatctttcattgcctgatacgaatcattttctaccgctgctttaaacattagttcatataatccttgcacggtattttttttacataaatatccagcttttccataatcaactgcatcacatacgcccggagcatcaaataccacactaggggttccaacggctgccgcttcggatataatcataccccatccctctctgattgatggacaaaccaaaaggcgagccctgctcattaattctaatttctgattttcgtccacaaatccccaaaatgtaacatctggctcgtcagatggagtgccccaacttatccccttttccttgcaaatgggaatcaattcatttgcaatatattcttcatcacgttttccgacaatccacaattttgcatttggtatttcctttttaaccatcccgaatgcttgaattgccatatctatccctttatattttgcatagcggccaacataaataaaagtaggctgcaattctttttcagccattttttcttttgtccatggaataaaatccaatccaggcggaataatatatatattctgcggtttgaatcccaccgcctccaagtcacttgctgtagatcgggacattgtaagcgttggatcatttttgttcaatttaagcatcaatgtttcaaaagcacgtcccactttgcccttaacgccgcccaacatatagtcccatatctctcgtgtcagctgaaaaatcataaatatacgcttttcttttttaacccaaaatttagtaaaaaagcgaaatgtgttgcattgatctataacataatcaatctcattacgatgtttaacaaaaaactttttcgcctcacgaattacatccttcaaacttcccctgcgaatataaagaactccatcaatttcttcgcagtccgaagctccttcaaacattggtgaaaaatgaatcgcttttatattcgttgcgcgcctgagcatctcatgagtatatatttctgctccaccgcttttaggcgcttttatatcacgccaagataacattaatatcgtctttttatgatctctttctaaaaattcttttttcatttttatccttactaatcatccgggctttgcatttttcataatataactctcggatattatatcatatatctaaagccattgaaatcattttgccatttttccaaatcgatcgttatcttgccttcactatatccaaaggaacactagaactttgttaaaaattcaaacgcaaaaaagccacaagaatatatatgtggcaacagaaacgtatatagaatggtttgctatgaacaacagtgaaccttcccactatcgttatgtttgttaagtatcttaagctgaacagcgtctgcgctgaatcaatgaggcatttccccagcgtatctatcttttctagcagccatgcctctatcggcctttaaaatgtgtatccttctctttttgcaggaaccttaacattgcatttttttgatcctgcgtttcgaaaagtccagaaaacagggcattttcaaaatcagctgattgattcagttcgagataatgttgcatagactgtttggccgccgctaccgccaacggcgcacagcggcatatgcgattacctttttcgattgctgttgccatcaaattttctgcctctacacattcatttacaaggcctatatggcatgcatcctgtgccatcactcgcgaaccatcaaagaccagttgagcagcagatgcataccctatcaatttgggtaaccttcgcgttccaccccagcctgatataattcccagagatacttctggcagcccaagaatcgcttgcatagaagcaatgcgcaaatcacatgccaatgccagctcaaggccgccgccgagggcataaccatttattgcagcaattgtcggaaaccgaaggcttgaaattcggtcaataatgcagcaagcatccatcgcaaaacgataagcttgtttttcgtccattctatacatttcttcaatgtccgcccctgcagcaaatgccctcgttcctgcacctgtaatgatcaagcagcgaacttcaggattggcctcgacggtctttacggcagtttccaactccagaagcatttgttgattgattacattcatcacttcttccctgtttagagtcagtatcgccaggttgccgttttgatccagttttacagtattcattgcgctctcctccagaacttttactttcttctgggaaccgaattgcttttttcaggcactacatattgctctttatcaactccacgacaaacatttgcgcccattccaatcattgtatgttcgcctatagtaacgccattaacaatagaactattaaccccaatccagcaattttttccgatgtgcgtactgcctcctacgattactcctgctgtcataatcgtgttttctcctataacatcattgtgcgcaacatgacaaaaattatcaatttttgaatggtgctctataatcgtaggataaatagtccctgagcaaaccaccgagtttacgccaatatcgacatgatcaccgatccttacccccccaatgtgcggaattgtcatattattcccttcgttatctttttcaattccaaagccgcaacttccaataacagcgttctccctgatgacacaatgatctccaataacactgccctgattgatcactgctccaggcataatcctacaattcttccctatttttactttatgatatattgtcacaaatggtgaaatgacagtcccttccccaatttctgcccgggtgctaatcatcgcaccgtcagaacacatgagatcaggggcttgagaatgaaatcgatccaaaatgcattgcaccgtacgagcatattcgtaacggggattatcacaaaaaacgatgacgctctcacctgatgtgatttcatttctaaaatctttctgtaccaaaatcaggcaatcacggatagaagaaatctttttcgaacaggctgaatcataagcattaaaaaacagcaaagtgtgggcttgtggattatccgctgtagaaaccccttttatatcctccgttggtgcagaaggaagtaaataatcataattcttatataaagaaagcacatcttttaatgcgacattttcatctaaaaacataaatcaacctctgctttcacattgtcggactattttcaacttctgttatcatcgatttaaatttcaaaatcatttttcgttacaaattcatctaaatccctgcaattctcgtctaaggtcttataaatcgcatatcgccgcctattgcaaaaatgaagaagtttttttctggtggtttcctcttgggaagcataccagatagggtgtgtcaaaacgtggagctggggataatttccagacaatatgatttctcgtacattctcccgccaatgcattcgtgaatctgatacgtatttaaaatcatgaaaaaaaattttttgatagctattaattaaacccggtatctctaaatcagcttccaaaatctgcggggaaggtatatgcatagataccgttgtcacttttgttccaatcatttcctccaacagtcttgcctctcgtataatattcattttcgttttgtctacatcaacgttttgcccatacttcacttcatcaaaatgaagtcctatctcatggccataaccaattatttctctgatcttttcctgacttccttttgagaacacattatagaagtccgaactgatcagaacaaaataagtggcttggatcttttcacacttattatactcaaacctcgccatttctactgctttatcaagttccatatctatatcgtgccgcaaaatacacggcttctcgaagtgatcatagttatggtaattagctatttgataatggtcttgtatcaaggaaatcagtcctttatatgcatcatatgtaaaattcatattttcaaccttcttcatctataatagaaaagcacacattttcaatcaaaagataatatcgatatttgcacccgaaagggtgttttttttgtaccttttttaatgaacgaaaatgtgtacttaataatctttttatgttactttatattaacaaaaatagctctatgcgtcaaatgtcacttgataggttggtaatttcggaaataaattcgaaactgcaatcaaactatcttttcccttgattgcggcttcgtttttctattaaaataactataatcacaaaaactacccctgccaaggtaaccagcattccctgccaaataatgtccggttcaaacttaaactcgacgatatgcttgccctccggcacatatacccccatgattacaccattgactttatacaccggtgtttccacattatccacatatgccttccagcccggaaaatagccttggctataatttaaaaacatctcgtcttccgcaacaatctcggcactggcataaccgtcctttaattgcaatatcgcaatttgatttgcagcactctcaatttggcgcggcgcattctcaatataacttgttttatcatattgatagggatccgccatttcagcatcttttacatagtgaggagaatacagaagaggctgcgcgtttttattttcataaataacttcttgcccattgcgaaaagctaccgaataaacatcgtcaaaagaaaccgtctccaactctccgatttttaaagacgtaatatttacttttccagccccattcgccctgataagaagttctgtagtcatttccgttggttttatttgtaacttatattcattttctccaggatccgcgataaaactccaagtattctcttcatcaaaatttatttttcccgccgtgctgacatctattccgtttcgctcttctgcattgatcaggagcgtaatcatatattcttcatccttatccaactctaccggaacaattatagcttccacctgatcaccagagggcaaggcaatgctattttcctgcaatatttctgtttcctcaatagcggcattatctttgttatcaatacgctgccacggatcaataatatactttatcgataacatagaaagcatcgcatttctatatctaaccaagtaatcagcattttcgaacatcgtccccgctgcgcttctgttctggtttatttccagcacatccacaaagcccggcaatgaaaaaacattgtttgtattaagcatattaatattaaagaacatattttggctcgattggaatttttgatactgttcgtctgtgatatcctccccagttaccgtcgcaagccatgttctgctatattccagattttgttgttgtttcaaaaaatcaaccgtcggatccgtttcatgataagacgaatatgtcactttctgcgtcacgattgtataaggcgcaagatccgtaacggtaatgattccaatcaaaacagccaaaaacaaaaaaccaaattttttcattccattaactttgataaagctataacagcctaacgtcacgattgccagccccaaaaccaaaacggttggaatgaatggatcaaactcccaatgccaagcgtacattataataaagatacaagccataaccacaactgccgccgctatcataaagcggaacaacctctttgcctcttctcgctcctttagcttttcaagcacaattccgaaattaatgactgcaaatgtgacatatacaaaaatcattcgagatgcgcatcgaaacccaccaaacagaggaattttactcacaacagtatttaaaaccggaatactacctatacagcaataaacaagagccaagatcataaagatcgtgttaacgcgtattcttttgtctttccaatgaaaaacggccgcatagatcgcaaaacaaagcgggattagtccaatataaatctcctgcggatgctccatacggttcggagcaaagaccagcacctcatctgcagtttgcggcaaaaccatacccaatagtgaatgctgcgtgcctgaaaaagagttgaaatagccttcggaaattgcggcttttcctgtaaaggcggatacctgttgcattggcaaaagctggatgccgcataatagggctaccaatcctatccatattaaaatatccagtatttttcgttttgcatcctttttttccataaaaataatcagataaagaaaaacaaaaagacttgaatataagaatacttgaggaaaattggcaaaaaattgtattgccattgtgatagccgcaaaaaccagtcggcttcgctttttctctgtgatatattgctgaataaaatacaaaatcagcggcaaccatacaaatgacccatatacgcccggatgcgcggcacgtaagccgccaaagattacgcaataagaaaatatcagacctgttacaaacgcgacaatcctacttttatgtatctctgtcatataaaggtacataaaaaaaccggccatggaaatatgaataatatagtaaatcgtattgaagtgctcaatcggaaataaatatgcaatataattgatcggatatgcccagccatacgtcataggcattcccagcgcagtctggccgttccaaaacggtatcgcgccactcatcaaatggtctttcgtccactcccgcaccggcgcccccgatatcaaatcaccaaaaatcatgctttggtcagcaaggaaataggttgcataaaagcaaaaggcgatcaacaaataaatacagaatataagtatattctgcatcgttttggatttataccatttattttcgcatagtaccatcatccacctatttccttatttgaaattgattcgattgtatcacaaaataatagtatgaacaagcaacgcagcagtgtactaattgatctgcctgtcgttctttttcgtctcccgataccctacggccgcaatcataacgaggcgtattatgttcgcagttagtgtcgcatatgcaaagccataaattcctttgtatagcgttgcgggtattgccataacaatatagatgactccataaatgatttgtatcgaaaactggaatttcgcatgatagaaccgcaaaatgaccgccaacaacaaacttgatgcaaaaaaagccacctgtcccaaggttccaacgcctatcaaccccgccgcttgttgatacacattggggtatagccactggatcaaccaaggcgagatgagtatgcatgcaatcgccgcaataacggataaacctagggtaaatactaatatttttcgatatccttttttgctgagttcaccgttataattggcaagatatgcaagaagcacacttgtcagaggccctgtaagcaaagccaatgtttttcccagtacggaagccgtgtaaaacgttgtaaccgcatccccccccaaaacattcagcagcacaattctatcaatattcagaaaaaaattactgattatatacgaccctgcgacaatccagatatcacgccatacgcgctttctgttctcggaaaattgcatcgcgggacgaaagataccacccttgcaaattacaaacagaatcgccagaagttcgccgacaatgagcgcgacataccatatccgtgaaaaggaaaataaaatggttcctgctatatagccgactgaaagcaacaaatagaaaacaaaatacagtttataattaagcgacatccggaacgcgacatccgagtaatatcgcagtagtgtaagtaccatcaataagcagaaaaacaaagaattcaggagatttagctggcctaaggccgccagcgcagcaatcgccccaccgcaggcaatgacacaaaacagcaacaagatcgaattgtaatctccatttttgctttcgtattttggtttgttaaccagtcggatattattggcagcggcgccaagcgatccggcaaggatcgctacaatcgacatcagatacaaaatgataccaaactggttctcgcctaatgtttcattcaaatatggatagaccacaaattggatcacgatattcatgaccacaacagctagtacattgagtgaaagatttttcacaaatccttttttaaatccgtttctcatcaacatcattttatttgaaaatcaatatcgtaaaaatgcttttgcgtcgtatgtgaagagctcagatattccttgatctgttttttgattttttccgctgtatttcctccatcaaaaggactcactactgttctgcacaattctttcatcgtttcggaccgagctttttggatggcagccttaatgtctttccgtttaggttcacaattaataacgctatctgcttgcatacgtcccttttcgcgaatgccgatattcactgtgggttttttcaaagcagggacttccagaattccacttgaagaattgcccagtacgaactcgcaatgcttaaccgcgctcaaataattgatctgtcccaaattatcaaacaatcttgctttttccggcttctgttccgcgtattgttgcaaccgttcgttgatttgcatccccccatcgtcagcatttgcctttgtaaaaacaaattgcatatcttctacatcatcaaccgcatacaacagttcttccagttctgcacaagcatcctgtttttgcagtgtgactggatgaagcgtcacgaccgcatatggctgcaccatttgccaatcaattcgttgcattagttcatttttcgataacagctttaacctcttgatattttcgatgcccagagcccctacattgaacaccctatttggttgttctcccatttggataatccgttttctatattcttcgcagcaaggaaaatggagttggctcattttagttatactatgccgaaaacaatcgtcatatgcaccttccgagagttcccctccatgcacatgtgcaacggatatcaacttgatgaccgctgcagcggtaacggcaaatgcttcgtatcgatcccctagaaccaccaacatatccggtctcgttttctcaaaataagcagcaaatttctcaatcgcattccccattgcaatagcagtcgcagtagatgtcatacgttctggcaatatttcgattttctcgtcgatcgtgtatccatcctgttcgattgcttggtatgttaagccgtattttggacttaagtgtgtccctgttaccacaattctgacatcaaaaaaggcgtccccttttagcgcatggatcaatggctccaatatgccatattcagcccgcgttcccgtcatgatacatactctttttttcataattctatcaactcgtcctcgttatagtcgcgttttgcaatcatacctataacctgatcccacatcattggtgagataccacttccaggccgtttcgttgtgatgttttcttcggtaaaatattcccccgccgtgatatttcttgccgctacaatgctttttcgcgcgatcaacatattttctcgttccgactccgttacttttttgatcccatcgcccagttccagctctacccgcctgatggattgcaccaaccttgataactcagaaggctctaaactcgctgcgtgatccggcccctccatataccgatccaatgtaaaatgcttttcaataactgccgcaccaagagcaaccgcagcaatagaagcttctatgccgtttgtatgatcagaatatcctacaggcctaccaaacgtttcgcgcatcgttaccatggccctgagattaacatcctccggcggcgttggatattgtgtattacaatgcaaaagtgtgatatcctttttttcatccgattccagtacttgaatcgcttgcttgatttcttgcatggtactcataccggtcgaaagcaaaaaagggttatcgctggaagccagccgtttcaaataaggaaagtttgtaatttcgccagaaggaattttccactttgcaatatgaagcttttccaataattctatgctgttcagaccaaaagcggttgataaaaattgaatattatattgtttgcaatattcaattagttccatatgcattgtcacatccatttcataccgcttgagcattgcatattgattatctccgccaatatcaaaattcaccttttgataatttgctttttttgcatatctcgatgctacttctcctgcctggaaactctgaaatttcacgcaggatgcaccggcttctgcagcaacttcaatcatgtgctttgctagttctatatctccattatgatttacgccggcttccgcaataatatagacgctcatttcaggcgatccccaatccttatctttccatcgtattcaaattctgttatttcaagcgtattatcctgcgtcttaacaataaatccattcgccgtcttaccgacaacctgtcccacagttcctatatagttaacagcgtttcgaatcatttttgcacggttaatttttattgtagtaccattaatttggctcgttgccataggaccgggtctacagatcgcccgtataaaattaaacagttccctgctcgtttgattccagcatatcttttcatctcctgccttcctcataccgcaataaaaacctacttcatgaatacttttttgcttgatcacatgaacctggtccatcttaatttgatatagcgcctcatataagacatccgcgcaataatgatgcgccttctctaacaaagtagcatatgtatcttcatccgtaatcggatatactttttgcagtataatatctcccgtatctatgccctcatcaatataatgcactgtaataccaaactctttttcatcattgatcaacgcccaatttaaaatatttcttccccgataaaaaggaagtttgcccgcatgacaattgatggtctttaatgatggcaggttaataatctcttttctaaatatctgattaaacgacatagagacaaaaagatccgtgtgatactcttttatccgtgcaatgaaattgcgatcattgatgtcaggataaataaagcattcaatattatgctcctttgcataatttactaaatattgatccggcgtatcataacgtacacaaatgaaatctatggctatttccttgtccaattcgattttaccaagcgcctgatgtgcccacaagccatcagcaaaataccctatcttaagcatcattcttcccccaacacacttaacatgtctttcatttcaccgatttgccccatgtccatccagcagctttccgatattggataaacacctactttacgtttgttttcaaccaaccgcagaatgagtcctgtcaaatcaatcgcttcatgcgccttgatatagcggagcacttccggctccagaatatacagtcctgtatttgtcaaataagattgcgttggtttttcttcaatcctctctacataaccgctattatccagacgcaccacaccatagggcatcaccacatttttcatagcacagaccattgtaatcgcattgccttcttctttgtgataatcataaatacaagcataatccgtctctatcaatatgtcgcagttggatacaaaaaaagattgatcaatttttccttgaagcaatgccagccccccggcagtcccaagcggctttgtctcctccgcataatgaatattataattgcaatcaagctcattaaaatatgccttaatcatatttttcttgtgattcaaaatcaaaaacacatctttacaatcataagcggtaaaacgcccaataatcctttccgtgattgttatattgccaatcggtacgagcgcttttggcaagatatcggtatagggcttcagtcgtgttcctttccctcccgccataattactaacggtgtatccggcatcggttttgaaatcttcttttttcctacatccgcgccgaaaaccatatctaaaagtttcccccgctcgtctgccaaaaggtatacaacgcggcggcgttccttttgttccctttcaaactcggctctagtgtagcatacttccggctttggattcatcgcggccaaaaccttctggtccatatcaccgttttgcagaatatatttccgcatatcgccatctgaaaaaaggccgaccaaaaccccttgagtatccagcaccgcaactgcttttttaccgctttgatcaatctttttcacagcatcttttacgcttatatcaggagaaacaatatattttttcaatgtgtcatccattattttttcaaccccatttttactaccgataccactttctccaattctccatccgtaatacccgttgaacaaggcaacgtcaatattctgctccatagcccgtcacaaatatccatgctcgtcccggggcattcctgatatggcttttgtaaatgcattggcttccaaaacgttctcgcttcgatatcatgctgtaataaccacgagcacatatcccgcaccttctgctcactttccaatacgattccagaaaaccagcacgtactttcatgttccggatcaggaaacattgcaactccattgcttctatctaattcagtattataaaaataccgtatttctcttttacgcataataaactgatccaaaaattcgatttgcgccagtccgaccgctgcttcgatatttgtcattcgatagttgtatcccaccatgtcgtgcgtgtattcaattcctatgcgtgctgtcgataacaaatgtctgatctgttcgaccaatatctgatcgtctgttacaactgctccgccgccaccgctcgtgattgttttatttccattaaatgaaaagactgttgctgttgccagcctcccaattggttttccatgataggttgctccaattgctgctgcagcatccgcaatcactggcaaatcgtacttctgtgcaattctccatattgcctccatatccgcaacattaccaagcgtataaaccggcataatagccgcaatcctctgccctgttggcttataaactaatttactgtctttatatatcgtatccacttccagcatctgttgcaatttctgtacatccattgtccatgtatgtgcgtccacatccaccaggaacggctgcgcaccacaatgtgataccgcgttggctgtcgcaacaaaagtatatgacgggataattaccaattctctgcatttcacaccacaagcaacaagcgcaatatgcaatgccgtcgttcccgccgatgtcgctacagcatatggcacgcctgcgctcttggcgatcgccttttcaaactttccaacaaacttaccaacgcttgaaacaaaggtagaatcgatacattcatttaaataatatttttcatttcctgaaaggttggggacacaaagtggtatcatcaacgactctcctatatattataaatatctgccttataacggcttaaatttttttgtatgaatgcaaccgttgcttttaaaccttcatctatcgtgatttccggtttgaatcctgtcaattgatatagtaggctattgtctccaagcaatctttcgacctcgctgtttttaggccgcaaacgttgttcatcacacaaaatcctagccttggggtcgaccatgtcaatcattttctgtgccaaatccccgatagttatttctcttcccgtagcaatattcacttcttttccaattgcttcgtcacacctcgaaagttcaataaaaccgcgtgccgtatcctctacaaatacaaaatcacgggtaggcgtcaacgaacccaattgtatttcttttttaccggaaagcagttgtgtaataatcgtaggtataaccgcacgtgccgactgtcttggcccatatgtattaaaaggccttacaatcgtcaatggaagattaaagcttctatagtacgcttccgcaagacggtccgcacctattttcgatgcggaatagggggattgtccctgaaacggatgttgttcggtaattggcacaaactgcgctgttccataaacctcagaggtggacgttaccaaaaccctctttgtctgcagctcccttgccgcattaagtacattgagtgttcctttgatattcgtgtccacgtatgcatccggtgcaatataactgaatggaatagcaatcaatgccgctaaatggaaaacacaatcgatcccctgcatgatgtgtctcacaaaatatggatctcgaacatcccctgcaaccggcttaattttgcttaattcttccttcgaaaaagtatccaaccacccaagcgaaccaaatgaattataatatgtaaacgctgtaacttcgtatccttgcctcagtaaactttgagtcaaatgactgccaataaatccatcggcgcctgtaaccaatactttcattatagtatcccctcgtacttctttagtaactcttctgcatatggatcgatattatctggtatacacacccaatggcgcgtacaacctttgcaaagttccattgtatccttttcttttttgagttgcagtacgcgtattttccgcagcatttcaccgttccatatctcgctaaccgtttgttctttagcatctccgaatgggtatgctcctttccaatccgcgccgcatagaatcgcttttccattccagttgatcatcagttgtataaagatcaatgcacatacttccttcttctgaagaggctccccaaagtaatctttttcacttttctttacattcaattgtgttcccggccatatattatcaacaatcgtttcaatatagatttcattgcaaatgtccccaaacatttgataaaactgttgcttttcttcttcagtatatccgtcgtcacccagcttgatatagagaaacaaattatctcggtgctggtacaaatgtcgaatattttcctgatatcgctccatatctaaattacatgaacacttttcctgatactccttcgcgttgactccattgacagaaatattgatccaatccagtccggcattcacgatatctttatttaattgcggagtcaataacaacccatttgtaaacaggtcgattctttccgcgacgttccgctctttggcatattcgatcatctttggcaaagctttatgtagcaatggctcgcccatcccgccgatttttaatcgttttaacctttgcggcatcaaggcaacatcgtcgatgatctttttaaacaattcccaatccatatatccaaatttcacgttggcttttcgtatggcgtcaatatccgcatgatagcaaaaagagcatcggatattacatgcgtttgttggttccaacgccaatgtaaacggtgttgccaacggcaaaacgtcctctaatctttgtcttttcgtatcattaacctttgcctgtatctttgctttcactctgcttcatgcgccctttcattctttatattcgtggagaaaaaatcccgtctttctttctttcccatctccaccatttttttcaccgcttgttcttcgcctgtattattacatataatgatataagcctcgtcttgcgcactcaattgatcaggcgaaataatctttataccatcaattgttccctttttgattatatctacgtatgccgctaattgagctttgggaaattcctttttcatacgcgcatacaccatgtgtccacgcactcccgcgccccagataatatagcgaaaggattcctgtttagattctttcatgcaagcaatcaggttatcgatacgatcttcaaagttcgcgccgctggttgtcttttctctttcttcataaaatgcgctcaaatcaaacatagcacagtacttatcgtatgcatcctgcatacgactttgaaacaacgacaatatttgcttttttctttggctataatcaaccgccatcggcgtccaatcgatctcatcatattggccttccgtatatattcgaacataacgatccacaaaacgaaatgttttccacatttcatcacgcgctaatataataggtatccccattgcaaggcaaggcagggtggaatgtaatcttgaagtaacgactaacgtcgcttcatctgcataccgtttgtaaaattctaatgccgtatgataaattttttgtttacgcgattcccgatctgcacttttagggaatctgaccacttgagtggtaaattctcctatttccagatattcttgcgggatataactcttaagttttggcgggatatccgtaaaaaaaactttaggttttgacggatgtttctccctatttggcaaaatggtcgtaatacacccgcctaagtatgccatgatattatgttcccgcataatattcaaggtatattcgtctctgcatcctattggctcaaaacggcgcaaatagataaccatttcttcgggaaggacatttaagtccgttgtaagtcccaaaaaaaccggaataattttaggtgaaaatatatggtagggagtaaaataagcatctaacaccgtgttgtaaatcggcacaacaacatattctccgtcgtatgtaaaaatatcattataaggaatcgtaaccacatctttaacatctacattcattgtctgatataaataatcgcaagcgtaatcttgtagtacatcccccagattgatattctcaaattcttctaacagcaatgaaattttgccgtatttcattccgacaccatccttttatttatacattttcgggcaaacaataaccatatcttttgctacctgaaagggtattttttttatgccttttttcgctgaacgaaaacatatatatatactttcaaggcaaacaaataatcgctatattcgttttatacattgtttatagtatcatataatgcatgccattttcaattatcgtttgcttcaatcgaatatatatcgccattcattgacaaaaaccgtataaattgatatgctgataaaataaaatgtatgcagaaagaagccatagaatggtgcagtttcgaaaaaaaatcagtataagcattccggtttataatgagattgaaaatatcggccctttagtaaagcagatcgagaatctcttttatactacactggcatcatatgactacgaaatcataatagcggataattgttctaccgacggcacgcgcgaacttgttaccgcgatggccattcaaaataagcgtattaaagttattttgaattctgctaatgtcggcccccgttctagttataatgcatttttgcaaaccactggtgattgttcaattgccatggctgctgattttcaggacccgccagagttgattccgcaatttataaaagcttgggaagatggatataaaattgtcatcggtatcaaatcccaaagtaaagaaaacaaattggtatacaaagcgcgttctttatattacaaaatcttgaataaaatttccaatatagatcaaatcccacaattcacagggtttggtctatatgataaacaatggatggattttttgcgaacaatcaaagatcctattgtatatactaggggattggtttcggagtacggttttaagcgcaaagaaattgaatttacgcagcctaaacgtaagcacggaaaatccaaaaataattttatgtatttatatggccttgcaatgcggggcgtgacatctaattcagaattaccgttacgtattgcaaccgtggccggttttttgctttcgcttggaagtcttgctgttggtatcatttatttgattttaaaattattcaactggaatcgctatcccgcaggtactgctccaaccattatcatcatttgttttattggagccgttattttgtttttcattggcattctaggtgagtatattatgaatatcaataaacgcgttatgaattatccgttggtattagaagaacagaagattaattttgatgaggatgcgtcttcttcggaaaaataattttttaagacaggaatttaatttgaaaaaaatatttataaccggcgccagtattacggcagctaccggcagaaaaatcgcacgcgaactacaggatgaatactgtttattttgtccctcccgtgcggagttagagttgaccgactatcggtctgtcacacaatacattcaaaataccaagcctgatattatcgtgcactgcgctacgcatactgcaaattcttctatgaatgcctgtgaggataatttgcgcatgttttttaatttgacagcgcaccatgacttagtagaaaaggtcatatatttaggaagtggtgctgaatatggcaaagaccaggctatatctgaagtaactgaaaaagaaattggtgttcgcatcccatctgatagttatggcttttcaaagtatatacagactttgcatgcacgaaacagccgcaacattatcaatttaaggctatttggtatgataaatcctttggaggattattcacggaattttttatccaacctttgcacgaaagctgcgtttggcattcctcttacccttcgacaggattgccgtttttctttcctggatgtcgcggatttggctgctatgataaagtgggccatcgcggagtctccgtcttatcatgattataatgcatgtaacaatcaaaattattacctttccgaattagccaatatagttagtgagatttccaaacaaaattttcctgttcaaatactgcgcccaggaatcgcttttgagtatacgggaaacgggtcgcagatattacaagagagcgggattatctgtcggcctatttctcaatctttaaccgatttgtatcaatatttttatgatcgcaaagagacatttgataagattgccgtagaaaacgcaaaatgaaaggcttgctatgaaagtatccgattatgttatccagtttatcgaaaaaaaggggatcagcgatatttttttgttgcctggcggaggtatgatgcatctcttggattctcttgctaaaaatgtatcattgcaaaaatattgcaatctcaatgaacaggcgacgacgattgccgctgaaggatacgctgcatataccactcagcccggcgttgcctttctcacaacaggtcccggttctacaaacgcggtaacaggagttgcagatgcatatattgattctactcctctttttatcatatcagggcaagccaaaacagcagacttgatgaccggaaaaggcgtgcgccagatcggcgcgcaggaagttaatattgttgatattgtaaaacccatcaccaattacgctgttacgatcactgacgccaataaaattcgatatcatttagaaaaagcctggtttctggccaccaccggtcgtcggggaccggtgtggctggatattcctctggatatccagtctgctcaaatatccgaagagcaattatccggatattctcctgatataagccatatcgcttcttctgttccagctcaggatatacacgatatctatcagcttttaaaccaggctcaacgacctgtcatccttttcggctatggtgtcgtttccggcggcgcaacggaactctttactgaattgatttccacgctcaatattcccgttttaagttcttggcgcgtaaaggacttacttgtcaataagtataacaactattatggtagccctggctcacttgctccgcgttactcgaatttcattgtccagaattctgatcttttgcttgtgatcggagcgcggctgaatttttgcatgactgcgtttaacgaaaccggatttgctccaaatgcaaaaaaaatcgttgtagatatagatcctaatgagttggctcttttgcagggacaatatgaaaaaaaattggtgatcgacgccaaatctttccttcaccaaatgctggagtttgaagctctgtatgatcccgccgatcagagcaactggctttcgtactgtaagaatatcaaacaggaattcccgctttccgcagaaaaacagcctcatgtttccaaccatgttgatggatatcatttagggtttacgttagcccgcttacttaaggctgacgatgtaatcgtcagcgcatcatccgggcgcgcaagcgcgatcgcccctatgacaatcggcggtaatgtgcccaaccgttttattactgctatgggacttggctctatgggatatggtcttccgctttctatcggggcatgtgtggcctcgggaaaacacagaacaatatgtattgaaggcgacggcagtctgcaacataacctgcaagaattacaattaatatcgacatatcagcttcctttgaaattgttcattctaaataataatggctacgcctctatttatggtatgcagcgtaaccatttccaatcgcgttttttagattgcactcccgattccggtttgcgtcttccgcctatacagccattagcagagctttacgatattccctaccatattattagacatgagtcggagatgcctgatatacttgcacaaattatggcgaatgatcttccatgtctctgcgaagtcatgatagatattgatttcgaagagattccccgtgccgccaccaaactcgacgaaaatggaaaaccttattctgcgcccctcgatgatctttatcccttccttaccgaatcacaaaagcagcacgcaaaactataaacagtaatttaaaaggcgcgcttgaaagcgcgccttttaaattactgaattacttttcttatggtttggatcatataatcctgcatatcgtccatcattccaggataaacacctacccaaaacgaatctttcatgatcctatcggtattgcggagctctccaaccatacgatatccaattttttcccgtctcatctcatcaaaacaaggatgcttagtcaaattccccgcaaacaacattcgcgtctgtattccagactcttcgagttgcctaacgatctgttccctatctaggccctcttcaaccgtcatcaagaatccaaaccaactaggttcgcttccggttaatgcctcaggcaaaacaattcgctccctcatttctgacaagccatcgtataacctcgcccagtttgcttttcgcttttgaataaattgcggcaatttctccaactgggcacacccgattgccgcttgcatatctgttgctttcagattatatccaaaatgggaataaacatatttatgatcatatcccttaggtaactcgccatattgtccatcaaatctatgcctgcacacattgtcccgacctgatgggcacacgcaatcccttccccagtcgcgcatagataatatgattttacttaatatgggatcattggtgtaaaccgccccaccttctcccatcgtcatatgatgaggaggataaaagctggatgtaccaatatccccaatcgtgcctgtaaactgcattttatttttatacaggcatttggagcccaatgaatcacaattatcttcaataagccataaattatgtctgccgcaaaagctttttacagaatcaatatcaaatggatttcccagcgtatgcgctagcatgactgcttttgttttttcggatattgcttcttccagtatagaaacgtcaatattatattgtggaatagtcacatctacaaaaaccggcacagcaccatattgaatcatgggagcaactgtagtcggaaaacctgccgctaccgtaatcacttcgtcgcccggtacgattctccggtcttttaacaatggggatgtgagtgccatgaaggccagcaagtttgcagaggagcccgaattaaccagcgcgcaatatttcacatgaagaaattccgaaagtttgcgctcaaagcgctctgcgtatttccccgccgttaaccaaaactccaatgcactgtctacaagattcttcatttcagattcatcgaatacacgtgctgcataagaaatacgctctcctttatgaaatgaccgtttttcttctttatattttttataatattcttctacgctgtaaagtatttcagcacgtgcctgctcttccgttttgtcttcaaacataatttctccttaacgaacgaatgatcaattttgttcttttggaacgtaatattgaaaaacttctccatatgatgtattgatttccgctgctcgatactctgccagcatatcgatttgtgtttctagccgatgtgtttccataaatttctcccaaaattctggcgaagctttacagagtctctccgcggaacgctgtgtagtaaaaaagtcttctccttccagggtttccaataattcacacgcatagttggccgtctgagaccctgccacacctaaatccgaaaaatccatcgtataaagttgtgtatcccaccccaagacagaatacatttctaccgctcctatccccatagcttttgtattcgcgggcacatgggatgcaacttgttgtgcggcaatttccaaaactcgtttgtcacgtttatccgggactgcaaacagattttggcccgccccaagaaacgtggctactgcaaaggaaaatacaacaaatactgtcgtaagccctatcgcagatttgattccatttccaacgcttttctgtcggtttataaaaaacgatttcatcggtgacaaaaaatgctgtgcaaaaatgcatatgagaagtattagtatcatatcaatgatgcacgtatttccataagctgctcgattaataaaatatgtaaaactcgttaaccccatgatagacagacccgtaaaagcggcattcctatagttaaccgttttctcgttcccgttccatttttttatcgacgataacccttttcctaaaaaaaccaagaataccgccaacacaaacatccaataactgatccctgctttgagaggcacttccaaactcccaacgtcataatcaacgctaaaaaatggatatacaaattgtcttattgtcagtggacttcctcctgcacatatattatacaaattgacgataccaacggcaagcaggaagctcagtatacatagcagaatgttgataccaatatctctccaaaatctccattcgcatatcttgtatttttgtgcagatatacatattaaaaataccgcccaagatagtatcgcaaaaatgcccatctcagtactccataccgtcaataacgcacaaatcagatacccaacccaggatataatttttatacttttacgatgcctgtatccaaacgcgatcatcgctactacagcggcaatgactaatattctatgcggttgacgctgataatacatattgaacctcaacgcgacattcacgaatgctagtgccacaactcctaaatacctgatcgttttgttcttaacaaatatccccaaggcataacaaaccagaagatatgtcagcgctcccagacccgccatgctaaaaacaaatgcattccagatatttgtaattcccaaaaacgatattaattttaaaatcggagcaataaaaattccatagtgcccatagatgcttgtaatttcagggctatatggaacattataataaacattatatactgagttatagtaagcgtgggcatgatattccacggatgcagaagtatatggatttgggaaataagccgcatagcctaccattagtgctatggctgctgccaatacccagaatcctacagtttcacgttttgaactctccagtgaaaaagtatcaaaacggtttgtaaaatagtaaagagctacaaataaagcaatcaatgtcgtagccataattgaaaaaggtatctgatgccacacatagtaagaatatcccgggaagaatacattatctgcattcaagaaaaaaagtgccatcaaaaaaaatcccaagcataaaaacagcccaaagaaaattttcgcaaatctatcactaatttgaaaccgttttttcatatgggcagataaaaaatatacgattaagaaggaaacaatatatataacgataagacctaaatacaatttcacgtttgtcaagccataggaagctagatgctcgcccattccatccgcaaaacatatttcccacaaaacaacattgaataacagtgcaatcgtcgttgcaattacaaatgtttgctcatgctttacattagtaaaatcatcttttgccagttttcccacctccctatcgacacacctttttaatttgccttttcataatcattcctatatcctcaccgctcttataggcccaaaaccattctactgttgcttcgatagcctctttcacattccattgcggcgaaattccaagcatattttttgccttctcacaattcaggcgtaagcatttcgcttcatgcactgcattcttttcctcgttgctctcccatcgcacatttgaccatgcgtcgcagaaaagcttcaccaattctcctgtcgtaatacaatctttatcttccggtccaatgttataattccccgcgagagttctattttcaaattgcttttgtgcaatcatcaaataagcccttaacggctctaaaacatgttgatatggccgaattgagtaaggattacgcactatgatcgtttccccagctaaagccgcacggatacagtctggtataatcctgtcctttgcaaaatcacctccgccaatcacattaccggctcgcgccgtagatattgcaatatccttgttttcgaaaaaggattttttataactgtctgtgaccaactctgaacaagattttgaattagaatatggatcatatccgttcaattcgtcagtttcaacatatcccctatcccactcattatttttgtataccttatcagtcgttacatttacaaatgattttacacttgagctctccctgattgcctccagaatatttactgttcccattacattggtttcatacgtgtatgccggtttctcataagatgtcctaaccaaaggttgtgccgccatatgaattacaatatccggttgcgcttcatacatggctcttttcagtttctccaaatcgcggatatctccaataatcgaattgatgctctgatctatgtttacaatagtatacaaattcggcttcatttcgggcgcaagcgcataacccgtgacatttgcacctaactccaataaaatattgcacaaccacgatcccttgaagcctgtgtgtccactcataaatacatttttgcctttgtaaaaactctttaatccttccatatcttccacggggcttctccatcatgaaacaatttctctagttgatttttatcacgttgcgtatccatgcactgccaaaatccgtcgtgcttaaaagccatgagttctccgatattcgccagagtttctaacggctctttctcaaaaaccgtccaatcaccgtcgatatagtcgaaaacagatggctctagaaccataaatccaccatttatcattccgacatcttcatctgctttttcccgaaatgccgttacagtatcatttggttggatatctaaaacaccaaatcttcctgttggatggattgcagtcatcgtagcaatcttaccatgctttttatgaaagcccaccaatgcatgtaaattgacatcagaaactccatcgccataggtcatcagaaatgtttcttcacccacatagtccctgatacgcttcaatcttcccccagtcatcgtatgtagtcctgtatcgacaagtgtcactttccatggctctgcaaaattattgtggaccatcattttgttttcatttgtgaaatcgaaagtaatatcggacatatgcaaataataatccgcaaaaaattctttaatcatatgagctttatatcccaaacaaatgacaaattcattaaaaccaaactcagaataatatttcatgatatgccaaagaattggtctttctccaatttcgatcatcggttttggtttcaaatatgattcttcgctaatacgcgtaccaaagccacctgccaggatgactactttcatgttgctctccctctcctgcattaataattagaacttgctcccatacaaacccacccttgatatcttttaaggccgccgaataatcataacacattccaaacggcaaaatcaattaacgatttgtctattgttcgaacctcaacttgctacccatatcatcttatgttccgaatccatcaagttccctttgttatcatatgccgctacattgaagatatatgtccctgctttgccaccgtatatgcccgtggaaaaatctccccaccaggtcccgtttcccatatccctgccctggatcatccggtaactgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctccccaccaggtcccgtttcccatatccctgccctggatcatccggtaactgcctacgccatcctcttgacggtacacccagaattgtacctcgcgcactcctgatggatcgctcacattataagcagccaaggcaaagcttgccttttgcgttgtcgattctgcatcaattgtaaaacttcctataaccggtcctgtattatcactatcttgtcctgcacgtgcaaccgcttcttttgcattaatctttccccatccataataaatatcttttccgggtgttcctaaatcatctgtagtcgaatatagaatatcctttacttcatcaaccgtaagttcgggggcttctgcaaaaaccatggctgcgactgcgctcactaccggcgcagccatggatgatccttgtaaaaaagcatacgaatcattatatgtactgaaaatctcgattcccggtgcagcaatatctttttgggcattataatccgcccatgctggtctttgattattttgatcggtaggaataactgaaatacacgcttcataatccgaaggatataccggccagtcgtgtcccccgttctgatcgccatttccaccggaacatacggtcaatatacctttgttttttgctgcgtttatcttctcttccagaaatctatcgttcgcataataagcacctaaactcatattgacaacccttacacctgatatattcataatccggtcatacgcattacgaatattcattgtatccgccaatggttctggtgatgctgcacgaaatacattgattgggacaattgttgcgttataagatacccctgcaattccaattccattattggcctccgccgcaataattcccgcaacatgagttccatgcccagacaaatcgcctgtaagaaattgctgattttcctcatcatatgcatttgcctgatcgatgttatttataagatcaggatgcgacatattgatacccgtatctataacggcgactttaatcgtttcattaaccttatgaatgtcccacgcgtcataagctttgatattgtcaaggtaccattgctgatcatgatatgcatcgttaattgttgtagctgcttgtacgccgtaatcatccatttccatcgatcgatacaagtaattgggctgggcgtactccaccgccggatcattatttagttcatcaatcgcttctcttacggataactcatcaggcaactcgaccactactacctcattctcttcgattgtttcttcagatatctccccttccgccataacggtcatcccgataacggtttcatttacctcttccatagaagcttcttctttaaattgtactaaaacctcgccttcagcatatactgtgccctctgctggatcaacaattgttctctctaccttttctgttgactcaggatcagccattgcaggttcttccaatgaagaattaggttcattttccggagattccgctggcattgtcgtagccgacgcagttgcttcaggttccgttatgctcccctcgtcatttaacgatgcatttctagtgtcatctattccaacttcttcagcaactatattttcttgtgacccattctgtgcaaacgctactacatatcccgaaaataaaaatattatacacagcagaataacaactacactttttacaaatcgattcatgattaacttttccttttacttaatgtttatcgcaatattacttttaatagcactaaactgccggtgaaaacgcatcttaaaaatagtataacataccctgattttcatgcaaacactatatctgttttttataattccctacggttcttggcgacaattttcttgcctgacagttaaattcaaattccaacaataaatcacttagcaacataaaaaacacctttctttccgaatacaaacccgttaagaaaggtgctttatttatgctgttatgataacggtttggtaacacgtacttgctgatgtgactttaccaacagttatcgtacttgaaacggtttttccctgcaatccttaaagattttgctgtcttttccttatgatgcaataccgttcaaacatgcatggttgtcgactatttcacgctgtcgatataggagatgaggtcaagaaccttgttggaataaccccactcgttgtcataccaagcgatgagcttcatgaagttgcctgtaagcgcgataccagccgtcgcatcaaagatggacgtatgagcgtcgccgaggatatcgctggaaacgatagcgtcttccgtgtaagacatgatgcctttcagttcgccttcacttgcctttttcattgccgcacatacttcctcgtaggtcgtatctttaccgaggcggcatgtaaggtcaactacagagccatcgagtgtaggaacgcgcatggacatacctgtcagcttaccgttcaattccggaataaccttacccaccgcttttgcagcgcctgtagaagaaggaatgatattgccggcagcagcacgtccgcctctccagtctttcttggaaggaccgtcaactgtcttctgcgtagctgtcgtcgcatggactgtcgtcataagaccttcaacaaggccgaagttatcgttgataaccttcgccagaggagccaggcagttcgtcgtgcaggacgcgttggatacgatcgtcatggacggatcatatgtcttgttgttaacgcccattacgaacatcggagcatctgcggaaggcgcggagataacaacctgttttgcgccggcatcaagatgcgcctgcgctttttctttggttgtgaatacgcctgtagattccacaacgtaatcagcgccgatctgtccccacgggatctcgaccggattcattttgtcaaacactttaatttcgttgccatttactacgattgcatcagccttgtgggaaacctcaccgtcgaatctgccgtgaaccgtatcatatttgagcatatactccatatactcaggatcgatgaacggatcgttgatcccaacaacctggatgttcgagttctttgttgcagcacggaaaacgagtcttccgattctgccaaacccattaataccaactttaatagccataatagaaagatcctcctaaaaaatatttaatatttgatatacattaaacttttgcgtacatcttatattatattggattctaccgcgttttgcaactgatttcgatcactttttcacagacaaaagacaactagtcctgcaacgatcaataagtttccgataatcttctttttggtcaacttctctttgagaatcacgcagcttaaaattgcgaccagtacaaaccctgccgactcgattgcaggtccgtatttgtaatccataccagtatatgcccataccgcaaagagcatcgataccagcagcatcacgtacccaaggatgacccgccagttgagatactgcttccaaaaaccctcgtgccgaacattggcacttgttttcagcagtatctgtgaaaatgcggcaatcgtcacgccgcataacatgataataaaactactaacgctcagcatctgtattcaccagcatcgcgcccgcaataatcagtgctgtaccaatgatattaggcacggtgatcctttcctgaaaaataagcgccgcccacaccattgaccagatcgtcgccagtgaccggtttgcgtacgcaacatgcaaatcaaatttcttgagcgcctgctgccaaagcagggcataaacacccagaaccaccacgtccagcacgatgtaaataataaacatcgtggacataaattcgtttccattgcttgccattttgccgaaaacaccggaaaatgtataaacgataataataagctgcaggaaaatgatactgcgccaatcgccttttttagaagtctgttccactgaaaactcccccttacgtacattctatgctactttctttgcgaaaagatgtcaatagcacttttatattatactttgtaacgatttccctgtttcagcagttgttattttgcccatcaaatagtataataattttgtcttagcatgtatcatattttaaggaggatttaaaataatgccattagttactacgacggaaatgtttaagaaagcttatgacggcggttatgccatcggcgctttcaacgtaaacaacatggagatcatccaaggtatcacagaagctgcgaaggaattgaacgcgcctcttattctgcaggtctccaagggtgcgcgcaattacgcaaacccaatctatttgactaaactggtcgaagctgctcttgaggatacaggccttccgatctgtctccatcttgaccatggcgacagcttcgaaacgtgcaaatcctgtatcgacagtggttttacctccgtcatgatcgatggatcacatctccctttcgaagagaatattgctgtcactaagcgcgtggcagagtatgcgcacgaccgcggcgttgttgtggaaggcgaactcggacgcctcgcaggcgtggaggatgaagtaaaggtatcccacgaggattcttcatatacaagaccggaagaggtttatgaattttcaaccaagacgggcgtagatagccttgcgatcgccattggcacaagccatggcgcattcaaattcaagggtgaaccaaagctgcgttttgatattctggaagaagtaacgaaaatccttccgggtttcccgatcgttctgcacggcgcatcttccgttattccggaattcgttgacatgatcaacaaatacggcggagatatgcccggcgcacaaggtgttccggaaaatcttttgagaaaagctgcggaaagcgctgtttgcaagatcaatatcgactccgacctgcgtcttgccatgacgggtacgatccgcaaacattttgcggagcatcccgcggatttcgatccgcgccagtacttaaagcctgcgcgtgaagcgatcaaacagatggttgcgcataagatcgtggacgttctcggctgcgacaacaaagcatgaatttaaagtaaacagaaaagctctttgcatttcgcaaagagctttttttctgcccgaatcaatatccgtttggatttttgctctgccagttccaactgtcacggcacatgtcctcaatattatgcaccgctttccaaccaagctctttctctgctttttgtgcatttgcatagtacttagcagcgtcccctgcgcgccggggggcaatcgaataatttattgttaaatcgtttgcgcgctcaaatgcatggacgacctcaagaacgctttgcgggcagcccgtcccaagattatatacaaacaacccttgctgcgcaaacttttgaatcgctttaatatgcccgtctgcaagatccataacatggatataatcgcgaatacacgtcccgtccggcgtatcataatcatccccgaacacattgagtttttcacgctttccgaccgcgacctgcgtgatatacggcatcaggttattgggtacgccgttgggattctccccgatcaatccgctttcatgtgcgccgatcggattgaaataccgcagcatggcgatcgaccacgtattatccgaatgataaacatctgtaagcatctgttcaataacagattttgtacgtccataagggctcgtagaatttcccaatggtgaatcttccaccaaacattccgatttcgttaaatcataaaccgtagccgaggagctgaatatcatgcgtttcacatcgtgatccttcatcgcttctaaaaggacgatcgtcccgttgatgttattatcaaaataagaaagcggctgtgcaaccgattcgcccaccgcttttaagcccgccatatggatcacgccgtaaatatcgttctgcgcaaaaatttcgtcacatgcgcttctttcacggatgtccgcttcgtagaacttaaccttttttccagtgatttcttctacgcgcttgagtgctttcttactgctgttgcaaaggttatccatcacaataacgccatatccctggcttagcagctccacgcaaatatggcttccaatatatcccgcgccgcctgtaaccaatatattcttcatacatttctcctactaaaaaggcgcatacattcctgcacacgcctttttgtcctatttcaaattctccggattcaatcctttgagttcgtccaaaacaaacataccgtccttgcgaatgagaacatcgtcaaaccatatctcgccgccgcccatttcgcttgtttgcaccaataccaaatcccaatgcaccgcgctttcattgccattatacgcatcatcatagctgctgcccggcgtaaaatgcatggaaccggcaattttttcatcaaataggatatctcccatagactggttgatatacggatttaagccaaacgaaaactcgccgacataacgcgcgccttcgtccgtatcaaatatcttattgatgcgctcgttatcattgctcgccgcttcgatgatcttcccatccttaaagagcaggcttacattttcaaacttaaacccttgatggaaggaaggtgtattgtatgtgatcctgccgttgacgctgtttttcacaggcgcggtatatacctcgccatccggtacattcatgtgtccgtcgcattttatagaaccgattcccttaatcgaaaaagtaatatccgtatccggtcctttgatatgcaccttatccgttttattcataagcgccgcgagaggatccatcgcttttgacatcttgctgtaatccaaattacaaacgtcgaaataaaatttttcgaacgcttccgtactcatgcccgcctgctgcgccatggaaggcgtcggatagcgcaaaatcacccagttggtatttttcacacgcagctcatgatgcacctgtttggagtaaattgaattatacagttccattttatccgccggtacgtcggaaagttccgtcgcgttgtctccgccgcgaaaagcaatatatgcctgcatctccttcatacgcgcgctgccccattttgtgatatcctccacctgctcttttgtcgcctgcatgagccattggcgctgcacccggttatgcggcgtatcaaaatatggcagcccgcctgccgcatatacctctttgatcaattgctccgtgagcgcatcgtcgcatcccgaaacatcgatcaatactttatcgcccgcttttacgccgcaggaatagttcaccagcgtatgacacagttgtttgattctttcatctaccatttttgttcacctcgtttatgttaatgtcgtaacttcaatatcttaaaagcgctccctgatagttctacgcttacacgtttctgcgcaaactgactgaatcacatccggcagtcgctctagccaatatctcttataatattactataccacaaaccaggccttcaaaccattctactgtttttgaagtatgttttttgtattaccgtccttccttatttcttacttctacaaatctgctcaagggcatccttaaaggggggatacactatgccatattctgtaataatagctgtaatattactcgcatcggttacgtcaaaagacggattaaacacttttacgccttccggtgccatgcgcttttcataccacatttccgtcacttcttcgtcatttcgcagttcaatatatatgtcgtttccatctgcgcatgttatatcaatcgtagaggttggtgcgcatacgtagaatggaatcccaaagtgttttgccgcaatagcaacgaatgacgttccaattttatttgcagtatctccattagctgccacacgatcgcatcctacaaaaaccgcatcgatccatccctttttcatagcggctgcagccatattatcgcaaatcagcgtcgtatcaattcctgaattgtgcaattcaaatgcggtgagccttgctccttgtaacagtgggcgcgtttcatcacaaaacactttgaatccgtaaccttcctcttgtcccaaatagattgccgaggttgccgtaccatattttgatgtagcaagttgtcccgcattacaatgtgttagcaatcccataccctgcttcaatacagagagcccatattcaccaattgttttacaaacccaggcatcttcagcttttatcatttcagcctctagaagcaatcgtttttttatttccgcaatactttcaccgctatgtgcttttacaacatcatccattcggtttaaggcccaagacaagttcacggcagtaggccgtgccgaattgaggtatgcctttgccgcactgaactgcgcataaaaatcatcatatttgtatgcgttgatagctttcgccgcaaggtagaggccaaaccctgccgcgataccaatcgcgggagcgccccgcacctgcaaaaagttaatcgcattccaaatgctctcctgatctgtcagatgcagcaacctcacatcattcggaagttgtgtctgatcaataatgacaagagcgctattttgatcgtccagcgcaacagtctcgatatccataatatttctctccatccatgaaacccgctttcattttattgcagtaacgttcaccggtatagggctgctatgtcctttacacagtccacatactgctttccttgcgtgtaggcggccctgtttttaataaattcctttgccgcgagcacacagattcgttctgcacgcatacgctttttctcatctggtattgttgtcaaatctttgacctgtgccatgccaacgaccctacgattgatctctaagcccgtataaccggccgtatccgccagaatgcttttcaaaaagaattccctgtatccctgtgtttttgccattggttctgtcacccgtttgtcaaatatcgctgtatatttctttttgaataaatcgaccacttggctaattacctcttccacccagcccagataagtctctttttccgttccatcctccatagttgcgtcaccattggcccatgcaaaaatcatatttgcaacaacattgccaatgtcatagcccatcggtccataaaacgcgaactccggatccatcacttttgttgcaccctgcttgataaaaatagaccccgtatgcaaatccccatgaagcagcgactgtgcgttgttcataaaatcatactttaatttagccacttcaaggcgcaggctttggtcatcatacagttcttttttgacaaattccacatttggcgcgaacacaagattgcgcttattcgcatcggtatatggttctgtaaacaccaaagcttcagaaatatccgcgcagagttgagggttaacgtattccttcgccaacgcctttttctcttttgaatccatcaccctgtccgtcgtcagaaataaagtgtttacaagaaaatctgtaatatcttctgcgaatcgcgggaatatctcatgccgcatcagcgcataacgcattacggtataatcgtgcaagtcttccatcgcaaagcacttcatgatgggatcgtagagataaatatccccaataagcttgggacaaagtttcttttccagcttcagcattcccacctcgatccgattcctgtctgtcgaaatatcaaaatctttcgcaatacgaagctcgattcctgcttgctttataataacagatttccccgattctacgcttttcacacggaacacataattcaaatttccgtcgccaatctcattcgctacaagcgtttcaccattacaaaacatgcatagcttcttttccgcatactcgacaacacttgtcttatccattaaaaaatattgatcaaaatcaaacattgcgccacctccctgacagcctgaattttgttttgtttaatccggagctcccacatccacagccatagaacccgcatccgccggtaaagtcgcgcccgttatagctgtggacatatcggaaatcagatagcagattgcgtccgcaacctcatacgtttccgacatgcgtttcagcggataatatcttgttgaaaattgaaacgcctcttctttggacgtattcctgctttttcccaatgcagccatttccatctccgccatgggcgtacgtgtccaccccggcgccacgctgtttgcccgaatattatatttgccgtaatccacacagatcgctttcatcagtccctgttccgcatgcttgctcattacatatgccgcctgcctggaacagcctcgtattccagctaccgaagtagtaaacacgacactgccgcttctttttttaaccatatgcggcagcaccatcctgcacaaccgcgcagcccccatcacgttcacagcaaaaactttttcgatttgttcgtctttgaccgccacaacatcccccagttctgtaatacctgcattgcaaataagcccatcgggcggtcccagtttttccacaatatcgtcaatgctacttttacacattccttcgtccgtcacatcacattggtaatacagaaaattgccggcctcccgttcgctgcgcgcactcctgctcaatactgcgatcttcgcccccaaagtacgcaaccgctttgatattgcctcccctatcccgctgttgccgccggacaggatgactattttaccagaaagcaattccatcggttttcctccaaaattaaagtaacgtatttgggtccatataaagattttccataccaaatgcctccgccaccgcacggtaagtaatccgtcctttgtatatgttcagccccgttttgatagtatctgagcttttggccgccacaagcgggccttctgatgcgatttgcagtccgtgtcttaacgtagagttgtttagcgccgttgtggacgtcatagcatatgcgcctggcatatttgcaacacaataatgaataattccgtccacttcaaataccggatccgtatgggtcgttgctttactcgtttcaaaacatcccccttgatcaattgctacatcgaccaccactgcgctttttttcatggtcttcagatgcgctcttgtaagcagcttaggcgcttttgcacctgggatcagcaccgcgccaactaccatatcagccgtcctgacagcattcgcaatcgtctcgctggaactgtactgcataaatacgtttgcgggcattgtagactgtaggtccgtcagggtattcaggttgacgtccagtatcgtcacttttgcccctatgccagccgctacgcgcgccgcacagcggccaaccacgccaccgcctaaaacaaccacatctgcaggctgcacccccgacacgccggttggcagaatcccccgcccgcctttggctttcatcaggaaataactgcccattaacggtgccatagatccggctacctcgctcataggcttcagcaacggcaatccgccttgcttatcctccattgtttcataagccacagcaataattttcttatccaaacaagcctgtgtgagtttttgatccgccgcaaaatggaaataagtatacacgatctgcccttcacgcattctgttatattcttcaggaagcggctcctttactttgacaatcatatcgacgctctgccatactgcgtctgcattcggtaaaattttcgctcccgccgcctcatattcacaatccccgaaagaagatccttcccccgcatttctttcgatataaacttcatttccgtttactacatattcctttgccgccgcgggagtcagcccaacgcggaactcattatcttttatttcctttacacaaccaattttcattttaacacctcattctccaaaattatcttgaaatatgcctttctctgtaaaaaaatattaacctgttccactccacaaccgtagagcttagtgttcgttctcttgaataaatccctcataaaagccttcgatcataatgtatgccgccgcagcgccgggatcgaccagacccaagcttttttcgcgaaacaccgccgcttttccatgctggttcataagctctttcgtgtgctccatcccatctcttgcagcatgatacgccaactccatgcattccacgatatcttggtcgccgtaagttgcaaccgctcgcgaaacaggatacaatacgtcaagtaaggttttatctccttcttgtgccttgccgcgcgccgccactgcgcccgccatgctcaaaaatatcttttgaatttgcggtactccgatccgcttcgcgtctcccaactcttctccagccgccataaatgcggttgccattaacgtacccatcgtagacggtgccgccatcgccattgcaatgcccgcttttttcaagatattccctattgtctcttcgctgttttgctccgcacttttttttgccgcgcgaaatgctttgctcatcgtaagtcccaaatccccatcgcccaatttactgtcgatttcgatcagatactttttgttttccttcatcagttcgctaatcatgcctatgctgtttacaaccttttctttttcaatcgactgcatcgctctacctcttttatccctcatacggaaattgtgcaaaaaacggtgtgtttgcctgataagccagcaactcctttaactcgtcgtccaccctgcacattgatatggaaaagcccatcatttccattgacgtagcaaattcccctacgtaagaagcatataacttaatgccattttccttcaatatccggctggtcctgcgcattgcaatataaagctcttcttttgcggttgctcccaagccgtttatcaggactgctacttcgtcgcccggctgcaaccccagatcggctttcagcggcacaaacatttcatctaccgtttgattcgtcggtttcagtttaccacgtttaatacccggctcgccgtggatccccatgccgatttccatctcatcgtccccgatttcaaacatgggcttgcctacttccggaaccacgcatggagaaatcgcaacccctatcgtagcaacattgtccgctgtcttttgtgcaacccgcagcacctcatccagatcagcgcctttgtccgccatggcgcccgccgctttatacaggaagaaaatccccgcaacgccgcgccgttttcctccttcttcttttggcgccgacgcaacgtcgtccgcacccaaaattgtttttactgtgataccttccactgcagccatttcagcggccatatcaaagttcataatatcgccggtgtagtttccatatatataaagcacccccttgcctttatcaatggcttttgttacctcaaacatttgctgtgcgccgggcgattgaaaaacacctcccaccgcgcagccatccagcataccgtcccccacatatccaaggaataacggcagatgcccggatcctccgcctgtggcaagcgccaccttcttttttgaccggtctttttttataatacaccgtaaatcgtttgcggcgatgtcaagccgatcaggatgcgctgccagaatcccttccagcatttcatcaaccacatcctcggggttgttaataaattttttcatagcataccaactttctcctgtttgatagaccgcctgttgccggaatagcggattccggcaacaatgcagtttatccctccttctttcttgcctgcgctttgaaggaccgctcagtcaataccgaatttcttctctgcttcgcctataatcgcatcgaatttctctaaagtacgatccataatttcctctgaaatattcagtgcgggtatcagttgtatcctgttatgataatatccgcctttttcataaactataccctcgcggataccgatatcccgcatataggttgtcgcttctacggcgggttctttcgtttttctatcctttacgaactccaatccgatgtaaagccccttactatcaatatatcccaggctggggtgtttttcttgcagcttttcaaatcctttacgaagatactcgcccttttggtttactgcctccaaaaattccggcttggtcacttgatccagaaaataattacctgccgcacatgcaagtacattacccgcttgcgtggagacgtgcgttgccggaccccattccatcacaatctcttccttcgcaatgactgccgaaatcggaattcccccgcccaacgactttgaagtaacgatcatatccggctcaatttcagaatgctcgaatgcccaaagcttgcccgagcgtcccagtcccgcctgtatttcgtcgatgatcagcaacataccaaatttatcgcaaatcctgcgcaattcctgcaaatattcttttggcgggatataatagcctgctgagctctggaatggttccaccaaaattgccgctacgctggaatatccattgaaaccgtctgtatatggcgtttccttgccgtccagcgcacgttcgagcatacgtattgcttccattccaaatccagaatattcgtcggttggcttccggtagtcgtgcggcatgtgaaaatacccaacatgttgatcaggagtcaccggatagaaattgggctgcatattccctttgctggtgagcgccatcgtaccataggttaccccatggtaatcaccgtaggctaccaacacttgcggtctccccgtatagtaacgggccgcacgtaccgccaattctacgctatcagaaccagtaacgccgaatacgacctttgtaggactactgattcgcgagttctggcaaagcttttccgccatcctgattctttccggatgcggcaaatcgaaataatgcaccagcttgccggcctgttcctgaataattttcgttatattttcttcacaattgcccagattgctaactgagaagccggaaagcatatcaatatattcctttccatccacgtcgtacagcaacgatccctttgcacgttctatgaccggtgcgatctcaaacaggccccagcccactccgccaaacgattccgattccacgaccttgcggctgtattcttttcccttagaaccaaacggcgctttctctattcgtttcagcagatcctccgttgttacttttacacgctccctttgcttgaaagcagcatttcttagctctttgtagttactcatttttttgtctcctttggctaaaataaattttgtatgtttatatgataaagatttgtaaaaataagagtgagagttttgggaaacccgtccaccatatagcagacaggtttccgcacatatcttactcactcgccgcctttattactatattctgttctttatgaacgtggcgggttcgtcaatgcatatggttgattctcagttttcaactggtaattggctgcatcttcttctacgctcttatggtcaaaatcatttgtcacttctacaaaatcgttcgtatatatctcttccagtgtcaaatcgtcccttgtgagcgtgccggctgctttgcaggccttcatctgcgcttcccattttgccggattatgccaaccataaccgttttgcgctacatcatcgccattctcaatataaaccagcgcttcgactgctttcatcgcatccgcgaattcaacttgaatggacggaaacctttcaagcgtgatctctgtagccgcagccggattcagatatgtgaagtaagagcccattgcgtacgctttgaggaagcgtccaatgatatcttttttcgcttcaatctgatcggttgcaaagcacaggctggaaccttgcaactgtacgacatcttcgcctgcaagccagtcaagttccatcccctgagcctgccacaggttgaactctttgtaccacgtcaataccgcatccgcctgtccggcttctaccaactgcgccctgttttcacctgcggtcacatattcgacttccgacggatcaacgcccgccgctatcaagattggatcgctaatcgtactccatgccggatcacctaacgtgatcgattttccagccagatccgcaatagatgtaatgccgctgtccggagccacacaatatccgaagatattcacattatcctgctggtaaaccgatatgaaaggaagctccgcttcatgtccggcaatctgcacaaaactggaaggcaatgctacatcggcctgcccagaaaccagcatttttagatcgtcaacacccattgctgtttcaagctgcaaatcaatgccgttctcttcaaaataacccatagcaaaagctacgtgtatctgcgcatcatccagcaattcataggatcttggaaaaacaaaagtcaaggtgtctagaccctctttaccaagttcaccttcggcatctgcaccggaggtatccgtgttttccggcgctgccgtgctttcagccgccatacttgcatcgggcgcttcgtttactgctgatgagacttgaccttcgccacctcccgtacagcctgtaaagagcgtgaaagccattatccaagcgagaaccaaagcaattgttttcattttccttttcatacagtttctccttttttaataagttggtttcgcattatattgggatcattcccgccgatataacctcactgctattttttgcctatttggatatattgtcgaactcacgactccaaatataatgctccatcctacttttatagtcgtataaggcgtatttaaggtatacaaaacacacctgccgaaaccttgatctcaattcatccggtgatttcggcgtagttcatcatccactcaatgtttcagattttccatttcacgattcttttttctataatggaaatcactgtgtaaagcacaatgccgatcactgcacaaaccagtatggttgcgagtaccaaatctgttttcaaagtacccttcgccaccataatcagattgcccaggccgccgcttcccgctacaatctctgtggaaattgccgtcgttgtcgcgaggatcgtacccagcttcagccctgtaaacacatgagatatagcatcagggaataccaccctgaaaaagcgcgtccaccgctttgcccccagagattgcatgagttctaatttgatcgtttctacattattgaatcccgtaaaggcattcatatttacaatagggaatacctgcaatagtactgcaataaccctgacgttcatgccgatccccatggtgagcatcataagtggtaccaatgaaatcagcggcgtacatactaaaataatcataatgggggacaaggtctgattcagaaaattaaactgcgatgtgactgctgccagcataattcctatcggtactccaatcacatagccaatcaatatgacctgcaatgtttgcagcgcttccggccaaatcatctttgtaaaattctcacccaacgattcaaaaatttccacaggcgttggcatgatatacgtcggtattttgagcccaatcacgatcgcctgcacggtgaaaaatattacaaagaaaagtataaccggccccatggcgctaactgttttatctttattccagaactttgtattattcaatgttctctctcctttaaacgattttagccaggtcaagtataccgatcagctcaataatcttttcctcatatttcttgaactggtctgtttcaatcatttccagtgtgcgcggatatggaagatcaatttcgatctcctccaacagcctgcccggatctgtgcccataaccagtacccgttttgacattaatactgcttctgttatattgtgcgtgataaatataactgaggttcccgtccgtttccagatggccagcgtttccaaatccaactgttccctcatgtcttcatccagcgaaccatatggttcgtccataagcaatatttccggattatgtaccatggcgcgcataacgcctgcacgctgcatcatgccgcccgaaagacttgccggatattcgttctggcattcgtacaatccaaatacctcaagcaggctatccacatttttctgatatttctcgtctttgagcttaaatacctgcaatggtaattccatattttttcttaccgtcaaccacggaagcaagttgggactttggaaaatgaatcccatttttttgattacttcaccctttacttctttagcatactctttaccaaacagcttaatactgccgtaggtgataggggtaattccgttgatcatacgaatgatggtggattttccacagccacttggtccaaccagggagacgaaatcattttctcccacaccaaagctgacatcttgtacagccagaaacgcccctgtttttgtatcaaatacttttgttaaattcttaacttccaatacattcacttgtattacctcgttatctcgttttgtattcgcgtatccagtccgttcaccctgttattttttccacactacaatctttttctcgattgcggtcaaggccataaagatactaactccgatcgcagcaatcagtataatgcaggcaaaggacgattctgtgagcatcatacgtgcataatatgtgacgcggttgcccagacctgcatttgaagctacaagttctgctgaaatcgttgtagtgagcgaaaagatcgtccccagccgtagccctgtgaatacataaggaagcgcatttgggaagatcgtcttcgtgaatatctggaattttgttgctcccacagcctgcccgagttgtattttcgcatactctatcttccgaaaccctgtaatcgaattcagtgtgacgatcgggataacctgaaatataactacgatgatccttgctgtaataccaaatcccgtccatgtaagcacgattggcagcaatgccaccatgggtaacgtgaccatagcaatgatgtaaggatatgttactttctcagctacaggaaactgtgaaatcagggatgctacaaggattccgcagggggccccaatgccaagcccaaccaacgccacacgcaatgtttcccacatctgcggccataattcacttgtgaaccgtgtcactaactcatacataacatccgttaatggcggaatgacattactggggattttaaacaggtataccaccccctgccatacgacaaatatcattccaagagcaattaatacgccaaaccgatccagccggaatctattatgtttcaactcaattttctgtgtctgaccgttattattcaccgctcccaacctttctttcgtcaatcggcacttttttgatgctctttatattcagcgccctgactatttcttccgcttcttttttgtattgcatatagcccggatgttttgaaatattctcgtcccgttgatcgtcagcaatgtctaccgtaagcgtttttaatatctttcccggatcttttcccataaaatgaattttcgacgagtacatcagtgcttcatcgacattatttgtcaccaatataatagggatacgcgtttgcttccatatgtccagcaggctcaggctaagcatttttcgcgtaatcgcgtccagcgccccaaagggttgatccaatatcaaaattttgggatcagatatcagggctcgcgcaaatgcaagtctttgcttcatcccacctgaaagttcatgcgggtatgacttgctgaaattttgtaatccaaccagctttagcagacccattgcttttccctttacttctgccgttatttgcactttctggatttccaatgggtacaacacgttcttcagcgatgtcctccacggcagcagattattattctgaaaaacaaatcctatattttttcgaaacataggcggtattccatgtgggaacacctgatccccgtacacgatctttcctgaagtgggcgtttcgattccacacagcatattgagcacagccgattttccacaaccgcttggtcccataattgatatcgcccgatgctgttctacctcaaaattgatctcttcgattttataattttcgaattctttggttagattttcgactttgacagccggtaattcgctcatgtatgccctctctttccaatctggttaaactaatttatttgcaccagtcatagatcatgcttgcatatattttagatgcatctaaaacttgctggcaggtaacaaattcattgtatccatgcgcaccgtcgcttaattcgcccggcccacatataattgagggaattccttcctcccaaagatacgtgccatcacatgtggccgggaatcctgtcactatcgcttcttttcccattgcttccgaatacgcttttttaaacgtcataaccggctcagacatgtcatccgtgacaaatccgtcccaaagctgggaaaccggtccgacaacctctggcggattctctttcagccaatcgtctgtttgtgcaaaatgggctacactttccttgatttccgcaagtatatcttcatatttcaactccggcggataccacaccgcatacgtaatctttatcttgcccggaaccgcgccaatgtaacttccggattcaataaacgaaggattgatagcaaatattccaacgccggccttgtcatgccccggttttccccctgtacctacagcagacttgcgatgccatctatgattccattgtttttccaatctgtaaaaatactgcataaggggaagcgccttttccactgcatccacccccacatccgcgccgcttggctgaaaagacgactggggatgcataacctggttcctgcatgaaatatggatggccttaccattgataatcagctcgaagcaaaccaaactgcatgtcgcgttgtgcagctccaacgcagtcggctcacatacgattgcaaaaggggccgtataaccgcgtttcacgcacgcccgcgctcccaatgttcctccttcgcatgattcttctccacacgacagcatcaatattacgtcgccgtccagctccatgttgctgtctttgattgcttttgcagcgaatactgacgctgctaaccctcccttcatgtcattggcgccgcgtccgtatatctttccgtcgatttcctcgccgccaaacgggtcaacattccacttttcacgttccggaacaagtacagtatctgtatgcgaatttaatataatattattcccttcgcgttgttttttcccaggtaaaaccgccacaacattgaatctatcccctttttcattaccagcaaacagatccaccttaaatccttcttttttaaggtatcccgcaagaaattcctgtatttctttttcttttgggccttttgcatcaattccaccattttcagattttatcctgattaacgacttcaggaaatccattaattctttttcatttcgttcaagatacgaaaacaattggtcttttgacattattcttcctccttgtatatgtttatttcttgctacttgcggcatctggcatcttgtttcatggtgcaaaaatatcaagtgcaagatgtccggctatttatgtatgtttatcatacaatgattcgtgccttaaaatgatttattccttaaaacgttatagtttttgctaattacaggaaatttttcacttcactacattgagatagcctaattacatcgggttatactatggtcttcaaccttacgctttgcatatcaacttttcaaattattctagtatcgagaaaatttattatggattgtatgtttgtattataaacataactttttaatatgtcaatcattttttattaaaaaaatttttttgtttttagcaggcaaattctatcgattccatgttgtatgcctatttttggttatatagaatcctaacaaatctatttcgcatatgtgcagtcccgaatatatagaaaactctttttttaagctgcgaagtatttacaaaagcagctttgtaggataaactttcgtaagaggatacaatttacaaatttgactttacaatacagcaatcttgaataggagctatttttatgaaaaaagcaatcaaacaaaaaacagttgtggaacaactggtacacgaaatccgcgatatgcttatcaacggtatgtacaaagaaaatgacaaattcccaacagagcaagaattatcagaacgatttggcgtaagtcgcacgtctgtgcgcgaagcgctcaaaacaatgacataccttggaattctggaatcccaaacctcgcgtggtacacgggtcagcttcaataaccggatcgtggaagaagcgacgacatgggccgttatgcttagttataataccatgtacgatgtttttgttcttgggtcggcccttgatacccaagttgcaattattgtccacaacaaaatccaacgtgatccttcgtcgcaggccaagttcataaatgatatggattctatcgttagtaatatgaaagaatctgcagaaaaaaatgatctgcagaaattcgagattttattttccgaatatttccgtgttttttatgaggcctccgacaatactgttatcatttctttaaacgactgcatcgatagcctgattactaaaaaatcatgtaaagcatataatgaaaccaatcagttaattgtagctgccgaactgcttgaagcaatatggctttctacaaaaggaggcaatatggaaaaggcaattatcgctgtacaaaactatggaatttttgcggcaaacacattccgcactttcgatcccgacttgttaaatgacgcatttattatgcatccatttgaagattaaccttatatccgtgtagatttgtactctggcgaaaaagagcaccttttcatagatcttgtacctatttaaaataactgctgtagctacatccccggtacagtcgcaagtggatcattcaaattctttaaatatttcttatatacataacggtagaatacgatacacaaaagcagggacacgcattccgcaaccggaaaagcataccatacgttattgacgtcgccaagcagggaaaggccgtacgctaccggcagtatcacgacgagctggcggcacagagatacgatcatgctcagaacgccgtttcccactgcttggaacaccgacgagaacacgatacctactcccgcaaaggcaaagcacaggctgataatacgcagcgcgtttgcgccgatctccagcatagccggcgttgcgttgaacatcgtgagcagcgcatccggaaacacctggaagataaccatgccaatgaccataataataacggcaagtagcgtggcaaaccgtatgacatccgtaatccgttgcttgcgccgcgcgccgtaattatacgcaacgatggggatcagtccgttggtgagtcctaaaaccggcaggaaaataaacgactgcagcttaaaatatgcgcccagcaccgaaaccgccgccgcggagaacccgacgaggataaagttgaatcccacaatcatgacggacgtgatcgcctgcatgataatagacggtacgccgaccttgtaaatttcaccgatgattctcttttgcggcttaaacccgcgcattttgatttttacgtccttgaccttggcattcgtaaaatacaggcacagcagcattgccgcgatttgtcctatcaccgttgcaattgcggcgcccgcagcgcccatttccggaaacggtccaataccaaagatcaggatcggatcgagcacgatattgatgaccgcccccgtgatctgtgtgatcatgttataaatcgtgatccctgtagactgcatgatacgctcgcaggtaatctggataaaaacaccgaaagaaaaaatcgtacaaatcgaaatgtattgcgtacccatttcctcgatttccgcaccgccatccatccccgcagtaaacgcttcaaagaatatacgtgaaaaaaacaagccgaataccgcaaaaacgatccaactcaaaattccaagaaaaatccccgttgaaacgcctgcgttcgcatcctcgagtttcttttcgcccaaacggcgcgataccagcgaattcatacctacgcccgtcccgaccgctacggcaatgatcagcatctgcaccggaaacgccagcgacacagccgcaaacgcgttctcgctgtattgccctacgaatatgctgtctactacattgtaaagcgcctgtaccagcatggaaatcatgattggcaaagacattgtgaccaataattttttgataggcataacgcccattttattttcttttatttcccccataacctaatttttctcctttctgcaaattgacattttagcacattgggggcataatgtaaacaaatagaaagaagttccctaaggcacgatagcatgctgcatgtataaggagggttgctttgtgaagaacgatattattattacgatttccaggcagtttgcgagcggcggacgctccattggtaaacaggttgcggaatccttggatcttccgtattatgacaaagaactgatcacgcttgccgccaaggaaagcggatacgacgaagagttttttgagaacatcgaggaaaaagcgaataacaaatttatgtattatctttcctcgggatttggcaacgtctcttcgtggggtacggatatcgcgcttgacgataagctattcctggttcaggcagatgtgatccgcagcgttgcggcaaagggatcgtgcgtgatcgttggacgctgcgcggattacgtattgaacaacaatccaaattgcgtcaacatctttatttattcggatatcgaccaccgcatcgaccgcgcaaagaatgattatcatttagatgcgcctaacctgaaagatgcaattttaaaatccgataaaaaaagagctacctattacaattattataccgacatgaaatggggccagatggaaaactaccaccttctcctgaacagcgacagtatcggtatcgataactccgttgaactgatcaaacgttatgtgcagctaaggcagcaaaacaggtaaggcagatatcaaaaaggcatatccaactggatatgccttttccttatgcgattttgaccttcatccacgcgtcctcgtataggcgcaggatgtcctttggcaggtattcataatattcgcaatgtttaagatcctcttttggcgggttgaacgcatagttgtctaaaagctcagggtctaccagctcaagcgccgcgtcttcgggcgtggaatatcccgtatattcggcgttcagcgccgcgatatccggccgcatcatgaaatcgagaaaacgcagggatgcgtcgtatgcgtccgtcgtctttaagatgcacataccgtccacaaagatatttgccccttctttgggcacgacatacctcaagtcttcgttatccgccatggaatacgccgcgtcgcccgcgtacatgggcgcaagcgccgcgctgccgttcgtcatcgtcatcctaaggtcgtccgtcccgtacgcgagcacgagcggcttctgggaaacaagcaggtctgccgcttcatcgagtttttctacgtcgcgcgtattgacgctgtaaccgagttttataagcgcaagcccgatgctgtcgcggatgctgtcgtacatcaaaatctggttcttgtatttgggatcgaaaagcgcgtcccaactgtcgatctcttcccccgtcatctcgatgttataaagtatcccgaacgtcccccacgtatacggcagggagtattttccgtccggatcgtatgtgcaggtcttcgcaaagtcctccacatactgataattttccattttggaatggtctatctccgcaagccggtcttcgagcatcaggcgctggatcatatattccgacggcacgacgatatcgatctgcgtcccctcggtggtcgcgatcacatacatttcctcgtttgacggcacagtcgtcatgttgattttgatatccggattttcctcttcaaataatgggatcacgtcagggtcgatataatccccccagttgaggaaattgacgaccgtccgccctcccgcgtccccgccggaggagcagcccgcagccatcacgaccgccatagcgattattaaaatcatgcaaagtatttttttcatctgttccctatcctaatatttaacgaaaactttccacattcggcgttttctttgttttctttaaagaccgcaggttgatgaccagcagcaacgtgatcacgaccacgaacatgatcgccgacagtgcgttgatcatcggattgatgcccacgcgcgccatgctgtaaatgtacgtcgacaggttttgcgtcgtgccctgcgacgtaaagaagctgatcataaaatcatcgaacgacatcgtgaacgccagcaaaaagcccgtcacgatccccggcgtgatctgcggcaaaatcaccttgcgcacagcgtatcctggcttcgctcccatatctagcgccgcttcgtaagtccccgggtccatctgcctcagcttgggcaggacggaaaagatcacgaacggaatatcgaaggtgatatgcgcaagcagcatcgtccagtatccgcgcgggatattgaaaaagatgaagagcagcagcagggatatgcctgttacgatctccgcgtttaccatcgggatatacgttaagttgatcatcacatttttgttctttttgcggaaattgtccattccgatcgctgccagcgtgccgatcagcgtggccgccagcgaagcgatgaccgcaatggataccgtcacccagaccgcttccgcgattgtcggatcgctgaaaagctgctcataccaatgcagcgaaaatcctgtccatttcgccatggatttggactcgttaaaggaaaaaacaatgagcgcgccgatcggcaggtacatgaacagcaatatgaccgccagataaaaccgtttaaaaaatttcgccatcttttcattcggcccctacatcagggtactgccgtccccttccttgtcgtatttacgcataagccacataaatagtatcgtaagaatcatcatgactacggcgagcgcactgccgaagttccattccgaaagcagcaaaaactgcatttctatcaaatccccatacatcataaaatggctgcctcccaaaagccgcgtgatgacaaacgtcgtcatcgccggcatgaataccatcgttacgcctgaaatgatgccgcctttggaaagcggcagggtaacgcgccagaacgtctgccatttgtttgcgcctaaatcctgcgccgcctggatacacgaggtatccatcttctggaagatcgaatagatcggcaggatcataaaaggcaggaaattgtataccagcccaaagatgatcgcgcccgacgtatacaaaaattgtacgggcggaagccccagggccattaacccctgattgatgatgcccgcgttatcaaggagcgcgcgccatgcgtaggtgcgcagtaaaaagttcatccacatgggcaggataaacaggatggacacgatcgcggcggtactttctttcatgcgcgacaggatatatgctaccggataccccagcagcaggcataccgccgtcgccagcagcgccatccatacgctacgccagaacaccgtcatataaagcggagaaaacgcacgctggatattttccgctgtgagcaccatcaccccgcccgaacccgtggtagtgaacgcataaagcaaaatcaggatgagcggcgcaaccgtgaaaatcgcgatccatgcgacatatggcaatgcaaacaccttccgcgagcttaacgtatttgaaagctgcttatggttccttttcattccgcagcctcccacgcatcgtcaatacgcattttgtcatattggctgacctccatgacatggatatcgtccggctccaacgcaaagcccacgcggtcccccacatcgtaaaaatccgtagaatggatcagccattcaaaaccattatctccatgcacgcgtatctcgtaatgtacgcccataaacaacacggaagaaacgctgcccacgatcatatcgtccgtgatcttttttgtgatattgatatcctccggccgtaccacaacctgcaccggttcgttttcattaaagccgcggtccaggcactcgaaatcagtgtttgcgaaatgcacaaaataatcgcgcttcatgatcccgctgatgatattggattccccgataaaatccgcgacaaacgagttgcgcggttcgttgtagatctgctccggcggccccaattgctggatcaccccgtcgttcatgaccgcgatcgcgtcgctcatggtgagcgcctcttcctggtcgtgcgtgacatacacaaaagtgatcccgagggatttttgcatacgctttagctcgagctgcatttcctggcggaatttcaagtcgagcgcgccgagcggttcatccagcagcagcacctccggctcgttgacgagagcgcgcgcgatcgccacgcgctgctgctgtccgcccgaaagttttgcgatgtccctgtccccgtatccggcaagccccacgagctttaacatatcgcccactttttgcttgatcacctgtttatccagctttttgattttcagcccaaacgcgatattatcaaaaacattcaagtgcggaaacagcgcgtatttctggaacaccgtattcacgcggcgcttaaacggcggcaggtctttgatgctctcgccaaacaaatgcacatcgccgcgcgtcggttcttcaaaccccgcaatgatacgcaaaagcgtcgttttgccgcagccggaaggcccgagcagcgtcaaaaactcgttttgtttgatataaaggttgatattcgagaggacttccaccccgtcgaattctttatagacgtttataaaatcaatgatatgctcggacattttcttcccccttataaacaatcacacattgccagcctaaaacatcggcggcgtggatatccatactacttctgcgtcttttttcccactattttcgatccggtgcggtacgctcgtcttaaaatagaagctgccgcctttccggatcttgtgccgcttcatcccgagtacgagcgttaccgtgcccgacagcacatagccgaattcttcgccttcatgcgggttgtctgtttccgtcatagctcctgccttaagatgcagcaggatgggttccattcggtttttctgcgcattgggcaccagccatagaatccttttatcttcttcttctttttcaaacaaatccgccggagaaaacgcaaccttctcctcttcgcgttcattgaagaattcttgcaggtccgttcccaggcattccaggatatctgtcaatgtcgcgatggaaggcgaggtcagatcccgttccaactgcgaaataaatcccttggaaagctccgccctgtctgcaagctcgctttgcgtaagccccagactctgccgccttcttttgattttttcaccgatatccattttcgtttcctttccaagtcataatttataaactttttgtttatcaaagctaaacccataaacgcaaatattattttgccatatacagcggaagctgtcaatatatttttcgctttgcaaagctaatatcttgatgtttttcacttctgcggatgcctactagtttaagaaacgccatacataagtttagcaatactatacaaaatcattcattttatcgttttctgaaaaacacaaaaaatgaaatccgccttatccagcggatttcaaatgttcgacagaaattttattgtattgtttgagagattttacttgcttacgtgctcttttcacatcacttcctttcttaactattgcaaatcccttatgttttcaaatattcttccaggcaaagcccgccctcgtatatttcctgcgccgcctgcttgcctacgtaacggtaatgccacggctcgtagatcactcctgtgaggttctccttatcctgcggataacgaaggataaaaccgtatttccatgcattttgcaaaagccattttccttcgggcgtatcgccgtatccctcgtctgcctcatcgccgcttgcagagaggatatcgatcgcaaggccagtcgcatgttcgcttgcatttccgggcatcgtccttaccggaatatcataaggatcacggccataggacggattcttttttagttgcgcttgccatagccggctttgatacgccactgaacggtatgcgctgctgattttatactgtccgatcccttcgctttgcgccgccagaaacatttgccgtgcagcttgccccgccgtccggttgattgagccttctccatcctctaatacaacctcgtctccaaaaacctcgtttaacgtgaccaggttattagggcgttcgcttgtcaccggatggtcccagtttacaaggacgaggtaaggatcgttcgcgttttgacgcacgctcatggcagcagcctgcgtatccgcatcgccctcatcggaaactgccagggaaggatcagcttcgaacgcctgcagcgcctgctgtgcttcgccggtcatgatgtgtgtatggtccggcgcgtccaccgctttccctatgtcaagcggaaatgcatgcagcaaaaaaaacagtcccatgccgatgagcgctgccacaaccaggaataccccaaaccgttttgtcgcccgtctgtgatgttttttgcttgtggtttcataatatcgataaggttgcaccaagcgcatctttcacgccccctttctgcaaaaaaagaccctgtattcttccttctgtcttcaagaatacagggccaaagcatatttttcacatcagtgttgtatcatttttgtaacttttataaaagatcagccggcttgagcaccattttatacgcctggtatgccggatggctctgcgcttccgtcatgacctcatagtccttgttcgtcatcgtataaaggtcattgataaaatccgtctcttctaccgtctgctgcgctttgtcgatcgcaagttcatgatatgccgcgaacgcgtccgccgtcttccgcagcccttgcgtatcccagtatttatgaatgtccacgccattttggaccgtttcattttcaatctcgatattcatataatatactttcccaatatcgtcgtcgatgatcagcccgtaccgctcgcccgttttgggattggatatcaacccctgccaaaaataaaactccgagttcgataccgtaggatcggacgcccgcacaaatgcgatactcgccaccgcgctgtagtccccctgtgttcccaggtcgaaatgcgggatcgctcccgcactttgcaaaagccgcgcctcgcgcacaagcgccatttccgcctgcgcctgtgtcataacggtatttttgtccgcatccttcccgtccatgacgtcaaactgcactgccgcaacatattcatccggaaaatatgactccgccgccggactgtccgcacgttctgcattgccgcccatctccatctctttgcgcatccatgtccccccgaaatctccccactgcgcgataatctcataaagcaccttcgtcttttgatatttcgtcgccttgtactgataggattccgatgcctgcgtatcctttttaacaacccctaaaaacgcgctgtcattctttttcgtgaaatacggcgggagcacggcgcacataatgaccacgcagagagcgaccacggcgaccaggacatatttcaggatttgctttaccttgctcatatccgcttcggcctccttgcccgtcgcacgcgtacacaaacgatcgttcccgtacccacgatgctcttaaattccagccgcgttccatgcagggatgcgattttatccgagagtgccagtcccagtcccgcgccgttttgcgcccgtgcgcggctcttatccaccatataaaacgcttccgtgatcttgcgtatttcgtcctgcggtatcccccgtccgtgatccttgacacaaaaaatataatcgcgcccatcgatcttcccgtaaagctcaatcgtgctgccgggttcggaggctttttttgcattgtctatcaggttaacaagcagcgtcttgaaaagatcgggctccagcatgacgatcgcgttttgcgccgcgaccttaagctgcatgcccgctttttccatgaccggctgcatgaggccgtcaagctcctcgatcaggatacgcggattgacgcgcctctgttcaaagtcattgcggttcagaaccatcagctcgagcaatttcaacgacaacgcttccaggcgctttccttctgtaaaaatataactcgacgccatgaacatctcttccggcgtcatattccgcgaacgcagcatatccgcatagccaatgatagacgtaagcggcgttttcagttcgtgcgcaaagctcgccacaaaatcctctttttgccgcgcggcattctccaagtcgtatattttatcttccaccgcatccgtcatgagattgaaatcgcgtgtaaaatccccaatctcgtcgttactcgttatcttcatgcgctctgcgtagttcccctgtgcaatacgccgcgtcgtagcggaaagccttcttagcggccgcgtcaaaaacacggaaacaatccacatcactcctgccgccgccaggagcaggaccacgctgatttccatgtaggtcctgaattgctgtgtgcgttgtgtgaaaatatctgagatgttccgcgatgtttccaggtataccttgcgcgagccggcgtccgactgcgctcctaccgtaatccagtattcgcctttgtattcttctataatataggcgcgggcttcatccgtccccttcaaaagctcttcattcgccgtttcgcccgttgtgcttgtgaagatcgtctggtaattttcatcggataagacaatatcccgcctgccgccgttttgcaattgcgacgcaatgatcgtaatggcttcgtctgtcagcttggtcccttcgtaagggatcgccgcgctctcatatgcgagcttcatcaactggttctcttcgagggcgcggtccgtttcacgctggagcgcagaatcaaacgaagacgtaatcaaaacatagccgccgattgcaaatacgacggctattaccatgatcgtcgataaaaataccttccaggcaaatttcatattatacttccagcctgtaccccactttatagactgcgacaatcagcttttcccatccaagctttttacgcaggcgctgtacgtgcaaatctacggtgcgggtatctcccaaatattcgctctgccaaacacgttcaaagatcgtctccctgaaaagcgcaatgttcttgtttcggataaacagcagcaatagttcatattctttcatggtgaggtctatctgccgtccgttttttttcacgctgcgtgactgcgtattgatttccacatcggcgaccgatatcttgctctcacccttgttgtaacgccgcagcaccgcttctacccgtgctaaaagctccacgatctcaaacggtttcacaatgtagtcgtccgccccaaggtgcagtcccttgaccctgtccgcaacgtcgttttttgccgtaataaaaataacgggaacattcagcggacggatgtattccatcagctcgtacccgtttacatgtggaagcatgatgtcaagaaggatcaggtcgtatgtgttttcttcaatcaggtcggctgcctgcattccatcgtttgcgacatcacaacaatatccgttttccttaaggttcatggaaatcagattcgaaatcggaagctcgtcttccaccaccaatatatgtatcatctatatcccccgccttgccccattactcttaagctttatcatataccgctattgtatcatatttgcatcaaccccgcctgcattgcttttgttaaaatatccgccacgcatgagaaaaggagacgttatccgtctcctttcaaatcatcatctattattttttgcagcttatccctggcttcctcgatacgttttttgagctgcagccttgtgagcggcgccttgttttccgtatcgatgtcgtttgtcatgcgcagatgtatccatccgagcccgcgccagaccgcacgaatttcatccttgagccgcacgaaatctttttccgaaaggtattcgcccttttcatatgtaacgacattcgtccatttatctttttccatggccttttacaatttaccgccgcactggctgcaataattatcgcctacgctacatttatttccacactttttacattctttagtggactgggcacaattgatcgctacctctatctgctgcagttcgccgtacagatccttgatttttttgccggtttcagccatatctccacgcagacgtccttttgcatacgccatctcgcccaactgcctatatgcctcgtccatttccttctgtttctgggatttttgcgtattgagtttggcagtctccataatttccttagatttgcttgctacggtgtttccaaacgccataataccttctttggctttatccgcagccgtttttgcagccgtttttgccacctgcccagcgtcctttgccttgcttgcagctttttcgcctgcttcctttgtcgcttttatggctttttcaccggcaaccttcgttgccgctgcagctttcccgcctgcttctttcgccttttttgaaacatccttcattgtcttttccacttttgcattttttgttgccattttattttcctctcttttcccaattatttggccactgacatcgccaaatgcgcggcctctgccgcttcagtcatcgcttgcgccgactgtcttaagtattctgccgattgctctgcgaattcctgtactgctttcccttcctgttcgtttcccaacgccgcgtatttgcttaaattgtccatagccgcctgcgccgattgtctcgcctggtccgccaccgcaagagcttcttccacagcatcctgcgtagccttgatgtaaaattccttgctcttcaggcgagccttctcaagaaagtttgcttccccctcaatgtgtttgtccataccgattgcccccgtgctttatgaattttaattataataaatatacacggatcgcctgcatttaaacaactaatctatgccttcccactatttattataccataaacaaaacctttcaaacgccaatgctttccctgtagcgcggcgatataacaaaaaaggcatggtcaattattgaccatgccttttgattgcggctggaactatttcatttctacttctgcgccggcttctttcagggatgcaacaagcttctctgcttcgtcttttgcaagcgcttctttgatcgtggaaggagctccgtctaccatgtccttcgcttctttgaggccaaggcccgtagcttctcttactactttgataactttgatcttttctgcaccggcagccttaagcactacgtcgaattctgtcttctcttccgcagcggcagcgccgtcgccggcagccggagcagcagcaaccgctaccggagcagcagcgcttacgccaaatttctcttcaagttcttttacgagttctgcgagctctaaaacgctcatcttctcaatcgcttcaataatctgtgctttatccataataatttaaacctccaaaattgtttccttttatatttttctattttttgttaagcttctttttgctgtgcgatcgcgttaagcgcacatacaagacctctcgggatcgctgcgagcacgcccacgaagtttgtaaccggagcattcatgctgcccagcattttcgccagcaactcttccttcgacgggagcttggacaggtttgtgatccctgccgcatccattaccttaccgtccaggataccgcctttgatctccgttttgtttgcatcttttacaaacttgcagaggatcttcgccggagcgaccggatcttcgtaaccgaacgcaaccgcgctcgggcctttgaagtattcgtccatgccttcaatcttgagctcgtccgccgcacgcttgagcatattgtttttgatgaccttatactctacgcctgcctgccggaactgactgcgcaggttcgttacctcttccaccgtaagcccgcggtaatcgaggacgatcacgcactgcgcacgtttcatcttatcgactacgtccgcaaccgccgcctgctttgactgtaatttcgcttctttcaaatcatttcacctcattcatgcgccggattcaaataaaaaatgcccttaccaaagccatgaagaccttataagagcacaaccaagcattcttagaaaatcaacctcgtcaggatctttcgaattaagctcacgctcctgagtctatggcttttacattattcatttttacgcaagtaagataatatcacacaaacgccgcgctgtcaaggttttcagttgagttcgtcgagcgtcaaggcatatcccggcaggaaatgttccataaaataggaaacctccggcatatgcatgtcctctaccgcttctttggtccgcgcgcaggccttttcaaactccgtgttgccgctctttagttcttccatgcatttgatatacgcgctgagcctgtccgccgccttcaccaaggtacggacctccccgcttacctcctgtagcacatacggcccgatgctcttttgcatctcttccggaagcatggagacaaggcgttcctctgcgtgccgctcgatctttttatacgactgtgtgatatcctcgtcaaaatatttgatgggcgtcggaaggtcgcccgtgatcacttcacctgcttcgtggtaaagcgcggcgcaaagcacgtccttctcgctgacattcccgccgaaatatgtatttttgatcacgcacagcgcatgggctaaaagcgtcaccgtaaaggtgtgctccgcaacgtcctcttccatattattgcgcataagcccccagcgcttgatatgcttgaggcgcgacatatatgcgtaaaagctctttttcatcacaacttccgccttcgttttcgatttgctccatcatagcataaacccatcgaaaaagccaccgtattgcggtggcttccttcttacaataacacgatcccaaggatcaaaagtcctgtcgtgatgacagggaacagcctgtctatcggttttaagaccatcggcttataacaggtgcgccgcgccctgtcgtcaaagccctgggattccatcgccgccgcaagcgcctctgaccaccgcaccgccttaaccatcagcggcgtcaaaagcgttggcgagatcgcgaccggataaagcccccttgcatggaatgcggcctttgttttcttgtattcatggctgatgttcggcaggagctggaacgacgccaaaaggccgtatacaaatttcacgggcatatggagctgctgctccatcgagcgcacgagcttcatggtatccgtggtgaacacaaaaagcatacccaaactgccaaacgcaagcaccctgcttgcaagctgcagaccattgccgatcgccccgccggaaataagcgaagccgtcgccgcgcctacccccacgttggacccgtcgtggaacttatagcccgtcatatacatcccgaccgagaggatcaatacggggatcagtaccttgagcacatttttccagttggcatggctgagcgccagcgcaagcatacaggctgccaccaccgcaaaattcaaaaccgtattatatacgaacgcgatgatcacgatcgggatcagcacaccgatcagtttatacgcaggattgatacgcttcattgcatttcctcccgcatcagtttcccatcccgcaacacatacgtttcatcggcataatcatgcgcgagctgcctgtcatgcgtggaaaaaataagcgtcaggcccttttctatcctccggtttaaaagctccatcaccgcgcggatggcgcttaagtcctgcgcgtacgtcggctcgtcgcacaccagtatctcgcagtcgtaagcaagaagcgccgcgaccgcgagcctgcgctgctgtccctggctcaacataaacggcgataaataacggtatttccaaaggccgatttccttcagcaccgcctttacgctctcttccattttgtcctcgggcacggttttcttcaggctgacagcaatttcgtcaaatacgctgctcgtgacaaactgatcctgcggattttggaaaacaaagcccagtttatgcctgagggcctttttccggatctttttcaattcctgcccatgaagcaatatgctgcccgtatacgggacgatgccgcacagcgcagaaaaaaacgtacttttcccgctgcccgaaagtccggtgatggcgtaagcctttcctttggaaaacgtggcgtccagcccgtccagcactgtttttccgccgtatccggccgtgagtccccgtatgcaaagcgcctcgccggtcgccgccgcgctgcgccgctcctgtttacagtagctttgccccgggtatacgatcccgagctgctcaaacgtttccttatgttccttgagattgccgcgcgtaatgccgcgtgtaagcatctcgccgcccgtccccagcaggatgatctcatctaagaccggcagccagtgcgcgacctggtgatctaccgctacaatgccgatcctgagttccttatgcagcctgcccagcttttgtaccagctctgccgtggagacggggtcgatgttcgcgaacggttcatcgagcagcagccatttcggacgcagcaacgtgacgcacgccagcatcaccttttgcttttccccgcccgaaagggtatacagcgctttttccttcaaatgcgaaattccgcaaaacgcaagcgcttcatccatctgccttggcatgtccgccggatcctctcctttgttttcgagacagaataccatctcgttttccacggtatccatacaaaattgcagatccggattctggaacatcatgcctatgaggggcatgcgctcagaagggctcaggtttcctacctcctgcccgtctattaaaacgcgccccgtgtccacaattcctgcgttctgcggatacacgcccgccatcagatataacagcgtgcttttcccgcagcccgaagaaccgctcagcacactgacgcgtccctgctcaatcgaaagggacgcgtgtttgatgatctcatgtttacttgtttccgaataccggaaggtaagatcatttagctcgataccgcttttatccatggaattcgttcgtaaaacgctcctcgcttgccgcataatccgtcttgatcattccctgttccttcataaacgcgctgaaattcgtccagcgcttaggacggattgtgccccagtgcccctgtccatccagatatagtttggaaacatattcctggctttcgcggagcaatccaaggtcaaaatgcggcgtatagccgtgcaggatctccgccgcagatatcggatcgtttgccgcgtcgataaagccctggtcgcttgccttgacaaacgcgcgtaccgcctccggatcgctctttatcaccgcgtttttcgcagcgaccgcaggcgcgcagaaatccatcacgtcgtaaaaatccgccaacgcaaaatagtcgcagtctgctcctgcgtgcttcatcacgaaccattcccagttcttatagatccacaccgcatcgccgtctgtccccagcgtttctgcaatatccccaacatccttggtcaccagctttaccttggaataatcgccgccgtcctcattcaccgcatagccgatcacggcatggaaccacgcgggcgtccagtgcgtgaggcgctttccttccagctcgcgcgggcgcgtcgctccgcatgatttcaaggagatgatccccgaatcgtttctttgcgtcagcaccgcaatcgccgtcgcctgatcctcttccttcgcttcgtccatatagacgagcatcgccggctcgggcgcgaccacgatatccggctgccccgtgaactggtgtccgcagccgccaaactcgccgttgatatgtacgtctatcccaaggtccttatagtacccttttttcagggcgacataaaaacccgtatggttcgtgtttgcaaaccagtccagttctacatgcaatactttcatttcgtttcctttcttttttctcatacagacgttgtcaatttcttctgtttgccttctacattccgggcagtaggctgttcccgccgcctcactcgtcgtccgcgatatcctgatgcacatacttcgcgccgatcgcgtagcctttgagcacgcctgtgcgcgccagtcccttaccgagcagccagctcaatacgcccgcgaacagcagcgacgtgccgaggcgcactgcaaacatcgcgatcagcatggaagtctcgatcgccgcatatccattggtaaaataagtccacacaaagctcagtacgcatgcaaacgttgccgaaacgcacatactcgccagattatatttcttgtagccgaacacggcaaatccaagctctaagcccacgccctgcaccagtcccgtcgtgatgaccagcgggaagttgcccatcagcagctccaaaaacgcggccagcacctccgttaccagcgccacgcccggcttttgcaggatgaacgcagccagcgtcgccgccatgaaccacacgccgtacacgatctcaaaattgaacggcgcaagaccaaacggcgttaatgccacgccgatcgcctggcttaaataaaacgcgcccaggtagattgccgcgaagatcagtcctaagataccgatcatgatgatgtccttaagttgccagccttttttcacttttgttttttccatttctcttctctccatctttagcgttgcgcgcataccgttttcatacccgtacgcacgctttactccggatgcaccagcaacaaaaaagtcctttccaaatgcaaccggaaagaactcactcaaaaaaacatgctccctccgccagtgtgaactggatcaggttcaacgggtaaagacctaagtctactctcagccggcaatgcgcgactccccttacattccatattcaatttctttttttactatagcagataccctgcgtgctgtcaatcaggcaaaatggacatatcatgcaatcaaaacaatacttgacgcgcctcaaaaacagtgctatgatgacctcataaaatttcattcactgctgggggagctgcggctgagaattaaacccttaaaaccagcacggtaatacgtgccagggaagcgcatgtgcgatgctattcactcctgctttccgcaggagttttcttttgcagtgatttggattttaaatccacacagacaaaggagtcttactatgtttgatcaattatcagaaatcaccttgcctgccctcatcatcgtatgcgccgcgatcgccgcggggctgaccggttatcttttgtaccgaaggcatacgaacggcgggcgtaatatcacaaaaaaatcgcaatggacgaccaaagagatcaccaccgccgccctgtgtatcgctgcgtcgttcctattgagttttatcaaaattttctccatgcccaacggcggctccattacgcctgcgagcatgcttcctatgatggcgttttcgtatgtttacggatttaaaaaaggatttatcgcagggctgtgctattccctgctgcaatttatccaggagcctttcgcgcttgcgcccatgcaggtcatcctggattacccgctttcgttctcactgcttgcgctcgccgcattcgccaaaaagagcatcattcccggcattgcctacggctgcgcggcgcgtttcatctgccaattcctctcgggctggatcttcttcgggatgtacgcgccggagggcatgcccgcatggctttattcccttggttataacggaaccgtcgtagggctggaatgcgcgatctgcgtcgccgtttcgctgatccccgcgctgagtaaattcttaaaccgtaccaaggcgcaggccagcgcgcagcaaaaggcttttttaaaagcgcatgccgcaagctgattatttgaaaaactccgcgaccttattgtaattatccaggaggtcgccgtacgtcttgtaatcgctcggatatacctcaagcatcatgatgccgtcgtaatggatttcctccagcttctttttcatgccgccaaaatccatctctccggagaacggcaggcaggggataatgcctttttccggatccttgcggtaatcgcaaacatgaacatgcgcgagcctttgccccatatcgtctataaactccgaaacttcatatccggactgggccgcctgcttgatatcgagcgtgaaataaaggttatcgctatccgtgtatttcaggatgttatgtgcaaaccccggctttgcataccagcaccaatgcacgttttcgtacgcgagcttcacgccgcgctgctttgcaagttcggcgagcacggtaacgcgctcgcctgcacgttcataattcacatgaaacgtttttgcgtgcttcaaattcatgggtccgtggaacacataaatatccgctgataactccgccgccgcgtctgccacctgattatatacgtcaagcgcttcgtccctctgccgttcgtgcatggaaaaaagctgcggctcaaattgtgtgcacagcgcgtggacggaacgcacgcgcattccttccccatcgcagatacgccgtatctcatccgtaaacggtttttgatactccatcatcgctgaaaagaacaattctatatttttgattccgagttctgccattttacggaccgaatcctcgttatatagcctgcaaaaaaagcaggccgtcgacataccggcttccattcctatctcctgttttgaaaattcaaattacgctacaaatccattttatttctttaaagaccttttgtccaatctatttttattatataatagcgattgtaggtaaatttaaagtaggaaggtgaaaaaatggaatacaaaatagccatcatacccggcgatgggatcggccctgaagtatcgcagcaagccgtgcgggtcttaaataaggtcggtgagctctacggtcactcctttacattcacagaggtggatgcaggcggtatcgcgatcgataaatacggcgatcccctgcccgaagaccagctcgaaatttgccggaacagcgacgcggttttgctggccgcggtgggcggtgaaaaatgggacgacctgcccgtgggcaagcggccggaaagcggtcttttaaagctgcgcggcggccttggcctttttgccaacctgcgtcccgcaatgatctacaacgaactcaaggcggcatgccctttgaaggacgagatcataggcgataaccttgatatcctcatcctgcgcgaactgaccggcgacgtatattttggtgaaaaaggcggcgacgaccttacctattcgtccgacctgatgaattaccacgattatgaggtggagcgcattacgcgcctcgccttcgaatccgcacgcaagcgcggcaaaaaggttacgagcgttgacaaggcaaacgtgctggcgacctcgcggctgtggcgcaatacggtcaaccgtatcgcgaaggattatccggatgtggagcttaaccacatgtacgtcgataacgcggccatgcagctcgtgcgcaacccgcgccagttcgacgtagttgtaacgggaaacctgttcggggatatcctgacggacgaagcgagcatgatcaccggctctatcggtatgctcccgtcggccagcctcggatcaacaaagctcggcatgtatgaaccgatccacggcagcgcgccggatatcgcgggcaccggcaaggcaaaccccatcgccatgatcctttcgtgcgcgatgatgctccgttattcctttgacttggagcgtgaagcacagtccatcgaaacagcggtcaaggctgtccttgcaggcggcgcacgtacggcggatattgcggcgagcggcgcttttatctccaccggcgaaatgagcgacctcatcctcgcacaattgaaatagtaaaaaaatcgaaaaggctgccttacttttagtaagacagccttttttattctcattaacttacatcctatgatctttacgccgcggcgctaccgtgcgcgtaggaacgttccttgccgtgctgctttgccgactccggctgcgcgtgggcgtgatatctgccgggcggcggcctcctcccgcatatcgcctgcgcctgcggcttaaattcaccgtacgcacaatgagcaacgtcagcactatcgccgccggaatgatgatccacagataccatatttcaaaggaaaagaccggtacgccgtattccttgctcgtttccatttcgtcacccgcaggatagacctgccggctcgccacaagcggcgcgttataaatctcttcaccgttcaaaacataggagaccgttccaacctggtcgccttcattaatgggcgcttttaaaggtttttcaatattcgtcttctgctccacctgcacgctgccgtccgcaaggccttgcgcagtcgcagcattaatcagcctcacgtctgttgtttccccgctcaggtcggccgttacttcaagctgtccctcctgcggatcgtttcccgccgcgccttcaatctgttccgttaccgaaagcggtgcgacatactgtccgacgtccaccttggcgtaattggtaaaaccgtattcaaacaaatatttggcaatctcccaccgcgcatacgaattggggattccggcttctttatcgcctatcgacttatctccaaagataagtgcgatcaggttcagatctccgctctttgcagacgccaccaggcaaccgtatgatgagacggtttccccgccgtttaaagtaatattttccaaaaggcccgttttcatgcccgtcgctttgtcataaaggtaggtcgcgtattccggcttgttttccggcgttgcgatcaggaaattcgaactggtaaatttacggggcgtttccgaacttgcgtctgcatccggcgtgtattccgtcatcagcgcagcttccataatctccggatgcttgtacgcttcacgcgcaaggatcgccatatccgcagccgttgtatagtggtcataaccaatattaaaaatatagagaccgtacggattcagaaaatgcgtattcgtcatgcccaactcctgcgccttttggttcatcatatccacaaaagccgattcgctgcctcccatgtgtactccaagcgcggccgcggcatcgttgcccgaacagatcatcagcccgttaaacaggtccttaacagaaagagtctccccgcgcttcagccccatcaggctggaacccttggaaaattcatccacttcagcgcctacggtgaccatttcgtccatcgtacaattttccagagtcagtatcgctgtcatcaattttgtagtactggcaggaaacaccctccagtccttatttttggaaaaaagcacttcccctgtatctgcatcaatgagcatcgcggaatctgcggtgatttttgacaggtcgacttccggcgcgccctcttttagttcggaggtcgcttccggcgttgccgtgggttccggcgtaggaatgggcgtaggcgtcgcttccggacttgcagcctctcccgatgccgcagcttccgcctcctggctcccctgtgcatccgtttccgcaaaagcgatcaccggtatcgtcacgatcaagatgaccgtaataaacaaagcaattattcttctcaaactcaataccctcactgaaatttcctcactataacatccatattatataataaaatggtggttttgtatagcgaatgtatcatttacgtaatgatttttcatagtttcttcacaattttttcttgccgatgcacctgatttgtacgctccgtatcgtatactttttttagcaacaataaagctacggaggacaaaattatgttggaaattttattatcaaaagaaatactcgctatacttgccgttgtgatttccgtgctcggcgcgatctgcatttccgccgcattgcttacgcataagccgcgtcataaataccgccgtcccacacagcaccgcgaataggttaagattttctcttgaaaatatcgctaaaatgcaagataataggaaaggcgattaatttttataacaggcaggtatttgcatgaagcatcagctagtaacggcagcgcaggctgcggacttaatttttgacggcgctatcgtcgctgccaacggatttatgatgacagctacggcggacgagatctaccacgcgctggaaaagcgttttttagatacgcaaagccccaaaaacctcaccttactgagcgtcacttcggtgggggacggcggcgagcgcggtcttaaccgccttgcgcataaaggattggtcagaaaacttgtggccgggcatttgaacctgatgcccaagctccagcaaatgattttttcagaggacattgaagcgtacaatctcccgcagggcgtgatcgcacagcttttgcgcgacacggctgccggacgacccgggctggtaacgcatatcggccttgatacgttcgtcgatccgcgttattcgggcggacggctgaacagtatttccaaagaggaattaaacgaaattgttgccttggatgataaggagtacatccgttataagccgtttaccaagatcgattttgcgattctgcgcggtacgcgtgcggataaggccggcaacatcagtatggagaaggaagccgcaaaggtagacgccctgcccatggcgcaggcctgccatgcgctcggcggcaaggtgatcgtgcaggtcgaggagatcgttgacgatatcatgccgcacgaggtatccgttccaggtatcctcgtggattatatcgtgaaaacaagcgatatggcataccattggcaaaccgccgcatgcgattataatccggcttattccggccagacgcgcgcgcccaaaggcgctatgcccgtgctgaaaaaaggcccccgccgtattatcgcactgcgtgcgttaaaggagctcgagcagggcggcgtagtcaacctggggatcggaatgccagaaggcattgccgccgttgcagaagaaaaaggcatcaacgattttacgctttcggtagaagcgggcgggatcggcggcacgccgctttccggcgtggagttcggcagcagcttgaatccgcaggcgatcctttaccagcaccagcttttcgatttttaccacggcggcggtttaaaccaggcgtttttagggcttgcggaagcggacccgcagggcaatatcaacgtcagcaaattcgggccgcgcattgccggctgcggcggatttatctgcatcacgcagtcaacgcccaaactttactttatcggtacgtttaccgccaaaggcctaaaagaagaggtaacggacggaaaactttgcatcctgcaggaaggcagcatcaagaaattcaaaaaagagatcgagcaactgaccttctccgccaggcgcgccaaggagctgaaacagcaggtcatgttcatcaccgagcgttgtgtttttgagctttccgatcgggggctggtcttaacggaagtcgcgccgggcatcgatatcgagaaggatatccttgccaacatggaattcaggccgctgatcgcggatgacttaaaagaaatggatgcagacgtatttgcataaaggtgcccaaaatgaaaaacgcggccgggcgtatttcccttggccgcgtttttttattatttcattcggtttcctgctctttggaataatcgcagaaattgccttccgttttccacaaacgctccaattggtaaaattcgcgttcttccttatggaaaatatgcacgagcacgtcgccgtaatcgataacgatccagcgtccctcgcgctccccttctgtgcggagcgggctcgttccttcgtcctcgcgcatcttaaactgcacttcctctgccagcgtttgcacgtgcgaaacgttaggcgcgctcgcgaccacaaaataatccgaaatgatcgtcatatccgtaacatgtaaaataacgatatcctgcgcctttttgctatccagtatctccgctatcctttttgccctttgtgaaatctccaaactcaaagctcctctcctggaaataaattccggtaataattataagcctgcacactgtccgtgtcgatgaggcttttatttttgatgatattatctatggacattttcagtcccagcaaaaccgccttatcgatattttcaaaagccagcttgcgcaccctttccacgcccggaaaatcgcggttcggctccatatagtccgcaatatacacaattttctccagcatgctcatgcctgctctgcctgtcgtatgccagcggatcgcgtccagcacatccttgtccgtcacatatcccttttccttgaggagcgcagcagccgtatgcccatgcaatgtcttttccgtcagatagggtatatggtacttttctgccagcgtcacgttgtccatttgcttcgtgtaatcgtgcaacagccccgcaagccccgccttgtcctgattttccccatagcgctgcgccagcgccagcgccgttttctctacgcccaggctgtgctcaaacttttcgcccttcactttttccgcaagtttttttacgatcccttcgcggtcagcgatatagtccatttgcaatgatgtattcctccacgttttggggcacgagcccttcgatgctcttgccctgcctgatcctgtccctgatgtaagacgaactcatgaaaagtccggtatattccgacagcaggatatccgcgccgtattcctccttgagccgcacgatctccgccgaaagtttgagcgtatcgtgcgcgacgcgccggacgcacacaaaccgcgtcagtgtaaatagttctctgcatttatgccatgacgcaagctcaaatacggtatccgcgccaatgatgaagtaatagtccgtttccggattttttccgctcagttcgcgcatcgtgtccacggtataagaatatcccttgcgctttgtctcaatgtccagtaccttaaggcccgcctgtccttccgtgcaaagctgcgtcattttcaggcggatatgagcacaagcgatatcctcggtcttatgcggcggcgtaccgcacggcatcaaaaaaacctcatccagcgcaaattcgcgcttcacgtgctgtgccatatccacatggcccgtatgcggcggattgaacgtgccgcccaatatccccacctttttatgcggaacgggaagccggacgcgtccttgcgccatgatgcccttcaggtattccatcgcttatatctcgatctttttcttatttttcgattcgcggtaaagcacaaatttccgtccgagcacgctgacgccgtccgctccaagcgcttcacacaaaatatcgcatgcctcgcgtgccgtaagcgcgctgttttgctgcacgctgcacttgaccagctcgcgcgcctccagcgcgtcgcctgcctgggtaatgatattgtcagtgataccgtccttaccaatgtgtacgatcggctccaaatgctgcgcgaaagcgcgcagcattgctcgttgcttgcttgtcaacataactcccccgctactctacgaagtcaaattcttcgccgttcagcctgattgtatcgccgtcttttgcgcccgcctgaatgagctgctttaaaatccccatatcgcgcagcagcttatggaaatgccgcatggagtccggctcgtccggattgatgcgcgagaatatttcttcgatcagcgaaccgttcgcttccagcacgccatctaagccgcgccctacttcaagcgtgagctcgctgtcctgcatctgccattcctcaagcacgccctcttcctcgatgatctgctcttcgggcagcgtttttaaaacctccatcatttttaaccgcaattcatcgaggccccggcgcgttgccgcagagatcaggaaaatttccttatccggataggcctcctcgaagcgttccaggttttcctgcgcctgcggtaagtcagccttgttcgcaacgatgatctccggacgacgggcaagcggctgcgaatattttttcagttcttcacgtatcttcacataatcgtccagcggatcacggccttcgctgcccgcgatatccagcacgtgcgcgatcatgcgggtacgctcgatatgccgcaggaagtcatgtcccagccccgcgccgtccgacgcgccttcgatgaggcccgggatatccgcgatgataaaatcataatcgtacgtcttgacgacccccagattgggcgtaagcgtcgtaaaatgataattttctatttttggtttagccgaagtcaggcaggaaagaagcgtcgatttcccaacgttcggaaagccgaccagccccacgtccgcaatggacttcagctccaaggtgatctcacgctccgagacctttttccccggcgtcgcaaaccgcggcgtctgacgcactgcggtcgcaaaccgcgcgtttcctttgccgcccgcgccgccgcgcaggatggtcacgccgtccgcgtccctgatatccgccgcgactctgcctgtttccgtatccataacgaccgtgccgaccggaactttaatgatcaggttttcgccgttttttccgcgcatgttcttcttttttccgttttcgcccggctgcgccttatactttttgtgatagcggaaatccatcaacgtacgcatgcccggatccgccacaaatatgacgttaccgccattgccgccgtcgccgccgtccggcccgcccgcattgatatatttctcccgccggaacgagaccgccccattgccgccgtcgcccgctttgatgaatatctttaccttatctacgatcatgctttattattgtatgggcacaggtcggctatgcagcaattaccgcaaagcggcttttgcgccttgcataccctgcgcccatgccagatcagccaatggtgcgcctgtgaccagtcctctttcctgattatttttttatcttgttcctcgaccttattggggtcgtcggaatgcgcgaacccgatgcggttcgaaacgcgctttacatgcgtgtccaccggaaacgccggaagtccaaatgcaaacgccagtaccacgttcgccgttttacgcccgacgcccgcaagcgtcgtcagctcttcttccgtatgcggcacaacgccgccgtattcgctcatcagcctttgcgcgcacgcgatcaggttcttcgccttgttcttgtaaagtccgcacgtcttgatatacccttccacctccgcaaggtccgcttctgcgagttccctgggggaggggtatttcttaaaaagctccttggtcacgatattgacgcgcacatccgtacactgcgccgccaagatcgttgcaatcaaaagttcgtacgggcttttgtagtcaaggccggatttcacatccgcgtattcttttcttaaacgttcaatgatttctttatttttatccatgctattattttaacacaaaaaaattctttttatcaataaaacgctgtttttgtttttatatcctgtctttgatacaataaaaatagtaaattcccgcttttcgagagtgattcccgtcatttcggctgtcattttgcatgacgcatttgtagaatacagatatcggagaaacgcaaaggagaataaacgatggataaaaaaacgattgggagctttatctgtatcctgcgcagggcaagcggcatgacgcagcaggaacttgcagaccgcctgcacgtatccaacaaaaccgtaagccgttgggaacgcgacgaatcctcgcctgagcttgcgctccttccggtgatcgcggagctctttggcgtgacgacagacgaattacttcgcggacagcgcgccccccgggcggacggcgagccatctgcccagtccctccggcaagtctcctacctcatcaaaaacagtatggcaagataccgcatgcgcagtttgctttccgcttttttggcgttgacgagccttgtatccatgattatttgcggctttggcctgcgcgcacccgtggtggggatcggccttgccgccgtactgatcgcggtaagcctgattttccaggccgactccctctctactgtgcggcttgccctcggcgaaacggaatccggtatccccggcgtgcgttccgccctttaccatgtgtggcagttgttctttatggtctgctacttgaatatttttatgctgttcagcgttttgccttttatcgttcaatatgaaagcatcggttccatcatgccgcgcaacagttggctttccgtgcttcccttttatttgttcgccgccttgctcatttgccttgctttttcctttttcatccccaaaatcatttcccatcaggacgatctcggggacgcctatgccattgccgaaaaaaagaacgcgcgcctgcggctcgtttgtatctgcgtttgcgcaacggcgctcttctgctgcgggatcatcgaaaataatactccggcggatatcagcgacgcagcgcaaggcaaaacctttaccggttttgaagaattcaagcagtatgcggaaactcccatttctgttgactacgacgggaacaggacggagatctacgacgaaaaaacaggcgagttccgcggttatgaagaatcggaccggaaccgctggatggatacctatttggtggactccgccggcagcgagtatcatttcatgtggaaaaaccaggacatttgcatgatcgatggaaatgacgatctttcgcagatcacggtctattcccgcgcagaccagatcgcgtacaaccattacgcggaaacaaggatggcattgtttcttcttgcttacattgccatcatcgctgcggcggtaatcgtttatttgaaaaagcgcgtccgcatcagcaggttgctcgccgatattatctgagattttcccaatcaaaaaagcagggagcgctttgcgcttcctgctttactttcttcgcctgctcaatatgttttgttcgtcatcatgcttttgacagtcactcccttgagcttgcccaaacggcctgtgatggctccaagctgttcggtcgtcacctccacgacaagggaaatgacataaatatccttctcatggttcggtacgcccatacgcgcatggatacagtcggaatattccgataatatccggttcacctcaccgacgctttccctgtgctcttctatgataactgcaatgattcctatcctgttcatatttcccttaattctgtgcgaccaccatttccctgaccgtcgcgattgcctgttgtaactgcgtatctgtttcaaacgtaagcgccgtaaggtcagccggcggatcaaccgcaacatccggcgtgatccctgctccattgatcagattcccgttcggcgtataatatactgccgttgtcagcttcacgccgccgcccgaatacggcatatcgagtatcgtctgtatcacgcccttaccatatgtcttcgagcccaccactttgccgcgcccgcgttcctgcacggcgcccgcaaaaatttccgccgcgctcgcgctgttgttatccaccaaaacgaccatcggcaagtcgaaatactccgcgtccgccgtcatctcgtccttttgctcgttcttgtctatcgaataccccagcgatccttccggaacgatttgatccagcatatccgcagcgttcttcacgctcccgtccatattgccgcgtatatcgacgatcaccccgtcggccccttcatcctttaaaaactgcaccgccctttgaaattcctcgacacaattcccgttgaattccgaaatcacgatttgtgcaatattccagtcgtcaacggaatccagcatggtatacgtcacgtattgcatatcaaatgtcgcccgtgtgatcgggatatcaagcgaagccccgcccgatacgacggtaagcgtaagggtggaaccgctcggcccctttaagagattgaacgcgctctcgtaatcaagccctgcaagcgcaacgccgtcgaccgcgacgatgacgtcattttccttgagccccacgccttctgccggtccgcccgaatagacgcgttccaccttgagctgcccgctgtttttatacgggcccgccgatataccgatacccgccatatccgtttcgcttttggccttatattccttgtattcatcctcggtatagtagacggaataagggtcgcccaaggattcaaccattcccttcagcgtaccgtttagcatctggctttcatcggcctgctggtagaaattctcattgatcagcgtttctaagtcgctgatttccatatacttttttaagtccccataatttcctttgccgtccacgcgcaattcattgccgcgcaattgtgatgtctggaaaaaatatacgaacaatccggtgacaaagctggccgtcgcagcgatcgccgcgcacatcactatgattttctttttatccaaatacccgttacctccgcttcaaaaagctaaagctatccaatcaaacaacgcactttggcgccgcttccaacccaactgtgcgttttcatgaaatattacaaagttgtaacaactagattatacccattcctatgcaaaaaagcaagtttttgttgctgaggcgcacaatcgttcatgctttcttttcattttgaagatacacggccagtgccgtaaggtcagcctcatacgtttccttcacagccggattatagatgatgctcgccggatggtacagggcaaacagggtgtagcggttttcgtccagttccaaattttgcacctgcccgtgatacgcgccgatatttgccgcaaagtcgccaagcaccgctcgaagcggcgtgttgcccagcgtcacgatgatacgcggcgcgacgatatcgatctcctctttgagaaaccctgccgcctgtatgatctcctgcttcgtgggaggcctgtttgaaaccgtccccttttcgcttatcttatacggccggaacttacaaacattcgtaatatagatttcttcacgtttaaggccggcagactgcaggaatccatccaaattctgccctgccttccccacgaacggctttcccttaagcacttcgtcttttcccggcgcttcgccgatcagcaacacggacgcatgctcgttcccgtcgccaaaaacaagcggcgtatcctgatagaatgcgccgattttttgatataacttattcagcaagtttcagttcctctaatttttgttttaatacctggaagtcctttttcgcaccgtctacataatccggattgtgcagcattgccgccggatgaaacgtcggcatgatcataaaatttttgacacggatgcatgttccatgttctttcatcattttcacgtcgcgctttaagagcacgccggccgcgatacgccccaggcaaacgatcaatttaggtttgatgaacgcgacctgtgcgcgcaggtaatccatacatgcgtttcgctcgctttcctgcgggtcacggttattcggcggccggcattttaccacgtttgcgatatatacgtccccgcgcttaaggcctatttccaaaagcattctgtcaaggagccggcccgccggtcctacgaacggccgccccaactcgtcctcgcgcgcgcccggcccttcgccgataaacatgatgtcggctttcaggtttccctcgccaaagacgacatgcctgcgctgcttggcaagcgcacatttttcgcagtgcatcaccgtttcatacagcgttttaaagctctcgtaactcacagcgtcgtccttccctcaagcgccttagcaagcgtgatctcgtccgcatactcaagctccgcgccaatagggatgccatgcgcgatacgcgacactttaaggtcaaaacctttcaggagcctgctgatatacgctgccgtggcttcgccctgcacgtccggattcgtggccagaataatctctttcacttcgtctgtcaaccgtcccaaaagcggtttgattgcaatatcatccggcccgatgccttcgagcggggagatcgtccccccgagcacatggtaaagccccctgtattcatgcgttttttcgatcgcaaatacatcgcgcgcatcctttacgacacagatcacggactggtcccgcttcgtatccgcgcatacctcgcatacctcgccttcgcaaaggtttccgcatatcctgcaatattttaccttgcggcgcgcgtcgtacatgtcgacggcaaactgctttacgtccgcttccggcatttttaaaatgtaataggccagcctctgcgcggttttcgcgccgatgcccggcagcttacaaaactgtgcaaccagctttgaataagattgcaaattcatactgtttagaacaatcctccaaggttcattccgccggtgactttgcccatctccgtctgcatcatttcctccgctttgttaagcgcttcgttgaccgcggcgataatcaagtcctgcagcatctccacatcgtccggatcgactgcttcttccttgatctcaatgcttttgacgatctttttgcctgtcgccacaacacgcacaacgccgccgcctgccgttgcttcaacttcccgctcctcaagctccgcctgcacctgctgcattttcgcctgcatctgctgcgcctgccgcatcatattctgcatgttcattccgcccgggaatccgccctttgccatcttcttattcctccaacgtttgatttatttgatgattactttatctttgccaaccagctccgccagttgctcctgtatactcttttcttccttctgttccttttcataaacgatatccacaaccatcggatgtccgaatatttttgtcgtgataccgcccatctgcgccgcgtattcttcctttttgagcatatcgaccagcgcgccgtccgcttcatccgcataaaggtcgagaatactgccgcgtaccgctatttttttaagggagcccgtcgcgggcgccaaaacagggatctcctgtccaaccaatgccctaaactgctttaacgcgtccgtttcgtccacggcttccgctgctttttccagtcctgccgccgcttcctgttcctgcgcttctacgctcttgatcgctgctgaagcttcctgtgttactgccgtctcctgcacagccgactttgccggcgcaggcgtttccacagttttctgcgctgtcgctccctgtttcggcgtttgtacggtttgcgccgcaacgctacttagccccccctgcgcgatacccgctgcgagcctttccacacgctgctcgagtttctttacgcgcagctccatatcctttgtatccacatccgtcgtattgctcgaggcgcgcacgatcgccgcaaccagcaccgcatccggcgtgctcgcataacgcagcgtattctggttatagataaatacctcgagcacgcgcagcaggtttgcgcatttgtatgcgtcccccacgtcatgcccgagccgcgcggaaagctccaccacaatgtcccgcagtatattatgcggctctacgccgttttccagcatttcccctgcggtgagcaatgcttgcttcgggttttcttccagtatcgcgtcgcatagtgctttgagctgtatgctgtccgcaacacccatcgcgtcgctgacgtccgcaagcgtcagcgtttccttgcccgcgatacactggtccatgatcgaaagcgcatcgcgcatcgcgccttctgcggactgcgcaatcatcgcgatcgcttcttcctcataggttacgcccgtcttatctgcgacttcccgcaggcgagcaatgatgtcttcttcggatatccgcttgaaatcatacctctggcaacgcgaaaggatcgtgcccggcagctttcgcagttctgtcgttgcaagaatgaacaccgcatgcggcggcggttcttccagcgtctttaaaagcgcattgaacgcgcccggcgagagcatatgtacctcgtcgatgatgtagaccttatatttcccaagcgccggcaacaacgataccttttcgcgaaggtcgcgtacgttatccacgctgttattcgaggctgcgtcgatctccacgatatccacaaacgcatcgctttttaggctcttgcacacctcgcatttcccgcaaggatttccatcctgcgggtcgaggcagttaagcgcattcgcaaggatctttgccgtactcgtttttcccgtacccctcggtccgtaaaacagataggcatgcgcctgccttcccgtcatgacttgatttttcaaaatgtcggtaatatgctgttgtccgtatacctcgtcgaacgtagacggccggaacacccggtacagcgttttatatgccataaatttttgctccctggtttttctactctttattataccatatcgtcgatgcaaagcgggaacggattcagccttttaatctgctctgccgttccctgatatactcgttaaatgcttcaaggttccggctcacaatcagttccgttgggaagtccgtttccaaaagcgccgcacctgcaaggtcgaagctgccgatcctgtaacagacgtgtgcgtctgaggacactgtgatgcgtacgccgtgctttttacacaaacgcaggaaatccttacagtttggcgggctccccttcctgtataaaaaggaatgatcgttgatctcgatcagcttgccaagtttctttgcttccttcacgaccgtttccctgtcgatatcataatacgggttgcccggatgcccgatcacatcgacgtacgggtttgcaagcgcgtttaccatcgccgccgtattctgctccttggtgcccgggtcgatgacgatatcgtgcatagacgcgatcgcaaaatccgttattttaaggaacctgtccggaatatcgacgcttccatcatagtccagaatattcgcttccgtactgcaaaacacacgtacgccttccaggctttccggcattgacgccagcaccccgataataaaatccggcgcgccgcccacgatcgcggggccatgatccgcgctgcagatcgcttccataccgctgtcccttgcatattccacattttccttgagcgttgaatatgcatgtccgctcgcaaccgtgtgcgtatgcgtatccaccaaaagtctcattttttctgcctccgttctatttcgggcaatctactttatgactaaaccgccttttcgcgcattttccctttgccagaagaacaggtattgctgcgcaatgcccgcgttactgccaaatttttcccgcgcgtattcatatacctgcctgtcgtttcccgcaaacccatactgttccttcaggatccgcttgatccacacatcggccggaaaagcatcccgaaaaccgagtgaaaaaagcaaaatacagtccgctaccttaggccccacgcccggcagctttctcagctcctgttttgcggcaaaataatccatacgcttaaggccatcgagcgggaaaccgtccgcgaccaatcgcgccgttttctttatataaggcgcgcggtatccgcatccgcattccttcaacatttccacgccaaggcttgccagcgcatccggctctggaaatttgtaataggttttcccttcaaacgcaaacggctcgccgcatttttcgcatatccgtcctatgatccccttgatgcgctttaagttgttgttagctgaaacgataaacgaaaccagcgtttcaaacggctgctggtttaaaagccgcaacccgcagccatattccattccctctttcagagccttgtcgccgcaatcacagaacagttcgccataatccacttccaaatcaaagtaccgcttccagacctgctcatattcttccggcgaggcgggatacagcgtcacggtatccgcatctttcctgacacgcaaaaaacggccgtgcgcgacgccttcgaaagcgcccttttccacctcgtcgaaacggaatgtctgtccattatcaaaaatgtgccgcggttcgaaacaggtaagccccgatatcaccgccgcaccatccttaaaacttactctcatgtatttcagtataccataaacctgcatttttttgtagagacaacaaaaggaaaatgccccggaaaatccgcaggcattttatcggttataacatattttgttttgatcgactgcatttacacgacatattccttgagcccgatcaggccttccccaaacaatatcgtatccattgttttcagcccatcggcgatgtgcggccgaaactccatgcggctgaggacatcgcgctcaaggtcgatgcccggcgcgatttctaccagcgtaagcccttgctttgtaatacggaataccgcgcgctccgtgatatacagaacgtcctgtccgttttggaggcccatttccccattgtaggtgatctggtcgatttgttttaaaaactttttgtttttcccttcctgctcaatgaccagttttccatccctaaaatgctcgcgcagtccccctgcggtaaacgttccacaaaaaattaatttttttgtgttctgcgaaatattgatcgatccgccgcagccatagatcttatctccaaatctcgagatatttgcattgcccctttggtctgcctgtgcaaatcccagataagtaacgtcaagaccaccgccgtcgtaaaaatcgaactggctttcctgttcgatcatcgccgccgcgttgcgcgccgcgccaaaatcctttccgccgcacgggatcccgccgatcacgccgctttccgccgtcagggtcatccgttcgtagacgccttcctccgccgcgaccgccgcaataaactcaggcgcgccgatcccgaggttcacaatggaatttgccctcagctcctggctgcaccgccttgcgatcactttttttgcgctcatggggagcacgccgctttccgtgcccagaacgcggatattccctgtcagcgagggatcataatccgtccggtcgccgatcggccggtggtttttttcaggctccccgcactcgacgacggcatctacgaaaatgccggggacatatacttcgcttgccggaaagctcccccgcggggcaatccgcttcacctgcgcaatgaccttcccgccgcaggccttcaccgccatcgcgatcagccggatatccgttttgacgacctcttcaccaatgcttaaatttccgtcctcatccgccgccgtcgcgcggatcagcccgatattgaactgcggcacatggtaggacaggtattcctcatcctttatccgaacggctttgacgatatcttccgtgcagcgtttggtcattttcccgccttcgatccgtgggtccacataggtatgcagccccaccttcgtcaggtattcaccgtttccctgcaggcgcgcgcggtataagcgcatgaccgtgccctgcggaacattgtacgcctctaccttaccgtccgcgatcatcccgctgattttcaggttcgtaccgaaaaaaccggatacgattcgtttgagcaggccctcatgagccagatggtcgctccctccgcccagggaatcgctcagacccgagcccgaatattgcgtcagccccttcggctttcctgtttccaaaaaccgttgttccaggcaggtcaggacctcctccgccatccccgccatcccaaagccgctggacgcaagcacatcccctgtttttatgaggtcaagcgcctcgtccatcgtgcatactttttttgccatcttacttctccgcaatcatttgagcggcggaaaatccgcctttctcttttccacaaaggccgtcattccttccatgcggtccggactgtcgtagcattgccgtgtcagcatttcttccagtatgatccctgtttccatatccgtttccgcgccgcgattgatcgcctgttttgcagcggcgacagctgccggggaatttgccgcgatcctttcggccattgcaaccgcttcgtcaagcaaatcttccggcggaaccactttattcaccaggccgatccggtacgcttcccctgcgtcgatctgctgcgcggtcataatcagctccttggcttttccaggccccaataaacgcaccatcctctgcgttccgttaaacccaggtataatgcccaggcccgtttccggctggcaaaaaaccgctttttccgaagcgatgcgaatatcgcacgccatagacatttccgtaccgccgcccatcgcatacccgttgatcgccgcaataacaggcttacgcagtaattccagcttgcggaaaaaatccacgcccacatgcgtgaaatacatgccctcttctatgttcagccgaagcatgtacttcacgtccgagcctgccataaaagccttgccttccgcagttatgacaatcgccctgatctgcgggtcgccgtccagttcatccacgcacgccgtcatttttttaaacagctccacactgaaaatattgagccctttgtccgacgcaagcgtcatgattcctacatgtccctttttttctaccgttacatctgtcatttgaaatcccgtctctttcccttatattttatattccgtttttctcccgcacgcgcagctctttgagcaacgccggaatggcttccatagcgtctcccacgatcccgtaatccgcagctttgaatatgggcgcatcacggtccgtgtttatggcgatcaccgtctttgccgaacgaaggccgctcatgtgctggatcgcaccggatatcccgcaggcaatatacaagtccggactgatgcttttgcccgtctgccctaccatatgttcgtgcggtatccaatccatatccgccggcggacgggagcaggccacaacgccgcccagatgatccgccagctcaaagagcaattcaaactgttttgccccgccgattcccctgccgcctgcaaccactatttttgccttttccagcccgcaggaactttcttgtcctttttgcactgaatccgccaatattgtacggacagtcttttgtgggagcgtttccctgatgatggcgcacgcccttttgttttcccgtggctgcttgaacatccccgcacgcaccgtcgccatttgcgggcggtgatgcgggcatataatggtcgccagcaaatttccgccaaacgcggggcatataaattccgtcttttggccttcccccggctttatatcgatacaatctgccgtcaatcccgtccccagccgcgcggcgattctgggcgcaaggtcttttccgtcgtcgctcgcaccgatcaggatgcaattcgggcggtatttttccgccaagctgcaaaatacgtccgtaaaactttccgtatgataaacgccgtatccttttccttccgctatgatgaccctgtccgcaccaaaagaggccgcctgttcgatggattcggaagaaatttgctcaccgaccagtattgcgaccacattttcatggtatgcgtccgcgagctcccgtgccggagcaagcagctccagccctgcctccctgatacacccatccgcttgttccaggtatacccagatatccctgtatcgcgttatatcttccatcatttccgccgtcccttgctttctgccgattcccttacgatatccgccatttggcatgcgacctcttccatgccgccttccagcatcgccgcatcctttccatgcggtacgaccgatacgccggtcacttgcgtaggcgatcccgaaattcccgcgcgcttcgcctcaaagccctgtatatccttcgcttccaaaatagagacctgcgccttcatggacgcaattttacttttcatcgtcgggtaccttgggcttaccggcgctttgccgatcgtcagcacgcatgcccccagcacctctatcctgtcgatgcagtcttcccgttcgcgcagaacgagatatccgtccggcgttttttcaaagcctatggcccccgtgacctgcggcatatccaaaagctccgcaagttctgcgcccacctgtgcggtatcgctgtccatcgcctgctgtccgcacaaaatcaaatcaaagtgaccgatcccttttctctgtgcgatcgttcccgccgcctgcgcaagcacatagctggtcgcaagggtatccgccccgccaaactgccggtcgctcgccagccatgcctcatccgcccccacggacaggcactctttaagcgcgctctgtgtttgaagcggtcccatgccaagcaccgtgatcgttccgccataacattccttgtactgcaccgcaagctccaatgccaaacggtcaagcgggttgacgatacaccggatcccttcgcgtataagcgtattggttttggggtccagccggacttccatgtcggcaggaacctgtttgatgcacaccagtatttccattctgttacctcatgaggctgcccgcgatcaccatacgctgaatctggttggtgccttccaatatctggaacacctttgcatcgcgcatgagtttttccaccgggtattccctgctgtagccatatccgcccaagatttgcaccgcatcggtggtaacgtccatcgcgatatccgaagaataacattttgcgattgccgcttcccttgtggtgcgcattcctttccctgacaattccagggcatggatcatcatctgccgtgcggtttcgatcttgatatccatatccgccaacaaaaactgtattccctggttttgtatcaccggcttgccgaacgtcgcccgcgtcttcgcgtacgcgaccgcttcttccattgcgcgctgcgcgatcccgatcgtgatcgccgccgtcaggatgcgttccacgtccagcgtcttcatggcaatcccaaagcctttcccttcctgtccgatcaggtttgatgcgggaaccctgacttcgtcaaaaaatacggacgtcgtattggaaagcctgagtcccatcttgttttcttcctgccctgcttttacgccctgcctgtctccttctaccaaaaatgcggaaatgccttttgttccggcctccttgtccgtcatcgcgaacacgatgtagatatccgcgatcccgccgttggaaatgaagcatttatcgccgttgatcacgtattcatcgccgtcgcgcacagcagtcgtgcgcgtattccccgcatccgaaccggccgtcggctcggtcagcgcgaatgcgccatatcctccggcagctaaaatatccgcgacctttttcacctgctgttcgttccctgccagcatgaccggctttagcgccatcgcgcttgtcgcaagcgtcgacggtatccctgcatccgcttttgccagctcctcatagatcgccgccacggtaagcaggtcaaggcccatcccgccgtattcttccggcacttcgatcaaatgaagctgcatttccagcgccttttccatgatgcccgcgggaaactctcctgaaacatcataatccttgcattgctccttgatctccttctccgcgaaatcctttaccatggaaacaagctcctgtgattcctgcgttaacagatatcccataacgaatcctcctatatgaatttttcatttgtattgcctggttgaaatcaaactatttttgaatagaaatagggatgttttctaatttggcccttatcttaacaaattcaaaccggactgtataggggaatatttcaacttccataggactttcatgcaccgatcggattttatttaccggtgtaaaatataaatttgcggacggcaagccggaatcagacgttggcgccttttatgaaaccggacaaaattttcccataaaaaaacggtatggcttgtttaccataccgccttagaaacaatttttacttagtcggatacatacggcagaagcgcaaagtagtattttcaagcatgcaaactttaaaatcggtcaaaaatacaattgcggtttatttttcaaacgcatatatgacatagtaatcatcctgataaacgacctgcccctgtgtaatatagccattttgtttccttagttgatccgtttcccttgtaagaaggataaattcgggtatatgttgttcaatattcgtatattctttcggctggagccactcaaaaaccggcatattctccgtttccgcttgaactgcagcaaccctcacgtctccattagttaaggctgttgtactatttgcatcccagaatcctgcccaaccgaactcataattattttcttttaaaaagcttatatactcagaccgatttgctatttcaccccgcgttgccccttcgcgatccataatgaaaatgtttaagttgcagcaaaccgcggcaagtattaccgccaaaatcaaaaaacctttacgtaatttacatccttttgcatcaaacatgcataatatcggcataggataaaataaaaggtaccctaaattaaccattctttcggaaatggcatctcctataaaaataagcatcatcgtattgaccagaagcgatacccaagcaaacacaacatagtaacgcacggtggaacacaactttttccatttggtcagcaaaataattccgcataagaaactcagacacccataaaccaaaagataaatattaagcactccttgtgtacttaaaactttatcgccagtatattgaaatcccgacatattgaaaaaatacttgatatactcgataagatttttcccaaaattattttcatttgttatctgaaccacgtcgctgtgcccgccacctaaatatggctgcaacacatatcgataaactagaaatccaacgacccaaaacatacatatcaagatcatactgccaaaacgtctagcatcttctctgcgaattctataaggtttatccatttgtctgcaagaaaattctttcgtcaacaaacgaatgcactctgtaagacataatggaataataaccaatgaaagataacggataccgcaaatcccaaacagcaggctaaaagccaataacaaaattagcaatgcttttcctaattttctttgaaaacgaatccatatacccagaaacaatagcaatccaattagaaaaaaactataataccccgtttggataaaaatttgaaaataactcgcaaatgatagtgaagcccccatcggcacaataaaacacactgcgcatcccattgcaaaatgttttggtatattcaaacccttgaaacaaaagtatccgcatcccaggaatagacaggagataataaccgaatatgttgttgtaatcgtattataatcatgtgtaaaataaaatagcggcgtcataatcaactgattgtgaaatatccgaacctctgtcgaataggcccagccattcgaaactaccccagcaccctgatcaaataaatattcaggcaataaaaattccgccgcagaatctgaattcaaagccgtatggaaataattattatattcaaatattccaatccaaataatttgcaaaatgccaaaacaaaacaaaagtaaaaaaaacaggttctccttcttctttatccactctgaaaccaaaatgtttttctccattttctaccccactttgtatcctttgctatcaattaaagtaaggtttatcgttccacaaaaacacaaaaaaaaatcacccttacaggtgataaaatggagctttattacttgaacgataaaccttactttatattaacttaaaaagacatgctacgatgaacatgtctttttaattacttagtcagatacatacggcagaagcgccatgatccgcgcgcgtttgatcgcgatcgcgagttccctctggtgctttgcacatgtgccagaagcgcgtctcggcataattttgccgcgctccgtgatgaacttcctcagttttgcaacatctttataatctatggtttcagacttgtccgcacagaaagcacatactttccttctcgggcgtcttgcacgcataggtcttcttgctctttcttcactcattgtgaaatactcctttactcaagaatcagaaaggcagttccgcatcgtctaacggttggaaatccgataactcttccgagaagagatcgtccgcattgctttgctgctgcggcggcgcttccggcgggacataatccccctggccgcttccctggctgtcgcgcctgctgtttaaaaattcaacctcgtccgcgatgatctcggttacgtagcgccttacaccgttcgcatcgtcgtagttacgcgtctggatcgtgcccacaacgcccactttggagcccttggaacaaaaccgcgccacattttcggcaagcccgcgccagcaaaccaccggaataaaatccgcctgctgctgtccgtcctgagatttatacctgcgcccaaccgcaaccgtaaaactcgtgaccgaaatgccgctcgatgtcgtgcgttgttcaggatcccttgttaaatttccaaccagaatcgctttgttcatactggaaccatccttttcatgcaaatcgttttgagatacgaaaaaactatctcttttctatttctcgtcgagattaatgaccataaaacgcaatacgtcgtctgaaattttgtaatttctttcaagctcgaccggcaatgtcggttccgcttcaaagttcatcagtacgtagtagccgtcattgatatactgaatcggatacgcaagacgctttttgccccactcgtcgatcttttcaacactgccgccattgtttgtgacgatgtcggaaaacctttttacgagcgcgtctttcttttcctcttccatatccggcttcaaaatatacattgattcatactttgtcatccgtaattcacctcctcatggactaatggccctgctttttgtccgcagagcaaggacgctacattaaggtattatatcttattctttatgggaaagtcaagcgcggctgccgcctcattctcctcttcttttgaggtccgccacttttcgctcgtattcctcctgcgtgaccacgccttcatcccgaagtacggtcaggcggcctatgatatatttcgcctgttccgccgcgtttgcccgcaggatcgaatcacgctcggtctctgccatctgcgctgctctccccttctcctgctcccagcgttttttatatttcaggtatgcgcacaggatgacgaccgccacgaggatgatccccacgataagcgccactgcatttgcctgcccgcttgcagccatcttgcggctgacttcattatccaccgtatcgatttttacgctctgcatgatggtttccatcaattctttacttgcgggcgttatgctgccgccattttcgcgcagtataaaataaatcgtttgcccgtttttgaccgtcatgtaatgcatctcgtcaaattcgtcatttgaggcatgataggaaatatacagcgcgtcgtccgtccttacctcgcggacgtccgtaatgtccgctcccatctcgtatgaagcctccgcgctttgcatatattccatctgctgtttgatgtatcccggctccgcattcaaaagatcgtccacatatgcctggtttatgttggtgccggaaaattcatccagcatatcgctttgcccttcatcgatcaaggtgatgaaaaattcattttccccgtcaatctcaagcgcatccagataaatcgcctgcgtatccaggtaatcctccaaagtctgcgtatccactccgaaaaaatcgtaaaccgtctcctccagtttcggatcgttgagcgtctcttccgtaagcacgagatactcctccggaatttctacgctgaggttcaagtccggcacgctgtaagaagcagactgtgcaaatgccgtacctgcgcacaaaacaatcagcaccagggtaataaagcccgtaaaacatttctttctcataaccatttcctcacagtcccatcagcagttttctcttgcgctcactgaattcttcctccgataaactgccttcgccatactgctttttgatttcctttaagtctgcaaaaatcttttcctgttggggattgagtccgcctacccgcgcaggcattggctctcctgcgccgtgagggacagcattcgatttgatatggaaattgtatacgcccgctactcgccgcgacatcagcaggtaggagatcaacagtgcttctatcaccatctgcacggccgaaacagcgccgtttcccgcgaggaaattgctgacgaccgtaagcgccgccaacacgatgtataagtagataaacggccttttcctgataaaataaaaaacgatcgttaccacgcaaagcgcagtacccacgcctatcataatatctgtgccataaaaataatacataccggccgccttgtttgccaccatgcccgcacaggtcacgatattcacaatcagccctgcaatcaagcggaacccaataaaaataagccagccgccgatcccctgcttctgcggagccggctgcggtgtaagcatctgcccgtccataagaaacctcctgcacatatatatcttttgtcttttattataccatatcatgccggtaatggtcacatacgtgacttttttacacaaaaaaactgccggtcattccggcagtccttgtttataccagcttttctttcaacagcgcgatgcttttttcaagccgcctgagcgtctcgtgctttcccaggagatacgcgatctcgatcgctccccccggcgtgaccgccactccggagattgctacgcgcaacggatataaaagctgtccgtttttgatccccagcttttctacaagctccatcatcttatcgtgcaggatcgtttccgtgaaatcgttgatcccatgcagcaccggatatgccgcttccaagtttacaagcgcgctttccggcgttaccttcatcttcttgtggttataaagatcgacgtcgtaatccggcatatcgctgaggaacgcgagctttgcgggtatctcggtcatcacctcgaggcgcggctggatcaggcgggtaatgagcggcagatcgaatttatccggatcgatcgcctgctcgaaatagggcatcgccgttttgataaaatccctttcgcttaatgcgcggatatattccgcgttcatccacgtgagtttttcaacgtcgaagatcgccggacttttgctgatgcccgcaacgtcaaacgcatctacaagctcgcccagcgtaaaaatttcctggttgcctacaggactccatcccaggagcgcgatatagttcaggatcgcgggagacaaaaatcccttggcgataaaatcctcgtaggaagcgtcgccatgccgtttgctgagtttggcctgcttgtcgcgcatcacaggcggcagatggatgtactccggcacgttccattcgagcgcctcataaagcaggttatatttgggcgtggaggagaggtactcgatcccgcgtatgacgtgcgtgatacccatcaggtggtcgtccaccacgttcgcgaggttatacgtcggatatccgtccgactttaaaaggatattgtcctccatatcgctgttcggcacgctcaccgttccatacaccatatcgctgtacgtcgtttcgccctctttcgggatgttctggcgaatgacgtaaggctcgcccgccttaatcttttcctgtatttcttcgggcgtcagcgaaaggcaatgcttatcatatttgaactgccctcctttggcttcgcattcttcgcgcaaacctgcaagccgttccttggtgcagaaacaataatatgccgcgccgcgcgccaccagttcttccgcgtactttttataaatctcctgccgctcggactggatatacggaccatacgggccgcctacgtccggaccttcgtcgtacacaagccccgtatccttgagcgtgcggtagatgatctcgctcgcttggtcgacaagccgctgtctgtccgtatcttcgatacgcaggataaatttcccgccatgttttttcgcaaacaaatatgcgtaaagcgccgtccgcagtccgccgatatgcagatatcctgtcgggctgggcgcaaacctcgttcttacttccatgatcaatttcctttcaaaacctgttttgcaaagctgtccttcagactgacgatctggttgaacaccaagatgtcgtcttttgtatctatcggatcgatactgaaatatccctgccgcatgaactggaaccggtcgcccttttccgccgttttgatatgcggctccaccatcacgcccgaaagaacggtcattgaattctcattggccacataggtcccgtcctcctgttccaaaaacaggtagttaagcaaacgcgcctgcgccctgacagctgtttcgccgtctacccagtgcagcgttcccttgaccttcctgccgctgttttccccgcctgacctggtcgtgggatcatagctgcagatcacttccgtcacgttgccgtccgcgtcctttaaggcgcgctcacatttgatgatatatgcgtttttcagccgcacctcgccgcccacatacaggcggaaatatttgttgtttggtttttcttccatgaagtcgtccctctcgataaaaagatgttttgaaaagggcacttcatgcgtagattcgcttccgggcaggtcttgcgccgtcagcatttccgtctttccgtccggataattttcgatggtcaacttcaatggacgcagcaccgccatcacgcgcggcgcatgctcgttcaaatcctcgcgcacgcagtgctcgagcagccgcacatccacctcggacacggccttcgcaacgccgatcctctcacaaaaatcgcggatcgcttcgggcgtgtagcccctgcggcgcacgccggaaagcgtgggcatacgcgggtcatcccaaccggataccacgccgtccgtgaccagctttttcaagtaacgcttgctcataaccgtgtttgagaggttgagccgcgcaaattcatactggtgtggtacgttttcacagtcgcaattcttcaccacccaatcgtaaagcggacggtgatcctcaaattccatcgtgcatacggaatgcgtcacgccttcaaaagcatcctctaatggatgcgcaaagtcatacataggataaatgtcccaccggtcgagcgtgcggtggtgcggcgatttcacgatacggaaaattgccggatcgcgcatattgaggtttggggaacacatatcgatcttcgcgcgcaggatcttttccccttccgcaaattcgcccgctttcatcctgcggaacagctccagattttcttccacactgcgtccgcggtatgggctttccttgcccggctgtgtgagcgtgccgcggtattcccgcatttgctccgccgacagatcgtccacaaacgcgagtccctttttgatcagcgtctccgcgcaatcgtacatatactcaaaatagtccgaaccgtacacttccttgtcccaggaaaatcccagccattcgatatcctttttgatcgcgtctacatattccacgtcttccttcaaagggttcgtatcgtcaaagcgcaggttgcatgccccgccgtattcctccgccaggccaaaattgaggcagatcgcctttgcgtgtcccaaatgcagatacccgttcggctccggcgggaaacgcgtaatcaccttttttaccctgccctcttttaaatcatcctcgatgatctcttcaataaaattctttgattcgctttctgacattgtctgctcctatcaatccaaatgaataatacacatattatatcataactatttatggtatgtctcgttgtttagtatcttgaacgcacgaaaaacctgctctaagagcacgatacgaaacagcctgtgcggcatcgtcatttccgatacggacagccttagatccgcacgctgttttacctcgcccgaaagccccagcgatccgccgatcacaaagctcaggacgctgtttccgccggtcatcagctcgccgagtttgccggcgaatgcttccgaagaaagctgttttccctgcacgtcgcacgcgatcacgtatccttcgcattttgcaaggatgcgtttcccttccgtttcctttaccgctgtttccgctttttctcccttgacgtttgagagcggttcatccggcagctcgcaaacaacgacgtcacaaaaacgcgcaagcatctttgtatattccgcctgcgcctttgtataaaaatcttcctttaattttcccacgcaaataatcttgatcctgatggccgcttcccccttattgctcgccggtcgccgtccccgacgcgtccggttcttccgaaggcgcgcctgatttcagcggcgggttttccagttcgacaaaaatcgtgatcgtccgttcgtcggtttgttcgtcggaaagcgagacatatacggtaatgtcgttatacccttccttcagctcgtacgttttcagttccttggatatttcttccccatccatgactttggtgccatgcacatggatttcttttccaatgttatcgctcgataccgtaacgctcgattgttccatcatgtcgacaaccgtgccatccggtaattccacttcaagcgccttcagtccgtcttcctgcgcacacgcacataagcacgccatcatcacgatgactaaaacgactgccgccaaaatttttatcctttttgccatataccactctccatatttttataccgcactgtaaagccctgtcacgccttcgcgttttgccatgcccactgcgacatgcttgccgatcacgataccattttgctgcaaaataccgcatactgtttcgtatgccagctcataaaaattatttttttccgaaagatgcccaagcaggatcccgcgtacgcccgactggacaaggcggcaggccgtgttcgccgcgtcgtcgttggaaaggtgtccgctgttcgataaaatgcggcgtttcaagtaatagggatatggcccgcatttgagcatttccacatcatggttggattctaaaaggacaatggaagatcccgcgacctgccgcagtattttctccgtcacatgcccgaggtccgtcatcacgctgatctttttcccgcctgccgtgacgctgtagccaaagggacgcaccgcgtcgtgcgagatctcgtacggctgcacgcacaagtctttcacataaaaatcctgttcgtcgatcacgcgcatattcttactgcttacctcgcccacacgcgtttgcatcatctcccacgtctgctcgttcgcatacacggggatatcgaatttacgcgagatcacaccgattccgccgatatggtcgctgtgttcgtgcgtgaccaatatgccgtttatatcggtcatgtctacgtccacttttttcagctctgtcacgatctttgagcatgaatatccggcgtccaccaaaacctttgacgtttccgtgccgacataaatgcagttccctttggagccactgaaaagcggcgcgatctcaagtcccatatattgtgcctttccttatttccaatacactttattgtatacccatcttccctttttttcaacgtgttttgtttgcaaagcgcatgttttttccgtatactggaaccaatcgatcgcttaacggaggttttttatgaaatttatatcccctttgctcgtcgtttccgatatggagatatccaaagcattctaccgcaatgtgctcggttttcgcattaccgccgatttcggcgccaacgtcacctttaccggcgggttttctatccagaccttagatacatgggagggctttatcgaacgtccccaaaaagacatttcctttgcgggcaacgaccacgagctttattttgaagaaaaagattttgacggtttgatcaagcgccttaaagctgcccacggcatcgactatgtgcacggggtaaaggagcatgcatggggccagcgcgtcgtgcgtttttacgatcccgaccatcacatcatcgaggtgggcgaaagcatgaaggccgtgtgcaagcgttttgcagacctcgggatggatgaagagacaatcgctgggcgtatggatgttccgcttgcttatgtgcggaaactactgcgttagcccaacgtccagccattttccccttgcatttcatgtaaaagtggtttataaataattatactgaccggtcaatataattccaaggggagaagatcatgaacaaaaccaaggaagccatctatgacgcatccgtagatattttttcgcgctttggttatacgggcgcgtccatggacgatatctcgctgaaggccggcgttgccaaaggtacgctttattatcatttcaaaagcaaggaagagcttttcctgtttgtgatgcaaaccggactcaaacatctggtggacgacgccaaaagcgtgatccaaaagccgcttgcgccggatgaaaagttgagggcgctttgcaagtcgcagcttcgggccgtttccaaaaatgaaaattttatcaaggtcgtcttgagccaattgttcggtcaggaagaacgccagcagcttttgcgcaaggaattaagcgaatattcggaagtcatcaaatcctgtattgcggagcttggcgggaacccgcggacgccgacacaagaagatgccgccgccatcggttttttggggatgctcgtttccgccgccgtataccgtgcgctgcatccttcctctaaaaaaggcgtttcggatatcctgcttgaaaattatctgcgcgggatcctgtaaaatataaccgtaacagcagttttttgaaaactgctgttttttttatataaaaagtgttgacaaatgaattcgaaagcaatattatttgtactgaccagtcagtacaaataataacactgaaggagtgactgttttgaaatttgccaagatcacgggacatgatatctcgagtatctttaaaaaccggttcatccgtgtttccgtcgttgcgatccttatcgttcccatgctttacagcctgtgctacttagcggcgttctggaacccctacggaaggcttgaccagcttcccgttgcggtgctcaatcttgacgaaggagccaatcttgacggaaaggatgtcaattacggcggcgatgtggtaagcgacctcaaggaaaaccatgaggttgcatggtcgtttatatcgcaaggcgatcttgagggcgggctcgcttccacaaaatattattccctctttacgatcccaaaggatttttcccaaaagatcgtcaatgcaaaaacacaacagcccactacggcggagatcgtttatacctccaacgaggcaaagaattttcttgcttcgcagatcagcggaaatgtagagacgcgcctaaaggagcaggtgtccgcttctgtgaccaaggaatatgcgcaggcggccttcgacggtttatatgatgccagggacgggctttcgcaggcggcggacggcgcggcgaaattacaggacggcgtcagcgagctgaatggtaaaatacctgaattgacctcgggcgtcacccagcttacggacggttcctccgctctgcaaagcgggcttctccagctcgattcgaatgttcccgccctgaaaagcggcagtacacagctatcaggcggactcgcttccttaaacgaccaggtccctgcccttaccgatggtgcaaatcagctctcgagcggtgcaggtacgctcaaaagcgggatcgatacgttaaatacaagcatccagacccttatcgcaggaatcggcgatgcctacgatggttccacagccctaaacgacggcatctcccaattaaacggcaatatgcccgcgctttcggacggcgcaaatacgctcaaggccggaacctctgcgctcaaaacatctgcagacaagctttttgcgggcagcggcaaagttgccgacggattggataccatgctaggcgcaacatcctccacgacgcagtttgaaacgaccgcagatcagatttccgcattgattgacgccggcgaccccgccagccttgccaatgccaaagcgcttcttgacggcctgaaaaccgcttatgtagacgggcagggccaactccacgacggtctccaggatgcccgcgacgggatcggacaaatacagaccggccttggcggtatgcaatatacgctcgatccttccaacgcaacgatgcctgacggttcccctgcctttgccgcaggcgtggacagcctttctgcgggcatcgatactgcggcgaccggcgtttcgcagcttgcggacggttcctcggcgttgcatacaggcctttccgaaatcaacagtaagcttcctgccctttccgacggtttgggacagctttcgctgggcgcaggcagtcttgacgcaggcgcaagcgccctgtccgaaaaaacacccgcccttgcggatggcgtaaatcaactggcctcgggcagcaacgcgctctctgccggtatcgcacaggcaaccggcggtatcggccggcttgcggatggctccaccgacctgcacgaaggacttacatccctggacgcgcaggtccccgcactgggagacggcgtccaacagcttgcggacggttcttccgaactgcatactaaactggcagacggtgtttcttacatcgacggaaatctcgtcaactccagcgatacaatggcagaatatatcagcgatccggtcacggtatcgaatcagccattgaatcccgttcccgattacggcacgggcttcgccccttactttatcccgctctcgctgtgggtcggcgcgatcctgatgttcttcatcatctcccccaaagcaaatccggccttaaaagcgaacagcgcccaggcagctattgggaaatacctctcctatgcttttatcgggctgctgcaggcggtcatggttggcgcggtcgtgttcacgctcggcctcaagccgaacaacatccccctgtatttcctggtcatcatcgtgatgtccttaaccgcgatcgccatcgtgcaaatgctcatttcactgctcggggacgcgggcaggctgatcgccatcgtgttattgatcctgcagctcacggcggacgcgggcacgttccccttggaactcgttcctaatttcttcaaggtcctaaacccgttcatgcccttcacgtactgcgtcactgccctgcgcgaagcgatttccggtacgaatatcacgctcatctggcaatgtatcggcattttgcttatcttcctcgccgtcttcctcacgctcacgatcatctttaagaagcgcgcggagaagatgcaggaacgggtcgagcagctgcggtttacggaataaaagctacatacgggataaagaaggggtgcgcgcgccccttttttattttctgcaaatttgtttataaattgtttatttttacatgctatattgtatattaggtgagtttcgtatattattttactagctgagggaattgcttatgtcgatatcattctccgaatttctttctcaaatgggaaccaatcccgcatttctgatcaccgttatattaacgcttgccgtcatcctcgtcaatggatggacggatgcccccaacgcgatcgcaacctgcgtttcaacacgggccctaaagcccaagcccgcgatcctgatggcggctgtttttaattttctgggcgtactcgttatgactatgatcaacgctacggtagcctataccatttacagcatggttgatttcggcggcgatccgcacgaatccatcgtcgctttatgcgcagctatggtcgctatcgtgacgtgggccaccgtcgcctggcgcttcggaatccccaccagcgaaagccatgccctgatcgcagggctttccggtgcggccatcgccatgcatggggggttcggcggtatcaacggtgccgaatgggttaaggtcctttatggccttgcgctttcaacgggcctcggctttggcctcggctggggctccggcaagctgaccgcgctcatctgcaaacataaagaccacaggaaaacgactaaattcttccattatggacagatcggcggcgcggccgccatgtcgtttatgcacggcgcacaggacgggcaaaaatttatgggcgtgttccttctcggcctgttcctggcccagggtcaagcgaacgtcacctccttcgagatccccatctggctgatgattttatgttccgccgtcatggcgcttggaacatccatcggcggttaccgtatcatcaaggccgtcggtatggatatggttcatttaaaagggtatcaggggtttgacgcggacatatccgcaacggcctgcctgctcgcgtcttccttaacaggcctccccgtgagcacgacgcatacaaaaacgaccgcgatcatgggcgtaggcgccgcgcggcgcatgtcgtccgttaactggggcgtggtcaaggaaatgtttatggcctggatactgaccttccccgggtgcggtatcatcggttttctgatggccctgctctttatggcgatcttctgatcaaaacagaaaggatttttaaaatatggcacgtaaacgttcttataattattatgaaggatttgttgatttagtagggtattcctgccgcgcggcgcatatgttgaatgatatcttgcaccatttcgatccggataccgtggaagatgtcatgaattccatccacgagatcgagcatgccgccgacaacgccaagcatgagatgatgcaggttctcctgcatgaatttttgccgcccatcgagcgcgaggacgttacggagcttgcgcagtctatcgacgatgttacggacgctgtggaagatgtgatcgtcaaaatttacaccttcaatatccgctccatccggcccgaggcgctcgagttcatggatatcatcgtttcctgctgcgatatgctcaaaaaagcgatgcaggaattttccaacttcaaaaaatcctcgttgctttcggaatgtattatcgagatcaaccgtctggaaggcgacggcgaccttctttacaccaaggccatgcgcgaccttcacgtaaactccatcgatccgattgaaattatggtatggtccaaaacctacaattatttcgagggttgctgcgacgcatgcgaggacgttgccaatacgctggaaagcatcgttatgaaaaacagctaaaattcatcctgcaatcaaaaaccgcagcctcttggctgcggttttttcatttcccattaatcacgatatccgtttttctttgccttttgcacctttatgatcaggaacaccgcaagggccgctactgcgatcccaacgatgaccagcaccagtatcacaggactgataccgctgtcctgcgtttgctcttcggcaggcgcagacggcattgggcttgccgatgcacttgcgtccgcagacggtgcggcggacgttactgcgggaacggtcgcctgcgtatcggacacgtccgaaatgatcaatccgccgtttccatccgccttcaggttcagatacacttcctttgcatccttggaaatactgagcaccaacgcgccgccctgcgaagcgattcccgtcacagagcctacctgtacctctacctccgcctcgccgacaagcgtgccgtctgctgccgttgccgtgatcttatgcttccctttggaaaccgcagggatctcaaaatatcctttgacgtccgttgcatcgctgagcatacccttgctttccaggttcaggctttccaccgtcgcatccaccaaggctttgccgctttcatccaaaagataaccgttcaggcacggctcattttggagctccacaggcttttgatgccctttttcatccgttttcttcgcttccgtttttccaggccggagcggatcgttcgataccttttctactacaatatccgtcttttcatcaccgtccggatttacatttgcggacataaaaatatcttgtgtccctttttggtatgtcaccgtataggcgttgtcctgcacagcgatcgccgtcgcgtcgccctcgctgaactccagcttgcaggtgccgcgcgctttgttatccgtatcgtatacacgcatggtctgcgtatcgtccggcacaatattggaaaggtaaagcgtacctttggcatttgccgtttttttatggtcatcccccagcgttaccgtgtatccgggcagcgccattccttcatcatccatcaggtaaaccttgacgtttaccttgtccggcgaagtggtaggcgcaggcgtcggaacctgcgtcgggactacgcttgccgtcggcgtgggagtcggcgcttgtgtcggtgccggtgtaggtgcagacgtttccgtcggcgtaggagtcggctccgccgtgggtgtggccgtcggatcaggcgcggacgtgggctcaggcagcacgccgtccacgacagccgtcagcatgatcatcccgtcctccggcaccgtcatggcaaaatcgaccgccggcgtctcccggttgatattgacctcatattcatacggcttcatatcgccgggaatgatcggccctgccgatgcggacgcactgctgtccgctgatccctgcgccgaaccggtcagttcagatatggtgccgttcctgatcgcggcacagacctcccccgtgccaagcggagaagtattatccgttgccaacgcggcatttttggccccccgcagatccagcgtcgtttccactttcggctggttcaaaatttccgttttttctgccggatataagtgtatccgtaccgcacccgtaagcgcgccctcctgcttctttgtcacaagggcaaaatccgaaagcggtacgttcggcaggaacagctttccatcctggtccgtcacgtcgttatagacatattccgtgtcgctgtcctcctgcaggaaaacatcgatccccgcaagcggctttccatcgctgtccgtaaatataaaattcattccaatagaaggaagcacaacctcgccctgctcctccgcttccgtttgcattacttccggctctgcttccgcgaaagcgggcaaaacgaacgtcgcaatcagaagcaccgcgaccaatatgcacagtatcgcttttttctttttcatagatgtccccttccccacaatcctgcttatctcatgtatacgttggttatgctttcatcataacacacgcgccaaaaaacgggaagcattccgcttcccgttttcgtatgtttcgctattccgttaccgcatcctgcccaaacgaacggattttctcataccgtttcgtgagcagcttatcgatcggttccttttgcagttcttttatagtatccgcaagatactgtccgatgaccttcgcgaactttccgttatcgtccgcctgtgcgccgcccgcaggctccggaagcacatcgtctacaagtcccatctctttgatctcccctgccgtcatgcgcatcagctccgccgcctctgccgcacgcgaggaatccttccacaggatgctggaaaagccctctggcgaaaggatggaatacagggagttttcaagcatcacgcgcttatcggcaacgccgagcgcgatcgccccgccgcttccgccttcaccgatgaacaggctgatcacaggcgttttcaaacgcgaaagttccatcatgttccgtgcgatcgcttccgctacgccgcgttcttccgcaccgatcccgcaaaacgcaccctgcgtatcaatgatgcacacgaccggacggtggaatttttccgcctgccgtaaaaggcgcagggatttgcggtatccttcggggttcgaacatccaaagttacgcgccaccttatcccgcaggtcggttcccttttcctgtccgactaccgtgaccggaatgtcgcccagatatccgatcccgccgatcatcgccgcatcgtccgcgaacaatttatcgccgtgcatttccatgaaatccgtaaatacgtgctcaataatatattgtgacgtaatcctcttcgggtcgcgcgctatcctgacgatatcccatgcagaacgtttctcactcatttcgcgctccctcctttatgcattttcaaaagttttgtaagcgtatcttttaattcgccccttgggacgatcatatccacaaaccctttttccagttggaattcggaggtttggaacgtagccggcagcgcctgcttgatcgtctgctcgatcacgcgccgtccggcaaagccgatggtcgcattcggttccgcgatcgtcacgtctcccagcatcgcaaaacttgccgtaacgccgcccgttgtcggatctgtcagcaccacgaaaaacggcagccccgcttcgtcgagcttggagaggactgcggccgtcttgctcatttgcatcagtgaaataagcccttcctgcatgcgcgccccgcccgaaacggtgaacgccacaagcggcagtttcttttccatcgcatactctgcggcaagcgtaaacttttcaccgaccgccgcgcccatggagcccatcataaaaaagccgtccatcaccgcaatcacagcgtcttgtccgccgatcttgcattcccctgtgatgatcgattccttttcgttggtataaccgcgtattttctgtattttctgctcgtatccaggaaagtctaaggggttggagccgatcatgtccgcatggagctcctgaaacgtatcgtcgtccgccgtatacatgatcctctggcgtgcgcttaaacgaaaatgatgattgcagttggtgcacacgttgaggtttgcgatgaggtcgtccgtataaatgaccgcgccgcactccggacacttttcccacatgccctcgacttgttcttcgtcatgcgcgacgggcagctccgcttcaaggtctgaaggctctatcgtttgctgcgcctgctggttggtgcggtatacgcgcatcgtgatatcttttcgttttttagaaaacaaacccatttgttattttccctccataatacgcccgacaagtccggtgtccagccttcccgccatcacgtcctcgttgtttaaaaggtcgagctggaaatccgcattggtttccacgccgtccaccacgagctccgttaaggctgcgcgcatcttcgccatcgcccgctcgcgcgtaggcgcgtggacgatgagtttaccgatcatactgtcgtatgtcggcggaattttgtaatccgtatacatcgccgtgtcaaaacgcacgcccggccctcccggcaggtgcagcgtctggatcgttccgatggacggcataaagttcttggtcgggtcctccgcattgatgcggcattcgatcgcgtgccccataagcgggatatccttttgttcaaacgacagcttaaggccgcttgccacaagtatctgttcgcgcacgatgtcgatccctgtgatcatttccgtcacaggatgctccacttgtacgcgcgcattgagttccataaagtaatatttgcccgagggctcgtcgtataaaaactcgatcgtccccgcgtttttataccccgaagcctgtgccgcacgtacggcggcttcgccgatctccgcgcgctttttatcgtcaaacgcaatgctcggcgcttcttccatcaccttctggttccttctttgcaaagaacactcgcgctcgtaaaggtacacggcgttcccatggttgtcgcacatgatctgcacctcgatatgccgtgcgtccatgatgcatttttccatataaagcgtgccgtcgccaaatgcgcccaacgcttccttatatgccgcgtcaaatgctttttcaatgtcggcttctttgtcgaccttgcggataccgcgtccgccgccgccgttcgcggccttgatcatgaccggatatccgaccttctttgcgatccttttcgcgtccttcgcatccttaagtgcatcgagcgaccccgggatcaccggaactttcgcctttgtcatgatacgccgcgccatcagcttatcgcccatcttttccatcgcttccgcgtccggcccgataaacgtcacattgcttttgttgcacatacggacaaatttcgagttttcggacaggaaaccataccccgggtggatcgcgtccgcccccgaaatactcgccgccgataaaatactgtacgcattcaggtaactgtccttgggcgccggcgggccgatacaaagcgcttcgtctgcaagctgcgtgtgcagcgcgtttgcgtccgccgtagaatataccgcaacggtttctatccccatctcgcggcacgcgcggataacgcgcacggcaatctcgccgcgattagcaatcaaaaccttgtttatcattcgtgttctccttcaaatacgcgggtttcttctttttccgcgcagattattgctgtaaccgatcttttagtcctgctttacaaggacaaacaatatctcgccttcgcaaaccactttatcatttaccgtagccttgaccttgcccttgccgcccatgccggacagcctcaagatttccgtttccaaaataaggtcgtcgcccggaaccaccatcccgcgatagcgtacgccgtcgatcccgccgaatacggcaagacggcccgcaaaacgttcctcctgcaaaatcgcaaccgcgcctgcctgcgcgagcgcttccgtgatcagcacacccggcaaaatcggattgcccggaaaatgtcccttgaaacaaaacaggtcctcgcggatatgccacaatgccttcgtgcgcttaccgacctcgcattcgatcacctcgtccagaaataaaaacgggtcgcggtgcggaatgatttttttgataccttcctgatcgatcatatccgttctccttacctgtagttaaagagcaactgcccgtattccacgctgtcgccctcttcgcaggccacccatgtgatctcgcctgcttcgggcatcgtgatctcgttcatcagcttcattgcctcgaccatgcaaacgacgtcgccctttttgaacttatcgccgatcttgaccgctttgccttccgcaagtttatggtaaatacccacaagcggagaggtgatctccttgcccctgtcctctgccgccgccacttcgcttgcggcgattgcggcttccggcgctgcggcggcagccggagctgcaggaaccgcggccggcacggctgccatcggggcagagggcgccgcgcttgtcgtaacgaccacctgttgcggcggcgcgtttacggcgcgttccagtttcaagctgaaatccttgtcgctgagttcaaatgtgtcaaagccggatttatccgcggctttcaaaagttccagtatcgattttaaatccactgttttatctcctatcttataaaagattaatcaacttttttaaagagcagcgccgcgttgtgtccgccaaatccaaggttatcggatagcgcgacatttacgtccgctttacgccccgtatttggcgtacaatcgaggtcgcattccggatcgggcaccttgtaattgatggtcggcggaatgaagccgtccctgatcgccatgatggaatagatcgcttcgatgccgcccgccgcgccgagggaatgccctgtcatggattttgtagacgaaatcgccaccttataggcagcctcgccaaatgcgcgtttgatcgccatcgtctccgttttttcattcaattccgtcgacgtgccgtgcgcattgatataatcaacttcgcagggctttaggcgcgcttcgctcatcgcagcctgcattgcctttgcaagcgattccccttccggatcgggcgccgtcatgtggtatgcgtcgcacgtcgcgccatatcccgctacctccgcatatatcttcgcgccgcgtttttttgccatttcatattcctcgagcacgagcacgcccgcgccctctgcaatgacgaagccgctccgctctaagtcaaacggaatggaagcccgatcgagctgatccgttgtcgtgaccgcatgaagccccaaaaagccggaaatcgcaagcatcttaatgggcgattccgcaccgcccgcgagcattgcgtccatataaccgtctttgatcatgcgaaaagcgtcgccaatggaatgcgatccggatgcgcacgccgttgtaacggtcgtgttatatcccttcaaatgatgccggatcgccagatggccggatgccatattactgatcatcatggggatcaaaagcggatttacttttttaaagccccgttcgttgagctttgtaacttctttttccatcgtatcgaggccgccgatcccgcttcctacaagcacgccgaaccggtacggatcgtaaggattattttcttcgctaaatcccgcgtccgccatggcctggtcgcccgcgatcacaccgtactgcgcatattcgtccatgcgccgcgcctcttttttatccagaaaatcgagtacgtcaagatccttcagttgtcctgcaaaatgtatgggaagaccttccgcgcccgcttttgtaagcggcccgatcccattcacaccatttttggtattctcccacgcctgcgcaaccgtgttgccattcggcgaaaggatacctaatcctgttacaacgacccgtcttgccatagattatttctctcctgcttatgttttctatatacatgttagcgtgcccagggctgatgcagtactgcgcgcgcttatgtgtacatgccgccgtttatggacagcacatgtcctgtaatataaccggcctgcccgcctgctaaaaacgaaaccgcatccgcgatatcatccgcagtcgccccgcgtccgagcgggatgctgccaagtatttcttcgcgcgctttttgcggcatcgcatccgtcataggcgtttccacgaagccgggggcaatggcgttcaccgtaatgttccgtgaaccgatttccttggcgagcgattttgtaaatccgatgatgcccgcttttgacgccgcgtagttcgtctggccgccctgccccgaaaggccgactacggaagccatattgatgatgcgtccgcttctctgcttcatcatatacgaaaccgcatgacggcagcagttaaacacgcttttcaagttgacgttgatcaccgcgtcaaaatcctcttccttcatccgcgctaaaagcccgtcgcgcgtgataccggcattattgacaagaatatcgatggtgccgaattcttccttgacctgttccatcatagccttgacttcgtcgaatttgctgacgtccgctttgatcgcgaccgcctttacgccgaatttttcaatctctgctacggcgcctgcgtaatcttcttcatcaaacaagtaatttaccaccacgttattgccgtcttttgcaagccgcagcgcgaccgcccttccgatcccgcgcgacgcacccgtcacaactgccgtttttgccatttccgtatcctccgcatcaaaacttttcgttaaaatcccatttgcttaagcgcttccactgtcaacgaaaacgactcaaagtcattgacgttaaatgtctgcgccccatcgttgatccgtccgacaaagcctgtcagggtcttgcccgggcccacttccacaaacgtatcgtatccgtccgcgcccatggcgcgaatgatctgctcaaacaggacaggatgggacgtctgctctgccatcacctgtttcatgtcctctttttcgtaaggcctgcccgtacggtttgcatataatgtaaacgccggatcgccgaattccatatctttgatcgtatctgaaatcttccccgccgcttcgcgcatatgggaagtgtggaaagcgcccgaaaccggcagcttcctgcatttgattttattttcttttccataagcgatcattgcgtcgatacggtccgtatccccagccacaacgatctgccccgggcagttgtaattgaccggcaaaagtacgccgccttctgcgcactgctttgcaagctgctctaccgcctgcatttcctgcccaagcaccgcgcacattgcgcccgcctgtttttctcccgcctgctgcatccactgcgcacgcttcatgacgagtgaaagcgcctcttcaaacggaagtacgcccgccgcataaagcgccgtgtattcccccagcgagaaacccgcgcccgcagacggacggatcccctgcgcgtaaagcgccgcatatgccgccgctgatgccacaaaaacggcaggctgtgtattcactgttctgttcaattcttcctgcgcgcccgaaaaacacagttccgtgatacccggccgcaccttttccgcccttaaaaatatctcgcgcgcagcagccacatgatcatacaggcttttgcccatacccgtcttttgtgcgccctgtcccgcgaaaagcaccgcaagtttacccaaaggttttcctcctcataaaagcacgtccgctatccatttgcagaccgttgctccttttccccatgtcatcgcttaacaataaggatatgcggacgctcatccaaggaagaacgtccgccgcctgaaaacttctatattatatatggatagatggcgtttcttatttgttgtcctcgatgaattttacgaggtcggcaacgctctttaaattctccgcttcttcgatggaaacgtcgaattcttcttcgatatccataacgatttcaaccatgtcgagcgaatcgatcttgaggctctcaaagctggagtccattgtgatctcatctacgtcaatatccattttgtcgctaataattcctgcaatcttttcataaatcatgttcattttcctccaagaaaattaatttattatacgctttaagcgcttttaccattcatacacggcgcatcccgaagaaaggccgccgccaaaacccgcgatcacgagcgtatccccttttttgagcataccctttttgttcatctggtcaagcgcgatcggtatgcttgccgcagatgtattcgacgtatcgtcgatattggaataaaacttatccatcggcattccgagcctttgtgcgatcgtctttgtgatacggtaattcgactggtgcatcaaaaaccagtcgatatcctccggcgccttgcccgtcgcctcgagagctgcacggatcacccgctccgcttcccgcgttgcaaacacgtatacttccttgcccttgagcgtcgcatacgaaggctgcactacgccgtctgcgagagtattcatgccgttaatcacgatcgtctcattgacgtccggcttggaatatacttcgaagtactccatattatcgccgtacgttgcgatcactgcgcccgcgccgtccccaaaaaggatacaactcgcacggtcttccatattcataaagcgggacagcgtttcgctgccgcatacaaggaacggcttgccgtccggctttaacagcccttccaccgcctttaacgcgaacatgaagcctgtgcatgcggagttgacgtcaaagcaaatcgcctccggaatctcgagctccctctggatctggctcgcaaccgacggaacccccatctcgtttgtaacggacgccacgacgataccgccaaggtcgtccttggtgatacctgcttcttccattgcaacctttgccgcgagcacgcacatatccttgttccacatgccgttttcaacgtaatgacgtcgcttgatacccgtgcgcttggtgatccactcgtccgatgtatctattattttttcaaagtcctcgttcgtcactaccttttcaggcagataacttcctgtacccaggatacgtatacccatataaccctccaatattgatgtcattcccatgctgcaatttagtaagcaaaatttagacagtataatgatattctaatctactgtaaatgtcaacaaaagcgaggagcagtatgcgcgcttccccgcttttgaacttgtaatcctttacctggcgtttttctttgtatagttcaggagcccgccttccagaaggattttgcgcagacgctccgaagcctcaagacgtaccctgaagctcgcatctttcgtttcattgcgcacagtaaaaatatccttgccgtcgacattttcacgtacatcctcgattttcagcacgtcgccctggtcgatcccgtcataatccgcctcgtctacgaacaccaatggcaatatcccgctgttcatgagatttgccatatggatacgcgcaaagctcttggcgatgaccgctttcacgccgaggtagagcggcgcgagcgccgcgtgttcccttgacgagccctggccgtagttgtgccccgcaacaaggatcgattttcctgccgcttttgcacgcgcagggaacgtctcgtccactggcgccaggcagaaatccgaaaggtacgggatattcgagcgatacggcagcagcttggcgttggaaggcataatatggtctgtcgtgatgttgtcctccattttaagcatcacttccgcttcgatctcatccggcatttccgaattgatggggaagggcttgatattcggccccctgatcacttccacctcgcacgcgcaatccgcgggcggcgcgatcatattatcgttcacttcaaatttttccggcatttccacatcgaggatggaaaggtctgcaaactccagcgcgtcgcttaaatatccgttgatcgccgtcacagccgccgtttccgggctgaccagataaacgcttgcgctctttgtcccgctgcgtccaaagaaattgcggttgaacgtacgcacggaaaccgcatccgtcgcaggggactgtcccataccgatacacgggccgcaggcacactccaaaatacgtgcgcccgcgtcgatcatactgctgagcgcaccatttttcgccagcatgttcatcacctgcttggaacccggcgatatggtaaggctcgtatgcggggaaaccgttttccccttgaggatggccgccacgcgcatcaggtcgcggtacgaagcgttcgtgcagcttccgatacatacctgatccaccttgatatttccgatctcctcgatcgtctttacgttgtcaggactgtgcggcatcgccgccatcggctttaacgcgcccaggtcgatcacaatatgctcgtcatactgcgcgtccgcatctgcactcaatggtttgaaatccgcttccctgtcctgtgctttcaaaaattcacgcgtcacctcgtcgctggggaaaatggacgtcgtcgcgcccagctccgcgcccatgttggtgatggtcgcgcgctcgggtacggacagcgttttcacaccctcgcccgtatattcgatgatcttgcctaccccgcctttaacgcttaacacgcgcagcacttccaaaataacatccttagcagaaacgccgggcatgagttcgccctttagttccacgttcacaaatttaggacaattcaggtaatacgcgccgccgcccatcgcgaccgcaacatcaagcccgcctgcgccgatcgcgatcatgccgatcccgccgcccgtaggcgtatggctgtcagaccctaaaagcgttgcccccggcacgccgaagcgctcgagatttacctggtggcagatcccgtttcccgggcgcgaagcatagatcccgtgctttttggccacgctcataatatagttgtggtcgtctgcgttctcaaaaccgctttgcagcgtattatgatcgatgtatgcgaccgatttttttgttttaacacggtcaatgcccattgcctcaaactgcagataagccatcgttcccgtagaatcctgcgtcaatgtataatcgatgcggatggatatctcgcttccggggatcatctcccccgatacgaggtgttcttccaatattttataaccaagcggctttcccatctttgcccttacctccgttttttcattacaaataatatgttgtttattttatacgcaaaacgaacttttttcaagtagtagcggttcctttttggcgcgtctccatttataatagaagaaacggatgggagaaaatgttttttatcccgcacgatctgttatcaataaacaaaaggatggttttgctatgctcacactctggggaaagattttaacggacggaaaagtgctgaaggcagatacatacaccagtgaaaaggaagatatgtcagacgcgcttttagacgccctcgagcatttctccaaggaattcgatatcgaggtgcccatgtggcatacagcgcacaccaaacagctcgggctgttccgcaaggtcatgttcaaacaggatgattttatcgataaattcccatacgacaggttcgagatgcagatcatcgataaatagcgcggcgcgcagcagccgcaaagctgcaattcgtcttacgcaaaaaaggcataacggaaattccgttatgcctttttaaaatcactcgtttacattttttaaaacttattcctgtctccgtatccgctgccgctgtttttcccgcgcggcttttgctgtcttggctgcgattgtctctgctgccttggctgcggacgtggttcaatagactcgtgcggcatgctttgcttctgccttggctgcggctgtctttgctggctcgccttctgttgcgtacgttccgcatatccacgttcctgcttcggtcgctgtttgccatttttcccgccgccggcttttttgtttttatgtaccatcacaccaagggcgaccgccacgcccacgattgcgcatatgatgataatcatcaagataagcaggttcatcatgccgcctgccgtttgctgtttgacagtaaccgtagcagtcggtatagacgtctcgatcgtcgttccatccggcagcgtagcagtcagcttgaacgtataactcgccgtattcgccacgctcagcgtatacggtatcgtcttttccgtttccgtcatagaagggatcgtttccaggtctcccagcgtcgtttccgaaatcacaacattggtaagctcctggcccgaattgttttgcaccacaaactcgatgggcatatctcccgctttgcttaattccggcataaagttctgtacgctgagcaccagcatattggatgcgtccacgctggccgaagggctcgcctccgcatccaccttaatctgtatcgcctgcgacgtcgctttgacttcgtttccgtcgctgtccgtcgccgtagcggtaaaggtatagctcccatcctttgtgatcgtcgcttccaaggtcccttcagcagactgtccgtctgcgctcagcgtcttggaatccatcgtcacattgttgccgttctggtctacgacctttaaatttttcaggtcggaagacccgctgttttttacgtcgattacaaagttgaccttatcgccgctcttaactgtcgtattatcacctgttgctgtgatcgtcatcgcggcttttttgtcttcgccggacgccttgatactgatcgtatccagtttgagcgtctttgtttcgccgttcaccttataggtaaacgacggcttgacgtccgtgctcccattcaggacggtcgaccattccagcgtccgcttctgtcctgcggaaagcgagaatgtatcgccgatctgcgcgccgtccttgatcggcggagctttcaaagcgcaatccgtaatttttacatttccgtcgttctggagcacaaaggtaaacttgaccttatcgcccgccttgatcgtatccgtgctcgcgcttgcgtcgcccgatacggcgaccacgctttccttgcgtgtgatcgtgaacggctgcgtactcaccgatttttccgaaccgtcttctgtgttgaatgtcagctcaaagaccatctcgttgccgatcatatcgtcgctgatagcccacgttgaattggtatatgtctgcgtatcgccggacgccatattctcaagcgaagcggtatccccgtttcctggataatgcagttgcacgttcgagatggtcacgccggacgtattgctgacctctatgttcagtttcacattgcccgcacttgcaagcgatgccggactgactgtcgccttgatgcttacgccggccgcagatgcaacgccgccgagcgtcatacacaatgcaagtataactgcgatagtcagtatgactgatactaatttcttcaaaatagcttacctccgctgaaaggccggacgccttatatcgtttcagtccagccgaatttgtctttgatttcgccgtactgtatccctgtcagtatatcataaaattccattgcaagcttgcccattcctccgcccgcaaccgtgaatgtctcgtcgccgtacataaattcgcctaccggactcaccacggcagccgttcccgtaccgaacgcttcgctcatcgcgcccgacttcgccgtttcgatgatttcctccacggaaaccttgcgttcttcgaccgtgatacccatatcgcgtgcgatcgtcataacgctgtcgcgcgtgattccgggaaggatgcacccgtcaagttcgggcgttaccagcttgccatctatgataaacatgatgttcatcgatcccacttcttctacatatttacgttcctccgcatccagccaaagcacctggtcgcagccctgttcatgcgcttccacgcccgcgatcaggctcgccgcatagttcccgcccgttttggcaaagcccatgccgcccttagcagagcgtgtgtattccttttcgatcaggatcttaaccggctgcataccgtttgcatagtaagcgcccaccggccccatcatgatataaaatgcatattcctttgccgcgcgcacgccgatgaacggatccatcccgatataattgggacgaatataaagcgacgttcccttctggtgcgggatccagtcctgttcaatctttaccaactcacggagcgccttgtgcgcaaactcttcgtcaaagagcggcatagcaagacgctttgcggaattgttcatcctcttgaaattatctttggcgcggaacagcgcgatattcccgtttacttgcctgtaggccttcagcccctcgaaaacctcctggctgtagtggaacacggttgccgcaggtgaaatcttgaaatcctcatatttcttgatctgggcgtcgtgccacccctgtccctcggtgtagcgcataatgaacatataatccgaaaaaatcgtcccgaaaccaagcttactctcgtcttccggttttttcttcagttcatccgtccccaaaaatttgatttccatcttcatcatcctcttcactatataaatttattttaaaaaacgcctgtctttatcatgtaacattctcccagcacccgcatgacctccgagccaaaaaaggcttcctgtaccttttttttgacctgcccaaacgaactctgccgcacaatcatgcgcgcctcgaccttttctgaaaactccgcctcgaccttcgcgtcatattcccccgcaatgctctgcaatttggaatagtccgcatattcgactgtgaacccaagctcaaaagcagggatcatctcagccgttttcgcttctttgagcgtttgcgtaacgcttgcggcgtatgcccgcacaaggccgcccgcccccagaagcgtcccgccgaaataccgcgtcaccaccgcgagaatatttgtaagaccgctgtgccgcaatacctcaagcatcggcaggcccgccgtcccctgtggttcaccatcgtccgagcttttctcaaaagacgcatccggttttaaaatcattgcagagcaatgatgcgttgcgttgtaatgcttcttttttaccttgaggagttcttccgccgcctgccgctcattttccaccggaatcaagttgcagataaaacgcgattttttgacgacagtctcgctctcggccctttccgcaaggcacgtatattccctcagccccatgtcatttcaaaacgattttgtgaaagaccttcttgccctttttgatcatcgcttcgccgccctcgaaatcggatggcttcacttccaaaaattcatccgcgactttttcgccgttccaaagcacgccgccctgcgtaatgagcctgcgcccttcgccgcgcgacttcgtgagccccgccgcgatcataatatcgagcaattgcgggtgttctgcaagctctgtttgcgataattccgtcgccggaatgctgccgcctgcgccgccgctcccaaaaagcgcttccgccgccgtctgcgcctgcatcgccgccgcatcgccgtgtacctgttttgttatctcaaacgcaagtatcttttttgcatcattgatctgctggtctttgagcgcgctaagccgctgcacttcttccatcggcaaaaacgtcagcagcgacaggcacgtcttgacgtccgcgtccgccacgttgcgccagtactggtaaaaatcatacggcgacgtcttttccggatcgagccatacggcgcccgattccgtcttgcccatcttcttgccgtcgctctttaagagcagcgtgatggtcatgccatacgcctctttctgctccttgcggcggatgaggtcagcgcccgctaaaatattgctccattggtcgtccccgcccatctccagcgtgcagccgtatttacggttcaagaccaaaaagtcatatgcctgcatgagcatatagttgaattcgaaaaatgtcagtcccttttccagcctttgcttatagcattccgccgtcagcatcctgttaacagagaaacatgtaccgatctcgcgtaaaaaatccacatagttaagatccagcagccagtcggcattgtccaccatcagtgctttgccgtccgagaaatcgagaaactttccgatctgttcgcggaaacggtctgcgttatgcgaaacgatctcgcgcgtcatcattttgcgcatgtcggatttcccgctcggatctccgatcatcgttgtgccgcctccgatcaaaacgatgggcacatgtccggcgcgctgcatatgcgccattgccatcaattgtacgaaatgccccacgtgcaggctgtccgccgtcgcgtcgaacccaacgtaaaacttcacgctctgcttgccgagcatctcctttaacccttcgtgggtcgtctgtttaatgaatcctctttcctgtaatgtatcaaaaacgtttgccatttatctaaactcctaaaattttgcagttaactttcctaaaagcgctcacgatccaatggattttcagacaaactccctgatgatccttcccatcttttccacacccttttcaatatcggggatagtcggcatggaaaaattcatgcgcagcgtgttttcgtgaccgccctccgcaaagaacggaggccccacgacaaacgcgaccttctgcgccacgcatgcgtcgaacacctcgcgcgcgtttaccgtctccggcaagctcacccacacgaacaatccgccgtccggatccgtgcgcaccgcgctctgcggaaaatatttgtcgatcgcgccgcacatcgcgtcgcgctgtttcttatattctgcgcacagcattttgacatgctcgtcataatatccgcgctttatgaactccatgaccatcgtctgtgtcaggtttgaggtatgcacgtccgccccctgctttaggaggttgaatttcgcgatgatgtccctatgcgcgatcgcatatcccacgcgcagtcccggcgaaatcgtcttggaaaagctcgccagcttgcacacgattccgctctggtcgtaagacttgatgcttaacagcggctgcccgctgtaccgcagctccgcatatgggtcgtcctccaaaatcagcacgccgtatttttcgcaggtgtcgtacaccctctgccgtttttccgcgctcatcgtgatccccgacgggttctggaacgtggggatcgtgtataaaaacttcggattatattgcttgatcttttcctcaagctcctccgtgtcgatcccgtccggctgcatagataccgtcttgatatccgcgtccgcaaggcggaacgtttgcagcgcgcccaaaaaggacggcgactccgcaagcatcacatcgcccttttcgagcatcgtgtgcgcaaagaaatcaatgccctgcgacgaacccgaagtcacgacaatgtcgtccgtttctttcatgatgtcttcattgcggtatttcaaaagctcgataaacgccggaacgcccagcgttccgccatactgcagcacgctctttccgttctccgcaataatttcttcgctgatctccgcaagcgtttcctctggaaacagctcgggcgacgggttcccaccggcgaacgagatcatgtccggaacagccagcaatccgaaaattttacggatctcactgccgcccacaccatcaaagcgttttgcaaatcgatacatcagttctttgtcctctcataaaaataagtatacatctagcattatagccattttcccgcgtaaatacaagacaaaatgaaaaccattttctgttttttgcaacttcaaatttcagaacttgcagtttttgctatttttccgggtatatctatcctgtaatgcaaaaaagcggagcatgacttgctccgcttttgcataatccgcttggtttattttcttcatgtatccatacaggtatctgaaaattccgccgaacacacgattttttccagatcgcggtcgctgtcgatctgttctgctttccataaaccgtgtatgttgcaatacgcatacacctcgacgaccttgtcttgattcagcgtaaaaatcgcctccggcaggtcatccggcgtattcgtgcggtaaagcccgccgtcctccgtcctgaccaatatccactcgatataatgctgcggggtcatcgggtgcggcgcctttcccacctttacatggagcgtatcccctgaaaattccaatacggggacgtgcttttgcgggtcgccgctcgccgtatccgtgctgagcgcttcaaggccgtcaaacgtcacttcgttgcaattcagttgtacgagcgtcgcgtcgttttgcttacatttataaatattcacagttttcattgcttttctccttggtttttctattcaataaaccactttcgcttttcggaaacacacgggcttgcgcctagtccagatagcgtccgatgaaggcctccgccgttttccagtaaagtcctggctccagcgtcgcagattcgctgtgctgcgcgccgtgtaccacaagcttttccttctcgcacgccgccacgccatacacctctccaagcataaaaaacggtacaaaggtatccgcgtcgccgtggatgaacagggtcggcgtctgcgattttttcacctgctccaccgaggacgcttccttgaaggaataccccgcccggcgctttgccatcccgttcgcgatatgcatgatcggaaactgcggcaggccgaacacctttttcagttgtatcgtgaattcttcccatacggaggtgtacccacagtcctcgatggccgcgcgcacatttgacggcagcgcttcccccgtcgtcatcataacggtcgccgcccccatcgataccccgtgcagcacgatctgtgcctgcgggtcttttttcaggatggcgccgccgatccattgtatgatgtccttacggtcgagccagcccatgccgtaataattcccttcactgtccccgctcccacgcaggtcgggcaaaaacacatggtagcccttatcatgccagtgctttgcggccacgccaaggtttaggccgcttcccgaaaacccgtggatacaaaccatccacacatgagatggttttgcgggcggaagctcgcgcgccacaagcttcaggccgtcaaacgccgtctgcgtatgcatcacaaaatcctgtcctaagagccactcgcgcgcccgcgttttttcgtcctgctccgcctgtgcgtccgcgtccttcttgtttgcatttgtcttgaggactttttcctttgtctttttggcgttcaccgcgacgtcaaaaattttgttcgccgccaccaatacaacgataaaaaacactacgatcactgccgcgatcgttatccataaccatgtcatgcaaaaactccttcggttccctgatgttttccgttttatagataccctgttctgcaggcttttaatcttccgaattgaggcggtcaaatgtttacgctgcacttcgaacacccaactgcgcttcgcgctgttaaacccgttcgcgcaaacgcttggccgcttcatacatacgttattttcggttgctcaatcccaaaatatagtccgccgacacgcggtaaaatttcgcgagcgtaacgaggtgcatgatcggcatttcattctcacccatctcatacctcgaataaacttgttgtgtggtttttaagatttcggctatcttagcttgtgtcaaatcatgatcttcccgcaattctcgaatgcgaatttgatatgttttttccatgttcatcaccttccacaaacatcttatggtacatcacatccgatgtattgattacacacttaaaatagtgtattctgtatacactacattaagtgttagaggtgatcccatggacaaacaaacgacctgctgctttaccggccaccgcccccacaaagtcccgctgctcggaagctgagccgatccgcgttacaaagagctggaaaacgccgtcgccctgcttgacccgcacctttacggcggaacggcttatacggtgtcgctcgcgcgcaaaaacaggctcaatgttgtggtcgtcgacgtatccccatgaaattcgcaaaaatataatgactatcccctttggaatatgctataatagcccttgtatgacttagtatttcattattaaggtaatcaatttttaaggaggtaaaaaatcccatgcaatactcaaaagaagtagaagaaatggtatgcgtgaaaaagggacctcaccacggccctgctccgatacccgaagaaggaaaatgggtaaaatccaaacagatcacggacatctccggtctcacacacggtgtgggctggtgtgctccccagcaaggtatgtgtaagctgacgctcaacgtcaaagacggtatcatcgaagaagcgttgatcgaaaccagcgggtgctccggtatgacgcattccgctgcaatggccggtgaagcgatcgtcggcaaaacgcttttggaagcgctcaacacagaccttgtgtgcgacgcgatcaacacagcgatgcgcgaactctttttgcagatcgcttacggcaggacgcagacagcgttctccgagggcgggcttcccatcggcgcaggccttgaagacctcggcaagggcctccgctcgcaggtgggcacgatcttctccaccaatgcaaagggcgttcgttacttagagcttgccgaaggttacatcctcgagatggcgctcgacaaaaacgacgaagtcatcggctataagttcgtgcgtatgggcaagatgatggaagatatccgtaacggcgtagaaccgaaggtcgcttacgagaagaacatcggtacttacggcagatatgaagacgcggtcaaatacatcgacccgcgtaaagaataaggagggcgattactatggcaacatttgaaggttatgaaagaagaattgcccagatcgaaacctgcatgaaggaatacggtttttcttctcttgatgaagtaaaacagtacacgatcgataaagggctcgacgtagactccatcgtgcgcggcatccagcccatcgcttttgaaaacgcgatctgggcatacacgctgggcgcggccatcgcactcaaaaaaggctgtgcaaaagcttccgaagcggcttgcgcgatcggcatcggcctgcaggcgttctgcatccccggttctgttgcggagcagcgcctcgttggcctcggccacgggaacctcgccgctatgctgcttgaagaacagacaaagtgcttctgcttcctcgcgggtcacgagtccttcgcggcggcggaaggcgcgatcggtatcgcaaagacggcaaacaaagtccgcaaggaaaacctgcaggtcatcttaaacggccttggcaaggatgccgcgacgatcatctcccgcatcaacggcttcacttatgttgaaacggattatgattatgcgacaggcaagctcaacatcgtttccgaaacgaagtattcggacggcgaccgttccaaagtccgctgctatggctgcgacgatgtaaacgaaggcgttgcggtcatgcgccacgagggcgtggacgtttccatcacgggcaactccaccaacccgacgcgcttccagcatccggttgcgggcacctacaagaagtgggcgatcgaaaacggcaagaaatacttctccgttgcttcgggcggcggcacaggccgtacgttgcatcctgataacatggcggcgggtccggcttcgtacggcatgacggataccatgggacgtatgcacggcgacgcacagttcgcgggcagctcctctgttccggcgcacgtcgaaatgatgggtctcatcggcatgggaaataaccccatggtcggcgcatccgttgcggtggctgtggcagtggaagaagcggcgaaataaaacgaaaaaccacaaacaaaaacaccggggaaatctctccggtgtttttattctgctattttccctgccgtttttgacgcataccgtcataacgctgcccacagctatcgctatacccgcgatcatcaaaggcgagatattttgccccgtttcctgtgcaaaaaggatatctccccgcaagtgtcagcttcagcgcaatgcataaatcattctcttgcataatttacgcatttttcttccttcctttggggtatggatacatgttctttcttctctgcatttttgccggcataaagctcgcggattgtgcgtcttttcaagtcttccgcttcctttttgtaaagttgctccataaaacggctgaacggatcatcgtctatatttttgtcgccattttcctctgagtggtattcgaaaagatgtaagacatcataaaggctcacgtcttccgagccatgcctcaattggtagccgccattgcgtccctgctccgatactaagagccccgcatttttcagttgtcccatgatctttaagcagtattgataagaaattcccacatgctccacgatttcccctgcggttgtcagggcattcctgcgagatgtgatataccccaatattttcgcagcataaattgtagtaagtttcatctttctttaccttttactaaaatttatattttgtcactatattggccgactgatgtatattgtctaatcctagtatactatttgtattatatatacgcaatgtcttttttattttaaaataaatttatttgcatatgttagaatccaaattattcaggcgttttcaattaaaagcattgtgtctcccagtattattttaattaaaataatatacgcattgtctttttgcattgaaaaaggccttgctgattcgcaaagccttttttagatttataacaccgctaactgattgttatccttttactttaagatgcaatatctcttcaataatcacctggataaccggttttaactcgccttccacaacgatccctttattgattatgcggatcgccagaccagacatcatagtattgatgacgtcaaatacatctgcatacttttccgcaggaacgccgcacctgagaacataatctttcgccattccaccaaaatcaaagctaaggcgctggaaatgttccgttacataccggttcgctctttctcctccttcattggaatagatcaatattccaaagttaggattgctcaccaggaaacggatcgactcctcgcaaaacaccaggaatggttcctcctccctgcgctttttcaccgagctggaaatatgcgcgctcatctgtgttagtatctctgcaacgatgctccccatgagcgcttccttattttcaaaatagcggtaaggaacctgatgcgtgaggccgcaacgcgcagccagtcttctggcagaaaagtcttcgatgccatcttcttttatcatcactactgccgttttcagaagaatatcctttgttgtgttggactccccgcgccttgtcattttacaccgccttcaacaatcccgccgtccaaacaagccaaagccgtttttacgattccacggatgcgttgctccccatcctcgccgttcttatccacagtataaggcatgccctccaacagcgcgctcaacatcatatgtttataggacgccacactccgctcctcatcttcgtccatcaaaaacggataatctgtcacatagcgccatatttcccccgtttcctcaatataatattgcgtcatcgggctttgtgaaaaaatctggctcaacaagcggaaatattgttcatagtaagtatagtatgcccattccagtttcataaaccgttccatcggatccttttccttcaatattgtgtcggaataaaggcgcctcatcagtttgcgaagtactttgtttttgatttcaccatagaaatcgtccgcatcttcaaaataattgtacgggcctttcggcgtcattccacactcgcgtgcaattttccggatagaaatatctttcatcccgtgcttacgaataagttcgatccctttttctatcagtttgtttctttgctccctgcttttttgttcccgcattttttatcatctttcttttttctactagctttatcataccataaaaatcaggttatgtttttgttttgtgcatttttctttgttcaaaatatctgttacgcggtcaacgacctgccgcccgccgatctcctgcaatttctccctatatagatggagcaaaaggcgtttacctgttcgctcgataatcgggtcgtctgtcgataatatcataacaggtaaaagcgattcatacccatggaaatgatcgatactgatttccaacatgaggtcactgtatacgagcgggtcttcaaatatcatcaggttttggattttttctagtccctctacattctgctctaaacatcccaatacttttttatttgacataatatactccttaattatttatagccactatatagtggcggaaagaggcagttatgcaaaaggtaattcaaaatgcaaattttggtcaaaacttaaaaaggattcgttcagaacggagactttctcaaaatgatcttgtaagcagaatgcaggtactaggaagtacgatttcccgtagtgggtattcaatgatagaacttgggacacgcaatataaaggtggcggatttgggaaggtaagtatttgtacctaaatccctgaaaacggggaaggcatgtcgacgcaataaaaaagaccaatgagtaaaattttgctcattggtcttttttgcgtttatcctgttattcgttcttgtcttatggataaccgccatacaccggcgtttttttacttggttaatcctgcttttttttccgtttttctacgagttcgtcaaattcttctacaggcagcggcttcgagaatacatacccctgtacgatgtcgcagccgatattccgcaaaaattccacctgctccaaagattccacgccttccgctactgttttcatgttaagagcctgcgccatattgacgattccccttaccagttccttgtcgcgagacaaattttccccttctcggaaaaacagcatatcgattttgagcacatccatcggcaagtctttcaatatattgagcgacgaatgccctgcgccgaaatcgtctaacgaacacaggaacccgttctcctgaaattctctcacaacactgcggaacaggtcatggttgtcaaacgcaatgctttccgtaaattccagttccacgcactgatccggtatccggtatttgtttttgatgccgatatacctttctaagaacccgggctgcagcatacacaacctggacacgtttacggaaatcacaatgggcatcctaaacccactgtccaaccgctcgcggtacatccggcaaaccgattcaaacatgtattcatccagcttgatcacaaacccgttgcgttcaaacagggggataaactccgagggcgacaaaaagccgagctccgggctgatccaccgcgccagcgcttccgctcccgcaactatgttcccgtgctgtatgtcgatcttaggttgcatatataccttaaattcgccgcttttcagtgccgcctccatccgcgcttcaaggtctgcgtcatgcaatatcttatcccgcattttttccgaataaaacgctacctgcgacccgcttaggttcttgacggatttttgcgctacgtttgcgcggtccatcatatcgttcacggtaaggtcaccgtcctgttcatcgatcacatagatgcccgaacagagctccagcttatatccacggtctaacgtttccggataggcggccagattatcggatatccacgcaaagcggttttccgattcttcgcgcgatgtatattcccgcagtacaacaaaattgtcgcctgtcgcgcggcaaaaaacttccccctcgcgcatgtcagattcaacaagatccgcccaatatttcagcaccccgtcgcccacgtcatacccaaacaggtcattgaccactttgaagtttttcaggtcgctgtaccaaagggaatagcgtttttcctttttgcggccgagctgtttgcgcacatcgataagaaacttcggataattcctgtatcctgtaagctggtccgtaaacgccaatttcttgagcgcgtcgttccccttgtcgttcgtccgcttgatcaatgccatcaataacacaaacacaagcgccgcgccgccaatgatccccgtgagtccccatgtaagcatggtaaatgtctcattgatatcctgctccggaaccacgctgaaaatataccaattattgatctcaagcggcgtatacgcggcccagcgttcctcgccgttatacggatattccacaaaaccgctcttccccgcgccgatgtcttcctgcattcgggctttttcgtcctcggaaaaagtgtcaaaatcatatatattcatagcctcctggttgatagatggatggtttgagcgtatcacataatttccttggctatctatgatacttgcaaagccttttccgccaaacatggaagtatctatgatttcactgaatacgcctgagttgtttacggcgcataatacctttataacctctccgttgtgccaaatcggtaccgcataataattcacccagaagtcgccctctttagccttttgcgtcatggtgatgacctcttcccctgcaaaggcccgttccacaaagccattatccttcaggtcaacgtcctcatataccgtgccgtcaatgtctacgccgtccgtaagcccgtccctgtccgtaaatcccatgcggatgaacgcattgttttggttaatttcattgaggacaggcagcaatgcctcaaaatccggctcatccatagaaccgaggatccccgcgatgcctttaagcgtctggaaatccccctgtatttgtttatccaccgccagcttgctttgctgtgcgacttcctgcatatattcccgcgtttccttttggttttcatcaattgcgtaacgcaaaaaaagcacactcgccaataagaatacagcacatgcgatcacagcaatgatatagattcgttgttgaatgatcttttgctttttttccatataattcccgtccggtattaaagcggacccgaacacacgggttacatacccaaaatgcccgttaatttatcccgataataataccatggaaacacattcagggcaatcacaaaatctttttgaaatattgcatatcgcgcagtttgaatccattttctataattatttcatcataattgtccgcaaaaaaatctttcacaacgtgggcggcgccaaatccgcacttttcataaaatcccatgcatccacgcggggatttccctgttcctacccacatcacgcggccaaggcatttataataggaaaaaagatgttccaccattttcctgccatagcctcgcctctgcatttccgcttttaccgcgaggtttttcagttcatattccgcctcggcttcttccatcaccacagccacgcagacggcatcgccgttttcttccataacaaaaagatcgctccccgaaaggtagcgatcaatcattcgctcgctggggtctgccaaaagcaacaagtcaagataacgctttttgtccccttcttcttttttgattacagtcatatatcgtatctcctaaaaccgtactctcctgacggccgtctctttatatttcctgtttgcaaacatcagcaaaaacaggaaggtaacgaccgaataggccgcgctcataaagaacgtccagaacatttgcacaatacccatttccacggcgatcatcggcgcaaaacctataaacagtatcataaaaccgtacagcaggtattcgctccaaagcatcttccggtggcacacgatatatgttgcaagggaaatcatcgccaccgcttcgatcgggatcccgaaaaccagcgaccataatccgccgcccgcattgaggtcgaacacgatcagcatcagcgagatcatacctacctgcacaaaaaacttcacacttccgcgcgttttggagcggaccgtatgaagcaccaaaacccaaatatatcccaaaattacggtcacatccaaaaaccagtagccaccgaccgttccgcgcgtcagtaaattgataaaaccacagaccgctataatcatcatggtaacgatcagcgcttggtaccgtgcatttgtgttggcgcccgtaacctctttttgaatacggtatgcagggtatgtgccacgcgtctttgcgctgctctcaccggtcagctccctaccgcacagcgggcatacgctcccgtccacccttacattacaagattcacaacgattcatcacaattaccccagttattcgtatagatatcgatatcctcgcttacattacgtgccagaaagcggaaaaagtaccgaatcatgtctgcctgctcgatagacctgataaacgagatcgtcattttgccgttcaccgaacacatgcagcagttgatcgggcttctctccgttggatagacgaccgtttccatccgttctataagaggtctcatatcgtccggcagcttgacctctcctacgttcgaaaccgtcatcgttttgacgtcctcgctgaaaaacgcaaatacaaaccgtgttccggcatccctcataaacctagggacgccctgcaccacaggattttccatcacgccgcaactctccgccaccgcgcttttcaggttttcgatttccgtcttttccttaagctgcgccataactttatcaagtatcgcctcaaatgtcaaataccggtcagtaggaaccgtgatattcacgatacaaaagaaattccgcagggtttttgacgggaaaacactgcgcagattcaccggcactgaaatcacgatcggttcttcatcgatcccctcccgcacttcctcatggtaaatagaataaacggcaagcgcggtaaggtaagctgtaatcgtcgcaccactgcgcttcgccgccgctttcagcgcctctacgcctataatcccctgcacgacattatggccgtacggctgaaactgtgtccccttgatcttaaaagcgaccggcgccttcacgatcttctttttatgtgccggatcatgataccgcaaaagcgcatcttccgcttcctcgcttgcaggctcatcttccggcagcaatacgagtccctgcgggtcgatcttctttccttgcagcctgaaatactgcagcagcagcgtttttaaaaattctaccgcgcccgcgccgtctgcaagcgcatggaacatttccagcgaaacccttttcccgtgatacaggatgcggaacaagtatccgctgttttccccttcgccgatcattccgcatgggtaatcctgttccctgaaaatatggaactgctcatctacctgctcaaagtgctgatcgaacgctgtagacgcaagcttgacggtgaacagcgggaagcgtttcaaaacaatatctgccgctttctgcaatagcgcgccgtccacttcctccttgagtactgccgcaatccggtaaattgaagtattcgtttttctggtaacaggcgggaaaagtgttgccgccgtatccagcttatatcccgtatccatagaacctcgttttctttgttcatcccatccggcctttcggctccggacaggagaggattttttatcctctcttattctaccatataaactgaacggaacttctaaagaattcttaaaatatcattaattttacctgtttacgatatcgagggaacccgatacggtattgacgttgagattgatgccgccgtttttatactggttgttcttcatcgcgaagtcgttgcgcgtgcttcccgaaaccgtgtcatacgacaatgtgaatccatcgttttccggcaggataatctctactgaccccgaaaccgaatccgcggaaattttttgcaaatctctcgtgtcctgacacgcaatacgcaccgaaccgcttgtggtgtcggtcgacacctttgttgcggaatccgtgacgatgtcgatagatccggacgtgctcgaaacattcacatccgcgagcgccccctgcaagtgaatgctgccgctcgtggtatctgccttgcattcttccgtcgtaatatcagacacgctgatctccccgctcgtggtatcggtgctcagccgttctctaaaccgtccgccgtccacggtgattccgccggatgtcgtatcaaggtctgcgcgcgaagcattgatgtcctgcatgctgatactgcccgaaacagtgctgatctccagcttgtccgcgtaagaacttggtatataaagcgtgatcttgatgtccttgtttttcgaccagtcggtaaagatcgtgcgtttcacgcggccgctctgcacgagcagctcgccgttcttgataccgtagtgcatgatgtcttcttcgtcaagctgcttattgctcgtttgctgtgcgcggatcatagtatcgtctgaaaggacgacttccacgcgttcttccacaaactgcagcgatattcgcttgattccggccatatctttctcgaaatttgtacttgtctgcgcgtcgtccggcagttggtcaaaaaaaccgtttaagttgatccccacattggaaaacacattgcttacgcctgaccatgcattgttccaccacgtcccgccgatgatcccccaaaccaggatgaccgcgaggatcacggcaaccaccgtccaaattacgattttacctattttactcatatcattgctcctcttattttacattgacctttatgatctttcctgccgccgcgccgatcagaaatatcacccacgtaataaaccatgcatgcgttgtaaagctgatcaaaaaatataataccacgatcgcgatccacattgcgctcgtatatgccgagatcctctggtcgcgtccctgtgcttctccctccggcgtagcggccgcgcgaacgacctgttccattgccgcgccgatcaaaaaaatgatccaggtaatgtaccacgcgcctgttgcaaagctgatcaaaaagtatgccgctaccacgagcaaccacaacgcgctggaatacgccttgcgcctttccatttctttttgctgttgttcatccattgttatcaccccttatttctttgcggaagccttgatgatctgctccacagccgccgcgatcaggaaaatgatccaggtaatgtgccatgccatcgtcaggaaactcaggatgaagtaaagcgctaccaccagcgaccaaaacgcgcccaggtatgccgagcgtttttcatttttggtcttgttctctacctgccactgtttaaagtcttccaccatcgtatcgtccatcttttcatatttagggcgcatcgaactgttataaacgagcagccccgtagcgatggcgatcagggcaaacatcagcgtaaggccgatgatcggctgtccggatgttcccaaaatgatgatcgttaccggtgacaaaatataaagggcaaccgcaatcgccacaaacttcgcagatttcctgcgttcagcttccgtctttgccttgtccgccggaccatagtcgcttgcgctgctaatcaattcatccacgtcgcctatgctgcttttcacgacttcatatgcctcttccggcgtcgctcccgactcgatcaggtcataatatttttccttcaggttcatgaggatttcctgccgcagctcgatcatcttttttgttttgggcgcatccgcaaacaggttttccacatattggcgtaaattttcttccattctttgatcctcccgttatgattccttccttttggtcgttatatcaggctgtcgatcagttttttcgtctttgcccaatcttccttgtttgtttcatataatgcccgcccgagcggtgtcacacggtaataccgcctgcgtgcgcccgtcgtttcgtctccccagtaagattctatcatccccgcattttccagcctgcggaatgcggagtatagcgttgcttctttcagttcatattctccatgcgtcgtctgctggatggatttgttgatctcatatccatagctgtctttcctgagaagctgtgccaatatgattgtctccgtatgcccgcggatcaaatctgatgttaaggacataaggtgctgcctcctttcccagggtgtcgcttccttcgtgggcgaaacatgctgcttccccgcgcgcacccttggctcaaagttgttttccgtcggcttccgcctcgtaaaaccaatttatttctgatgatcataatcgccaagcgatcataccatccgattcgtgcggagacctctgtaatccatgcccacggtatcatcggatcgaaagctatctccgttttcaatttacattatattcatatatacctcgtctgtcaatgtatatttttacaaaagatattatttctttcttgacattgttcctctgctatattaacataacactccagactcattgagtccgaaagcgctgcataaatggaggcgacagactttgacgcaggaaaacatcacagcaggtacggcaaaaccattggacccaaaatacgccggctggcagaagaaggtcatattatttttatccggacagaccgtttcgctgttcggttcttcgctcgtccagtttgcgatcgtctggtatattacgctttccacgcaatctggaagtatcatgaccatttcttccatctgcgcgttcgcgccgcaggtggtgatctcgcttttttccggcgtatgggccgaccgctataaccgccgtttcctcatcatcggggcggacgccatggttgcgagcgcaacgtttatccttgcggtctttttcctgactggccatgacgacctgtggatgatcttcctggtgtctacagtacgctctgtcggcgcgggcatccagacgccggcggtcaatgcgttccttccccagatcgttccgcatgaaaaactgacgcgcatcggcgggctcaacggcagtctccagtcggtgatgtttatcctgtcgccagcggcggcgggcgcactgctttcctttaccgagctggaatataccttttttatcgatgtcagcaccgccgcgatcgcgatcgtcatcatgatcttcctgaaggtgcccgcccatgaaaaagcgcagctcaagcaaaagggcggctatttcgacgacctcaaggccgggctgaaatacgtatggggaagcggatttttccgtgcttattttatcttctacgcgctgtttttcatcctgatcgttccggcggcgcagcttacgccgctcatggtttcccgcagcttcggcgatgaatactggcggctttccgctacggagatcgccttttccgtaggcggcgtgatcggcggcatcgtcatttccgtgtggggcgggtttaagaaccgcatgcactccatcgcgctttgctgtatattattcggtatttttaccgccctcgtaggcattgttccggggttcatcgtattcctggtcctgatgtttttcacgggaaccaccgtaccgttgttcacaacaccttccatggtattgctgcaggaacaagtggatccgaacatgcagggccgcgtattcagcctgacgcaaatcgttatgaccgcgatgatgccgctcggcatggccttcttcgggccacttgccgaccggatgcgcatcgaaacgctgatggtcatcacggggatctgcggcgcaatcgtcggcgtgctgatcttcttcaacaggcacttcaaacacggcctgattacagattagtctttttgtttaataatagcgtatgatttttagaatggaagaggcgaatttcaatggatcttagctaccgtctcggatatcgtgcaatcaaaacggccctcgcagtctttctgtgccttcttttgggttatcttttaaaccgcactgccctgtatgccgtaatcgcagcgatcctgtgcatccagccgacctacgacaaatccaagcatacggcgctgcaccgcattttgggaacgatcctcggttcgctgttcagtttcgttccgttggaacttgcgagcatcatcccgcagtatgccgactactggttcctgctgatccttccagggatgatcctgctgcttatttttgtttgcaatatcctcggcatcaaggattccgttggcccgagctgtattattttcgtagtcatcgtgcttttgcattccggctccacattggatacgcttccttatgttttatcccgcacggcggaaaccatagcgggcgcgctcatcgccctgcccatcaaccgtttcctccttaaccccaaggaactgccgccctgtgacagtgacgacaaatgaaggcgctatactatttatgtatcttcccataccggcggaaaccgtttatactttgtaataacagtcaacatggaggttctgcatgaaagaaaataaatatgacgatcaaaccttttttgacaaatacagccaaatggaccgttcggtaaaaggacttgcgggcgcgggagaatggcacatcctgaaaaccatgctgcccgatttcaaggacaagcgcgtgcttgaccttgggtgcggttttgggtggcactgcgaatacgccatcgatcaaggcgcaaaatccgccgtcggcatcgacatttcccgaaaaatgctcgagcaggcccgcaggcgcaaccattctgataaaatcgagtacatttgttcatccattgaggatgtggattttccgcagggatattttgacattgtgatcagctcgctcgccttccactacctggaatccttcagcgaggtatgcggcaaggtctcttccttccttacgtcgggcggatcgttcgtcttttccgtagaacatcctattttcaccgcttacggcagcgaagactggtactatgacgaaaacggcaatatccttcattggccggtcgaccggtattttaccgaaggcaaacgggattccatctttttgggtgaacaggttgtaaaataccacaagacgctgaccacgtatgtgaataccctgtttacctccggattcatgctcaccggcctcattgaaccgcagccgagtgaagatatgctcgataccgtggcgggtatggaggatgaattacgccgtccgatgatgcttctcgtatcggcggaaaaaaagtaatgcaggaataaaaaagacgaggtgatatcacctcgtcttttttaaattagaagccgtacaccacgcttcgaatttattctcatgagaggaactcatatcgctgactcagaacaggcacgcctgcggcacacgcggcaatttgcttactgctgcttccgtcaggacctgacagggttcacaacgcaacgttgcacaggacccatccatcaacaccaaacgatatgctccataccttacaagaaaaaccctcagcgcggaattcaaccccgctatagcggcttgcgggttacaggacaccgctaactccccgtctagtacggcaaactgaaaaactatttcttacagtccacggaaaatgcattcctcacggcctgcacccacgccgatcattttgaccggaacacccgtatgctgctcgatgaactccacataccttttcgcggcctccggcaaatcttcatatttgcgaatatgcgaaaggtcgggcgtccatccgtcgaactccttataaaccggcttggcttttgcaagcgtttcgagcgatgccggataagtatttactattttaccatcaatgtcatacccagtgcaaacaaaaactttatgaaatccgccgagcgtgtccatgcgtgacagggcaaaccctgtaataccgcttgttttcgcggcaaaatcaacgattacgaggtcaagccatccacaacggcggggcctgcccgtgaccgttccgaattcgtttccttttttgcggatttcatcgcccgtcgcgtcgcaaagctccgtcacgaacggtccttcgcccacgcgcgtcgtatacgccttgactacgccgatcacatccgttatgacctgcggtccaacgccggctcccgatcccacgccgcccgtgttcgggtgcgaggacgtaacataaggatatgtcccaaaatcaatatccagaagcatcccttgcgcgccctcgaacaataacgtcttgcccgcgtcatggtattcatgcagcagggatacactgtcgcatacaaacggccggagatatttggcgtgcgcgcggcactcctccagaatttcttcaaagtcgagcggctcgccgccgtacaccttggtgatgatctcgtttttatcttccacacacttcttaagctttgtcgggaacgtctcttcgtccatcaggtcgcacatccgcaagcccacacgccctgttttatccatatagcatggcccgatcccgttgcccgtggtgccgattttaaaatcgcccagttttttctcattcaactcgtcaagcaccctgtgataaggcatgatcaggtgcgcacggtcactgatatataggttatccaccgaaacgcctcgctccgcaagatactcgatctccattttcagcgcttttgggtctacgaccacgccgtttgcgatcacgcacggtttccccttcgagaggattcccgacgggataaggcgcagcttgtaagtcacgccgtccgcaaccaccgtatgccctgcgttgtttcctccttgatagcgcaccaccatatccgccttggatgccagatagtccacaaatcttccttttccctcgtcgccccattgggcgccgaacactacgataccggccatttcagatcactcctgtctggttcaaaatttatgggcagcgcctacgcgcaatacctttcctataaataaaaaaataccgccgggaacatagcgcccccttgcgatatcctattttagtgtaacaaaaaaaatatatacccgtcaactttttttcacagatgcgagcttttttccgctatagtctgattcacggttgctttttcccgttataaataatatgatatcaatagatgaatacgaacgcgccgcgattattttcagtagcatttatcccatccattcacgcggcagacgaaaggggctcttatgaaaaaaaggatattcttactctgtctggttcttgtttttgctgccttgctgatatcatgcgcggcgccaatcaccttccagacctccggcgcacaatatgaagtcgtcgagatgaagaccgcagagcaattcaacggttccagcgcatcaggcggtaatacgttcttcattatgacgctgggtgtggatgataaaaacctcgacgatgcccagagcgcatttttcggcactgatacgacccgcgcttcagtatcggaaggatctggaaactatgaatgtaagggcatgatgatcgagacagacggcagtcgaacacaggtcgagcttgcgttcgaagtccctgcatcctttgcgcagatcaagaatttcaccctgagcggcaacggcttcggccctgtaaacctgcaaaaataagaatggtatattaaaacgccgtggaaaattccacggcgtttcttttttacatatcacacatgaaaacgcctttgcatctctgcctttaaataccgcagggcaaaccgcagcatacccagtatcgtaatactgcttgcgaacgtagatagcgccatcaaaaagaaggattgcttgacccccgccagatacaaaataagcgggataaagcccatagccacaaacataatcgcatacatgaggtttccgcgccaatacgatttgtggtgataggaataaatgtccagatacgcaatgcccagcgccaagatcaacggcagcatgtattgataggaccaccctgtcctgctgccgacataatcgaacgccatgaacatagcgatgagcgtgaccatctgcaaaagcaccttgatccccgcgaaccaatcggaaaggatcgtcccttttacaagcacccatgcgtaaagtatgggcgctgccacagccaaaaaccacggcgtgccgtcccatttgaagatattgatcgcaatgcaaaggatgatcacgacaaaggtagccagcagcaaatagtccatgacaaggctatggcggtcgacgtaccgcctgcgcgagacctggggatacagctcgttttcatcgggcgtatccgtcagctttttgccgcagagcgggcaattttcataacagctatccacatatacacagcattcgtcgcaaaaattcattttgtgccccatgtgttgcccctcacttccacatccattccaagcgtcttggagaaatgctcaaaaaagctgcgcgtgatatccgtttccttgatgccgcgtgcaagcgtgatcaccattttatcctggtaagagaccaccacgcagttcatcgggttcatttcgctcactcccagcgcataatacacctgtttgatgtgcttttccatcgtttggggaaactgcgccgtcctcaggttggaaagcacgagcgtatacgctccctcgccgtacgatttatagctgcttgaaacgacgatgtttttcatgaaaagcggcgtcatgcgtatgaacggattttgttcgtacttgacgtttttattgatattggcggatatccgttccttcgtcagcccttctttcaactgccgcgatatttcttccaggatctgttcaaaatccagctcgccctctaccgtcattccgacattggcgaacgagataaaattccgcaatgtatgcgacgggaacatactgcgcaggtccatcggtacggaaataatgatcggctgcttgactttccgttctatgatcatctgttccttcgcgatgcagtataaaagcagcgccgcaatgtacgcggatacggtcatgcccttttccttaaccctcgcaagcaattgcttcaggtcaagtataccgtgcgtcaggaaaatcccctcgtcgtcgttgcgcgtccccaaaatatggtatgctttcggctgctttaatttgttgaaatcgcccttggcgtcataatacgtgctgaagctgttttccagttcgtccgcgctcaccttgccttgtgcgtccaataccatgccctgcgcatccatatcgtatccgcacagcttaaaatactcataaagcagcgtctttaaaaactcgatcgcgcccgcgccgtccgataggccatggaagcattccatgatcacgttttttttgtaatatgttatgttgaacagaaaaccgttgttgataaaatctttcaggcgtttgcatggaaagcccgtctcctctttgaccacggggagcgcgtcgttcggttccaaataataccagaacatcccgcgccgcagtgtgaccgcaaacgaaggaaaacgcggcatgatcttcacaagcgcttcctgcagcttgtttttgtccacgtcttcgtcaagttccagcatcagccggaaggtcgtgttgttatgcatttgcgagatggacgggtatattttggccgccgtatcgagctggtaccagtcccgctcctgtggtcgtttgttcatgcttccccttttaaagttgcgctcactctgctcgcttcacgggcggaacatgctgttcccccgtgcgccccctttgctggcagttgttttgcggcgcgttcccgcttgcaaaaccaattcattcctgacgaacatatatattttgaaaaaacaaatacgggaaacctaccatcccccgcatttaatctgttttatttcgttccgaaaaggcggtcgcccgcgtctccaaggcccggcacgatgtacgcatggtcgttaaggccctcgtccaccgccgccacatagatgtcgacgtccggatgcgcttttctcaccgcttcgatgccttccggcgaagcaatgatgttcaccagcttgatattgttgcagccgcgctttttgatgagtgtgatcgcatccgccgcgcttccgcccgtcgcaagcatcggatctaggatgataagctcgcgttcctgcgcgtcgatgggcagcttgcagtaatattcgacaggctggaaggtttccggatcgcggtacagcccgatatgcccaacctttgcgcccgggatcaggtttagtacgccctcgaccatcccaaggcccgcacgcagcacaggtacgatgcccaccatcttaccggcaatgacctgtgtctttgccgtcgtgataggcgtttccacttccacttccttaagcggcatgtccctggtcacttcgtaaaccatcagcatggcaatttccttgaccagttccctgaattcctttgttcctgtgttcttgtcgcggatcattgaaaccttatgctgcagcaaaggatgatccaatacgtgcgctgtcgccatcttaattccctccaactcttttatctgtcatttattttgaatatttcttttcgatgtccgtgatcatatcaatacggcgctggtgcctttcgtcccctgaaaaaggcgtattgacgaaaatatcaacgatatcgaccgcaaggcccggccccatcgtacgcccgcccatcgcaagaatgttcgaattattatgctggcgcgtcgcgcgtgccgtaaacgtatccgcaaccgcagcgcagcgtatgcccggcactttgttcgccgcaatcgaaataccgatgcccgtgccgcagatcaggatgcccagatccgcttttccatcctttacgcactccgcaacagccagggaatacgtcggataatcgacggatttctcatcgttcgtcccgaaatctatcactttgtgtccgcttttttccagatattccatgatctcttttttgagcacgaacccaccgtggtcacatccaaatgcaattgtcataacgcaatactcctttgaaatgaatcttacaaaaaaaattatacaacaagcggcgaccaaattccacacttcaggccaatttgtataaaaaaagcaatgccgaatccggcattgcctttcaaaacttatttctgttcacgctccaggcgcgtaatcagcagctcgatcgcttctttcaactgcgcggcgcactgcctgtattcttccattccttcatcaaagggatcgatgatatcgcacgagttgtcgatcggctccccgttgatccccttcgcaaacccaagcaacgtatgcaccttcgatacctgttcgggcgcgatcacttcgatatgttccatttgttccttgctcatcgcaaggatgatatccgcccaatgcgcaagctcagccgtaaaaggctccgcttcatggcgtttgagttccagacccatctcttccacgacgcggacagcttcttccgtcgcctgtgctccttcgcaggcaaaggtaccggcagattttgtctttacctcgccgtgaaggatgctacttcggtctaccgcatcgtccatcagtgtttccgcaatcgggctcctgcatgtattacccgtacaaacaaacaatacattcatgattttaaattttttcctccttggcggtaatgatttcgtgtcccgccgctctgattattctgttcatcacggcaagacccattttatcttcctgcgcgtgaaaaagcaccagtttgaaattttgatcgtctatctcgcgaagcacgcgaaaaagcgcggcttccgcgccatgcgcatctgcgcccaaaagcacaacgttcttaacatccggataaagccccgcacaatcgtcaaggcatagcaccgcagtcttctttccctgcgctttaccattatgatacatggtgtttacggttttcgcaacctcttttttgctccctataaacacgatcacccgcgcctccggcgaataatgcttatatttcatgccgggcgacgcgcatacttcgtcctgtttcatctcccccagcacgccggggtgcacccgcacatttcccgcaacgttttcaatcatttccggcgtgatatcgcccggccgcaaaatcaccggaacgtctcccgttgcgtcgaccacggtagactccacgccgactttgcacgggccgccgtctatgatgagcgggaccctgccgcataaatcttcatatgcgtgcatcgcgagcgtcgggctcggctttcccgaggtgttcgcgctgggcgcggccaccggaacgcccgcaagcgcgatcagcgcgcgcgcgatatcgttgtccggcatgcgcaccgcgaccgtctcaaggcccgcgctgacctcatacggaaccgcatccgactttttcacgataacggaaagcggccccggccagaacgcttccatcagggcgcgcgccgtaggcgtcacctcagccgcaacgccttccaattgctccatatccgcgatatggacaataagcggattgtcctgcggccttcccttggcgataaagatatccctgaccgcctctgcgcaaaacgcattcgccccaaggccgtagacggtctccgtgggcataaccaccaacccaccttttttcagttcgtccgccccttcgcggaccgccccttcaaaatcccttaaggcaaacaccgtcttcgtcgcatatttcatcatatcagcaccaccaatacaaacccaaccagtacgcctgcggcaatggatatccatgtcgccgcgctcctgtgcatgctcaccgcttccggaatcagttcccgcaaagtcaggtaaagcatcgcgccgccgccaaacgatacgctccccgcgaaaaacatcggcgaaaggtcgccgatcgccgcgccgatgagcgcgccgacagccataggcgccgccgccaggatcgccaccagaaaaatcttcccgtatggaaccttgcccagcttaagcgggatcgccagtcccatcccctccggaatattatgtacgaacaacaacaccgcaaggcctgcgccgaatcccgtcgccaccgtcagtccgctccccagcgcgagtccttcgggcaggttatgaaccccgatccccagcgcaagcaaaagccctgaacgcacaaggcgtttttccttgagcccttgcacgatactgtcgtcatgttcggaaggcacgtcatagtgcggcaatagtttattgacaatcaatacggcaagcgcgcccagtgcaaagaaaacaagcgttacccaccacgcagccgcttccagcgattcgggcagcatatcaaagagtacgatggccagcataatcccgcccgatatgcccatgagtacggcggatatccggcttgacttcactttaataaagaatgtcgctaccgcgccgatccctgttcccaaggcgcctacgagcgcaccgatcagcgttgcgtaaagaatcgtatccattttgaattactgtgtgagcttcttttgcctttcatccagaattagtgcgtctatcatttcgtccatgtccccgtccagaaatgcttccagcttataaagcgtaaggccgatccggtgatccgtcacccttccctgcgggaagttatacgtacggatacgctcgctccggtctcccgaccctacctggcttttgcggttttcagacatttcgctgtccgccgcgtccttatacaggtcgtataagcgcgacataaggaccttcatcgccttcgctttgtttttgatctgggatttctcgtcctggcaggtcaccacaagccccgacgggatatgcgtgatacgcactgcgctgtccgtcgtgtttacgctttgcccgccgtgcccgccgctgcggaacacgtccacgcgcaaatcgttgggattgatgttcacttccacctcttccgcctctggcagcaccgccaccgtcgccgccgaagtatggatgcgtccggaagactccgtatccggcacgcgctgtacgcggtgtacgccgctttcatatttgagccgcgcatacgcgccttttccggcgatggacaccacgatctcctttacgccgccaagctccgtcacgttggacgaaagcgtatccataacgtatccgtgccgctccgcataacgcgtatacatgcgcagcaggtccccgccgaaaagcgcggcctcgtccccgcccgttcccgcgcgtatctccaaaataacgtttttatcgtcgtttttatcttttgggataagcaggatcttcagctccgcttctgcctcttccttttgcttcaagagctgttccaactcctcttttgcaagcgctaaaaactcctcgtcgctttccgtctcgatgatttcctgactgcccgcgatatggtcgaggatcgtcgcatactgatcatatgccgccgcaatatccgcgatagacgattgttccttggaaagcgcgcggaatttatcctggtttcctatcacttccggatcggaaagctcccttgaaatttcgtcgtagcgttccttgatctttttcagcttatcctgcatacattacccctcactgccgcggcaggccgcacttacaaaacgcggccgtccgcttaaatcataaccagtttttatcttagcaaatccgttttcttttagcaaggcgctgacccctgccgcctgcgtgtctccgatttcgagcaccagcgcgccgcccgcgttcaaatattgcggcgcttccttggcaaggcgttcataaaaccggtacccgtcatggtccgcccataacgcaaggcgcggctcgtattcccttacctgcgtttccaatccatgatactcgccatcgctgatgtacggcggattgcatacgatcaggtcggccttttttgtcaccgcttcaaacaaatccccttgcaaaaagcggatatcctgtccctttgccaacgtatccttattttgctttgccaccgcaagcgcatctttcgagatatccgatagatataccctttccagcgcaccttcgagcgacagcgtaataccgattacgccgctcccacagcacaggtcaatcgccgtccggtatccgttttcatttgccagcataagcgccgcttccgccacgcattccgtatcgtaacgcgggatcagcacacgctcgtccacaaaaaacggccggccgtaaaaatatttttcattgatcacatacgcgagcggtctgcctgtaagcctctgctcaagcaattcttcgatccgcttttcataaggacaggcatcgaaaaagcgcacatgcagccgcgaaaaatcgtcgccgtacacatgcgccaataatacttttgcctccgcttccgcttccggatagcccgcgcctgaaagtatctttttcgtattcgcgtatacgtctccccaattactcattggtttgcgcttgcgccgtcgcttcttcctgcaccgatcctgcttcattcttaaggtcggcaggcgaaccatctattttatggctgtacgtgcgtgccagctccgcaatttcctcatccgttttcttgtcttccgccgcaaggaaggaaacaagcgccacctcgagcatgccgtcgtcaggttcgcgcgtcgtcaggtattgcagggccatgcccggcttccttaaggccatcgtgaacttattgtcgtactttgcgaccagcttgagtatctcatacgagacccccgctacaacaggcagcatcaacaggcgcagcccaatacgcaccgcccagttttcgctccaaccgagaagcgtgaaaagcaggatcgagatgatcatgacgatcaaaaggaagctcgttccgcagcgcggatgcaaccgcgtattttcccgcgcatgctccacgtccatcggcatatcgtgctcaaagcaattgatcaccttatgctctgcgccatgatagccaaagagccttttgatgtccttcatattggagatcgccaccaaatagatcaaaaacattcccacgcggatcaggccgtccaccagattcttgcccagcgagctgtctatatacggcgtgatccagcctgtgatcaggttcggcaggataaagaacagccccaccgcgatcacaagagcgatgaccaccgcaaaaaagatcgcgacgtccatcggatttttccctgtcttttcggcgataaactcgtcggccttggaaggctccatttcgtcgtcttccggatcgtacatcttcgccgcatccgtgatcgtcttaacgcccgaaataagcatttccacgaagctgaccactccgcggataaccggtattcccaatatcttatacctggtcgagagcgactgcgtcgactgcttttgcgtcacgatctcaccgctttcgcgcctgacggcaatggctgtcttttcgggcgaacgcatcattacgccttccaaaactccctgcccgccgatacttgtacgtttcattccttcctctttctgcgatacaaaaaacagaccgtaagaataccttctgacggcctgtagtttttacacgcgaatatcatgaaatagccggcattatttcatgccgtatctcttcttaaatctatccacacgaccgcctgtatcaacaagcttctgtcttcctgtgaagaacggatggcatttcgagcagatatcgaccctcatttccgatttcgtagaaccggttttgaacgtctctccgcacgcgcacgttactgtgcattcaccatacttcggatgaattccttctttcattccatctcacctctttttccaaaagtagcattattcattatatcacaccaaaatcaaaaagcaacaccttttccccataaagttcacagtttttttacagttttattgccccgttcaggtataatgggtcatatacgtttcaaaggagcaaatatggcgcggcgcaggataaatattctcggtttggtactcgcttgttttttcatggtcaacatcgttgtttccgtcgttttacaaaacagtacctttaccgtttccgaatttaaggttgcaaacgcaaagatcgctacgcccgtcacaatcgcgcagatttccgacctgcacgaaaaggaattcggccagggtaacggcgagctttttgccgcgctcgcatccatcagccctgacctgatcgtcattacgggcgacatcatcaaaaattcctataccgattctccaaatactccttacatggaaacgcttgcccaaggctgcgcggaaatcgcccccactttttttatcacgggcaaccacgaccgttatcatgccggagccgtcaaggatacctttgcgggcaacggcgttaccgttcttgataaccgcgtcgccggatttttcgcaggcgaaacggcgctcaacatcggcggaatcgacgaccagtcgatagaccccgacgggatcgaggatatctcttttccggataacggacgattcaacctgctgctggcgcataagcccgacccattccgcaccgactatgtgcagaccggcgcagaccttgtgctttccggccactcgcacggcgggcagatccgctttccgtttggcaaggctgtgttttacgctgacggcggcctcttccccgaatattcggacggcctttattatgaaggagacgccgctatggtcgtcagcatgggccttggcgtaagcgttgttcccttccgtctgttcgcccctgccgaaatcacagtcatccgcctgttgcaagggtaaaggttatcgtatatcataatcatatgagtaaaagcaatgggttccgcatcaaggaatataaaatacacaatccgaaaatagaggcccccgtgcggatcgcgcaaatttccgatttgcatgaaaaggaatttggggacagaaaccgtattctttttgacgctgtggaagatttaaggcccgacctgatcgccatcacaggtgatatgatctatgatacttacacaaaacaaccaaacgatgcgtatatcgaaaacgtggccgaatgggcgggcagcgtcgccccttcgttttttgtgacaggcaaccacgaaaaaatctggacggaatacgtcaaggatatctttgcgcaaaacggcgccaccgttttggaaaatcatttcgtacctttttccgtgggcgataccacgatggacgttggcggtgtcgaggacctgaccgtggataagcggggctttgacaggctgcgctttccgggcgacggccggttccacctgatgcttgcgcacgatccatccccgtttaaagacgggtacgaccgtaccggcgcagaccttatattatgcgggcatacgcacggcggacagatccgttttcccggcgggaaagccatcatctcccccggtgaccacaggccgtttcccaaatattccgacggactttatacaaacggaaatatgaaaatgatcatcagcatgggcctgggggtcagcgtcatcccgttccggttgttcgcgccccgcgaaatactgcttatacatttattgcccgaaaacggcaaatgaaaggacgataaataaagatggaagaaaaacaatataacattgtttcacttggcgaactcctgatggatatgactcccttcggaacctctcccgacgggcagcccctttttgagatcaacccgggcggcgcggtcgcaaacgcgcttgccatggcggctgcgttaggctctcggtgccttttgatgagcaaggtcggcgacgattcgtttgggcggatgctgatttcagcaacagaaaaagcggggcttgacgcttccggcctcctgaccgatccgtatatcccgacgacgctcgcgctcgtcagcctcgacgagaatggggaacgcgacttcacgttctaccgcaaacccggcgcggatatcatgttccacaaagatgaggtttgttatgacgcgattgccaattcccgcatcttccattttggaacgctttccttagtcgatgcgccgtgcagggaagcgaccttcgcctgcgtcgggcatgccaaaaaaaacggatgcctggtttccttcgatcccaatatccgcatgtttttatgggaggataaagacgcgcttttgcgcgcgatccattatggacttgaaaattgcgatatcctgaaaatatcagatgatgagatcctatattatacgggtgaaaatgacatggaaagcgctctttcaaagattcgcctctcttaccccaacctaaggctcatttttgtcacatgcggggcggacggttgcctcctgcaccatgaaggcggccatacccacattcccgggtgccggcaggaaaatatcgtggacacgacgggcgcaggggattcctttatgggaacctgcctgcattacatcgctaagaccggccttgaagccttgcaaaaagaagacctcatggatatcgtaaggcatgcgaacgccgccgcatccctcgtgatcgggcgcaaaggcgcgttttccaagatgccgcgcgcaaccgaaatcgatcaggcgcttgatcaccccttgctttagtcgtcgatcagggctttgaccgctttcttgatttcttcgacgtccggaaccacatatttttccagttccggattgtatgggatcggtacgtctttgccgcacagccttctgataggtgcatccaggaaatagaatgcttcgctgtctcctacagctgcataaatttctccgccgaagcctcctgtcctggccgcctcatgcacgatcaagaccctgcccgtttttttggcggaccgcaccatggtttctacatcaagcggtatcagcgtccgcagatctacaatctcaacatcgattccttcttgttccaattgcttagccgcttccagacaggtgtaaagcatccgtccatacgttattaccgtcgcgtcgcggccggcccgcttgatatctgcggcgccaatcggcactgtatattcttcttccggtatttcccccttttgcctatacagcattttgttttccaggaatactacaggattatcgtcgcgtatcgccgatttcaggagccctttaaaatcatacggcgtagccggcataatcaccttaagtccaggcacatggcatacccatgcttccaggctttggctatgctgcgccgctgcgcccgttcccgaacccccgggcgcacgtaatacaagcgggatgcgcacctgccccgcaagcatataccgtagttttgcagcctggtttacaagctgatccatcgcgatcgtaataaaatccgcaaacattaattccgcaatcggacgcatgcccaccatggccgcgcctgtcgccgcgcccatgatcgccgcttcggaaatcggcgtatcccgcacgcgctccgtgccgaattcgtcgagcatacctaccgaaacgccaaaaggcccgccgtatttcccaacgtcctcgcccatcaaaaatacccgttcgtcccggcgcatttcctctgacatcgcttccctgattgcctgcaggcatgtaacttccttcacagcgcttccctcacacataaatatagtccagcatttcagaacggtcaggatacttacttttttcggcaaaagtaacggcgtcctctatttcctgtgccgctttttccttgttttgttctatctcccggactgtaaaaccattctccgccatatattgttccagccgcatgatcgggtcttttttcttccattcatcgatctccgagcgcgtgcggtatacgttggcgtcgctcttcgaatggcccatataacgataggtgatacactcaaggagcatcgggccgttttttttcacctgctccaccgccttgcacgtttcttcatacaccagcaccgcgtcgtttccgtctatcgttttgccctgcatgccgtatcctgccgccctgtccgagatatgctttgcctttacgctgcaagaaacaggcgtcgatacggcatattggttgttttcgcatacaaataggacaggaagttcccatactgccgcgaggttcagcgattcgtggaaggtacccgtattgctcgcaccatccccaaaaaagcatacgacgacattatccttttgccgcattttgagcgcaagtgccgcgccaacggcgataggctgccccccgcccactacgccgtttgctccaaggtttccgcgtgaaatgtcggcaatatgcatcgagccacccttccccttgcatgtacccgtcctttttccgagcaactccgccatcataccgttcatatcgatgcccttgcttatgcaatggccgtgtcccctgtgcgtactcgtgatcaggtcgtccaggtcaagagcacagcagactccggcagcaacggcctcttccccgatatacagatgcgtcgtaccgtgtattttacccatagagaagaaataagccactttttcttcgaactttcgggtcagtaacattttcatatgtatttcgttcaaaacttgcttgctcggctttgacaaaatcttacctccctgtttgttaagacggatcctcaataatgataaatatcgatcacgtcttcccttgtgatcgggacgcgggtattttggatattatgctttcccattacctcgtccgtataagcctcgaccatctcgtcggaaaggcgttcatctcttcgtatttcgccaacaaatgtcccaatcgtttccgcaaattcttccatactgttcatacccatcaggcaaagcagctttccggtcaattccggttcatgcttttgccagaacctcatatagttcgtcagaataagcgccatcgccctgccgtgcgggatatgggcaatagacgtcatcgggtaactcatgccgtgcagggccgtcgtacgcgtctgcgaaacgaccataccgcccatcagcgaccccatcatcagcttttccctgccagcaacgtccagcgtattgttcttaatgtcggaaaaacaagccgcgatattccgtatcccttcccgcgcgatcgtctgcaccaagggattggtcgttaccgcgaaaatactttccagcgaatgtgtcagcgcgtcaagcgcagtattgatcgttacgcctatcggcaccgtcatcgtatatctcgggtccaaaaaagcaattttcgagaaaatatacggagaattcaggttgttctttgtcccttttttatcgtcgatgatcattgcgtacggcgtgacctcgctgcccgttccggatgttgtcggcacgcataccagcggcaatacatcgcttgtatatttcgtagagaaaacaagctcgtccgctacgtcctgccgtgtgagcacgcacatcgctttggctgcgtccattgggctgccgccgcccgtggcgatcacaaaatcagccccaaactccctgcatgcagccgcacccttacgcacgttgcttaaagttggattgctttctacgctgtcaaaaatccggtaactgatcccattctctttcagaatttgcgtgatctccgcttccgatccgttcagcttggaagaaaccggatcagttacaataaacgccttcccaccaagccgttttagctcagcctcatatcttttgatacagccttcccccatgtgaatgtgcgtaggcaagaaaaacccgatctccatgttttcggtccgtcctttctcaaattctccacatatccctcacgggtgccagagaatggtaaatttcttcataaattttctggttttcctggtattgcttttgcagttgcggatcaggctctaccgtctgcctgcagcgcgcggccttgtctacgccgtcctgcacgtctttgaatatgccgaccgctacgccggctaaaatcgccacccccaacacaggcgcctcgttggtatccatttgttcgatgattttccccgacgtattggcacgcagataaagcgtgaaatcagaacgcgcaccgccgccgttgatacgtactttttcaaactccgacgtcatgcgcgccatcaggtcgcacatcatcgcaaactcatgagcgatcccttcatataccgctttgtatagcatatgtcgggatgcgaccggcgaaagcccataaatgcttcccctcgcacgcgggtcattataagggcagcatgaccctaccatatggggcgtcacaaaaatatccgtagggccctgcggcaatttttccacctcgcgtgccagtacttcgtagaccgataccccttctttttccgccgctatgcggtcttccccgcaaagttcgtttacaaaccattttgtgcacaatcccgccggaaaatatgcaaagttcgcgtacaatccatccaagtggcaaaaggtattgaggcagcagtcatatgcttcgtccgagctgttgacttccgttgtgagcgtcgtcagtccctcatacgaacccgccgagcaggacaccagtcccggttttatcactcccgacccaatcaggccgttgaaatggtcaaagccgcccgatacgaccgtcactccttctgcaagtcctaaaaatgcggcatgctcacgatcgagcttaccgaccacctgtcctgatgggatgggggtactcagcttttccttttctacgcccgcagcgcagagtatctcatccgaccagtcgcgtttatggatatcaaacatcagcgtccggcagcagtttgaataattgcataccggctccaaccccagactcaacatgatgtaatcttcacatgaacaaaatttatatgtcgcggcatatccttccggatcatgttttttaaaccacatgatgttcgccagggcatacatcgggtgcggcggcgtacccgtgatctggtacagccgttttgccggaatctttgccgtcaattcttctatttccacaaatgcacggttatcggcattcataaatgcaggaaccagcgctttcctgtttttcccaaccggaatgatcgtctcgccgtgcgagctgatcgccatcgcaataatcgggtcatgtgcaagttttgccgatatttcccgcgatatatcccgaatggcgttcaaaaaacattccgcatccagttcgcaccagcccgggtgcgcagtgaacgtttggtaatccttctcagattttgcaagtacatttcccgcgtagtcaaacgctacgcctttgcatgctcctgttcccaggtcaattcctaaaatgctcatattcttgtatcccctttttcctcaagttcctatgaccggcaagggggaacctctccgtccccctcgccttgccatatatatttctagaaggaaaatttactgaatcgtgtaaccaccgtcgatcaacaggttttcgccgttgatcatattcgccgcgtcgcttgataagaaaaggatcgccgccgcgatttcatccggataacaaaaacgcccgcacggtatctttttcttcatttgcaccgcatcgtccccctgccatatcttttctcccatttccgttaagacgaccgtaggagacacaaggttagcattgatattgtattgcgcccattccagtgcaagcgttttggtcatgccgatcagcgctgccttgcttgccgtataggcgacatgcctgtccgttgcaatcacaccgccctgagaagccacgcagacgatcttcccgccgccgagcttcatcattgcgcgccctatcgcctggcataagaaaaagggcgctttcgcattgatcagcatagtcttatcccacatttcctctgtcacgtcgattgcataatccaccagtccgacccctgcaacgctggccagtatatcgatcgtcccaaaccgttccagcgttttgtcaacgatcgtctgtcctgccgccatatccgtcagatcgcacacgatgggcagggtctccgttccgtaatgctgcgcaatctcgtctgcaaattctacgaccgcgggattcatatcgatgaggacgactttcgcaccgctgtttgcatatgcatgtactgtcgctttcccgatcccgttcgccgcgcccgtcaccagcgcgaccttatccttaattgaaattgttccgtcaaattgcttgtaattcatggatcacatctccttttcaaatgtccggacaatgctatttcttcgtactgttcgtgaagtggtcaagcatgacagccagtataatgacgacacctgtcgcaatctgttggtaatatgattgcacattcaagagtgtcatgccgtttttgagcaccgctaaaatcagcgctccgagcaccgtcccgatcacgcttcccttgccgcccgccagactcgcgccgccaatggccgaagccgcgatcgcatccagttcatatccggttgcggcggtcggttccgctgcgcccagcctgccgaccatgaccacggcacccaaagcgcaggccagtccgctgatcacataagctgtcattttgtatttggtaacgttgatgccggacaatttcgccgcttccatattgccgccgatagcgaaaatatatacgccgatttttgtgaatttaagcaggcaatataccagcaatacgattacgatcatgatgatcaccggtacgggaacgatgccgatttttccgccgatgaccgatgtgtacgaatcaggtacgccgggtaccggctttcctgtcgtatagacaagggcaagaccacgatagatactcatcgttcccagcgttaccaggaacggctgcaggttgaaaactgaaatcagcgaaccgttgaaccgttgatcagtcccatcaatacgcccagcgcaagcgccgccaaaaccgccaggaacgcattcgttccgtttacaagcatctgagccaggaccacgccgcataccgcgaggatcggcccgacagataaatcgataccgccggtgatgatgacgactgtcataccaagggctactacgatgttgatggatgcctgcagcacaacgctgatcaggttccgttcattaaagaaataaggtgaaatgatggcgaaaaacacgcatatcgccagtaggcacaacagtacgccgccttgccgcgcgaatcttttccatccgctctctttgatcgtatacctcgttgtttccatctcttaaacccctcccattgcatatcttaatattctgacttcatccgcctcttcgcggtttaagtccgctgttacctttccttcatgcatgaccaatatcctgtcgctcattcccatgatctccggtaactcggacgacaccatgataatagaactgccatttttgacaaactcgtccatcagcctgtatatctcgctttttgcgccgacgtcaagaccacgcgtcggttcgtcaaaaatcaaaatctgcgcgtccacgctcatccatttcgccagtacgaccttctgctggttaccgccgctcaaattgaccgtgtgcgtttgcggattgggcggagtgactttcaactcctcaataaaacgctccgtattcttaagcattgccctgtggttgatcagaccgcactgcatggatttatcaagcgagctcatattgatgttgtaattattggatagttcgcccacgaagccttgggatttcctttcctccggcagcagtgccaaccctttttcaatggcctgctggggagatttgatttttacgtgttccccgttgacgtatacctctccgctcgtcagaggatcgaccccaaaaatagcacgcacaacttccgttcgtccggcgcctaccagtcctgcgatgcccaggatttccccacggtgcagctcaaagctgacatcctcgaatacatcgtccgaagtcaaggcttccaccttgaggacaacctcgtctgttgagaaatttttgttatggtgcataaattccgcaacatcacgcccgaccataagtcctacaagcgtctgcttgtcaatgtctttcacatcatgtgttgaaatatactggccgtcacgcagcacggtaaccctgtcggcgatctcgaaaatttcttccaggcggtgggatacataaatgatagaagttccgttttcctttaatcggcgaatcgttttgaacaattgatccgtttcgcttttggaaagactggccgtcggttcgtcaaatgcaatcactgacgaattgtacatcagcgtccgtgcgatcgcgaccatctgcatctgcgcaacgctcaggtttctgaccggttctttgctggtaaatgcacattccagttctttgagcgtctcgtcacactttttgtataatttcttatgatctataaacatatcagcacggtgcatcggttcatttccaagcaagacgttttgcccgactgtcagctccgtcaccagattcagttcctgatgcaccatgtttatgccaagtttgcttgcgctgtttggatttttcactcggatattctgtccgttaaagacaatgtccccgctgtcagggtggtatacacccttcaggatattcagtaatgtggacttccccgcgccgttttcccccacaagagcgtgtacttctccttttctgatcgaaaagtctacgtccatcagcgctttgacgccgggaaaggttttggtaattttgttaaagtgtaaaatatcttcgtatgcagccacgtttcctgcctccttactttattgtttttgatgggctggggagccctgccaccattaatctttgccagggctccgttccccatctctgtttcaggcagacccccttacaggggtttcagattctttccttacgctgccggcgcagctacatgttccgtataattgttgatgtcaagaacaagttgcggtacttcaacgactctcgggatatcctgtcccgccagcagccgcagagccacttcgccgttcatttttccgccgacatacaggttgaggtcaaccgtagccgtgaggtcgcctgctgcgatcgaatcgatcgcgccttcgataccgtccgaaccgacaaccgctactttgccgtgcttgccggcttctttaaccgcttccaccacgcccagcgccatcgtatcattgttgcaatagatgcctacaaggtcgggatactggttcaaaaggtctgtcgctacgtccattgccttctggcggtcccagtctgcgggtgtgctcgcaacgacttccatgtcaggatattccgcaatgccttccttgaagccggccgttctctggatcgccgcataagcgccggccaatccttcgatgcaggctacttgacctttttcgcccgcaaactctgcgatgtaatctgccgccagtttgccagtgtcgatggagatgttgccaacaaagctcttagcgtcattgatctgcgcatcgaaaaggttaaccaccaggatgccggattcgttcgcctgtttcacagccgcgtccagcgttgtgttggactgcggtgccaaaagcaatgcgtcatatcccttggaaagcatggactccgtcatcgcaagctgttctacgctgtccgattcgcttttgggagcctgcaaatccactgttacgccaagaggttccacataatcctttacgccctgggaaatcgaggtccaggattcgtttgccagcgtctttacaacaacgcccatagagatgttttcgaaatccagatccaagtcttcgatcggcccgaatttttcttcgagttggtcaccggagatagagtcttcacaatagtcggcgtcaaacatctccatctgttctgcggatgccgcaggctcctcagccgacgcgctttcctgtgcgcttgcttcagccggtttgctttcctgcgccgccgattcagaagtggctgccgaactttccgcagcaggcgccgccgtgcatgcgaccatagcgaaagccagagtcaagcaaagtaaaactaccagaacttttttcatacaaaaacctccattaatttgtttttttgcgtcgtgccccgttgttagttttattgtagaattgggtcaaatggaaaacaacgtaacgatattcggattggtggtataaaattcgctttttgttcgaagtgtcttattgctcgtctttttggataggtaaactgatttctacgctcgttccatgattctctgagccatagatacgcaagccgaattcttccccgtaatggagccgaatccgcttatttacattgaataatccgatgctggtatgggaggtgccgcgcggttcaacgtccttacaggttaccaggcaatcattcagcgcaatcagatcctcgcgcggcatgccgatcccgtcgtcctcgatcaaaatgatgagccgcttttctgtacggtaggcctgaatcatgatgttccccctcccctgcttgggctctaacccgtggaaaacggcattttccacgataggctgcacaatcagtttgggtatcaggcaatcgcgcacgtcaggatcgatattttccgtaacaatgaatttatcgttgaaacggtattgctggatcataatataattgtggatattggccagttcttcttttaaccttacctgcggacctttcctgctgatactatagcggaacatatccgatagggcttttgtcatcgcttcgatgttgtccgctccctgtgcgatcgcgatcccccgtatagaatcaagcgtgttataaagcaaatggggattgatctggctttgcagcgcgtccaattcggcctgcgttttcatgattcccgtagaatattccttggccaccatcgactggtatttttcaatcatatttttcaaatccgcatacaatgaatgaagcggatggttttccggtatcacttcaaaatcgtcgttcctgcccgctaccatgccgtgtaccgtccgctcgatcaaaaaaatgggtttgataatatttttattgaacatataaataataacgccaaacgccaatatcagtacgatcgtcaacacaatcaccggctgagaagtccccgcactgcccgcgagcaggtctttctcctcgaccacatatagcagaatatcgccgccgctgcttggtagttcggcataaaacaggtaattctgctccccatccgttccttgatatttcaacacatctttctcatcgttttgcatattttcagttatcacgctgctgatatcctgctgcccatgtgtcaattctccttctcttccgccggaaagcatgatttttccttgcgctgtatcaaacacatatagctgcccttttacagggccgattgtttccattaattcttccgctttttcaatatccccgtccgcgcttgcaagcgcagcataattcagagaggtattgaccatctcaatgcggtaaatttccttttcacggctgatttcccgcgcgctcaggttcgcaaaaacgacaattgaaacaaccatagctgcaaacaggataccaaacatcaggatcaggttgatctgcatactgctgatacgcgtattttctttaaaatgccgaaaaatctttttaaatttttgcatcatgccaggattccttatgtaaaaagcttacggtattccgtcggattgatccccactctttttttgaatactttgctgaaatagcgtgcatcgttatagcccaccatttttatgatatccgcggtgcggtatttctttttcagcagtaattcctttgctatattcatacgataatccgtcaggtattccatgatggtcgtattcatttcctgcttgaataacgagcttgcatatttggaacttaaaaaaactgtttcactgatatcatcaagcccaatgttctccttataatgctcgtgtataaatcgcttgatctgttccactatgcgcttttgctgatccttttggttcatcgaatagaactcttttaccgttcggatcattcccgtgatatgcctgaccatttcttccacggagcggctttcgcggacatcccttatcaactttttctgtgagatttcctcgaactccgcagaatcctttcttcggcggatcacgttgaaaagaatatcaatgatttgttcggccaggtcgaagaccagcgccggatgcagtttgacaggttgtttcataatctctacaatcgttttttcgagggcttccgtatccaggatatccatctgccggatcaaacggctctctttctcaaaggaaagcacatcctccatgctccgcttcgcatattgttctcccgatatatcgatcacattcctgtccttaaaataaatcctcgcctttacagccgcttgggccttcacaaaggaatccctaagtccggcataatccaaggcagcctctccgatccctataacaagtccgtaatctccatgcaggtgtaccttctcaatgattttctcataggaatcataaatgttttccaaaaccgccgcgcgcttgctttcctcataattcaataaaaaccccacctgccctgtcagcgtaaacttaacagtatcatggcaattgggcgcaaatcttcccggcagcagatcgtaaatattatccataatattttgacgcagcgcctcatcgccatcccccttcgcgcctgcgccgataatatcataaagaacagcgcggtactctccgtcttcaaagcataccccatacgcttcacgtacctcgtccaacgttttgggctccgcaatttccccaagcatcagcttacgaaaataatcctccttcaaatgcgaaaggctctgcaccaatttgtctttcaccctgttgttctcacattcttcttcgttgcgctgtatgatgctccttttgacgcgcagcaaaacatttgtcaattcagttttatcgatgggcttgagtaaatatgcaaacacgccgttttccagtgcctggcgcgcataatcaaaatcgctgtatccgctgattacaacacaaaccgtatccggcaaaagctcccttaaccgttctgtcaaagaaagtcctgtaaaaccgggcatccggatgtccgtaatcaccaaatccggctttttttccagtatcatatcaagcgcccgctcgccgtcgtccgcatcgccaacaagctcaaatcccagtttttcccagtcgatcaggcttttgatgagttggcatacccatatctcatcatcaattactaccgttctaatcattgcaaaaaacttcctttcctatcactcttggttcctgatgcttagctgattgcttgtgaaagcacttcctcttcgctgaaatcttctttttcaagttccgctgtgatcattccctttttcatgaccagtatcctgtcgcacacttcaaacaaatcaggtatctcggaggaaacaacgataatccctttcccctcgtagctcatttccttgatcagggaaagaatctccacctttgcgataacgtcgatcccctttgtaggttcgtcgagtaataaaatatccggcttgtatgaaaggtattttgcaaacagcattttttgctggtttcctccgctcatcctcgtcacggctcccgtcctttttcgcggcttgatctccagccgttcaataaaaaattctgtcaacgcacgccgcaggcggaaaatcagtagtccgaatctcgaaaaacgtttgacgcttgaaattgtcatattctcttccattgtaagattcataaatagcccttgccgtattctttcttcgggcatcataccgatcttgttccggatcgctgccatggggctcctgatttccacctggttcccatgcacgaaaatccgtcccgcccgtttttttctgagtccaaacagcatgctcagcaattcagtcctgcccgaaccgacaatgcccgcgatccccaacacttcgccctttttcaggctgaagctgatatcctgcaacaactgcccgtcataaaggccttccacacgaagcacctctttgccgatatctttcgccttttcctcttgctcccatacatgcattttctggctttgccctgccatcagcgaaatcaatttagccctagtacattcgtctttttgaaatgtccctaccataaggccgtcacataggacgctgaccctgtccgctacctgaaacacctcatccagcttatgcgaaataaacaggaccggtacgccttccgcctttaatctgaaaataattttttttatgatatcaaatttactttttgaaagggaagacgtcgcttcgtctaggatcaggaaggacgggtgcgttgccattgcctttgcaaccataacaagctgccattgtgcgaatgacagcgacgacatatgcatatacgggtcaaggtcaagctccagttcggccaggaatttttttgcttcctcgtgcatacgcttgtggtttaaaaacagtcccgacttataatatatttcattccccaaaaaaatattctgcgcaatatccagttccggaacgatttccggctcctgatgtacaatctggatgcccagcttttgggcggcaaaaggagaatttagctgcacctgattttcccgccaataaatccgccccgcgtctttggggcaaacgccgctcgcaatgcccgccagcgtggacttcccaccgccgtttttgcttacaagcgctaaaacctcgcccctattcaggctcaggcttacattattaagcactacattgttcatgaacgtcttgcagatacagtccatgcgaaaaacttcaattttcacctgatacctctttgcattgttcaaataagccgtattcgccatataccggcggtaggctttgttaaaacaagaaatgtatgcagcaattttcccaaatatccctttaaatagccgcaccgtttttgatctgtactaaaaatataacataccaggcatttcttagtcatcaatatcacgaaatttaatctgttttttcatattttaattctaaataaggctgcggagcggctcctgtaaatattgtatgatacgctgcataagacatgccccctgcatatcccccaccttcccgcggtcaaaagacaaactcagatggactatttttttgtatccgcatctgctgtccggtatatcttcgatcaaaccgatgccaagcgatgtacttccattcccatgcactgccggattaaaattcatgatcccaaacctgcccagattgcagaccacgaatgcaggcgctccacagtcgccttgcgccagttgctttccatatgccttttccgttaattcttccaaggttttattcattttctgcagcgagagtttgtccgcattgcgtatcaccggtatcagtatttcatcccgcgagagcaaagctatcccaatatccacagaatcatacaaattctgttccctctctgccgccactgctgcagcagcagagttcaatataaatgcatcaacttttatttctgcacctgtttgcctcataatctcgccgttcacttcaaaaaaagcactcaaatccgctttggcctgcagcgtagcgatagaacttccatccgccgccgtttccctgtttcctgcgtatttttctcgttctatcgcacccaggacgtcctgcttcttgatttggccggacatgcctgtcggcgttatgtaagcaagaataatgccattttcccgtgcaagtctttttgcaaccggcgttgcggcgatcttcgcattacggccttgttccccgcccacctctactgcttctgctttatatctcatcgcaagcacctcctctcctctttatccgcctattgatacgtcgaacccctgcatttcaaaaaaatgtttaatggcttccatcttttcgggcgtaggcggcagcacgtcttccataggatacgtcttcaaaagccgtttatatttcgttataccaagccggtggtatggcaaaaggtctatcctcttggattcaaatgtgttctcctgcaaaaaatgcaatattgcctgaaaattttccattttgtcattatatccgggaaccacggggatcctaactactatatgctttcccagcctagccaattttttaaaattttcaagaatacttttattgtccacgcccgtttgcttactgtgcagctttggatccatttgtttgaaatcatacaaaacaaggtcaatatcctgaaccgccttctccatttgcacccatggggcatacccgcttgtctccatgcatgtagatatcccctgcttcatgcactgttttgccacctgcgctacaaactctgcctgcagcagcgcttccccgcctgaaaaggtcacgccgccgcccgattcttcataaaacgaagcatctttcaggatctcccgcatcgtttcttccacgctcatccatcttcccgccatcgcaagcgcgtctgccggacacacaaaggtacactttccgcacctcttgcatccggcatgatcgatctcaacgcctgctttccccatttccagcgcgtggttgggacagctttccaggcattcgccgcagccgatacatttatcctgccaataccagagctcgggcgaggtgctttgcgactccggattcgcacaccacaagcaccgcagggggcaccctttcaaaaatattactgtgcggatgcccggcccgtcatataatgcataccgctctatttcaaaaatatttcctttggcctcttccacgttttccatcctacaaaacatgttcggtacgctctatgatatcgtcctgcgtagcgggctcaaggctattgaataaagcgctgtatcccgctacccttaccacgagatccgtatattcctcaggctttttttgcgcttcgcgcatcatatccgaggatacaacgttgaactggatgtgccagcccagttttttgaaaaatactttgatgagggagaccactttccgaatacccgcatccgttgccatcatccccggcgtaattttaatattcaggagattgccccctgtaataagcatattaggcatctttgctaccgaattaagcactgccgtcggcccaaggctgtctgtcccgtggtatggcgaacatccttctgaaagcgcctgccccgcaagcctgccgtctgcacttgcccctaccttgatcccgctgggcacgtttccggatatggtcgcggtacacggatagctaaaacagccaatcggccccctgcctgcccgcgtgtttttatatttccccagttcacggataaacatgcgatataactcatccgcaagcaagtctaccgaatcgtcgtcgtttccaaatttaggcgccttatggatgagcatctgacgaacgcgctccccatcttctcctgcaaagttttccgacagtgcctccatcagtttttcgcctgtaatcctgtgttcctcaaataccagtttccggatcgccgcaagactgtttgctgcgtttgtaacgcctgtctccggtcctgtcgtcatgtcatataccgctccgccctctttgggtgtttttccgcgccggatgcaatcctgcaccagccccgaacaaaacgcatccggcaccagttcctcgatcgcataatcgattacatgctctcctacgaaccgcagccttacaaaataatccatttggcgctcaagcgcctgccataattcctcaaaacttgtataggaggataaattcttgccttcttccaaaagcgcgatccctgtacgcgggtcacgcccgccgttcaaagtgatttccaatatcttggggaaattcgtaaagctcatgcctgccgcgcggtatccatatttccccggcacaataggctcgatgcatcccaccattgcataattatttgcatcttcctgcgaaatccccctgcttttcagggaagggatcatcagcgcatcgttatgcattgccggcatcccaaatccaaggcgtatgacttgcgcacatttcagcaggtattcttccggatttttttcatgataacgcgccgatacattcggctgcggcaactgtgtcaacgccacgctgtcaaggcacagcatggtaagatcgttcaccgcgtccccgcctgcaggcgtaatcccgccgagcgtaagattttggtaggtcggtccgccgccggaaaaacgggtatgcgaccacggacgtatcttgacgattccaaacgctttaacccacaggcaacccaacagttccacagcctgctcccgcgtcagtattccttccgcaatatccttttcgtaaagcccgtataaatattggtccaatctcccgaaggacatggagtgcccgttactttcaatctgggaaatcaggtgtgcaaaccaaacggactgtacgccttcataaaaggtttgcgccggatattccggcgaacggctgcaaacagccgctattttttccagttccttttttctttttggatccgtttcccgcaaggcgagcgtcttcgcaagctttgcatacctgcctgcaaaattcaccacgccctcatatgcagtcgtcacggcttcgtagaatatcctcttatggaacgccgacggatccgcctcatccagtttgcccaattccctgcgcgcatcctctaatatgccgcgcgcaccgcatttcactatcttttcaaaatcgagcatgatatgcccgtcccctgacgtcatattgccgtttgccgaaaagacccccatctcataagtgtcttttacttcttttggcaatgttttcagcgcacggtcttccaccgtttttccgcgccaccatttcgctatttcaagcaattcttcgcgaacctcgggcgagacccgaaaccggtctcccgggcgcttgggtaattcgtcaatttcttcaaatatccaatttatgttatactccggaaaaatagccgccgcacattgcttccccgcttggtgtccggcaatcaactgcccgtcttctataaaaacggtcatgttctccaatacattcctaagcgcctttgccctgcgcaggatcatgggttcgtcttgtgtttcacgataggtctgcgttaagtagcgcgcgcgttccacgcacacttcctgttcaatcataagggcgttctttttgagccgcccgattctttccctttgtgcttccgataagttcggttccgtatagcgcattgttttcctccttgtctcgtctatctgccgcagcaacagcacgattttccatcagtttaggaacatatgtaactaataatcacattattaactaaattatatccctatttgataaagaaatcaagcggcaatcgaagaaaaccctatatacatcaaaattttgcggcctgtattattttttagattcaaaaaataagcaacaaaaatactaccagtataatcctgtaaaaatgatatcgattcgtttgtttatgacgataaatcaggcgagacttgcgcctgtttcatatggctattttaagagcgcctctgctgtgttggaatccgttaccaaaacgtcgatccagcgccccagcatggctgctttgattaccttgatcttgttttccccaagagcgatacctacgacatggcgtgcgtctgtgcacacctgttccatatcagccgccacgatcctgtcattgacgctgtggctcagaattcgtccgttcttgtccacaaaccgcattgcaaggtcgccgaccgcaccgtcttcttccaatttattcacttcttcttccgtgacgtatccactggcaagaagggtagaattccacaacgatccaatacttaataggacgatatccgatttctctcccgcatgcactgcatctgagatcatcggatccttcaaaaaaatatcccgttcttctttgctgcccgtcaaagctggcgcatgcaggagaatgcattgcgcttccaacgcatttgcgatctttccggcaatctggttgctcagtatttcaggattttttccaaatccgcccaccaacgacaccaccgtaacatccggatggcgcagcgggataaactggtcggcaaccgcagccagggtttttccccaatatactcctattgtatcattgggccggatagccgagatcagataatgagccgcagcacgcccaaggtctttcagactgccttgcgggtcctggtccgcgccgctgctgcggataaccgtagcctttttgatcccataccgctcgcaaagagcttcttctatctgcacaataccggcagagggggacatcacctcgatgcgtacgatacccatttcttcagcacgtttgagcatcttcgatacccacggccgcgtaacgcccatgcggttcgccacttcttcctgagacaggccgtacgtatagtaaagctctgctgcaagaacgattttgtgataaattgtcctgtttttcttacctgtctccattgatttgtccctttggggcacgctctgcgtctccgtctcatccgtgccggaatatcttctgtttctgcgtttcattatactcgaatcctcactaaaaaacaatattttccgccgctttgcagggatatcctatgaaaaaagcaccggcatgaccggtgcttttcattcttcttcccctcacaatttaaccgcgcagaaataagctgttatcagatcgttttcgtaattgaacaattggtactgcatccccttcggaataaacagtgcttcctggtcactgatctggtacgattcccgttcctccgtcataaatacgctcaaagttcccttatggatatagtaaacggcgtcgccttcatgcctgcacggctcggacatccgcgcgcctttcccgccagtcgggatcacgacttccgcgacctgcataaaatcattgctgaccacaaacttcattaaaagcgggttttcctgtccgttgatgaccataagttttttattttccggaatataatggaacatttgaggatattcacgggcggaaggaccgtccaccggccatgcccccaaatccgagatatttcccatgtaatttgtacccggatatttcgcaaaactttcgaactctttctttccctttgcattcagtacattgtatgtgccgattgtgtcggtcgggaattcctgctctgcaaaaatcttcggggccagtacggccattgtcctgactttttcctgggtgaaattatagcccacatgcaccgcgcccatcggcatcaacaggccttctcctgcatgcacatccaccacttgccccgataccgtattgagcatggtgagctttccttcaagcacgatatatacctcgtcgcccgcgtggtaatccggcggctcaaaccgtccgcccggtgaaatatcataagtcgtgcatgtgatttcattcgtgctcagataaacaaaactgatgtcgctgtaatccatgcccagctcaggcgttggataaataaacggcgcaatcatatcccgtgtgatatggatcggtttgtcacgcggttcttctgtatagggatggttttgaaaagtacatttagctatcatgtttttatcctccttgatttctaaaatgttttttatcctgcattattcaagatttgcatggtactgccatagttctttcatattgatattgttttttgcaatgatcatttttgcaaccgtgtcgcctaataaaagcaggcattgctcaaacaggctggtcatgggctgtatcgattccgtctcatccggcaggtataatttcgtacgtgcgggaatacgtaccatcacgtccgctatccctgccatcgtgctttggggatttgcgccgatgtatgcaatttttgccccaaatttttttgctttctttgcaatagaaaccggtatgatagattcgccgctgcccgaacccaccacgagcatatctttgtcggtgatcgcgggttccgtgatctgccctacgcaatatgtctttatgccaagatgggcaaaccgctttgcaatcgcttccagcgacagcatcacccttccgacgccggtaaaaaaaattttttgcgaggcatccatcatttctatgaatgcctgtacttcctccggctttatctttaaaagcgtactttcgcattcatctgtgatctttccgacgatttcctcgtacgatagttgttccatttccagtaatcctcctttatccgcgtgcgcgccgtccctgctcgatcaagcctttcaatcggtcgaagttcgttcctatatcgccgtccttactgaaaatgctggacgttccggcaaccacggtatccaagccggcgcagacttgctgctgcacattctcgaagtagaccctgccgtctacggtgatactcgtattgagtttgcgtttgtctatcatttcacttaagtcataaagtttttttgtgacaaaatcgtatttgtccgctccgggcatggatgcataacccgggttgatgcgcatcagaagaacaaaatcacatagttctatggcatattcaatctctgtgagcggtgttgcgggcgtaagcgctacccctgcctgtactcccgccgccctgatttgcgaaagctttttacaaatatggcgttccgtttccacatggaaacagatgcgtgcgggtttgataccaatcatttcatctacgaaaaaatcgttatctaccgccataatatgtacgtcgtacaaaagcgatgttttttctttcaactgcttgacggtatcgacgccaatcggcatgcttggactgaaatatccatccaggatatcgacatgcagcatccggcagccgatttgttccaatatctttacctcttgttccaaattgcacaggtccatacaaatcagcgatggtgagatcgccggaatatccggagattttctggacgttataagagaagctgttccactcatttcctgcacctcttattccagatttgcgtgcagcttgaacatgatgtcagaagtcgtatggttcacttccatcagccgcagaatcacataatcaagatataaaagcacgctttgttcgaaaagcgaccccatgggctgtatcgattcgatgcttgccttttggtctgatttcgccgtcggggcactgatttccactaccacgtccgccattttaccgatcgttgcctgcgggaaaatcgtaacggttgccagcgtcgcccctatgctcttgcattttttcgccatggagacaaggcttcccgtctctcccgaaccgcttgcaataagcaataaatcatctttttcaatagacggcgtcacgacctctccgattaccgatacctttttgcccatgtgcatcaaacgcatggcaaaacagttgatcatcagtccgcttcgtcctcttcccgcaataaaaatacggtttgctttttgtatacaatctataagctgcaaggtttgttcttctttgatactgcccagcgttgcttccagttcttttgtaattgtcaaaatatccacgctcatatttcgttctcctgtcaatccatttttttccggataacttttgcttttgccgcacggtccccttgcgtcatgatcccttcgcctactataatgatttccggcttaagacgtacatatgcctcgaccgtctctgctgtaatcccacccgcaagagcgatcttactggatttgatatgcttctggatcttctcaaaatgctcatccatgctcatccccggccgctgcaaatcttttgaggtatgcaggcagatataatgcgcgcccagctcttccagacgttcaatgcgctcctcgatgtccttgactgcgagtaagtccaccatgatcgccttttcataggtatttgcacaatccaccgctgccttgatcgttgcatcttccgtcgcccccatcaccgtaacgatatccgcgccggccgcaaaagccactcccgcctcatactgtcctgcgtccataattttcaaatctgcgagaatctcgtgctccggatatttttccttgacctgcgtaacgatcgacaggccgcattccataagaagcggggttcccatctcgataatatcgatgtacttgccgacttcctctaagatactgttggttttatccagattttcgcaaaagtccattgccaattgaagtttcataattgattttccccctgttgaatttagttcattataaaaccttaaggcacatatgtcaactatatttatttctttttaggaacttttgtaaacttttttcttgacttcaatacgcccattcgtttattctaaagatgagaaaacgatgcaacggaggcatattatgaatagaaaacaatttgacattcttgcccttggcgaacttctaatcgacatggcgccccacgatccttcctcttccggcggacaactgtttgaagccaatcccggcggcgcgccatgcaacgtccttgctatggctgcaaaactgggatctgtttgctcttttatcggaaaagttggaaatgatgtatttggttctgctttgcgtgatacggtaaaacaagtgggtatcaatacccattgtctgaaaaccgatccaaataccccgaccacgcttgcgcttgtaaatctggatgcacagggggaacgctccttcactttttaccgcaagccgggggccgacctgatgctgcacaaggatgacctcgatttcgatcatataaagaatgcccgtattttccactttggtacaatgtctctgaccggtgatccctgccgcagcgcaaccaaagcggcagtcgcgtatgcgcgcagccatggctgcttggtttctttcgatccaaatatccgtatgcttttatgggataatgagaaagacttacgcgcggccataaattatggccttaagcattgtgatattctaaaaatatcagatgaagaaattttatattataccaacgaagacacgatacatagtgccgctcaaagccttcatgaggcatatcctatgatacgcttgatgctcattactttgggcgcagagggctgccttttgttcataggaaatgattttttccatattcccggctgttaccagtccaacgttatagatacaaccggagccggcgatgcttttttaggcgttttcctgcatgatatcgcccgccgggattttacatccctttcgcggcaagcgcttgcaaagacagcgcagcgcgcaaacgcggcggcgtccattgtgatcggtcgtaagggcgcgctgctcatgatgccatccgaagcggaaatttcacgggttttagctgtgcattgattttctatttcgagatatttcctgattttcttttgatacgttgtttatatataatgcattccaaccgcaggagaaaatcagatgtctgaaagaacaagtccggaatattatgcaaaacataaatggtccattctcgctgtactgatcttcatgccgttcatggcaacgctcgacggcacgatcgtcaacgtcgcgctgcccgttatggtcaaggatctgcacacgaatatggaatccatccagatggtcgttatcgtctacctgatcgccgttgtcgcttctatcctgcttttcggcaggcttggcgacatcaagggcaagggcaggctgtttatgttcggtacgattgtctttaccatcggctccctgatggctgggctttcacacgacctcaatacgcttattttctcccgcgttatcgaagggatcggcggcgccgcggcgcttgcgaacaatcagggcatcatcaccgaggtctttcccgcaaatgagcgcggacgggcgctcggtatctcagggatcgccgttgcgctcggaacgatgctcggtcctcctcttggcggcttgatcgtcacatacttaaactggaattatatttttctgatcaacgttcccgtcggcataattggtttcctgctcgcgctgaaactgttgccgcgcggtgaaaaaacgcagcaaaaggtagactaccgcggcgcagtttcgctcgcggcggctgtcatcctctttttctttggccttctcaccggcgaaaaggtcggttacgataaatattacatcatattaagctttatcgccgcagcagggctcattgccctatttctgtatttcgagcgcaggcagcagcagccgatcgtcgatttgtcgcttttcaaaaattccctgtttacgttaagcatcatctgcgtgcttatccagttcttcgcgatgagcggcatcagtatcatccagcccttctatattgaagacgtccttaaaatagatcctggctccaccggccttgtcatgatgagcctgcctatcgttatgggcatcatgtcgcctatatccggttacatttccgacaaagcaggccccgccaaggtcacgctcgtgggtcttgtcatcatgaccgcagggctcgcgctgctcgcgaccatgaccgtttccgaaccggtttataagctggtcatttatttgtgcatcgtgggttttggcgcaggtattttttccgctcccaatacgtcgcttatcatgtccaccgccccaaaggaaaagctcgggatcacaggcagtatcaacgcttttacgcgtaacttcggcagcgttaccggtatctccttgctgacgaccctgctttatgccttgatgagctccaaggccggccatactgtggacggatatgtaagcggccggccggatatcttcgtatatggcatgcaaactgtatacacgatcggcgttgtaatcctcgccgtgagcgtcgtactgacagtcgtccggctattccaggataaaaaacaaaaggcttctctcaagtcttcttaactcactggcatcaaaaaagaggcggcaagtttgccgcctcttttttagttcctgtcgatctgaaaatcaaacgtacacctcgtcagctccccccagttctcctgccatcccaaaatctcgtcctctttgattttggttggttttccttcttcaaacggtacgccgtcataccccgcgtacctgcttaaaaccggtacgagccgtatcgtatcaatggtttccaattcagacggtaaaatatcaagctccatatagaagcccatatcttcctctccttcttccaacccatattgctcgccgctacttgggatccggctctcacctgcgtatgggacaaacgtcagactgcctaaaaatccgcccttttcaatatccgtccagtagtcggggcatgtaacgccgatataaagcttcgtacccgacgacgaaacgaccatacgttttacatgaagcgccacgccggataaatcttttgttatgttgttacagatcgcataacctggatcgcttatattatcatacgtcttgaaccgtccttctccggagaaatccatcgtcttgccgatctcatatgtcttgatgttcgcatagccttcctccggatcgatgctgcatctgatgcgcagcataccgatcaatccgcccttgtaccgaatcgattccccatattggtccttgtgctctaccacgcccggcacggaataatccgtataggaaagcggcactgaaatctcgatattctgcacaccttccatccgcatagtcgggtcccatacgctgtaatgctcagggtcgtaaagcgggtcgtttttacgccatttttcgatcacgtcctgccaggcggcgtaatcttccgcactcatgctttccttagagttatccacagacggcagatcaaggtctaccgtcgcagtaaacaaaacggattttgcgtccagcaactcctgttttccctcattggtaataaattcgttcccttcctcatgcgggatttccccctccgtagagtcttccgtttcatactgcatatatttcttatactcgatcggagcttccgttacaaacggcgacagcgaatatgtttttccgttaaccgttacataacccgacataaaaccaacttggtcggggaacggcacgatgtcgttttcaagggacatataacggtcgcccaaaaactcagccgcgccgccgcccatatcaaacgccacgaccagcttttccccgtcaaaataaacgtcgcctatttggggatccagcttatccgcccagtcctgccatgcgggatcggttactgtaagctcaatgctgttttcctgtgcttgttctgcttcccctggctttgcctgcttgatcatcgcgtcaaggtcggatacttgtcccctgttttccttgggttgggaaatataatcctccacgccgtgaaaggtctgattgaaccattgtacgatcgctgcgcgcacaggcggcacaaggcagcaaaccaggaatacggcgaccgcgcacgcggtaacaggaagcagccaacgctgtctatcccttccttttttcccaaatactatcgcgcgctttaagtcgcgtccatccaggctgttttgtactatattcctcaaaaattctttttcattcatctctggtttctcctttcattaaggcacgcaccctgttgcgcgtacggtacagccggtttttggtcgcctgttcgctgatatgcagggtctgcgctacctcggcgattggtttatcgtatccgtaaaacagtacgaatgcctgataagaaagcaatggttcgccctttaccagcgaccatatccgttccgtcagcgctttgtcctctatcattttttcaaacggaatgtttaccgcggcttcctctgccgccgcgtccagcgcaaaatgttcttcgtcgcctttcctgcgcgcgtaatgtttggtaagctctttttttgcaagtgttatcaggaaggctttgggcgccataatatcgcgaaacccacgccgcctgatccggcggtaaaaatgatggtatacattttgcacaatatctgccaccgcgtccgcatttcccgtctttataataataaatttcaaaatatcccagtatgtttcttcataaaccgcgctgaaatattgttctttgttcataccgccaccccgcttgtctcattttgaacagccattctactgataaagaggctccaaagctccaaaaggtcccagaataatttgcccgcctctttcagcgtaccacaagtggttttaaaatcgccctttttcattcataaatttgttacttttccttcaaaatttgttcaagtgcagttcaaaaattcgtcacgttcctgctttatcattaaattgtaaacagcaaaggaagtgacgcgagtccaccataaaatatataagctacgaaggaggcttaaacaatgaacaactattataacaatgaaaatgatggtcttcaggatgtgccgggctttgtaaaccaaaacagccaggcgcctcaaggcaatgattatagcagctattatccggtccccagtaattctgatgcaggcggtaatggcggtaaaaaaccccaaaaagaaaaatctccgtttctgaccaaaaaggtagcggcggtcgtcttaacggcctgcatcgcaacctcggcgtttcttggcttcagtgccggcaggctggataacgcggcaggaacggcgacgggcggcagcgcagataattccgtcatccagacggcggcggatttaaacagcggctccgacctgtcggtttcgcagatcgttgacaaggctgcgagctcaatcgtagagattacgacggaggtgacgcaaaccaaccagttcatgcagcaggtgaccggtgaggcggcaggcagcggcgtcatcatttctgaagacggttacattgtaaccaataaccacgttgtggaggacggcacaaaatttactgttcgtctgaagaatgaggaaagctatgaagcgacgctcatcgggcgcgacccgcagatggaccttgcagtccttaagatcgatgcaaccggccttactcccgtaaccttcggcgactcttcgacccttgaagtgggcgatacgacggttgcgatcggcaacccgctcggcacgctcggcggcacagtaacgaacggtatcgtaagcgcccttgaccgtgagcttgaccttggcgatacgacgatgaacctgatccagaccaacgcggcgatcaaccccggcaactcgggcggcgggctgtttgacggacagggcaacctcatcggcatcgtggtagcaaaatccggcggtacgaatatcgaaggccttggctttgcgatcccgatcaacgatgcgcgcagcgtgattgacagcatcatgcaggatggttatgtaaaagggcgcattgattccggtatgactttcgtagacatttcttccgaacaggaagcaatgctctatggtctctcgggtacgggcgtatatgtttcttccgtaacggatggttctgcggcggcgcagatcggtgtgaaatccggcgaccgcctcgtctcgatcgacgaccaagaggtcacgagcgcatccgaggcaaacaatatcttagaaggtcattctgttggtgatacggtcaaaatcacggtagagcgttcgggcaggacgggttctgcaaacatcacgctcagtgaatatgtaccggagtaagttctcaatttgttcatatttacttcatgaaggcttcacataagaagtttaacatgggtataacaaaagaaacaaggaggacgtgcctatggtatgaaggatacttttgaaacataaccccacccaaacagaacctacaattaatatatatcatctgagaagcatccgtccaatgggcggatgcttctttttacagcacaaactgcaatccatccaggtccgcctgctgtagttcgtcactattttcagcgattacctgcctgatgttctgctctgtcacgtttttataattttgtacggtttcgctgtaattgtcgctcgcaactgacacaagtatctcgtttttggtttgagtgttgacagcctctacgtccaggcctgcttgttccagacattcccgcatactctcataatccatatcatacttttcaaaaaaaggagagtctatcggcataataaaatacatcatattcaatgtaaggccaaaaccttgtgagttgcatccacttcatcctgaatcgccgtctgggagaccgccgccggaggattgcctgcttctgtgccggaataacacgccggaagcgcaaacaaagaaaacgcaatcataagaataaacgaaatttttttcataagccccgctccttcatttgcttcaatcacaaacttagtcgtttaagtataatatttattcttttcaaaagcaaaagcaattaaaatatccactcaaatatatgtcggtttcttaagccatcttaagaaagtcttcagttttttttccgttaaggttcatgctccgttcacattacccctttataatgaaatcaacataaagaaaggagccaatgcctatgtgaaatgaatttacaatcttctgtccctaaactattgaataagaaataaaaatataatcttggtgaaaatactgtccatccgccgaagctttgcataataagaaagagggcttctggaaaagcaccaatgataatacatatatggaagctttcttttaaaaagcaaatgcccatcggcggatatgacagacaagcaattataatcgcagcagctttgctgcaaacaaaaacctcgcttacgcgaggttttattgattctgttttttattcttacatactattcatatatctttacaatatcgccaaacggtttaaactcccgcagttccggcttttccgccgccctgccaaacggcatctgtgcgaccatctcccattctttcgggacattccactcatctttcaccacctggtccacaagcggattgtaatgctgcagggaggctgcaatatcttccgcctcaaaaacaagccaaacagcgtattgcaggatcgcgttgttatgctgtgaaaactgcccgaacttatccgcgtaaagcgcaaagtcccgcttgtatttttccacagtctccgtatcctcaaagaaaagaatcgtaccgtttccgccctgaaagccatccatctttttctccgtacgcgcaaacgcgtttggcggcgtcacgccgcgcaggatatccttggtcatatcccagaatttttcatgctcgcggtcaagcagcacgaacattcttgaactttgcatattaaaggcattgggtgcataaagcgccaacgaaagcatttcttctatcttcttcttcgtgatcccctcgccccgtgtgagcacgcgcaccgagcggcgctcaagcatcgcttcctttagtttcgtcttcatttttaacaaccttcacttcttcctgttcgtttgtatttttccattcacggcattggtcaagacgcaatccgccgtcgccgtaatctttatcctttgcaaatttcacaagctttctgcacggaaagacctcacattgcccgcagtgtttcagctttttgtcttcacaacagcttttgatcgggcaccttgccgcccagacaggcttatccctgcccacgcatccgccgcatttttcaaaataaccgcagtccgcacaaattcttccgcatctggattctatcatattattgatacctctttttcccttcgtttaaccgtcctttagccgatttctattttctgccgttcctcaaacagcatttccgcgcgcggaagcgtcgtattcctgcgcagcgaattccttgtggaacgaataaagtcgctgttgtctttttccgcataaggcaaatggaacacgatcatacgctccggccggatgacatccgttacgatctccctgccgcggtgcagcgtaatatacgggaaattcaccagcgccagatcaaccggcttgcttccgagcatccccttgatcgccgccttgtcaaacgttgcgtccccaaataccgcgatccgaaagccgtctatttcggccgcgatcccatagtttggtattccggcatattcctgcccgtcatgcgtcagtttgcagcaatgcaaaaacacgccggcgagcaacaggttttcttcctccgcatccaacacatgcacattgtgcctgtccgcaaaatccgcaatcggcgacacaaactccgtgtccggatggttttttaaaaaccgccgcgtccaccgctcgctgtaatggtccgggtggtcatgcgtataaagcatcaggtcgatatcagcaaactcgccttccccgtccgcaatctctgtaagaaggctccccggtacgcttgaaaaaagcgtcgtatacctgtcgtgcagcgcgtcgatcaatatcttcttgccgtgatatgaaatcagcactcccgcattcgcggtaagcatcacaaaatcttccatgttgttcctttcgcgtataaagtaagtttattatatgtcaaaatacgcctcttttcaaatcctctttttgcgtccggcgatatacagcgcgccgattgccgcgcccagcactaatatccaccagtcgcccatccgcatatatggcgtaacatcctgcaaaaaggatacctttcctgaaaggacgccttccgtgtttacgggcaggctgtctgtaacaacgccctgcggcgatacgatcgcgctgacgcctgtgtttcccgcttgcacgagatagcgtcccgtttccaccgcccgcataacggactgcgcaaagtggcggtttaaagggatctctccccggaaccacgaatcgttggtgaatacgcacaaaagctgcgcgcctttttggacggtgtctgccgcaacctccggaaacaggctctcaaaacagatcgttgcccccatcttgccgtactgtgtttcaaaaacgccgcgcgtagtgcctgcctgaaaatcaaacggtttttcatacccgttttcaaaaaaaggaaccagccgctgcttgtggtagacctccggcacgcttccgtccggcgttaccataaagacggaattgcgcagctcgtagccgtggatcccgtatacgcccaaaaacaggtatccttccgattcctgcgtgatatccgcgcatgctttttgcagttgcccatcttccataaacgaaccgtaaaccgagttctccggcaaaaggatgatatccgttttttcctgcgccggcccgcccgccatctggatcgctttttcaaaccgcccctgtccctcgttttcccaaaacggaatattatactgtatcgctgcaacgctcacatccggcgattcttgcggcctgtttaaccacaacatcccaaacgaaaaatttgcgaaaaacaaaagcgcggcagccatcaaataccgcgccgtccgccgtgtactgcttttacatgttaagaccccctgcgcaagcaagacgttcacaacaacgaccagcaggctgacgagcagcacgccgcccagccgcgcgctttggatcgccggaaggaatattccctgcgttacgcccagccgcacacacgggagtcccagtacgcccgcgccaaacagccattccgctccgacccaaagcacaccaaaaagcggtgcgcgtaaaaaggccggacaaggaattgccgttcctgcaaagagcgccgctacgaggatcgctccctgcaaaagcgaaacgcccagccatccaagcgtgaggtaaacgcccgccatcccgcctgcgcggcttgtaatatccagtgtaaaaaaagcggcgtaatagcataaaaaaagcgccgcacaaaagactgccgcaagaccaagcacacgtttttttcttttttcccttaacaagacgacaaaaaacggaaccaaaagcacccataaaaaaggcgccagccacgttacgtcaaaacataacgcacataaaatcccgcttccaagagcaattacaatgtttccccagtcgtgtttttccatactaactacggagcgatatctcctacgccgttcaaaatatatcccgggcggtacgggaagttgtgcggcgttttttcagtgctcacgcccgacaaaacgagcacggtttccatgccggactccacacccgccacgatatccgtatccattctgtctcccaccatgactgcatcctgcgcatgcagtcccaacatttttagtccggtacgcatcatcaacggattcggcttgcctacaaaataggccttctttccggtagccacctcgatgggcgagatcatcgcgccgcacgccggcatgataccgttttcacccggcgcattgatatccggatttgtaccgatcagctttgcgcccgcaaacacgaactgcaccgcacgaacatagctgtcataagagaggttccgcgtttctcccacgaccacgtattccgggtctacgtcattgatggaaatgcccgcttcataaagcgcattggtaagccccgcttcgccgatcacataagcgctgtttttctgcgtctgtttttttaaaaactttgcagtcgcaagcgcgctggtataaaaattttcttcgggtatctcaaggcccatacgctcaagcttttgctgaagctctttgggagaacgctcgctcgcgttcgtcaggaacaaaaaccgtttgtcttcccgcaccagccaatcaacaaactccttcaccccgcctaaaagcctgttcccatggtagatcacgccgtccatatcgcatataaagccttttttctcacgtaactctgctaaatcgatcattttctttttcctgccttatccatgataattttattataatccgcttgccttaatgccgcaactcgtccttttaatataaacggcttttccgccttatattcctcattttctgtatatccactggtttacttattttcaatatgcgttataataagattaaagcaaaccaaaaggaggacaagctttatgtctaatattattgaagacggcattaacttcggaatgggcctttttgcatactcccgtgaaaaaatcgaggacatggtcgaaaaaatggtagaaaaaggcgaagtacagagaaaagacgcgcagagctttgccagcgacctcatcaaaaaaggcgaagtgcagagaaaagaactcaaacagatgatcacaagcgaagtccatgatacattaaaagatgtcggcctcagcgcggacgaccgtatcaccaaggaagacctgcgcgcgatcattcgcgaagagatcgctgcagccaaaaaagaagacaaataaacagctttattcgaggggggagaagttatcgcttccacaaacctaaagcggtatagggaaatcctttccgcattcaaccggaacggacttgggtttttgtttgtcaaatcgacgctcagcaaaaacccgcaaaaaatttttgaaagcgaacaaaaacataatctgccgtctgtgggcgagcgtatccgtacaatgtgcgaagaactcggccccacgttcgtaaaactcggacagattctttcaacgcgcacggatattgtcacggaaaatgtggcgaagcagttgcaaaagctgcaggattccgttgcgccgttttcatttgagtccgcgagagaggtcatcgaaacggaacttggcgacaccatcgcaaatctttttgccgagttcgactccacccctgtcgcttctgcttccatgtcccaggtatatgctgcgcgccttttttccggtcccaaggtcgcggtcaaggtgcagcgccccaacatccgcgccagtatcgaaacagacctcgatatcttagaaaagctcgcgaggctggtcgataagtattccaaatatggtcagctttacgatttcacgggtatggtagcggagttccggcgcgtcatgcagcaggagatcgactttaccaaggaaggcgaaaataccgatttcttccgcgaaagcctcgcttcccaaaccaatatccgcgttcccaaaatcaaatgggtatatacgacgcaaaaagttctgaccatggattttgtggacggcattaagatcaacgacatggcggcgctgtccgcagcaggtgtcaacacctcgcagatcgcctatgactttaccaactcgctgatcaaacaaattctggaaaacggcgtgttccatgccgacccgcacccaggcaacgtctttgtcgtggaccaaaagtatgtcgagtttatcgacctcggtatggtgggcacgatcaacaaccgtttccgcaggcagcttaacgacctagtgcttgggatcgcgacacgcaacaccttaaaaatcgcgcagagcatcatggaaatggatgttgaagacgcagatgtcaatatggaggaattcgtgcgctccttagacggccttttggacgaatacctttatgtgccgctcagggacgtcaatattgccagcgtatttaccagtgtgtttcagctcgccggagcatataaaatgaaaatcccgcgcgaatttacgcttgttgccaaatgccttggaactgcgcaggggcttgtagaacagctcgaccccaacgtcagtatccttgccattgcagaaaaaacagtcaaagggattttgtacgactatatcaaaaccgatgactttaaaaatgaagtccgtacctttgcgcttgactggatggatgtgttaaagggcattccgtcctcgctgatcacgtttatgcgcaagctgcaaaaaaacaactattccatcgagctgaaagtgcaaaacttagaacgcatggaaaagaatgtcgaacgtatgtttaaccggatttcctttgcagtcgtgctgcttgctgtctgcatcgtgatggcaggcgtaattatcagtgcaggttacagcaacttcggcaataacgatcctgaaatctacggtctgagcacattcgcgctgggcacagggttgctcatttctattatcattgtgctgggcatcgtcatatctatgatccgctcgaataaaaacaataagcgtaaataattttcgcggcatacttttatgccataaatttttctggtattcttatattatcaaaacaaggaggctcacactatgaaactcggattctttacagctaactttacggaaaagccgcttgaggacgtaatcaagctcattgctccttatggctatgaaacgcttgaaattcccgcttacgaaggtaacggccagcttgaaacggccgatgtgctaaaggaaggcaacgcacagaagatcaaaaaaatggtcgcaagctatggtatggatatctgcgccctcagcaaccattccgactccttcctcatcatgggaccgacaggcgaggataccgattttatttacaagggaacggcagaagaaaaaatcaagcatggcacggaaagtctgatccgtacggcacaggcggctaacgcccttgaagcgccgactgtcgtcggctaccctggcgtagaaaactggggacgtttcttcttctttccctatggccaaggctgggcggaatacgaacagcagtttgcagaccgcttcacgccaatccttgataaatttcaggaatacggcgtacgctttgcaatcgagatccatcccaacagctttgtgtacgataccctgaccgcagagcgcgcactggaacttgtcaattaccatccggcgctcggctataacctcgatcctgcaaacgtcatgtatctgggcctgagcgttgaactgatgatcgaccgtctcggcgagaggatctatcatgtgcacgccaaggacgcgcagatggtcaagcagaacatgccgctgggcggcgcgctcatgcagggcgatatgaagcgtcttgaccgctccttccgcttccgtatccccggctgggggcagacgcactggaaagatgtgatcaccgaactgtccatggtcggttaccagggcgttttgagttatgagcatgaagacgttacgatgagccgtatggacggcgttgaaaaaaccgcagcatacttaaaacccctgcttatcaaagccccgtatgagggtaggacggacaagctgttctcagacgataaataatattacgagaatcaataaaaaaccgccggaaatccggcggttttttccattatcccagtacccccatcaccgatgcaagcggcttaacgatcgcctgcaaagcggcgatactttcgctcagtttgtcaaaggggatccctgcgattccctggatcgtatcattgagcgcgccaaaatcaagagcgttgatctgttctatcgttgcgtcaaggtcctcggtcgccgtttccgtaagctccgtcaccgcctgaaacattgcgggcagatcctttgtcgcactgctcagcgtcgcattcatcgcaaaaagccccgccgcaaaaacgaccacgaaaacaattaatatcaccgtatgcacccgcgaagacctgagtgcttttttgttgtgctcccgttgctccaccagaagggcttccaccccttccatgcgccgcataaacgctttccgccagtcctccggcggcatatcctcaaatgctgcacccgtatcctccgccggtatccttccgtccttttcatccattctcctatttacgctcctttcagtcgcttcgcgggcaggggaacgcttcccctcccgcgcaccctccctgctagcggttgtttcctttcgcgttcccgctcaggaaaccgattcgtttctgacgaccacagcaagtacgtgcatattcctttcacccgatccgcgcgtcgatccagcttaaaatatcctgctcgacttcgtcgcggttgatctcattcaaaatctcgtgacgcgccccttcgtacagcttcatggtcacatccgtcaatcccgcttgctgcatccagccatagacctcttttacgccttccccaaaattgcccaccggatccatgcttccggaaactaagatgcacggcttatccttcggcagcttctccgcccactgcgcgccggacacctcgtccaccaggtttgcaaaatcatacgccgccctgtccgtaaataaaaacgtacaaagcggatccgcattatatttttccacgcgctcacgatcccgcgtgatccaatcgtttttgctgcgtacatcctcatacctgtcgttatatttggaaaacgcgaggtgcgaaaggaacgtcgccggttttttcgcacggccaaatatcatgccgacgcgcgccaaaaatcgtatcatacccgtcaggctgttcgcgccggatgttcccatgaacacggcgcagcatgcttcaccgccgtatttggtcatatagctgcgcgcgaccatgcttcccatgctgtgtcccatgatcacgaagggcaaccccggatacgcttccttcgcaatgcctgtcagcgtatggacgtcctctaccaccagcttttccccgtccttttcggcaaaatacccaaaataagacggctcgttcatcgcctttgtctttccgtgccccagatggtcgttaccgaaaacgatccccccgtttgcgcacaaaaattccgcaaattcctcgtaccggtcaatgtattcgcacatgccgtggcatatctgcaaaataaacctcggccggacagcctcatcctgccagcagcaggcgtataccttgcttttcccgtccgcagacgcaaactccatatcttttttagcaacagccatcccttcgccctcctattgttccgtgtcctgccagccctttgcacaatcgaccgccctgccccagtttttgcgcatcgccagtcttttttcctccggcatcgccggaataaacgtccggtcgagtgtccagcgcttcgccacctcgtccatgtcgctgaatacgcccgtagcgatgcccgccaggtaagaagccccgagcgcggtcgtctcgcgcacgcgcggccgcattaccggtgtatgcgtaatatccgattggaactgcatcaaaaaattattggcagacgcgccgccgtcaacgcgcaggcggccgagcttgatcttggtatccgcctgcatggcatccagcacatccgccgactggtaggcgatcgattccagcgccgcgcggatgatatgctctgccgtggcgccgcgcgtcagcccaacgatcgtccccctcgcatacatgtcccaatgcggcgcgcccagccccgtaaatgcgggcacgagatacaccccgccgttgtccggtaccttttccgcaaaaaattcgctgtcgcggctatccttcaaaagccgcatttcgtcacgcagccactggatgaccgctccgcccataaagacgcttccttcgatcgcataatgcacttttcccttgggggtcgccgcgatcgtcgtcagcagcccatgcttgctgtagcataatttttctcccgtattcatgagcagaaaacagcctgtgccatacgtattttttgcctgccccgcctcgaagcacgcctgcccgaaaagggccgcctgctggtcccccgcgatgcccgcaacggggatctctttgccaaataatttcgcacaaccgtaaacctccgccgagctttttacttccggcagcatgcaggcagggatatccagttcctttaatatcgcgtcgtcccaggtcaggtttttgatattgaacatcatcgtccgcgacgcgttggtcaggtccgttacatgtaccttgccgcccgtgagattccatagcagccatgtgtccaccgttccgaacaaaagctcgccgcgctgcgcacgctgccgtgcgcccggcacatggtcgagtatccatttcaatttggtgccggaaaaatatgcgtcgatcaccaatcccatattctcacggatatactcctcccagccgtcctctttgaggcgcgcgcaaatatccgccgtgcgcctgcactgccagacgatggcgttataaatcggacgtcctgtgctcttttcccatacgatcgtggtttcgcgttggttggtgatgccgatccccgcaattgcccctaaagcgatctctgattcctcgaacgcttcttccagcacggtgtactgggacgcatagatctccatcggatcatgttccacccacccgggctgcgggaaatactgcgggaactcgcgttgccgtacagctacgatattgtgattctcgtcaaaaatgatacatcgggaactggtcgtcccctggtcgagtgcaacaatgtattttttcatgccgctatccctgaaaatttatttttctttattgtatcccatacgcattgcaaaaacaatcattatacaggataaaaaacaccggacaggctcagccctgtccggcgttccgcttctttactggtaccgcaggtcatgtatgcgctttgtctttttttcgctgcgcggcagggagcccaacgcaaccgcctgcgtatcgatcttaataccgatacgctttttgaattcgcgcccgacggcttctcccatctcaacgaggtccgcgccgctttccacctcgaattgcagcagcatacggtctgcgcttcccaccttttccagtgtcaccgcatattcgctgctcaccttttcgatccctttcaaaaggatatcgatctggctcggatggatattcacgcccttgaccttcaccacgtcgtccgtgcgcccaaggatgcggtcatgccttggatagctgcggccgcatgcgcattttcccgggatcagccgcgacatatcgtgtgtgcggtagcgcatgagcggcgctccctgttttttcaatgtagtgatcacgatctccccgtattgcccgtccggtacgtttttgcccgtctccggatcgatgatctccatatacaaaaaatcatcgaaatagtgaagcccctggtggcattcacagtcgatggaaatgcccggcccgtaaatttccgttaacccgtaaatatcaaaaagctcgatccccagcccctcacggatgcgccttctcattttatcgctccagcgttccgacccgatgattccttttttaagcgcgatctcgtctttcagccccagtttctccacctgctcggccaaaagcagcgcgtaagaggacgtcgaaccaagaaccgtggtcttgaggtccgccatcatttttagttgcttttccgtgttgcccggccccatgggcacagccatcgcccccagcgcctcgcatcccgcttcaaagccgatgcctgccgtccaaagcccgaaccccggcgtgatctgtaccctgtcggtattggtcactcccgcgatctcatagcacctgcggaacatctcgcaccaatcctcaacatcctgtttcgtatacggaatgatgaccggctctcccgtcgttcccgacgtggaatggatgcgcacaacctcctgttcagatacagccatcaatccaagcggataagcctgccgcaaatccgttttgtctgtaaacgggatttttgcaatgtcgtccggcgatttgatccctttcggatcaaaaccggattctgcaaatttttgcttgtaaaacgcgctgttttcactcacgtttttcagttgcttttggaacaacatgaactgtctttcttccatttctaatctcctctaatctattctcgttttattgcacagcgtcatatcccgcttgcagcgctttcaaattcatatccagtattttctgcggcaagctgcgctttaaaagttcttgcatgcgccgcagggaaaacgggatcgccccgatcccgatcgccgcgccgatcagcacgatgttcaccgtctttgcattcccgcattgctgcgcaataccgtatgcatcgatgaaatgtgcatccgcatgctcgctgatatatgcgcatatcccgtcgagatcgtatgcttttcccgtgagcgaagccgtcaccggaatcacacgctgcgtacttacgaccgctttcccgccttttttcagccgcccgatctggcgcgccgcttccgccggttcaaatgccaacaaaaggtctgcggtgtgcatggggatcacgctgctttttccttccgattccacgcggacatggcttaccacgcttcccccgcgctgcgccataccaatggtttcggacgaccgtacaaaacacccgtcctccatcgcagactgtgcgatcaacctggaagccagtatcgttccctgtcctcctacgccggcgatcaatacgtcacacttcatacccgctccccctctccgatcgcgtgggcggggcatacatagctgcacagcccacatccatagcaaagcgacggttctatttcaatctttccgtctttgaaagaaatcgcagggcatccgatctccctgatacatttcttgcaggagatgcatttttcctggtcgaccccatacgtttgatcttgtttcatcagggcaatacacggcgacttgaacacgatcgcagacacgccgtcatattccgccgcttcgcccgccgtctttttcgccaactccacatcgagcggatcgactgttttgatataaccgacgccgcacgcgcggagcatcccctcgatatcgacgggcgtggatttttcacccatcatcgttgtccccgtccccgggtggggctggtgccccgtcattgccgtcgtactgttatccagcaccactacggtaatatccgctttattgtataccgcgttcaccacgcccggtattcccgtgtggaaaaaggtcgaatcgccgatgaatgcaaaatattttttgtccggctccatgtggtaaagcccctgcgctaccgtgatccccgcgcccatgcacaggcaggtatccgtcatatcgagcggctttgcgttgcccagcgtatagcatccgatgtcgcccgtaaaaaccgcgggtatccctttcatcgcctgcttcactgcgtaaaaagatgccctatgcgggcaacccgcgcataataccggcgggcgcacaggcagctcgggcacttgttcgtcctgtcctgcctcgtcctcgattccacagaacgcagcgatcgcaccgcgtaccagttcatgtgtatattccccgcaaacaggaaggttccccgtttcttttccgtaaatatcccattgcagcttatgcctgcccgcaatctccgtaaggctccgctcgatcaccgcgtcaaggtcttcgaccaccaaaaccttatccagcttttccatggcctccagcataaaatcctccggaaacggatacggcgtgccgatttttataagcgtcacatctgcattaagttcttcaacagcctcttttgcataggtataagccgcgccgcacgcaacgatgccgatctttccgcttccggatgcagcgttccatttcgacttggagaattccttgccgatctctttttgcttttgttccaacaagccgtggttttttagggacaggctggggaatatgacccagcgcggatccttttcaaaaccatcaaagccgtgcttttccatgcgttctttcgtttccaccgaagcatatgcgtggcaaacgcgcgtcgtcgcgcgcagaatgaccggcaatccccatttttccgaaagcgcaaacccatattgcaccatatggtatgcctcttccggcgtggacggatccagcacaggcaggttcgcaaattccgcaaaatgccgcgtgtcctgctccgtctgggaagagatcgggcctggatcgtctgcgaccatcaccaccatgccgcctttgacgcccaggtaagaaaggcacatgatcgggtctgccgcgacgttcagccccatttgtttcatggtgacaagcacgcgcgcgcccgaaaagctcgcaccgccgccaacctccatcgccactttttcattaggcgaccactgcacatggatatcgcccgagttatgttttgcgaccgtctccagcacttccgtggaaggcgtgccggggtatccgcatacgaggttcacgcccgcgcggatcgcccccaaggcgatcgcttcgtttcccatcaataatttcaaaaacaggcctcctgctcttttaaaaaactctttcaattatatcaaaatacccctctctttgtaaaacgaaacttcctaaatacagcgtatttcctatcaaaaacggtttatgatataatagaaagaaaaccgaaagaagtattttatggaaaacaatgataaaaggatcgcggtattgatcgatgcggacaatgtgtccgaccggtatatcaaatttattttcgatgagatttcgaattatggcacgccgacctataaacgcatctatggagactggacgactacgcaaaacgcttcgtggaagaagctcctgctcgattattctatcgcccctatccagcaatatggctatacgaagggtaaaaatgctacggattcagcgctcatcatcgatgcaatggatatcctgtattctaaaaatgtagacggattttgcatcgtctcctccgacagcgacttcacacgccttgccgcgcgcctgcgggaatcgggcatgctcgtgatcggcatgggcgagcaaaaaacgcccgccgctttcatcgctgcctgcgaaatttttaaatacctggagatcctcgcgcaaagtacggatgaaaacgcggagcccgaagcgtctcccgaagaaaaagaggagaaaaccggacctgccaaatcgcctatggcgagcaagcaacagctcacgcgttccattaaagcgatcgtcaacgatatttcggacgacgacggctgggcctttttaggcgcggtcggcaaccgcttgaataagcgatatccggattttgactcccgcaactatggctatgccaaactgacgcagctcgtggaatccttgaagcagtttgatatcgatacgcgtaaaacagccaatccgcatatcaagcacaaattcatacgcaacaaacaggacgttaagcagaccagaaaaacgcgttaacagcttgcacaataaaaacaaacccccgaacggttattcgtttcggggggctttattatcaatcgatcagcgaaagctcaaaagatcgtctaccgtctttctcggcggcatcgccggctgttcatccgcatatccgatggcaagcagcgccgctaccttctgtccttcttttacctgcgccgcctgcgcgagcttgtcatcgtcaaagatacccatgatcaccgtgcccacgccttcattatgcgccgccaggcaaaacgtttgcgtcgcaatcccagcgtcaaacatctcccagcggtcttccttgctggtggagaaacttccatcacgctcaaacccgctgcgtcctgcaacatatgtaacgaccacgatcgccggagcatttttaagcgtattcgtgttataccggaagcccatcacgcagttttccgcgatctcgttcttgagcgtttcgtcttcaatgaacagataccttgcgatctgcgtattcttccacgaaggtgcgcacgccgcggcttccacgattttttcgatgaccgcgcggtcgatctttttttccttaaacttacgtatgcttcttcttcctttgacacaatccaaaaattccatgatgattcatctccctattttaagcggcctcatctgcgccgcctcttttacttacctaccgcgtttttcagttcgccgatcccgtctatcacgatgctgatcttatcgccctgttccatcggcccaatgccgcccggcgttcccatcgtgaccacatcgcccggcccgagcgtcataaagctgctgatgtattcgagcagcgtgtacgcgtcaaaaataaaatccgccgtatttccttcctgcaccgtctttccgtttaaaatagcgcgtatcttgcgatccctcggttcaaatccggtcacaatccacggaccaaacgggcaaaacgtatcaaagcccttgcagcgcgcccactgtccgtccgtgctttgcagatcgcgcgccgtaacgtcgttcaggcaggtatagccaaagatatactgtactgcgtcctcgcgggatacgttgcggcactttttacctacaacaaacgccagctccgcttcataatcaagccgcttgcactgcggcggtttgattatcgtcccgtccggctccaggatcgcgctcacaaattttgaaaaaataagcggttccttgggcgcgtccatttcaagctccgccgcatggctcctgtaattaagccctaccgcaacaatattgcgtggttcggacggcggcaatatcgcgcaccggtcaagcgggatctcctctcccgtatataccgccccttcatatggggaatccagcagcagcttcgcactctcatccgtgatctcggcataaaaaacgccctgctctgttcctactcttccaaatttcatcgttttgtccatccttgtctttttttcattatatcacattctttctcttgtgatatgcatggcaggaagaatttttataaaataaaaatcccctacaaaggtaagggattttatgcagcgacatccgccgcaatatgtgtcgttcatacaaaatagatgcagctaaaaacggggccccgtgctagcccagcgcagcgggtcgcgtggggaaaaggagcggcagtggaacataaaaaagccctcgcttttgcgagggctttggaatcgcggaacttgccgcgacgtgtatcatcttgacagaatagatatcgctttgtaaaaggctttattgtcacgttcttgcagtaaaacatgggctaaattatatggataatatgtatcccgtttaactgtcggctatagattcgatacgacatctccaatcttaagaccacttttagaaaagagctgggatagattagtctgaaagcaatttgcattataatcattaagcttgacaattaccaatttactttttgcccgagtaactgaaacataatgattataaatgcttgccatatcagaaagtcgatgaacaaacaaaaagccgtacgacggtggagtgttgtacagcttagatatttgtttagtcacagaaatttactaattatcctactcatacattgtggataaaccttttggccctatcgcatcaacagggtattgttcgagatcttttatatattctatacctccttctgaacaatactctgtatttcgtcttgtagtggtaaaaacatcattgataactgtattccatatcgtatccagacgcaaggtaatgtaatcatgtgctaaaacgctctcaaagcagccattttttgccatggtatctgcgggtagattaggcggaaattttcgggtattttcttagtagcttcaccaataatctccactctccgaataatagcatcttgtaattgtagtgattctaaaatatatttcaaatgaaatctgaagtctttcaaaacagcctcaccctttcccttaatatctgttccgctatttcgggaaccagactatcgtccggcactatatccacttttattcccaaatgatcttccaaactaaggcgaatatccagcaaatcaaacagagaatagtttggcttcaattccaccaaaatatcaagatcactattctctttttgttcatttcgaacataggagccgaatagaaacgcgcccgtcacatcattttctctcagtatatccacgacttcatttttcgttttttcattgaagttgatcataccgtttcatctgtttttatcgcttaatccgctttttagatatttttcacttaatattgaaatattatatttgtttttcccatttatttaacaacttgaaaaaatagtggtaccactatgctgcttttcccttgtaatcaacaaccataatctcgctggagagttctttcgccgccgcaacgatttcttcaagtctgtccattacggtgtcagaaaaatatttctcaccatacctttcacattcttcacagggaacgttccgtacgattacaatgcaactctttaaatcaacaacatacgttgtatagctttgttttgtggcttcttttttgcaatatgcgcacattactttggctcctttcgtatcttagagtcgctttcccatttcactttatctggataatatgctgttacaacatatataaacgcatcatcacatccaacaacaatatgtaaagctttgttcttttcgcctactcccaaaacaagacagctagggtgaggaaaatcatctggatattgctcaataatctccccggcttctatcccgtgtaggatttcagttcgcagaatatcgcgttcctgaatccttgtggcgcaatgcgtggtctatttaaccattttttgctttacgaaagatcggagtatatccagggaaatccttttcttatcttccatgcttatccttaggtgcttgctctgagcctgtcagcttgattgtgcctgtaacacaatatggagtttcataacatcaatttttactaatccacactgacggcgacctaatcgccaccgacatttctatcggttaaccatttagacccgtacattcgcgagttcgtcagacctctcggtcattctcaccatagatattttgtagacctccggcatataggtagcacaattcaccgctgaaccgctttcgttgcattactgcattacggctactctctgccgacttcaccgagcttttgacggtttcccgccaatcggagattaaggtgggcgctttcgaacgttacttcttcatttcacccattgaattaccagttctccaagtattatgtgcgctcctttcgatcgcatttttctaacttgtgcctaaccttttcagttaggaacgagtcgcactgatattcgtctcgactcccaatagcttgttttccacttcgcgtaccgcctcgtcggtcggcaccgggatgatatcgatggaaaagaagatattgcggctcagttcacatagttccgttacgaggctgtccttgatgtaactggcataatcccgcaaaaagataacccggccgaacttatctcccatccggaaatgtcctttttcaaactccagggtatccgggcagatatagtctttgaagttatggcctttgcgcaccgcggcattcaagtcgaaattgtagtgaacctcgtctgccgcgcggtaaaaatcatgcaggatgcgaagacgttcagacgcatccagttccgtacaccgggaagataacacgcccagcttcgaggccatctccgcgctgatccgcgcaaagtatgtacgcgcatcctcaatatttttccgtaccacggatatagtaatataacgatcctggacaatatggtttgattccgcagcatatcccatcagcatttcattcatttcgtcgcggtaatgatccaggccatcatctttcttcctcagcaaaatggcgtcttcaaaatccgcccggttaaggcggcggttacagatcgtcagcttggttgtagcgttggtatccagggcgtttagaaaatctgggtaattcaggaacatggatgttttgtcgtcttttgatgtaatggaataattaatgtctgtaaaacgccagcatttcgtaaatttgtttccacatagaaaaatcccatccggccatatgcgccggatgggaatcgtatcttgtacgctttgcgggacaacatacctttctttgtcctgctttaatactcgttgtaatgatttcagcatgaatcattctccttgttcttttagtcaggagcagtattttcatgccaatatgaatttctaatccttcagtcttttggacatatcatcgtgtaatatatattcgccgccctgaacaccagcttttttggagtcagcagctcagactttacccaggcggctataaattgttccgcggtcattccgttatatttcacaaatcccaacgcgccgaacgggaacgcgcccaggatacaaagccaggataccgtttccgttccaagcacattaacattacgcaagccaaaatatatccctacagttacaatgattgcaagcgccgcaaaaacaagctgccgcaggtttaagccaaaaaatattgatcctggtagtcgcgtatctccctgtttatcttcacttccatccttattctccttactctctgaacacaaaaaaatcgccattacccatgacgattttccattcagttaatcatttcctattcttggctaaacaaaatgctaatatactctctcctgtaatataatatacggtagatggatatatactcactatctgctttataaaaaacatgatagtgtccacaaaccagccttttaaatccggttttaatgccaagcacggttgaaatgtccgaacccattgtgggaaaatctaccagtttctcatatccctcaacaatatcccatattacctttttcgccgactccggattagataattcttccgatatatatttttcgatttcagtgaggtcgtcatccgccgccggtgtcagccgcagtttcaagccgttcatagcccgtgcctttcgcgtacttcttcggcagtaagccagccattttcctgcgcggattgttcgcccttggcaagttctgccaatagtttcattgtggcctgctgtttctcatattccctaatatctgtaagcacatacttccccctgccgtttttcgtcaaataaacaggcgctcctacagcgatatcctttaacacttcattgtaattctttaaatctgaaataggtttaatattgggcattacagttacctctctttcaaatatattataccccatattcaaccccatattcaaccccatttttgctatagccccattaattcccaaactacccgatccgccattttgaccaaccctgtaagtacaagtaaattaaatacgagctccccaagatacgcccaaacgagtgttgtcggactggacgacggatcgacagcaggcggcgaagtcgcgaaagaactgaatatgatgcacgcaagcacaatgacagccccttccaaacagaccgccgcatatcctttcagaaacgaaaagccaatgttttgcgtcggttcgcccgcgatggacgagagagggattggtgaaagggccgtgtaaagaaataggcggaaaaaccgcccgtacacactcatcagcataataaacgacaacacaatgatgaacaggctgcctaacagcgataccgcccacaccggaatactttccagaaaactcaaatcgcggattgccgtatccatcgcttccggtatcgtaagcggcgcgcccgccatgccgccgcctgcacttaggatcgtggaaactattccctgcacaatcctgaataatgccatcagtatttccatcccggaactaattatggcttttgcgacagcaaaccggataaacagccgtactgcctgctccgggcgctttaaatcctggaaatttgtacaagtcttgattacgcccgttagaaaaaaaggactaataatgcgtagccgattgcctgcagcgccccgttgatgctggtgatggtattccatatgccaccgcccttgaaggtttcaggcgactgcgtaataaggttcaggatttcggccattttctcattccaggtttgcaatgcattgccaatattctctataatccaattaccgctgttcatggcccctcacgccccttccatagatatttttccataggtgttcagcctcctgtaatgaggtcaaggatttcctttgcgaatgtgattatgatgccgccggcaagagtcaaaaagccgtttgcacgctgggacggatcatggcttttcaatgagagtccaacctgtacgataccgaacgcaagcaagataataccgattgcccggatcaggccaaaaataaaatctgaaaggttattgactacagcgattggatcatcggccgcaaaggcggtattggcaatgttaaatactaaaacaagaatgatcaaaaccgagaaaaagaatttatttcttttactctttttgttcatgcggtaattactccttgtgattgttttgatattaagttaagatgcaatgagcggcttccccgttattatgcctttgtggtggacataagccggagcgtccatgcgattgcccatgggatttcgtcataatagacgccgcccctaatgccgcgctgatccatctgtggctttcctgctcgttccctccaaggaaaagaatcgtatccgagtttccgggaatggtttcccatgaatacttaaataattctttgatttgcgcaatattttggataatggtgcaggcagatatatttcttgacctcatatttgacaaccacaaaggatagtcctcaagttttgttgaagcaaattcatcacatatgagccggacgtgccgcggcaggccgccgccatagacttgatcggcaatataatacatagtctggattgcctgctggtataaaagtgacacaatgaaattatacgtctggtgattgtcgggaatgacagcgaacaaagcgacttttccttcgccaagcgtatccagccctatctcatcatgctttgttaattcccggatttgcggaatattgaaaggagccaatctaaccgccagcgacacaatgatggattttgctgttttaccagccgcctgctaatatactttatacatttttaccgccagatgatccggccccgcttcatgttccaaagactcaaacagcatatccagcggcgatatatactcttcgtcatcctctttgacttcggcaaattccaacatgcgcatgaccatggaaaaattctgctcatattcaggcgcttcatacatcagataaaaaaccaatgcttccaggagtgcggactccgatctcgtccagaacgggtcgctctcgttcgtgtttttggacgtggttgccgcaatgattgtattcgccaggcgcagtacagacgcttcatccgtcaggtagcggaacgggttgtatccatctgagcttgacatattgacaaggttgaggacgcgaatatcatatcccttaattttcagcaggttgcctgtcgcgttaagcatttcctgtttaggatccgtaatgatataattggtattcgcgaacatgatagacggcaggcagaatccgcgtgtttttgacgagccgcttccccccatgacaaaaacgctgatattacgtttgtgcttgtgggagtcaagacccagccgtacatgctttgtcaaaacaatattttctttctgacggaacttcgcgttgacactcgccggagacgcccaccgcgccgatccatgttcttcgccgtcacgggtatcccggagcgaaaaataatatatgcttaccgagcccaaataaatagcggtagctgccacaataactttcaaactatattctgtccatatgacttggaatggattttgaattgaaactgtaaaatttgatatgaaaccaggaagcccgccgtcaaacgattgggcaattagaagtgatatccatataaccggaatatatatgatggctgtaataaccagggcctgtaataaagccccttttttcaaatctccatcaccaagaatctttgtaacagccattaactgtcagcaatcctgtccattttggcatacaccttcttcagcaagaacaacgcctgtgccgcgcaggattcaggatcggcgcccgcgtttgagttcctggcggcctggttgatattcacgcctattttattgatttccgtatatagttctttgatggcctccgaagggcgtgccctgatccgctttcccatgatcatactgcgaatgaatccactcatggacaggccgctttgctttgctttattttgcagggcattatattcttttttggacaaaacaaagtgtgtgtgatgcatgacctgttccagcactatcacctcctcattttggcatatataaaaaagacgttcatttctgaacgtcaccgcctgtcaaagaacgcagtaactgtttaggcgacgcagggttctttttcatctgagtattgtataagcagtctgtaaaactgagaaaaaaggtctttggccttccacaaggccatcttcttgaggttcatcgccgcatatttcatcttgatccagcccgaaacccggctaagtcctctgtgccaggtataccgcataccgtgtttttccttcgcgtccgcgaataccctctctatcgtttgcttacgcaacgcgtagctttctttgccaatatccgaatgccggatgtcttccgctatctccagatattcattccaggtatggcactgtactgtcttttggcagttgcggttatccgtgcataaatgccgcgttggacactctttgcagatatacggtctgctcttgtattcccggtatccatccccgtttgtagtcgcgtagggcaacgtcttgtattccgggcagatcacgcagtcgtaatattcgtcctccacatactcgtaccactcgcggcagtctttttttgtcatcggacgtttgcatggaagtgacggcagccgcccgtcatctatcactcgcttgcaaatccatggcgttttgtaacctgcgtcgatcgctatcacttctatctgcggaaacgccgctgcgatccgctcgtacagcggatcgaacatcacgctgtcatgaacattacccgcgcttacctccacatccagcacaaaattatgtttgtcgcatgccgtatgcgctccatacgcaaaacacattttgtgttcacccttatggaataatccactctgggggtcggtggtggatacggtggtctcctttattcccacgccgccctttaggattgtcgtcaaacagcttttttccatgagcttccctatcggcattcacttcctccataagctgcttctcatatgcccttgcgcagcgggggatttcttttttcacctgttcacattagcgctcgcttttacatgcattgcgtctatgaaaaccatctccggtgacagaaagcctgcgtttgccacttcctccaatatccactcaaacactttgtgaatcgtctcttcctgaaaccgattcacaaagttgtagctcacagtggcgaagtgcgggatttgctcattcaggccatatcctatgaaccaacgatacgcgttgttgtcctcgatttcccttaacgtctgacgcagcgacggtatgccgaacagatgttgtataaacacaatcttgaacagcaccactgggtctacgcccggcctgccgttatccgggcagtacaaatcctctactatatcatatatcttcttaaagtttactgcactctctatcttgcgtaccagatggtcttcgcgtaccaacgcctccaggctaagcatggatatttgccctcgattaaccttttttcgctctatcattacaattcacccctatttcagtctaccaaaaaaggtcgcatgccgcgaccttttttgacaatgaagaacccttcgcccaggcgaagggttctttccccctgttgattggtaatctgttcatttattttttgtaaagaacggttttttgggggccgtacaattgacaaaaatggccccgggatgctatagtacccctagaaatagaataagcgtatgatcttatcgttccattaacaacaattatcgcaagtttttatgtaggccagatcccttcaggcctattttttctttttccacaatccggccatgtctttgggcttattatttttcatctttccgggcagccggcatatgcctatacctgtaaaaacaagctgcacagcgcattcctgacccattccaggcactgcgcacggagcatagtgctttccatcccagaactaattgtttcaacctccccgtgacagagtcagggagttatatatcccgctgcgtttcgtcgtctttcctatgctgctcataaaaggacttatacagctcataatccttatatttgattccttcccgcagcttggtcgctccaaacaaatacaaataggcgggaatcagggaaacgtaaacgaacgccttttccgcgaaatccgtaaacaggttggccataaaagtggaaagcagcaccatgaccatcgccagtgcagaggcagccatatgcttttcccggtgccggatgaaataaaaagccaacagccccgcggtaagctctaccgaagtcatgacccagtcgaggagcataaatttccaatccggttcataggcatagcccgggtccatctccatcaggtaaacggaaattacagccaacgcgtccagcgccccgatgataaggagcagcacgcccgcggctttaagcagtttctccgccctgattccttccacaaaatccacgattttctgtatcaaaccgaaggttctccttttattttaccacctgccgaagctgctgccgcccgctccgccgccggagaatcctccgccgcccgagccgctgccgccgcccgaacttttcgtcgccgtcatgcttgcaagcgcgctgttcatgccccggtgcagcgactgcgtgaaatacagcgcagaccatgcgccgccgtaatagccataataccaatgcggcggctcgagcgcaatgctctcaaagcgcttcgcccatgcgtccgtcacacccagcacatacgcatagggcaggatatgatagaaggtggccggatcttcttttaccatcattttgatccggtccgcttccgccgtctcgataaagcgtttgaggcccagaatgcgcccggcccactgcgcgccctgttccgtacggcggggcgccaggcccgataaaagcgccataataagccccgcgacagtgggcaggacgatccaccagcccagataggtggaaaataaaatataagctgccgccgtcatgcccgctagaaggaggatccccccaatcatctttcccgcgcgcgcggattttttatccgatttccgcctgctcactgaatcgctgacaagcagcgcgcccagccagccgactaatcccatgaatacccccccgatgaggatggaggcaaatatgtccatactttccaaataggccgcgactgccgcaaccgccgcgagcggaacggccgccaaaagcgtcccgaggtatttgaacgcaattgatttttgcgtatagacgcggttttccgcggtattatattttgctttgatcctctttttcgcgctgtttaccgtatcggcaaattcataccgcatgtccctgatgtcgatgctgtcggaaagcacgaacatcttcccaaacagtattttttcatagtcgtttgcgccttgcggcaaatcttttatctttttgaatgtcaaatttttttcatccggctggtggatttcaaggaaaccctgatccgcccagaagatcagcagggaaaccacgtctttgttgtccgtctcgccgtcgatgatatacccgacgtccgcgctgttcatgccttccggcgggccgaattccaccgtctccacctcattgcggcgccgccccgcgcacgcgagcaaaatcaccgtgagtacaagcgccgcgccgcccgcgcacagcgccgggataaagtaaaagaacgccgaacgcgcgcccgcataatatccgtcaggcagctctacgcgcacgcccacgccgtaaccgctttccaccgtttttattaagttgccccgaatgacgtttccttccaccgtataggtaagggcgctctcgtcataggtgccgcttccctccactccggtggtaaagccgatcttttccgcatcgaacgctttgggcagctcgatcgtaaagctgagcccttcaatgggaatcgtgttttccgggcttacaaggttgtagtaaaactcgtctgcgcccgaaagcgtatccggccccatgtcgtaacggtagctgtattcatattccactatgcccgtcaccgtttcgtccgggtcgccgaggcggatcaccgcattgtttccttcccgggaaacctcgctgggaacattcgctttgaggtctgtcaacacggcatgcgcgcccttttcctcatagctcccgtccgccatacgccgcagcttcatatccaccggaaccgtttccgtgataccatgcgtctcgcctatgctttgtgaaaaatccgccgttattttcttagagatatcgtatgtgttgtcctcattgacccggatcgtgatctcctcgcttgaaatcacataatccggcgccgcctgcgcaaaggcggcaagtggcaagagcgccgcaagcgctgccgccgccaatatgacaaaccttttcagcttctgtttcatagcgcctcccgtttaaaccatcttttgattatagtatatactttgcgcccgccgccgtctatccgaaaacttccggcctgcgcttcttaccagacggagagcctttcctctggagcgagatacatgccgtcgccttcctctacgccgaacgcatcgtaaaactcctgaaactgctgcacgttcacgttcgcgcgcagatagcccggcgcgtgcgtgtcaatctggagcatatattccgcggtctcctccgattcctgcagcttccagacctttgcccagctttcaaaaaacgtttggtaatcgaagccgtctatgccctttgcaagctcgagcatgcaggacatcccgccgaggtcggccaccgtctcgccgatggtatagtctccgtcgatatattttccgggaagcacctcgatgcttgcgtaatacgcgcccaccttgtccgtgcgttccttgaacgccgcgcggtcttcctccgtccaccagttagagaggtttccgtccttgtcataaaggctgcccatgttggagtcgaacccatgcgtgatttcgtgcccgatgacgataccgagcgcgcccatctgcgcctccagggagccgtccggatcataaaaatccccgcccaaaatgcctgccggaatattgatggaattatccgtcggctggtaaaaagcgtttacttcctgcggagaggtcatccacaggtccttatcgatctcggcctttgcctcgtccactttctccgacatacttttttcccgcaccgcaagaacgtcgtctatgattccgccgtcctccggcagcgtgtaatccgaataatcgtacagcgaccagtcgtccgggtaggccacgcggatcttgagcgtatcgagcttttcgagcgccttcgctttcgtttcatcgcccagccactcgttttcctccagtctttgccggaacaccgccacggcatcgttcaccagcttcgtcacatcctgcttggtctcttccgtcacatagttttccgtatacagcttgccgatcgccatatcgaacatcgcggagcacatctggtaggcgagctgctccgtcggcagctccatctgcgcgctccccattgccgcgccgctgtattccgtcatgatatcaatgcattcctgatcgagcagcgccgccgtggccgtcagcgtctgatggacgagccatgccttgaatccctctatgttttcctccgtatacagctcgttcatctttgcgagccattccggctccgtgaggataaagcggtcgatgccgccgtctgtatagggcttcagaatttccatgagcgggaaatcgggcgacagtcctgcaagctccgccgcgctcttcggattataggctttgtcgcgtatgtctgcggaagttccctccgcattcccgaccgacgcctgcgcgatctccgtctcaagggcaaagaacgcttcccacagggcggacgcctcctcttccgaatatcccgcgcgggcaagcaattttttgaacatcacttcccccgcgtctttttttctctgccctacgtccgttatgcttttatattcgtccgcatccgagagcgagaagctcggcggaccgatgtaaacggcattctgcgtgctgtccttccaatccgccgcgatatccgctttcgcaggcgcgcccgcgaggttcccccagtctgcaaggtatgctgtcaaatcgtccagcgttttaatcgcttcgatttcctcgagcagcggcaaaaccggctccatgccgagggcgttgcggctttccatatccacatagtcgttataaaattcccgcacaagctccgcctcgtggctcgtctgcgactcgtctgtaatgagcgccatgacctgcgccatcacttcattgctgcgctcggtaaaggtgctggcctgcacctgcgcgccaagctccgttcccgccatccattcctgattgaccgccgcattgaaatcgtctttggggtcgatctgcatctccgccgtcacgctcccggaaatatccgaattgacccacgccgcgcccggcgcgctttcctgcgctccggcctgtgcgttctccgctgccgaagcggacggggccgcgctttcctccgcctgcggctgtacgccgcacgctacggcaagcagcagggccgccgcaagcaagaccactgagactcgtttgatggttttcatattttgtcctccttatatctgttcgctaaaaagcaggccgccccccgctgatacgcagctcaattccggccagcctttttctctatgatcgccgcgatgtcgttccgtatctgcgtataccgcattttgggtatcggaagctcctcccctgtgatcagcgtcagcttataccgctctatcttcgccacataatcacagttgataagatagctcctgtgcagccggtaaaaatggggcggcaaatccgcctccaacgctttgatggaagcctgcgcctgcctgtgctcattcaccagatataggatgctttcccgttccaatgcctgtatataccggatcatccccgtatcgataaagcaaagcgagccgttttcctttacctctaatctccggttgttgttttccccgctttccctcagcaggcgctgcacataccggtaggtctgcttcgtgatctggacggggaaaacctcctcgtctacaagttcgttgtattcattggatacgtgcatgtgatacaggcggtaaccgtctgcttccttgcggtagcaaaacgtcagccgctgccgcgccgtgcacactatgtccgcctgtccggaggcatagagcgtatattcgccgagcaccatgagctggtctccgctccctgtttcgatctgccggaagcttggttcctccaattcaaagcgtggcataataaagccgtcctggaactgtgccttgatcgcctccgcgcccgagacgagaagatttcctatactcagccaaacgcagtctccggtcagcacatcgaacagcgggtctgtattcaggcggtaatattccctgatgatatacagggtgtcttcacatacggtctcttttttgatctccataagcatcatccaagcatatcattttctgtctgttgatagaatccattataccgggcgcaaaaatattcgtccattaaattgcatgaatcgggcatacagcgcgttgaatgatccctccgttcttgtccgcgcgcaggaaatcctggtattttgttccatcggaacggcaaacaagcagcttgaacgcatcaaagttttcgtaaatataatcttttactccatttgtcaacagcagaatttctgcaaaattttccggtatagtattttggtttgaaaaataccccatctgggtatattgagcctgtcaaagaacccagaaaccgtttaggcggcgcagggttcttttttatgtgaatattgtataagcagtgtgtaaagctgagaaaaaaggtcattgaccttccataaagccatcttttgagattcatcgccgcatatttcatcttgatccagcccgaaacccggctaagtcctctgtgccaggtataccgcatgccgtgtttttccttcgcgtctgcaaatacccgttctatcgtctgtttgcgtagtacatagctttccttaccaatatccgaatgccggatgtcttctgctatctccagatattctgaccagatatggcactgtactgtcttttggcagttgcggttatccgtgcataaatgccgcgtcggacactctttgcagatatacggcctgctcttgtattcccggtatccatccgtgtttgtggtcgcgtagggcaacgtcttgtattccgggcagagcacacagtcgtaatattcgtcctccacatagctatcatgcccttaaccgcaccccttcctccgcaatgctgcgatagtaaggtaacgtgtctttgtattcttcaaaatcttttacaggtatttccgtgaagctgaccaatacgccgtactccatcataaaatgcgtcatttgcgatacaagctcatgatggtacttttttaactctccgcgtgttgcgtccgcaaggattgcaatatctatatcgctttcctgatcgtaatcgccacgggcgtatgagccatataagatcacagaaataagcctattgccaaaaacgctttgcatatttctataaacttcatttaagagcatatctaactccattgctcccatacggtcacgccctttctgtcttttgctggtattataccttatttttacgcataagacacttctttgtgatagtcaaactccttcttccatgctttaatccgcaacgcggcataggggtccggggccaacgccccggcaagctgtgcaaatgtacatttgcgctatgcttgcgggatcagcggcgcagcgccgccgatccccgcccgccaattcagcgggcaacggttttcaaattgtttgcttttctttgccttatccggtgctttgactggaattcccatcatacggcaataatctttttgcgtttctataacacattccgcaatcagggaaataaaaggcgtagtattcggattgtgttcccgttgcgcagcccgcaaagcatcaatataatccccgcggcgaacaggaggtatgattgccggcccatatcccgcgtgtatgagaatcatattcatgagcaggcgcgctgtcctcccgttgccgtccacaaacggatggatatctaccactcccatatgcgcccgcgccgcccattcaatagggtgcaacatgctcattctgttgatttccgaaacaagtcttttcattgcttcgggtactttctccggcgcaggcggcacatattccgtacccgttataaaaacgcgttcatggcggtactgccccgccgcatcctggtcgattaaatgatagaatagttcatgcagcttacgaatcatttcttctgtgatagtaaattcttccgcatttgccaaagaaagcatatagtcataggcttcggcatggccggttgcctcgtagtagtcgcgaattggctttccgccgacagccagcccgtcctcaagcaatactttcgtttccgtgatcgtcagcgtatttccttcaatggcattgctggaataggtcaggccgacacggaaataccctgccagatttttcgcttctttttcaggaatcgggcgtattttgtcgattcttgacatatattcatctgcttttaaaaacaattctttcaaggctttatccataggtataattataccatgcaaaaaccgcaatatctattaagacagcgcgctaagatgccgttcaatgcgctcgcgcccaatctgtgcatactcgtccgacatctcgatcccgattgccttatatccctcaatcaaggccgcaagcacggtagtcgctcctcccgcgaacggatcaagtatcctgccgcctggttccacaatatgcacaacctcgcgcatcagattcaacggcttttccgttaaatggatacggttttgcggattcccatgcttaaacactccgggaaggcatggtaccgcccgtttgataggcatcgggccattggagccccacacaatgtattctgcctgcgcccggaacctgcctttctgcggccgtgaatttcctttatcccataccgcggttccgcgccatatccagccggcccactgcagcgcgtcggttgcggcgggcagttgcctccaatcaatgaacatacaaacaggcgcgccctctttacaaacctttctcgcgtcggacagccactcagcggcccacctcgtccagcttctttggtcttttgcgtcgccgtcaaaggttggcggcgccccttctttcatgctggaatacttttgcacaggcgatttcactttttccgcttgtgtcctgccgcccgatgcatacggcggatcggttataatcccgtcgaatgtacccggttcaaactccttgatcatgttcagtgcgtcgtcatggataatatccccacagcttatcctcggggtaattcatatatgttctattgtcctcctgataaaaaatatgccacagctttacctgtggtctttattgtgattctgtctttttctggcgccggtattttttaccaagggcgttgagagttccatttccacatattcacttattatatggagcaccgattcatagctatggctttcaaaaacacgattgctcatttcttttgcctggtcgctaggcccgtttcttctcaggagctggctggctttccccaaaatagcaaaaatattaccatccatgcctgccagtttcatttttaggcgttcattcaatctgcttgccctccgtttctatacattttttgcaatacttccgaagttcatccgcctgtccttccctctcctgtcgcccagggcctgccggaaacaaaccgtttggatattcttcaaacaccggcttattaagcccgaaaaaagggatattgccgccggccgaaaatcaaatatatcccttgcctcctgtgcgagcactgcatccgggtactctccagtgctgtgcgtatccaccgttatctccggccgggatgcgccccgcgtgtatattgccgatattgtgcatgccttagccaagcccgcctcaacgatactttttgccgcataccgcgccataatgagtccgctgcgggatatatgcctcccgtctttaccataaggcggacagcttttgtgggatataacatcaccatatgtatcgctgtccaaatgcattccactcattccaggcttaaattcctctcgtttttcagattcgcaaacctgtatatccacttctgtctttgcagatatatatctttccggtatcgcaggtttcagaacaaactgcatcagcctttgcctggccatttcttcatccgttcctttttcacagtctaccgcaataatgactgaggaaagatagaccggcttatggccggaataacacacagaaaccttggcttttccccctgtaaaagtcctggtatcgcattgacgctatagatacttgacagccgttgggcaatcctattggataaaattacagggagaggcagaaactcccgcgtttccgctgtagcatagccctgtattgttactgtctcatcagctggtacatctccacaagagaacgatgtatatcctccaatacacgtgcttcccgaacagttttttccctttcccgcagttgagttgcatcgctcagaaacggcttcctcatggtcttttatattgatttgcacttcatacggaaagctatatcctcctatacgaacagtttcacagaccagcaatggcgtcaagaaggcgggctgcaatccggtcacacagcttatccggatgcccgtccataaatgcctccgcgctaataatctcctggtttctcatggctgcttatcctccttatggtcttcttttttctttttcctgctatgcaggaatacatatcctcctgctataaatatgagcagtaatgccgttgttagattcatttttttctcctgattctgatcgtagttttgggtcctccttaatcgtattccgtcagataaaataatctgcttttcatacacaaacccacacttatctttgacgctatgttacaatgccaacacttaaatattggctttaaaacctatttggaatgaaggaggattcaggcatgaaaaacaataaccatttgtttattccacgtggcaaggatatatgcgatgaatttgtcacccattttaatcagctctccatggaacgctttggcttaatctatggcgaactggaaaagaatactgaaacccggagttttcttggcgcctttgcttgtattcgggactacattgtaaaaaataatatatcgcacactgagctttccaataatgatgtagtacaaatcatatgggaatcacattatgcaagaggaatgcaaaaaatgcggggcgttctgcggtacccatgctaatacggatatccctctgggggtgcccggcaacgaggaagaacgcctttaccggtggatcacgcaccgattattcgatagctattggaacacgaaaggactggatcgcggggaagcgtatggctggcttgcaggcaatattggcttatataccaaggattgtcatataggaaagtttgatgtaactttgtgcaaacgggccattaaggcgattggcatatctcccgatttagaaacggctgaatataaagatatgatcaggacaaattcatttccttggactaatgcctgcctggacgattctattacacacgaaaggccaagctgccaaacaggaaataactcaaatctgccactcgactccgagatacagaataaacaaatagcccatatccttgaaaaaaccagcatccccgatctcatgcaatatatctgtaacgatatccaggcgggacacgatttaaaaaaatttatgatctctctaattgtggagtaccatacccagcaagcaagtctatcccgccggccagttctttcaatccaggatgagataaccgggttactaaaatagcgcttttaagggggcccggtagttcctgtcggactccctctgctgggatagttatcttgtcacctttcttcttggaatgatacgttgctatatctgttttatcccttttaaatcctcacaaattctttaccgcaagtacaacaagcctcccgttggccccatattttgaccggtcgcaggtcgaaagcgccagtacagtatcctccgccgaaacgtcaacgcccgtatggtagatcgacagctcctgcgtctgttttaaccatgacgcatattcctcctcgttttcaaacacctgttgcaggtaattaaaatccgtctcaactatgttcaggtaaatcactgaaaagactttccaccaatcgtggcattccaaataggtgtcaaactgtatttttttgtgcgctccaaagtattcccggcttttgtagccaagcagggggccgaacatttcatcctggcggccgctgcccatattatgcgcgtagataatagtgtttttatccaatggttgaacagtattcatataatccatgaaagccgctcccgcgctggacttatcccccttgctgtcatggttgagatattttttgttatccccgcattgcatgacaggataattaataggcgtatccggaatgcttaaccatccgatcacctccggattcatcgtgcgcaatgaggtaaaatccgccataatatatgggacaggttcttcctgcctgttttgcgttgttggttccgggtagagcgttttggtatattccgactggatttctatatattctatggcttcttttcgagctgtattgtattctttcaaaaacataaaagagaaagcaaccgctgccgcaaacagccctaagatcagcgctgcgggtattctatggtgatgcccattcatcgcgcttgtatcctttttttctttttcgcagcctgtttcgttttttgcgatttaagcgacaggcgttcctttgcccgcgccagcgccgtttccaataacgggaaccgtatcaacgccctgtccggccctaaattcgcttggttctccaaagcgttgcgaaacgtccgcatttgcgcgtcggtaaaggcagggtttgcatacgaggacacgtccagcccattttccattcctttccgaatctccatcatctgtaaccatgaatactttgcgtcggcgtaacgggatacatccacgccgctttccattcccattacaatctcttgcatctgttcagcgcatagtttcgtatttgagtaatgggacacatctaaatcctgcagcaatccgcgcaatatcatccccatttgcttatggtcatattccgggtttgtgaacatagatacatcaacgccctgttccagtccccgctttattacgtgcatctgctgccagtcgtaccttggatcggcataaattgtcacgtctacgccgttttgcatcccctgctcaattagccagatttgcgccgaatcaaatttttgtacaggttcaaccatgctttcaggccctggttgttccgttttttcttgctttccctcttgttctttatgtgagtcggcttcaggcggaatgtcctgtgcagcaacttctccgttcttcacaggctcctggccttaattggcttttttctctttgtggaaaggccgtatattcttagcagtcaatcgttccggctcttttgcagctttgatttgggaaatatcataccgtttcatatattcgttttccgatacttcttccgtctcaaaatcaatcccggcaacttccgggctgtcttcacgcacgatgtcctcaatgggaatgatatgtactttcacatcagccggcagcagccctccaaacaatccttcagtattgtgctgttccctgtccccggctacccacaataccttcgtgcctgccggtatttccccaaatgcttttttaagcacaacgacactacgcggttccgccgcacccgggttatcatagaaaccgctggacatacctttttggtatgtttccaacagcttgctaaagtcttttgggtcgtctggtatgatccatgtttcctggtatcctatggtgaatcacctcgaatctttgttttttcaaatgagttatacaaattccagttttgttgtaataaaaacattagattagtattatccggatcctttgatgcgctgattgaacgtgtccgtttcgctgcgcctgaattattgcatttaaatggagtcctacaggatacagtatctataccttttagtgcaggattatttgctttttctacattcgcgtaaaaatggtttgcgtcaacgtgtaatataactctctccattgttgtcaccccttccaagtaatgcttattatatgtctgttaatatacgatttcaatagatttattctattttaatacgaattttaattgatgtttacgattttagcagatatagtatacatagggaggtatcatcctatgaattttaatctaattctttacgagcttcgctcacaatctggatacaagcaaacggaagttgccgatttccttacagaaaatggattgccggcgaacaacaagatcatttcctcatgggaacgtggaagcgcaaagcccaatgcagaacaatttttgttattgtgcaagctatacggggtacgcgacgtactctcaacctttttggggattcccgactccggtaatcttttagagggcttaacgccatctggtaaaaaccgcgtcagagaatatgccggattgcttcgccaaagcccggaattctcaacggctgcacctgcgaaggtatataggcgcctgatcccgctatataaccttccagtctccgctggtaccggaacatttcttgatagtgaacattacgaaatgatggaacctgatgcagctgttccttcggacgcgacctttgctgcccgagtaagcggcgacagtatggttccccgtttcagcgacggacagattatctatatccggcagcaacaaactctggagaagggcgagattggtattttcatgctaaacggcaatgcgtactgcaaaaaactatccgatcattccttggtatccctcaatccaaaatatccaccgattcccattaacgaatttgacgatttccgtgtttatggaaaggtagttggctgatttggcatatgtgaaagctattacatagaaataaccgattttcttgaaattttatgatgcatctttttcttcttattatatcttctttttcagagtaccaaaaaagcccatcgttatgggcttttttggttgcatcttttttatacaattgatttggtgaccccaccgggaatcgaacccgggtttcagccgtgagagggctacgtcttgaccgcttgaccatggggccgtctttttcagatagcattaataattgtagtggattcggcctcttttgtcaatatttgcagaaaaaaatatgccgcttgccaaaaggcaaacggcataccgctattttctcaatattttgtcaagtaatgttcgcgctcccaatcgtggacgcgcgtagaatactccgcccattcatgttttttgcccttgaggtatttctcataggccacatccccgagcgcttcacgcatcaacggatcttccatgaaatcatcgatcgcatcaaacatattctgcggtacacggcggatcatgtgctttttcttctcctcgtccgtcaatgtgtaaatgttcttattgaccggcggcggcggcgtcatccccttctcgatcccctcaaggcccgccgcaagcgcacctgcaaacgcaaggtacggatttgccgtcgggtctggattcctcatttcgatgcgcgtcgcagatccccgcgcaaagggcacgcgtacaagggggctcctgtttttagccgaccatgcgatatagcacggcgcctcaaatccgggcaccaggcgcttataagaattgatcgtcgggttggtcaggagcgacagcccgcgggcatgcttcaatattcccgccatgaacccgtacgcttctttggaaagtcccagttcgtcgcccttatcgcaaaacgcatttccctccttggtgcacaacgacatattgatatgcattccgcttcctgcgatcccaaaaatcggcttcggcataaatgtcgcatgcaggttatgcgtctgtgcgatgcgcttaacgacaattttgaacgtcatcacgtcatccgccattttgagggcgtcgccatatttaaaatcaatctcgtgctgacccgcagcacattcgtggtgcgccgcttcgatctcatatcccatttcctcaagcgccaaactgatgtcgcgccgcgcgccgccgcccgtatcgagcggagcaaggtcaaaataaccgccgtcgtcgtttgtctcaatcgtcgctttcccatttgcatctttatggaacataaaaaattcacattccggccccacatccatcgtgtagcccatttcctttgcatgcgccagttgtttttttagaatgtggcgcgggcatccggcgtagggcttgccatccggcatatatacatcacagataaaacgggctgtgcgccctttcggattggaccacggaaaaatcgcgaaggtgtccaggtcggggaccagcatcatatcagattcttcgatacgcgcaaacccgtcgatggacgagccgtcgaacatacacccttcttcaatgatcttatccagcttgctcgccatgacggtaatgttctttaagatgccgaacacatccgtaaattgcaggcgcagaaacttgatatcctctctgtttataatttcatgcaattcttctttcgtatatcttggcattattttcttccttccatatgcgctatattcttattatatatgaatttccattctttgcgcaaccactattaaaaaagaccgcttatttgcaagcggccttttatatttattactcgtttatgcttcccttgatcgtctcgtccgtaccatcggcgtatgtcacgactacttcccgttcttccggaatcatcgtgatccatgtattgcccggcgcaaacgtcagttcctcgccgctttcaagcttgtacgtcgttttcttgtcgtaatccggccgttcccatgtgcctttcaggagtttaccatgaatgacgaacaccgcgtcgccgctccctctggtattcacgatcctgcggtcgccttccttagcgtcgctgcccgctttttcatcatgcacatactggataaccacgttctgcacttcaagctgattgccggtcgtcgaatccttgtgttccttgcctcttgtagagcgcagcagtttatcgctgtccttatcatattcatatacggcgaacgccttatctccgaagaacttaagcgtgatgtcctgaatctccggctggtccgcataatcgctttccggatagaaggtaaaggactgcaatgcttcgggtgtataatcatagatatcgagcgccttcatgaggtcgatacccgcataagacgacgtattatgtccgcttacgagtgggaaaaacagttctgtattgaccgcatgctttcctgcgccgttgatacgctgtttgatatgctcgccgctcgcgccccaaatgtcagtgccttcgacggatgttgcatccggccctcccatgtggacatataatgcgtcccattcctgttgtattctctgatgataatatctcgacgaacgaaccggccctacgataagctcctccggtgcgttttccccgttgatcgcatcgttgaacaaggccgtaaaacgtgtatccccgccgtctacatccgtttcatatacgatgtccgccttgctgagcccttcctgataaccgcgcgcgccgtcagcgttatcgatttgtaccatgataggtttataagttgtattccccggcattcccgttgttggggatatatttgtcgggattccgtccgtcgtttccgttggcgtcggcgcaggcgtcgctgtctccgatgtgatctcggtcggcgccacagacggctcttccgccggctttgcacatgctgtgaatatacttcccaccataactaccgcaagtataacagttaaaatcttcttcataaaaaaccttcccttttttcaatcttcctggcagttattatatcacactctatatttttgtaaaatccccttaatacttttttaataaatattgttgtgaaaacgccctaataatggggtatatagcttgaagaaaaatattttttgtgatatgattcgtctaaatagcggaggcttgcttttatggcgaaaaagaaaaaagcttttaattttaaccgcataaagtttttcgtattgattggcgtactgatttatgccagtcttactttctttaaccaacaaagcatcctcgcaacgcaagcggccaagcaggccgagcttttaagcaaggaagaagagcttaccaaggaaatcgattattataaaaatgagctgggatatatcggcagcagcgattatatcgaaaaagaggcccgcgaccgccttggatgggtattgccaaacgaaacaaaatttgtcgaagacgaaaacggttctgtctccccttcggcgcctgccgaaccggatacctctccccagccaagtgcttccgcttcccctcagccacaggaaactgacggccaataacgcgaaacaataaccgcagaaggtattgatgaagaaagatggccaaaattagcgaagacaaattgctttcggaggaggaactggagcaggcaaacggcggcgttgaggttggcacggagcatcattggtacggcaacaaataccgcaagtgcaattcatgcggtccttcggatttcgacgtaatcggcatttattcaaccaatgttttagaggtgaaatgcaaaaaatgcggcatggttcagcgcgctaccctcaaatcgtaacaattggagccttcccattctgcatctgtgaaataatattgtaaacaccgctttttcgcctgtcccctattgcaacaactaattacaaaaggcctttggattcttccaaaagcctttttgtttgtcttttccttattcgctgaccattgcggacattatgcgacctctttcgcggactgatatgtgattcagttcaagatatcatagctgcttttatgtctatttgctttggattattttactttgggaatgaaagaagcacacattgcctgttgacttatccccatacatattatataataattaagctgtctcaaataagagacgccaaaatacgtcgcggggtagagcagtttggtagctcgtcgggctcataacgcgtagcgaacataaatatccaagactctgtaatcataatgcagagtcttttttattccatgaatcaacacctgttcatcacgatttggcccccgtttggcccctgagagtatgaaaaaaggcccaaccgtgtgatggttgagccgcataattaaatttctcagtacgcaacagaaattatataaatatctgccacaagtgctaatcttatgctaaaaagcaattaggcataatatgctaaagcgatttcacaacctgacatattacctacatataaagataattcgattttatcccaaagaacctgaaccgctaatgacccgttttgctctaaagcctccttagcatccttcaatatccgttctttacttatatcaggattgtcagaaaatgccacgtcggttgttataggttgtccatatttactctctaattctttcttgacgtcaaaaaacatattaacacaagtctcactatctacctcaactggagcccaataggatacccagtctattgtattatcagtaatatggtatgttatttcgccagtatatcccaagaaatcaatgcttttcttataactactttctggcgtaccagagatcaaaaattcgtcctgtagcattccgatattagcgccgaccatcttcttgtcaataactttttcaggatcaaggtcatatttcccagcaccacaacctacaagcatagtaactactaccgtcaaaactagtagtattccgataatctttttcaacatattacttactctccccataacatctaatgtgtcgtattatagtcgtttatttgacttgccatacctatgattctgttgttcattgcttcgcgtgatgtttttacaccattgactataccaactatagctaagacaattagtgcaatcacaaccacaaaaataataagtttcttgcctgccatgattctcccctcccacattaagataatttcattatagatatatgtcatagtgatgtcaattacattatttagtggttgcatacacatgtctttatttcttctatactgtaatcagactaatgtcagtgaaaggagaacctatatgtctacattaaaacgagtatttaccctacgcttgaacgatgaaatctttgaccgaatcgaagcaatagcaaaagatgagcatcgctctatgacgaatcttatcgaatatgtattgctgaaatatattgaggagatcgaccgtaaaaacgacaattccaagtagacacaagggccgctcctatatacagtacaatggagtggcttctgtttgttctatcctgacagcatattttcaccccctaaatcgacaccacacattccagaatcacataggatatttcttcgttccaaagataacaacttgcctatccatacagaatatctgctgaaaaagcaccctgtatacccatagtgagatacataatagaatacttcatacctaaaatcctgctatgacagtaaatcaaaaaattttccattctccctaaaatccctcttttatgatggaagaatattttgatgtcttgctttgtttacttttcggaaatagaaagaacgtcatatcacaataatatgacgttcttttttgtataacgatatatcctcaccatgcttcccaaaatcacacaggtgaagttttccataatcagataacaagtaggctgatgaaatgtcgggcgcagactgataaagctcctgccctgtaaatcgaaattccatccatcgaatgcttgtgatatgataaagataataataggtaatatgggggtaacaaggatgaagctgaaactgaactgggtaacggatattattggtgaggaatataaaaactgggaaccgggagatattatcctcatcgaaagccagacaggaacaggaaagacacacttcattaaggatatcctaattccatacatatttcgtgaatataaaaatatgctgtttgtatgtaaccgaatcaaccttaaaaggcaaatcaaacgggatttactgaaacagtatggtaaggaaatcccctccacccttgaagaattggataaaatatccagaatcgaaggacgcttagagccgtcatggatatctatttccagttaccagtcgctacaggaagatgtactgaatcacagatattttgaaaaagaaatgggctctctcgaccgtagtgtttggtatagttatatcgtactggatgaatgtcattacctctttgcagatagcggtttcaacaataaaacgaatatcgcccttggttctttggtaaataattatcatcttaacgctatcaagatattcatgaccgctacgatggatgaagtaatcgagccaatcaaagaatatgccgagaagataaggcccacagcagagaaatacttattagggggagagcgtaaactgaatatcagaacttattccacaggtcgggattactcatatatcaatccccaatattttaaaaatatccatgatattaccgcgctcatcaaaaatgaccgttcagacgataaatggatcgtctttgtaagcaatctggataaagggaagaaactgcaaagggaattaggaaacgattctgtctttatatctgccggaacagaacatgaagaacttgactgtatcatccatcacagtaaattcaaccgaaaagtgttgattaccacaaaaacattggataatgggatagatattaaagaccatgcagtcaaaaacatcgtaattatggcatgggataaaataacttttctccagatgttaggcagacggagagtagacatcaatcacgcagacttattgaatctatatatccccatgcagtataaaaagagtttttataccctgcttatgagctatcaaaagaaattagaagaaatccaattatgcagggagaatccaaacgagtttaacagaaaatatgataccaatataaaagctcttggagagtatcaggaattattctatcgggataaagaaacaaaggaatggactgtcaatccatcaggagaagcaaggttgctgaacgataaacgttttgcggaatctatgatacagaaatttgaagaagatggaaaatttgcgtttgttaaggaacaattatcatggatgggtctggaagatacgtttgacgagaatagactgattaagaacagcgtatctgatacagaacatgaaaatctggaaacatatctcaacagattatatacatcccatatcattatgttaaccagagaagatagacaggaattgattgagagaatcaacgtgagagacggtaataatcgtaataggttactgaaaagcatagacactctgaatagtaagttaaaagaagtcggaagtcagtttgttataaagaaatttgaaaccagtaaaatgatagatggaaagaagcataattacaaaaatgcttggagaatcgaaaaacgtaatatcagtcaatagcttaccccccgatttgggtgaaaatctaaaaaatataaatttccatccaaaaaagggggtaaatgaatccaaatagatcccctttgcaataaataagcgaacattatcataatcaagtatatctaatgacgagatgaagtaataaacaccatctcgttctttttatgataaaatcccctatcatccattggtctggaaatactgtgtatttccaaaccgataaaatataatgtcttaaatcattctgtcaaaatatcctatccgaaaaagagggaatcctgttcagtatggaaaaaatgaaattttgttgaggacgactcaatgaatcaatcatacaggagtggactacacaaatggcaagtatcagaaagaaaggcaagggatatgaccttagggtatgctgtggatatgacgttgatgggaaacgtatcgagaagtacagaagatgggttcccgattcatccatgacagcaagacaggcagagaaagaggcgaaacgtcagcttgtattattcgagaatgagataacgcgtggtaaatgccatgacaacaccacccgtttccatgatttggcagagatgtgtatgcaggagttcaagacaagactggctcccaagacatatatccgttatggagattatctgaaacggattgataaggcgatcggtcatatcaagattcgtgaccttacacccattcagctaaatgcgttctatcggagtcttgcacgggatggagcaaatcacagcagaggcggaggactttctccaaagacgatcatagaacatcacaggctcatctccaaaatgctgaatactgctatccgttggggcatgatagatgtgaatgtggctggaagagctgacccccctaaactgatacgcagggagatacaatgtctgaatgaacgggagacttctcacatgatccacctgttgaatgaagaacccatacagtatcgtaccatgattctcctgcttctctatacgggtatgagacgcggagagttatgcggtctggaatggaaagatattgatttcacggaacgcagattaagtatcgtcaggacgtctcagtatatcggtcatggacagatcattacgaaagaacctaagacacgttcaggacgtcgggaattatcgttaagtcctactctctgtaccctgctgaaagattacagggtatggcagaatacacggaggcttcgtacaggcgaacgatggatgaatacagacaggctgtttacccaaagcaacggagaacccatttatcccgatacggtaacagaatggttcgccaaattcctgaaacgtcatgacctgcccaaagtaaccctccattccctgcgtcataccaatgcaacccttatgatagcagagggggtggacatctgtacggtctctaagaggttaggtcatgcaaatacatccatcacattggatgtgtatgcccatgccctgaagacaaaggacagcgacgcggctaataagctggacgctatattggctgtgaggtaatatgttaaggaggatagaatatgattgagattacggaagaagtaacaaataaggagacattagcggataatctggctaaggcatatcagtatgttacggacgctatgtcggctaatgtggacgctccctatttttcggaacgggagtttgacgatttgcgggatatgagattcaaactggagatacttgttgaccgtttgcgtggattatgtgaaactggaagtatggaatgaggagggatagtatggggaatggaatcgagatcacggaactgagcacaccgtccgataagctgagggaggcaaagaacctgatactggaagtactctacgaaacccgtcatgacactgcattgagcgaagcggaggcttcggatttgcggcgtgcggccaagacgcttgccgtcatatctgacaagctgagtagatagcttcctgtccgtacagaatcaggcccccatttggcccccataatagcataaaattcaatgaaatccttacttgacgaatattaggcgggggtttataaacttgattatacttgaagtatttggctactttcaacaaaaggcgttacatcaattttattttttgtttctatgatttcggaacgctggcctctcattatggctaatacagggggaatgttatagctaatattatcacctattatccaccgatcatgccatctaaatgatgtatcatatataatacgccattcgatttgaacagaacgctgagataattcttgctttaggagcatataatcattttttgcagttgcggtaacgtttccatttccagaaataattgtaactgaaataactccattagaagaaatgccatcaattataatctcaaatgcttcttttctaaaatgtttgtcaatccagtaaatgtttccccggcattctcgcagtgcttttcttaagttgtatatatttgaaaatggggtggacggctctataaaatatgtatcaaatgcctcatattcgattaaaaattcattgagtgtaaataacccattctttttatcatatactactatagaatatttatttaacaaaattagaaatgtacttatatctttttcacatagtatttctggaaggatattatgaaaatttagtaaattacataactgttttttagagattttcccccgtccgtaaaatacctgatatataagatttactatggaattgcctaatatatctctttggatataagcgtctgcttcagtctcgttattcataatcaaagaaagataacagtactgtttccctttttctgaaaggtagccatctctatcaatatactcattgtcgctcataaataaatatacttcaaagggcacaactgtatctggtaaatctccgctatcactggaaagaatggcgttcccaatatctgtttgtaacaagcggtcataacgtagtccaagagcttcaaacgtatctatgatatccttatgctttaaattcaatatatacgaacacatagcatactccaattaaatcttcaaaccatatagtcttttaaacattaaactaatcatatcatgtaaatattgtgcatcttcacctactatatcgttaggaacatagagtactgctggtttctgttgaccaaaagggactaccaacttttcatatccatgatcgtcaactaaatccttatcctcattatccactctgtcttcttggttttgtgggtggatattggaatcagatgacaaattattagaattctcttttgcttcatgactattcgtattcgcagaagctgtagtaattctcaacatcccatcttctatgacgtcgatttccgcaacagtatctaggaaagcttgtgcggcgatctttttagctttgggggcaataccatgctgtgatactaatatgttttctaaaatatcttgcggaggcaaggcttttccatcataatcatttgctaactcttggtatatagtcggtaacaaaaagcattgccttttcaaatcagcaatatccccagtaggatagaggataccttctgctagcttattaagggtaaccttttgattagttacagaaattagcccgaattgttttgcggcgctgatagtatacttaaacgattttgtagttgtacttacgtgtactgcttcggctacagactcataagctatcggtttcccagcgggaaaacttttcagtttcgagagaaaattaataaccgtatctaacgataccgcaggatactgtttgctccgcacatattctcgttttttcttctgttccatagcgtttcctttcgaactataattttataaatattatagcgcaaacaaatggctatgtaaacatatatttgtgctatgaatttcactcatgcatttttagctttaaatcagtatgtgttttgaagcacaataatattctttttgaggtctacacgcgaaacaatctaatagcaaaattacatttccgcctcctatttccctcaactttaattgattcagattatgctgtactcgatcatattacataatcataccagattgacttttaatccttacataaattggcctttctccttgacatctcccaccacgtgttatataataattaagctgtcttaaataagagacacaaaaaattatgtcgcggggtagagcagtttggtagctcgtcgggctcataacccggaggtcgcaggttcaaatcctgtccccgcaaccattgctaaaaaggctttcggaagaatccaagagcctttttatttaccttttccttatgatgtcctttgtaaaatcgtgataaagaatatccaattagcgctgctgttttacccagaatgacttaatttataaagcttaatttattgtaattcgatatccgaactgcccttcatcattgtttgactaatttggtcgagagtgacaaggctgagcaccagtgatatagttatcacaaagaaattaatgaatttgtttaggaggcagaaaaatgttagaagcaattacatacgacgcgatgctagaaaacataagggaacatggaattgtgacagatacaataggaattttattagcacgaccgaagtctgaggcaggtagagatattattgacgccttgccttattaccatcatcgttcgggtcatagtataaatttttatttgcctggttatggcgcttactggtatgatgcttatcctgacgaagaggctattgttcagattgaacagacgatatggtcatttagtaatcagaaatatgtcgaatttatcgaatcctttgaaatacattctcggtggaaatattcaggagagagtgagttattgcttattgaatataaaaatgacaaactggattattcgaatgtactaagatgccatttggatgcaatgcttagagataatgtaattccttcaataaatgtatttttcgaaagaatttttaggcaagcttcacaaaaaaagaatgttactcaaattagcgatattaacgggctcaatactttgggacaaatcacactggattctatcttggaagcattgccaagctttttttccggaataataaaaaaggaacggcattacttagttaataattatgcaaaaaaatagatgatatataagtgaaatgtggctttttaagcagcttgaatatgtaaatcctgcttttgtaccttcctagtccccataataatcacatttcctttcaaaagttagaagtccgcaaccactaaaaacgcatcggatcgaggcgttttttgtttgcattttatttgatacatcattatataaacaaatcatcaaaagctattttaagaacttctttgattgctttgatttcgcaagtataaatatggcgttgtcctgcctcgatttttgcaatggcacttcttgtcaaatcgcaaccttttgtttgcaattgcgcggataagtcttcctgtgtcaagtttgcttgtatacgaagcttagcgatttgcttgcctatttctttatcatacctataatccatcacacacactttcccttgatctaatactagtgcaatccatataaggattatagtaagcggtggacggattcatggcggcttcgtcatcaaaaaccggaaaaccttgcgaaccaaagcattgatatctgtgaaaagtactcgaaggattgttaccttgcacgcaaccgttttatggccgatcacgcaagccgtcgcatctgctactatgacggaaaatccggcggcacagcttatacggtggattattgccgaaaaaaggattggagattatcaacctcgcagaaaaaatcagtgccgcccgtaaataagagctatcaaaacaggccccaccggaaaatttttttggcgatgcctgtttttttaatctgctctgaagacgtttaggacaattccagttttccggtgtagagctcgtaataaacgcccttttgtttgatcagttcttcgtgcgtaccgcgttcaataatccgtccatgctccagtacgatgatcgcgtcgctgttgcggatcgtggacagcctatgggcgatgacaaacaccgtacgcccgtgcatcaggttatccatgcccttttggacgatggcttctgtgcgggtgtcgatgctggatgtcgcttcatccaaaatcaacacgggcgggtcggcaactgccgcgcgggcaatcgccaaaagctgcctttgcccctgggaaagttcctccccatctccggtaagcactgtctggtaaccgttcggcaggcgcttgatgaactggtccgcatacgccagccgtgctgcttcatgaacttgctcgtctgtagcgtccagcttcccgtaacggatattctccatgatggttcccgtgaacaagtgggtatcttgcagcacgatccccagcgaatggcgcaagtccgcctttttgattttattgatgttaatatcatcgtaacgtatttttccgtcctgcacatcgtaaaaacggttgatcaggtttgtgatcgtcgttttacccgctccggtagaacctacaaaagcaagtttttgtcccggctttgcatacaaggtcaggtcgtgcaaaaccattttgtcctccgtatatccaaaggacatatcatagaagcgaacgtctcccctcagctccgtataagtggtgcttccatcctgatgcggatgcttccacgcccatatccccgttctttggggacattccgtgatgtttccgtccgcttcttttttcacgtttacaagcgttacatagccgtcgtccacctccggctcctcatccatcatcttgaagatgcgttccgcgcctgcaagcgccataacgatggaattaaactgttgcgccacttgcatgaacggctgggtaaagctctttgtaaattgcaggtaggcaacgatcgttccaatggtgagcccgcctacgcccatgacaagcagcacgcctcccagaacggcagtcagcacaaattgtatattgccgaggtttcccatgattggccccagcatgctggcaaacgtgtgtgctttggatgaactgttataaagcttttcgttcatctcgtcgaattcctcttttgacttctgctcatggttaaacactttgatgacacgctgaccgttcacccgttcttccacataccccgtcacttccgccaggtccacctgctgcttcgcaaaatatttgccgctgttcccgcccagcttccttgccaccaggaacatgataaagatcatgacgactgcgagaagcgtgagaagggggcttaataccagcatagcgataaatgtgacgatgatcgtaaacgccgacatcaaaacctgcggaaccgactggctgatcatctgcatcagcgtgtccgtatcgttggtatacaggctcatggtagaaccgttggtatgctggtcaaaatagcggatgggaagcgtctgcatatgctcaaacatctcgtcgcgcacgcgctttaatacgccttggccgatcgttaccatcagcctgttatagaaaaacgagccgacaacgcctacgataaagatgcacgcgagaacaataagcgcttggtagagacccgcaaaatccggatttgctttgcccaccaacggcaaaatataatcgtccagcaggtatttcattgagaaagaaaccgcaatcgtggcaatagcggaaagaatgatgcacacgatcacgatcacaaattcttttttataggttcccgacacgtatttcagcagccttgcggctgtttttaaagtgtttttagggagcttcttctgctttttattcattgttctccctcccttttgcctgcgattcatacacctcgcggtagatctggttggtttttaataattcttccgaggtacctactccgctcacctcaccgccgtccagcacaatgatctggtccgcgtcctcgatggacgagatcctttgggagatgataattttagtcgtttccggtatttcctcacggaacgccttacggatgagtgcatccgtccttgtatccaccgcgcttgttgaatcgtccagaatcaatatcttcggttttttcaaaagtgcgcgcgcaatgcacagccgctgcttctgtccgccggaaacgttgttcccgccctgcacgatcatcgtatcataaccgtgcggaaactcctgtataaagctgtccgcctgcgccagccggcataccctgcgcacctcttcgtcgctggcggtctcatcgccccagcggacgttggcataaatggtaccggtaaaaagcacgtttttctgcaataccatggacacttggtcacgcagcgccgcaagatcgtactcccgcacgtcgatgccaccgactttgacactgccggaagctacgtcatacagtcgggggatcagttgtaccagtgtggtctttgcgcttcccgtaccaccaaaaataccgaccatctgaccggacttgatatgaagattcacattcttaagcgcgagggtgccatccttccccgcatagctgaaatccacgtcttcaaagtcgatattcccattggcaacttcttctatcgcgccttcctggtcctgcatctccggcacttcttttagaacctcggtaatacgttccgtagaagcttcagcaatcatgatcagtacaaatacgaaggagaccatcatcagcgagatcaaaatctgcatcccatacactaaaacgctggtaagctggcctgcctccatactgccgaatacgatcgcacggccgccgatcaataccatgccaaggatgaccgcatacatcacaaacatcatgaccggactgttaagagcaacgatcttttgcgccttggtaaataatttaaatataatttgcgaaacccctcggaatttcttgatctcataatcctcgcgcacatacgctttgacgacacgggcggcattcacgttttcctgcacagaattgttcagcacgtcgtattcgtcaaatacctgcacaaaatacttgtgcgccttcttggcaataaaaataagcaaaaagccgagcacggggatcgtcaccaaaaacagcagcgcaatatccacattgatcgtgagcgtcataacgagggacagggtgatcatgatcggcgccctcgaaagaaggcggatcgtcatcatatatgccatctggacattggtgatgtccgtggtcatacgcgtcacaaggccggacgtagaaaaacgatctatatttttaaacgaaaaatcctgtactttataaaagatatcctgccttaagttttttgcataaccggcccctgcttccgcggcaaatttaccggcaagcgcaccaaaaagcaaggcaagcatcgccataatcacaagcacaattcctacttcgatcacataagaaagattctgcccttggattcctacatcgatgatttttgccatttggaatgggatcagcacttccatcagaacctcgagggcgacaaatatcggcgtcaaaatcgattgctttttgtattcccgtatggatttgaataatgtcttgttcatgcccgtaaccacttcctttccaaattcctctgggttggtacatttgcccattataagaagaaaattttttaatgtcaagaactgtgattccctttttttccattgtccatgaaggaatcgatattccatccacagcttttttccccgcagcaacatctgcattcatcatgccgtcaagcataactccattcactgacatatcgcgcacttgtatcgtaacagtaagcgcctcaaagtcagccttaccaagaaaatcaaccgatcataatgcggtctttggggtagcggatattcgaactcctgttttccaagcgcgccgcgagcgccatagtgagggtgaagatgcctaccctgccgccatacatcaataccataaagacgccacggcttgcgtcggtaaagttggcggtcaccgcagaggtcatgccgaccgtaccaaagctggaaatgacctcgtagatcgtatccgaaagcgtaatcggcctttcatattcgatcagggaaacgatgatgatcgcaatgaatacaaatagtattcccagcgcgacgatcgcaacggagcgcagtacgaccgctttatcgatacgcctgccaaatatcacaacatcgtcctgtccacggataatcgatatgataaataagagcatcagggccacagtcgtggttttgatccccccgcccgttcctgaaggggaagcgccgataaacatatagatcacggtcagtatcttggatgcaggcgtaaggtcgctttgcggcaccgcggcaaaaccggcggtacgcgatgaaacggagtgaaacagtgcccacgaagccttgtcctgtatgggcatatcttcccgcccgagcgtaagcggattattgtgttcaaaaaacaagaacaggacaaatccggccgctgccaaaaaagcgctgacgcacaggacaattttggtgtgcaattggaaatgatagcgtttattgcgtatcttccggtacaggtccaaaaggacatagaaaccaatcccgccaagaaccattgcgctcatggtggcaatataaatgaccggatcgccaagatacggctgcaagcctgtaccaacgccaaaaatgtcaaaccctgaattgcagaaggatgaaaccgcctgaaaaatactgtagtaaagccccctggacataccaaatagcgggacaaaacgcgaagcataagcgaagaacacgcataattcgacagcagcagtcacaacaagaatatcgcgcgtcatcctcacaacgccttgcagccgcgaatcgtcagtcgaattttgggtcatggaattttgtatgatcagacggtcacgcagtgtaaagcgccttccgatcatcatatacagcaaagaagtcatggtcatgaacccgatcccgccaagctggatgagcacaagcagagtgacctgcccgaaaagggacaacgttgcgccaatattaaaaacgcttaatccggtaacgcatacggcggacgtcgctgtgaaaagcgcgtcaaaaaaacgcaagggttggccgtctgccgtagcgactggaagggacagtaaaaaagccccgatcaggatcatccctgcgaagccgaatacaagaatttgtgcgggactggcaaccccgcgttttccgaatgaatgggccataacgcggcttctcctatagccaaatttttatatctactttttgcttgttttaaagttactcgcaactccctttggttaacaatatattaagttatattttaccataataacaaaacaaactacagtataaacgaagggaaaaagacatgcttgtactaatttgcggaatcgcggctattaatctatttgcagtattcttgattttactccgaccaaaactgtttcacaccaaactatacagaccgatgctcaaaaactgggccatgtctttacttccaatccttgtgctggtcatcaccgtctttttgacggctgttattatgctctatgtcaaccctatcgcaggactgatcgccggaatcatcggcgtggtcttctggttcctacttttgccaaattccggctacctgattaccgagctgaatttgaaccatcggacagtggataaacaggaagtcccgttatggtatgatatcattgcggttttatcgctttctatgtccggcgtgatgaatacgctgctgaacgtcatgctgcttcagcttgcttatgcggtcattgtacaccctatcgatgcgtttgacttgggctttgtaaacaatctcaacttctggatcatcatctccgttgtttttctgctgatcagctttggtatttatatcgggcgttatctgcggttcaatagttgggatattttaaaaccaaaacgtttcttcggcatcttaaagacacattttaaggaacaggacaaggtaaagcatcttgttgtattcatgctttgctataccgtctttttcctcattatgtactggatcgttatatggcccgtcctcacaaatgcatgatatcctacatttacattttattcatacttttttcattttgacttcatgaaagccgtttatgattaaaccatacaaattctatcccggtcttataccacccccacacttgatcgggatagtcaaaaaataatgctgcggcgtttacataaatctcttctcttggcttcctcaccgggaagccttttgtttgtccccttagacttttttctgcatatttgttacaattggttttatgaactacacctatatccttcgctgtgccgacggcacgctttataccggatggaccaacgatctcgacaagcggatcggccttcataacgcaggcaaaggcgctaagtataccaaatcgcgtcgtcccgtttcattattttattttgaaatacttccaacaaaggaagacgctatgcgccgcgaggccgccatcaaacgcctttcaagggaacagaagctcgcgcttggaaagtgcaaaaaataagactccccgcaaacagcaggaagtcttattggatttgcttttacccttggggtactaagccgccgtcacttgtccgtccgtttccgtataagtaataaccgtatctccgccgtctatgaaataaaagtcgatcaacaggatcttaccttctgtagaagagcttttcccaatttggtaagattgtcccgttccgtcattttgcacctcttgcgttatcaggaagccgtcttcattgatgagtttcgtgatatatccattgacgtcatctatggagaccgcgccgctgccatacgtcaatttcgtcgtcgcgccgtccgtatctgtgctgacggacgaacctgtgatcgtcctttctcctacaaccgaatacagcgtagctacttcttccccgcctaccttgaccgttgccgctgttttggacacgcagccagttgccaataccagcaggattccgactatagccactacaatcgccatttttttacgtttcatatagatactccttcaaaaaatttatttcgttattcgttgatgctccatccgtttttaacagcgccttcataggcctgcgtttgcgtcaggagcatcggtacgccgtttggcattgtctgtacctgtgcggtctgacccgcctcaaggccttcttcccgtgtttgcaccagtttcagtgttctgatgtcacaaaagcctgcttcatttgcttccgaaacaactacattattttgcgtggaagaacaatgagccaccaaaagctgtccttcttcgtttctccctacgataattccaacatggttacgcggcgtttccgatggcggaccgtaaaacgcgaggtcccccggctgtgcttcctcccacggaatctccacagataattcccattgccctgccgttccatagcctgtgtgattaatgacgcctgccttatcgacctgcgtcagctcgccgcttgccgcaagtacttcttccgtgttcacaaagctccatagcacatagccgctgcaatcaaggccatacttacgtattgtccctgtctgcgtgcttccttcgcttcctacgattgcttcattttcccacctgatatcccatcccgtggccgtacttttaccgccccagaaatagtttacctttcccacaagcgaatacgcctgcataacaatttccctacgataggtggaaagcgtttccggcagcattttttcaatttcctcaagctggtcgcctgtcagcccaagcgtactattatcgcctttcgccacaatatcttttaagaatactgccggcgcgtcatagaccggtttcggttcttccgcaggagccggcgcgttttcaacaatactctgactctcttctgccggtgcttcagatggcgcttctgccggttcgcctgtccctgtcgtgtctattgcgggttcgcctgacggttcaggcgtttccacaggctctatggacggggtaggttccggcataatggtttctgccggagccggttctgtgggcgcaggggctggtccttcgggttccaatacttcttcgcccgaaggcgcaggcgtttcctgcgaggcggcagcagccatattccctgttggggacatttctgccggaacctcttgcgcaaaggccgataccgtcattactgccaatgtaacaatcgccacacagatatacagtattcgttttttcatttttccttgatttttcatttttatatcctttttataaacatatcctgacagcctgtcacaactttaccattttttgtacgttacgtctatgcgcttaccaattttccaatcaaggcatatctggcattggtaaaatcatacgtacatgtgaccattgttacgatcctgtcttgtccttcggccgttgttttcgaaacaaaggtggatttccctttgacctgctttatgaaggaagccagtttttcttctgttccgtagttcaattccaggtcgttgaccgatccatccacgacgtatcctgcaatcagttcaatccgataggcgccattttgtgtataaagcgtaagcgatggatgcgtattatagtatgtttgctccttataatgttccaattccgcaaacattttcccgcttttcatgtggtgcccatacaggatcgagttttggtccgaaaagtcagatgcgttgcggtaatccagaaagatggcccccactctgttttttgttccgtcgtgcagatgggttaggtaaaagctattatcatttccctgcacaacaggatagtcgattggcgtaccttctgaacaaatccatgcaattgcattgccgcttagttgtttaagcgcggcaatatccggctcccatgcggcgggatttccttcgtttgttccgcttgtcccacctttggcggcctgttcctttaaggcagcatatgtactattgcccaggttgtcctcttccgtttcggtataaatctgaaatcctgcgtacagcatcacgcaaatacaagccagaattccgatccatatccataccctcttcttcaactttttcctgtgttttgccatctttctttacatttccttttttatatccatatggatattttattttccgttcttgccgaaatcttgcaaacgaattttctcccgcttcattacctgcatgaacaagatgaatagtgcaagcgcggccgtgataaacacgatactcatcatgggcctgatatcgtctacgcctgtctttggtatttcttcgccttcccccgtattgctgctgttgtcatctgaagcctgtgttcccgcctctatcggctgcgatgttgtcggctgcggatccgatgttccggtcggttctgtcggctgcggattaggagaaggctgcaatgcttccgctactgtcactgtaaagtggtgcgtcttttcaaccccgccatccgtatgccgtatgataacgtcttttgtgcccggcgtacttgtatctacagcatcgatcgtatactcgtgggtaccaagtaccctgtctgcgccgccgtttgtatactttgcagtcactttcattcctgtaggatcaaatatttcgcctatggcatactcagtctttgtcggcggtgtcgttactacgatactgctcagcgtcaccggaaccgcgttcactgtgattggcgtgctcgctgtcttggtgacgccgccttcttcatagctgatggtcaccgtgctgtccgatgtcgacagcatacctgttgggctgtacgtataccctgtgaccgctgccgtcgaactgtccgaatacctcgccgtcactaccatgcctgctttgtcaaaactctcgccttccgtatataccgtctttgccggcggcgtcgttacctcaatactgctcagcgtcaccggaaccgcgttcaccgtaatgggcgtgctcgctgtcttggtgacgccgccttcctcatagctgatggtcaccgtgctgtccgatgtcgacagcatacctgttgggctgtacgtatatcccgtgacctctgccgtcgaactgtccgaatacctcgccgtcactaccatgcctgctttgtcaaaactctcgccttccgtgtataccgtcttcgccggcggcgtcgttacctcgatactgctcagcacaataggaacagaatctactacaatactgaaggtcgtagttttagtgatactgccttcagtatatgtcactgtgactgttttcgttcctgccgtattcatattcggtgcagaaagcgtatatgcacccgccgcaagcaccttgtctgcgccgccattggtgtaatgtgccgttaccttaagccccgtgggatcgaaagtctcgccaaccatgtattccgtcttggcgggcggtgccgttacctcaatattcgaaagttccggcgcaggcgttgtcgcggtttttgtcaggttaatgtaaaaatattccggatcatagccagacgggtattcgttggaagtcctgttgtcgtcataggtaacggtgtatccgtccggtacgccgcttacgaccagcttctttgacctcatcttaatgatattatcgaaccagccgtcaaaatcattgtcggcattcaatacttccgtatttttggacgttcccaaccgattctgtgaaggaacccaatccggataagaatcctgcggccctttatccatcaaaacagccgtgatcgacgcacctgcaggggcgctggtttcgcttccgtttttatcataccaaagaaccctcacgccaggataaatcatcgtttcatcagggtcgataatatcaaatggtatgatgatatttctgttttgtaatgcatccggagaaaatccgggtgtcaaaagccccttgatttcctgtgtttccttttgctggttttcttcttgtgccggtgaaggctgcgcttcttccgtaaccgtctcttcgtctgccgtatgttccgttttacctatttcctccggttcggctgtagcgtcttccggctttccttcattgcccgttgtttccggttccacggatttttcctctacaacttcttctgttgccagaggctccgctgccgtttcagtattttccattgctacggttggaattaccatcccgatcatgaccgcgattgcgacaacgaccgttataatgtttttgaattttttgtcattcatccgactgttctccatttttcttcccgtccaaactgagccggacgcaatacccaatattcttttagcgataacacagagagagaagcgtgtgcttctctcttaccctgtgttaaccgctgaactaattccggttacgcgagttaagatacgcctcgtatgctgcctgtgagtctttccgccgtttgcggatgacgagcacaacgaccagccctgccagtaccgctcccgcgaatataaacagcattaccatattcatgggcagtccgccttcgtcgcctgtcttggggaacgcccctgccgctgtctgcgactgggtcagcgtgaccttgttggagtccttgaacccgtcgtctgtcgggttttggggatcctcgcccggcaccggttccttcacctgtgccacgttttctatggcattcgttcccgcctgcgccattttgttcactgttaccgcaaagctgactgtcacagtttcgcccgggtcgatctgcgggataatccacgcgaggccatccttgcctccgatcttgacgctgtccgcattcacaccctgtatactgcacttctcagagcctgttacaagcgtcgtcccctgcgggatcgcatcgcggatgatgacattcgtcgccgtacctgcgcccttgttgttgacgccgatcgtataagttatcgtgtcgccggcgttcacctgcgcgccgtctcccgggttcgaggatttcaccaagtcgagcgtcggttccgttacctgatggtatgtcgtttccgttaccttcgtggtttcttctcctgcatacaccggatcgcccttcttgtgagttccggtgtcttcttcgtagaagagtcccgcgttttcgttatcatccatgcgtccggtattttcgaacaccttggaaagttcatattccggcgtatcggggttatccgtcgtcctgggtgccgttaccctgaatgtcaggtatgccgtttctccttccgaaagtccgtttacaatccactctacaccgttcttcatgcttccgcttggcgtctggacctgtttgaggccgatcgagcgtaccttagctgtcgaccctgaaacagcattctggatgctgcccgctgccgaaccttccacaaacgtcgtgccgtccgggatcgcgtctgtaatgacgaggtctccgctcggtgcgcctatacgcgttacgcgcaggcggtattccactgtctgtccgcgcttcgttgctaccggcgagccctgcgtaccgtttgcttcggactgcgccgcatcgttttcaacgagtgccgccgccttactgatcgcagatgtgcctgtctgtgtcctatgcgttatcgtattgcttccctcagtaaccggcgtaccgtcgcccgggtcgtatgtgatggacgcgctgttcacgaacagtttcgccgtttcgccgtctgccagtttatctacaactgccttgaaacggaagcctgttacgccctgctgcacgctgtccgcgttccaggtgatgatcctccacgcgctgtcgtatgcgctgtcggcaagctgcgtcaccttgccgtccggtgcgatgatctggatgctgcccggcactaccgtgagcccctgcggtaccgtatcccttacagaaacgttattcaccgcttcgcctgcgtcaaactgcatcgtataggtgatcacctgtccctgccttacatccgtagcagtcgcctcgtccgttcctcccatcggatctgccgtctttacaaacgtatgcgtctggtgctgcacctcgttagacggagtatattcgtctactggcggcaccggatcgtccgggtcaaccggcggattcgggtctgtcgtatccggtacatataagtacccgacattggtgatgacacccgcatcattttccgtcacctggttcaccgtcacctggaaggtgagttccgccttgttttccgtgccggcctcaagctgcgcgagtgtccagtcaatacggcctgtcgcctccgtgaatacgccgctatatgatgctgagtgtggcacataggtcgtaccttccggtatgaagtccgctacgcgtacattcgtcgccgccgctgcgcccgtattcacgaccgtcagcttataggtgatcgtgtcgccttccttcaccaccggaatgagcccgttttcagccggacttgccggatcggcggatttctctatggtgaccaggggctccttcacctggtggtacgttgtctccgtatcgagcgagtattcttctgcggcaaagatcgtgtcacccttcgagtgctctgtcctgttgccatttttatccactgtcgtgaccgtttcggtgtgctttgtttcgctcatcgcctgatcggtcatgttcgcctgattcgtaaacaccttggtaagctcgtattccggtgttgcagggttgtcgctcgtgacaggtgcgctcacgcggaacgtgaggtatccctgttcgcctttgtcaaggccatttaatacccactgcacgccgtttgccgtcatttctgctgacttaaccgttgcagtcgatccgctcaccgcatttttgatctcgcctgcgatggagccttctacgagtgaacaatcctgcgggatcgggtctgtgaccacgatatccccactcttcatgccctgtgcgccggtgttggtgaccgtgagacggtattccacaatctggcggcgctgcacgtctaccggagtatccgcgctgccgcggtcttcatccttggcggtatcgttttcaaccactgccgacgtcttggtgatgcttgcgctgcgcgtcctgatttcatgcgtgacttccttggtcggaggatattccttgtcctcttcgcccgggttgtcctgctttaagactgcgttattgccgatcaccttggttgtctctccgtcggccaccctgtccaccattaccttcaggcggaagttcgacgttccttccgggatatcaactttgggccatgtcactacgccgcccgcatgtacgtctgcttcatccatcgtgacccgtgcggcgtctcccagcttgtagctgaccgatcccgctacaaggctcacgccgtccggaagcgcatccgttataacgatgttcgctgcgccgcccttggaagtcgttacgttgatgtcgtacgtgataacgtcgccttcgcgtacaactcccgggtttactgcgttgccgttttgatctaccgtgccgcctgccggtgaacttaccttttcgtaataaagcgtcggattgttcacttcgtttgtaggcgtctccggatcctgtggatcgctcggatccttaggctcttcgttgccattgtcatgcgctgccgcgtttttgatcaataccggctggtcttccggatcgaagtcctgcacgactaccgtaaaggtcacgtcgattgcgttgtcttctccgaccagcactttatcaaggttccagttcaggcactgcttgccgtttacggtcttcagttctccgctatggctcgcgctgccgtctttatacgtcgtgccttccggaatatagtcgcgcaacgtcacatttttcgctgccgccgtacccgtgttcacgaccctgagcgtataggtgatctcatcgcccggcgctatcagttgtcctgtcacgtccggatcgccgccgatcatcctgtcgctcgtcttgttgacgccgatcttcggctcggtcaccttgtggtacgtcgtttcggaattcttgtcgtattcttcttcttcgtatacaggctttccgtttttgtctactgtgttctttttctcttcgtccacgaggttcgccgtattggtgaacagcttctcgcccgtttcgcccaccgcagccggtgcgtaaacgcggaacgtgagcagcgcttcctctccggctgtcataccattcagttcccagcgcatgccgtttgccgtcagtgttcccgtgccgatcgttgccgtcgagcctgcaactgatgttgtcatcgtgccggtcgcgctgccatctacataggtcgtatccgccggaagcggatctgttacgatcagcttgccgcttgtcgcgccctgctcgcctgtatagctcacgcgcaggtggtattccacggtctgccgcttcgctacctctaccggcgcttccgcgctgccacggtcttcgtcctgcacgatgccgccaactacaaccgacgcattcttgtggatgtccgcaaatccctcgcgcacctcgtgcgtgatggtattcgtatcctcttcgaccttatttccgtttccgtcgttcatggaagcatgggccgtgttttcgtacagcttatacgtttcgctgcccgccagcttatctgccgtcgcgctgaacataaatgccgtctgcccactcgccacgtccatcttcggccatgtgatcgtcctgctcgcgctgttgtaagcgctgtcgggggcgtccaccttgctgccgtccgctttcacgtaatagatgctgccttctgcaagcgtcataccttccggcacctggtccgtgatcacaagccctgtcaccggctgctccgcgttgaactggatggtgtatttcaccttctgtccctgcgcgatctccacagcgctgtccgcgtcgcttccgcccatcgggtcggagagcttcacgagcgacgtcagttggtggttcacctcgttggtctgctcgtacttgtcgtccggctggtcagggtcttccggattttcttcgcctgggccctgtacacggtaatacgctccgtttgtcacgatgtctgacacctcgcctgccgcgagcccacccaccgttacttcaaaggttaccgctttttccgtgcctgccgcgatctccgggatcacccagtcgatacgcgtgcgttccgtcccgtccaccgtcacattacttggcgtgccgccgtccgagatgcttgcatccgcgagcgttgaacctaccggcacataatcgcgaacctgtatgttcttcgccgccgcatcgccgctgtttgtaagagtgatcgtgtaggcgatcgtatcgccctgcttcaccaccggtacaaggtcgcccggcgcggggctcttcactacgcttgacttcaccgcagtaatactgggctcctgcacctggtgccaggtatgctcggattcgagcgcatattcttcttccgtatagattttgtccgtcttcgtatgcgaggtttcgttaccgtccctgtcgatggtcgttaccgtctcgctgtacgttttttcactcagctccttatcctgaaggttcgccacgttttcaaacgtgcgggtatattcgatttcttccgttgccggatcatccgccgtaaccggcgcatacaccctgaatacgagcgtcgcggtttctcctgccgacataccgttcagcgtccatttcacgcctgtggccgtcacttcctttgcagaagtcgccgtgctcgtgccagtcccacccgagaacactgcgtcaagctgggatgcgtccacatactgcgtcccattggggaagctgtccgtcacgacgatatccccgcttttaagagcatccgatccattgttcgttaccgtcaggcggtactccaccatttggctaagctctgtctgtaccggattttccgcgctgccgcggtcttcatcctttgcggtatcgttttcgatcacagccgccgtcttgtgcaactccgccttgcgcgtatgcaccgtgctgctcgtttctaccgtctgcgtcggctccgtttccggcgtcgttacgactgccgtgttcttgagctccagcctttccgtgccgtcggcaagcttatccaccattgccttgaaggtaaatatggattcccctgccggaacgtctgtcttcggccagtagaccgtaccgtccagatactccgtccccgctgcgacaggccttccgcccgcgagctggtaacggatgctgcccttcacaaggctcatgccttccggaagcgtatccgaaacttctacatcctttacgccgccttcggaagccgtcacgcggatggtgtacgtcaggatatctccctcgcgcacatcgccctgcggacttacttccttcaccgccacgagcgtcgggtttttcacctcgttcgtaggcgtgtcggggtcgggatcatccgggtctttcgggtctttattgccgttatcgtgcgtcgccgcattgcgaatcgtaatcggcgcggtgttttcaggtacttcgtctaccgtcaccgtaaagctgaccgtgacggtctcgcctaccgctaccgcaggcaggttccagttcacatactgtttgctgcctgcgtttgttttcatctgcccgctgtcagaagcgctgccgtccttgtacgtcgtccctgccggaatatagtcgcgcactgttacgtttgccgcatccgcagcgcccgtgttcgtcacgtggatcgtatacgtgatttcgtcgcccggtgacacgcgctggcccgtgagctcgctcctgtcatttgcatcaagcatcctatcacttgttttgtatgcttcgatgcttggtcttaggtaagcgttcatgaaggatgcagatgcaccgcccgtggtaacgctccccgttgcaacaccattcgacgggcttgcctgtgtataattcgcctgcgccgtctctgctacttcatagatgctgcctaccgcaataccgctaaatactgctttttgtccgcccgcaagcgtcagctttccgtcaacgtctgtacggaacggcccgccggtcgtaatttccgtgccggtcgccttatcatacagcttatatccctgatttgcataggcgctgccatccactttgactgtgaattcaaacgcatcgccctcgggagcaccttcgcccgtgaccgtcttatcgatcgtaagatcgcgcgccggcccatagctgttgacaaatgcagcatccactccgtctaccgttaccgttccttcatagcggtccggtgttgccgtataatctgccttcggcgtttccgttaccgcgtatgtactgcctaccgcgatattttcaaagaccgccttacggttggccgtaagcttcatctgcccatcatccccagtcgcgtatgttccgggaatctgaacgcctgtcgccaggttatacagcttgtattccctattggcgtacggagctccgtccaccgctaccgtaaatgtgaattcttcaccggcaggtgcgccgctgcctgttaccgacttggataccacgatattcctcgatggtccgaaatgatttgtaaataccgctgcgctgctgttatccgctgcaattgttcccttattgccggcctgcgtcatctggtaatcgccgttcggcgtttccgtcacctcataggacgttcctgccatgattccttcgaatagcgctttttggcctgccgtaagtgtcagtttaccttccgcgtccgttgcgtacgttccagcaatttcaagtccgtctgcgccaaacaatttatatgcctggcttgcgtacacgccgccgcccacattgacggtgaactcgaatgccgtatctgccggcgcgccggctcccgtgacctgtttttccaccgtcagattacgctgaggctcatagctgttcacaaatccagccatgctgccggaagaagatatattgcctgcttccgcattgccgtccgccggctgtgtctggacataatccgccttggctgtctcgatcacttcataggccgtaccttctaagattccctcaaacagcgccttttggcctgccttcaggttcagcttaccgcccgcgtccgttgcaaacggaccgcctgctgtgatttcttttccatccgcgccataaagcttatattcctgatttgcatacgccgtgcccgccacgttgaccgtaaactcgaacgcatcgtttgccggggcatttgtgcccgtcactgtcttactgagcgtgagaccttgcttgggttcataattgtttgtaaacactacgctgttcgtgccatccgcgatgctgccgttctgcgacgtatggtccgccacataaccgtcctttgccccttccgccacttcgtaactgctgcctaccgccaagccttcgaatacagctttttggtctgcttcgagcgtcaattggccgttcttgtccgtcgtatagttgcccgagatctctacctgtgccgcgccttccggtgcataataaagtttatactgcttgaatacgtacagcgcgccgtccatcttcactgtaaatgtgaacttatcgccatccggagccgtaaagccagccgccgccgtcaccttcttattgacctcaaggttgcgctttggttcatagctgttcgtaaagacagctaccgaaccatccacagaaaccgttcccttgtttcctgtcgacgaagtaacataatctgccttcggcgtttccgttacttcatactgcaagcttgcagagtgcccttcaaagacggctttctggccggccataaggctcagtttaccatttgcatccgttgcaaagggagcgcctgcagtgatctcgtttccatccgcaccataaagcttgtatgtctttgccgcatacgcctcaccggcaattttcacagtaaactcgaatgcctggcctgacggagcgccgtcgccgttcaccgtctttgtaatcgcaagatcgcgcttgggttcgtaactgttgttgaactgcgccacgctgcctacagaagatatacttccgcttacgctcgttttgtcctgcacatagtccgtttttgcatcctcggtcacttcataagccgtgccttccaaaataccgtcgaacaccgccgtctgtccggccatcagggtcagcttaccttcgccatccgttgcatagcttcccgctaccggattcccgtccgtgccataaagcgcgtacggctggtttgcataggcgctaccgcccacctttaccgtaaaggtgaaagcgtcgccttccggagcgcttgtccctgttaccgtcttagcgaccgtcagcccctgcttcggctcataattattcgtaaacgtaatattgtttacgccgtccgctattcttccgccctgtgacgtatgatctgcgacataaccatccttgccgctctccacgacctcataggccgtaccgactgcaaggttctcaaaaaccgccttctggtttgctttgagcttaacctggcctttgccgtccgtcatataggttcccgggatctcgaccggattacctgcatcgctcacatcgtacagcttgtatgtcttatatttatattctgttccgcctaccttgaccgtaaaggtaaactcgtcgttttccggtgcgctcagtccttccgccgctgttacagctttggtgatttccaggttgcgtttgggttcgtagctgtttgtaaatgcagccgtcgaaccatcggcgccgatcgtgccattggttcctgtagacgaagctacatagtctgcatgcggtgtttctgtcacttcatacgcgctgcccgcgaggataccactgaatacagccttctgtccagcctggagcgtcagctttccttcgccgtccgttgcatacgagcccgcgatctcatttccgtccgcgccaaacaatttatatgcctggcttgcatacgcttcgcctgccaccttgaccgtaaactcaaacgcctggtctgcgggagcgtcctcgccgttcaccgtttttgtgaccacaaggtctcgcagcggggcatacgtattgttgaatgccgccgttgagcccgccattgcaacattgccgctctgcgacgtatggtccgccacatagtcttccttcgggtcttccgttacttcataggctgtattgacggtgatattattaaataccgcttcctgatttgcttttaaggtcagctttccatccgcatccgtctggtatacaccgagttgctccgtaccgttttcatacagcttgtatccctcgtttgcataggcgctgccgcccacctttaccataaacgtaaacttatcgccgccaggagcgctgctccccacaaccgtctttttgaccgtcagtccctgtttcggttcatagttgtttgtaaatgcagccgctgcaccgccctcggaaacgctgccgcttaccgcttgttctgccgccgtataatgatccttggcttcctcgttcacttcatatgagctgcctaccgcgatgccttcaaagaccgctttttggccgccttccagcgtcagcttaccatccttatccgtcatatagctgccaggaattacgatcgggtttaccggatcgctgatatcatacagcttgtattccttatatttgtataatgcgccgtccactttcaccacgaacgtaaacttatctcctgacgggataatgaagcccgcacttgccgttacgtccttcgtgatctcaaagtttcgtttgggggcatagtggttcgcaaatgctgctgcggagccgttgttcactgaaatatgtcccgcagcccccgccgcgtttgtcacataatccgcgttcggcgtttccgtcacttcgtatttaaggcctgccgcaatgccttcaaacatcgctttttggccggctttcagggtcagtttgccgtccgcgtctgttacatacattcctgaaatttcgtttccgtccgcgccgtaaagcttatatgccttgtttgcataaaccgcttcagagaccatgactgtaaattcaaactcggtctccgccggagctgtgagtcccgattccgcggtaaccgtcttttgcagggtcaggttacgcttgggttcatagctgtttgtaaactgcgctacgctgcccgcagaggagatcgttccgctcacactcgtttgatcctgcacgtaatctgcttttgcgtcctcggtcacttcataaccggagttcagcaaaatgccctcgaacacagcatactgcccgcccttaaggctcagtttgccctgtgcatccgttgagaacggcgcgcccgccgttacttccgtgccgtttgcttcatacagcttgtagccctggctcgcatagacgctgccgcctaccttcacagtaaacgtaaacgcatcgccattgggagcatcgctgcctgtcacgatctttttgaccgtcagtccctgcttgggcgcgtatgtgttattcgcataaacttcgatgccattaaggtccacgctgccggcagacgggtcttgggtcgtcaggtattgcgatgtgtatccgtccttcgcactttctacgatttcatatgtgctgtttaccgcgatcccatcgaataccgcgcgttggtttgctttcaacttcagctcgccgcgctcgtttgtggaataggttcccggaacttctatccagttcgccgcatccggtcccaggtgcgcatcctccgcataatacaattcatatgtcttatacaggtatgctttttcatccactttcacggtaaatgtaaactcgtcgtctgcaggcgcgggcagcgactcagaagatgtcaccagttttgttacgccgatgctccgtttgggatcatatttatttgaaaatgtcgccttcgaactgtcgtcgctcgcgactgttcccttatcgcctgtctgcgtcgtggtataatccgccataggcgtttccacgatctcataggaagcgccgcgaagggccatcagcactgctttttgtcccacctttaaggtaagcctgccttcgctgtctgtttgataggtcccactcaccgcgttcccgtccgccccgtaaagggtatatgcggtgtcagcaagcggctgcccgttctgcctgactgtaaattcgaatacatcgtttgccggagcgctcaggccggatgcagcttctaccttcttttccaccgtcagggtattcttcggctcataacggttattgaacaccgccttcgaaccgcccgctccgttggaaacgattccttttccatccgtcacggtggtaacataatctgccttggccgcttccgtcacctcataagcgtatcctgcaaggattcctccaaacacggcacgctgctgcgcctttaacgtaagctgcccgttttcatccgttgtgtaagcgccgatcagttccaccggatttaccggatcggttatgtcatacagcttatacgcctggtttgtatacaacgcattccgcacctttaccgtgaacgtaaattcatcgctttccgatgcggtataacccggttctgccgtgacatttttttctacgttaagcggacgatacgcttcgtaccggttggtaaacgtaacgctcgtcgtcggcatcaaggccgtactggtcgtaatcgtaccgctatacgtccccgaactcgggcttgttatcacatagtccgccttaggtgtttcagtgatctcgtaacgccaaccctttactacctgcgggaactcggcatattggccgcctttcagcgtcagtttaccattttcatccgtcgcaaagggtcctccgtccgtaatctccgttccattggacaggtacagtttataggtctggtttgcatacggcgccatcgtgtcagccgtcttgccaagcttaacggtaaattcaaactcatcaccggacggcgcatcaacgctgcccgaaagcttggttacgtttttggtcagcctcagctttgcgagattgccgatataatcgtccacaaactccacgctctgtggattgtttttatcaaggactcccgtagcaacgccaccttccggcgatacaatggtgttccccgtcatcgccgcctctgtcacactgtatgtcgctttgttgtccatacggccgaacactgccatctggcccgatttaagcgtaaatttgccattggaatccgtcgcccacgtacccgataccaccgtcgggtttgcaggatcgctaatatcgtatagcgtatattccgccggaccgtatggctcaccgttttgcagtaatgtaaagctgaaatccacgccgcccaggtcaaggcctgtcgcctgtttggaaatacgcagctccgccgcttcgaacagttctacgataacgctgttaccaagcgtagtttccgtcttggtctcgcctgttgccgccgtaaactcgttgaaccatgccgggttattgtatgcatgcactgtcggctcggtaagcgtagccggcgctttcatcttaagcgccacataagtaccttcgagcggtgcaaacacataatccgtaccgtccgttttcttagagaggtctatcgcaaccgcttttaccgtgctcatatccgttggtttcactgtcgtccagccggaagccgcgtcggaaagatcgtatgctgcagtcggattggtggaataatataccaccggattgatccctttgcgcttcgcctggatcgtatccacatcctgcaatgtaccctgccagtatgtgctgtcgaaggaaaaatcttccacgccggcgcggtcgatcgccgcacgctccagcctgtcgaagattacgacatttttcattgtaccgccatctgtattctgtacctgcaggcggtaggtatacgtttcgcccgtcgcgacgcgtgcattttcgtcgtacgtcgcaaacttatccacatcctccttgaccgccttcgtgatacctgtcgccgtagccacggtaatatcgatcgtctggctgttggagccatattgcgtattcatcgaatccacatcgccgtcttcgttcaggtcataaaaatatgattttccttcatcatccttgcctacgccggaaggcgcgtttgcaccgctgtccggacgcacgtattcgttactgctgtactggtttccaatgccaaggaaagttccttcctgcggctgccatgcagagtcgttttctttaccgtttgccgtctggtaatccgtgtaacggaaatatgccccaatgtttacataaaggttgaaatacaggctctcgctcaagtatggctcgccattataggtcggggtcgggttgaactccgtatgtacgtttaccttgaccatcgtacggccgctgcctttataatcctcgatgatatcataggacgtaatcgtcacgtcgtcattagacaggaaatacgtcctgttgctggtgttggcaccgttggccgttgccgtgatgggtacgttcggatcgaatacatacccctcgggcagcaggtcataaaatatccagtccttctgcgtccagccaagatcctcaagcgacgggtcccctgcatccttaagctgctggaaggtcacgttgcttcggtatgaagtagatgaggaatagtaattatacctcattgcctgcgtacctgtaagctgtatccttgccttgacttggctgtttgtcttatcgtttgtcaagcttacggatttgctgtggctattcactgtgaacatgggcacgaaatacttatagtcataatattcctgcgaccatgcctgcgaaccgttaagctctgtacgcgctgtcatatagttctggaaattgatccggttgcccgtctcaacggaatcctccacaagcgttttgaagacaggagaatcgtgccgtacggtcgtattgatatacatatagacctgtgacgaccagccgtgtgaagaatccgactcgtgttctgccttgaccttatagatgccctcggctttgagcgaagccggcacataggccatagcgtcctgcgctcctttggaggtataccgttcatatccgttcaagtccgtacttttctgtataaaattttcatagggaatctctcccgcagcctgccatgttcccggcgatgccgcagtttgtacgtaaagctttacaggatttcccgtcggggaatagaaattcgaataatcggacatttctttttccgcgtcgacgagccaaagcaaatccgcaatctggacggcccagcttgagatatagtaatcctccgggccgagcgccgtgttgtttgcaagcatcctgccatcctcagcaataacatttaatttgctgttttcaggcgtagggatgctggtttcgttgaggtatttccgcccatacgagtacacatagaaattatatttactgtttccattgtttatcgtggaaacattacttgccgacatctcaaagtccttaccgttctccatcgccgttttcaaaagcggaaccaggtcgttgttgccgtattcgtccttatatccgctataaaggctgcccgaaggccgcggtggcgtccattccacaatcggtgtcgtgatcgctttttcctgcgtgctcgtgagattgtcgtctataccggttagttctaccttgaccgtattttccgcatttgcgcccgccgtatactgggccttggggaaccgtactacggaataaatatagtatgtactgcttggataaacgatcgcgtcatagtaataagacgaatttgacgtatacagcgtctggttataatcaaaagaaagcgtgccgtcctccacgttccaccagcccgtcgttgccgtcgaaccaagcctctgggaataaccgcctatgagctcgccaccttcgccggggatctccgtcagcttaatatcgtatggctgcgtaaaacttgtattgtagcgtacttggtataccaaataccaatagtcattaaaatcatctggttgttcctggccctttacctggggcgcatacgtctgtaccgtgctccagttggcgaccttaccgccgttgatcacggatttcacagcagacgtaactgtcgcggacgtatcaatactccccgtgatggcgttgctgtccggctgcgttacacccttggtcgtgagttttgccgtaaaaccaaagtttgtttcgtcgacaacgcccatcgcgtccaccgaccatgcgatctggatcaagttgttaccgcccgacttgatcgctttgcagtttgtaaggatcacatctcccgtttccgggtcgatcgtataattgaaatccgacgcggcaatcatatctggcgccttaggcacgccaatatccacaaagttacagttcgcgccgttcatcggcttgccgtcgcggtatttaagcaatgtctgggggatgcgtatctgcacctcgcccaccgcataatcctggttattggagaacgtcacctgtgctttaaccgtcttctttgttttattgttccaaccgtcaagggaaaggtccgaatccgacttagtcccgggcaggctgtcgtacgcgatccactttagctcgaatttatattgttccgtttcttcgtccgcaaaaggtgctactgcaagatcgtttgcagctgcgtccatttccggtctctcaggcacaggcggcgcttccggttctgtgccttcctgcgtggcctcggtactgggagacgctttcacccccgcttccatctgcttgagttccagttgcgctgtgcttcccgcttccgtcacagtacccgtcgcagacacgtcgccctccgtattcagggcgagcgccgcagtattttcaagcgttccgttattttccggcactacaaaggagaagccttctttcgcgcttccttctacgacatatccggtgtccgcagtgatattttcgaatacagccgcgcggcccgtttccattgcgagcttgccttcaccgtccgtcgtaaaagtccccagctcctccgccgggtcttttgtcacgtcaaacaggcggtacgcctggcttatatacgcttcgccatttatcttaagcatatattccgccgtctcgccttcggcaacactttcgcctgtgatggtattatatatccacaggcttcctgtagttggcatggtttgttccgcttcccctgtctgtccgggggacggcgtttcttccggtggacttgacgcttgcggctgttcctcctgctgcgtttccgtttccggctgtatcgtcgccacaggctcaggcgaagccgtatcaagattcgtctgcgcaaacaccgtgataatgctgctcaggccgatggcaaccgccaatataatcagaagcagccggtgcgtccgcttttttgcggagactttctgttgctcctgaatatattcctgtttcttttcctgccaattgctcttcattttcttctcctttatcgtgccaatccttttagaaactatttgatcaatgctttggtccggggatacttctccccggttttcaccgtgtatcagattatgcaataaatattcatctttgtgtgttttctatcgtgaacaacattttttttacgcaaacaacactttttcggttcattgcagcgttccaattttgtgcagcggatatatcctgaaatataccttgcccaacaatgtgcactccggcaccatgccaagggcgctccgcctgctgtccacagaattgttgcggttatcccccagcaggaacacgcggccggcgggaacctgcacggggaattgcacgtcgccttccaaataggtcggttccaatgtatatggttcttccatcgcttttccattaacgattaccataccagtccggtaatccacatccacggtatcgccctcaagggcgatcacccgcttaatgaggtcgccctccccgacatccatttccgttacgacgatatcgccgtaatcaggcgcatatcccagggacgaacaaagaacaacatccccgttttgcagggtcggttccatcgacgccccgtttaccgccgcaatgcgcacaacgtaaatattgatgagtacgaccgccatagcgacaaataatacgcggcttatgacgccccatacttcttttctttgcgccttgcgtttttgcagccattcaatttccaaacgtacggctgcaaggcttggacgccatttttccccttctgcattcatttccggggatactttcgttttatccatattttcccgcatcatttatcctgctatgtacttccccagacctatcctattattcagcctgcgccgccgtttccggcctgccgaaccgctttaagaccttaagaaggttcctggcctgttctgcgttgaggacgatttgctcctcatgtatgcgtgtatcgctgtcctgcgatggaaattcgcgaattttatcctcgttttggccggctccgcccaattccatatggaaagccgcttcatatccgctacgtgcatggtcgatcgcagcctgcatattggaaagcatctccatatttgttttctgcagctgtttcgtgattccaaccgcctgcatttgcgcagcttcgataatagactgtgcctgtgtatgtgcggctgccgctgcgtccgcagtatccctgtgttcgtttttcatttcctgcagcaaatccagttgcgctcttgtctgcagtgccatttcgttcatttttcgtgcaacgtcctcgatcgctcgcaggttcgcggggtgttcctccatctccagtaacttcctgtttgccgcctgtatctggttcatcaagttttcatttttttcggtcagggcgtctctctctgcgcgcaacgtttcattttcctgctgcatctgacgtatcttgccctctttttcatggatatctttttcaaagccttccagctcttcacccagttccccgagtaaaataataagatccatcttactcagtttttgcagttctttgatctcctgattgatttcagccatagctagcccctccttctactcccgttacccggatccgtactttaaagctgctctcccaaatgctgcgttttataagtcaggtcgttgattacgcttttgatctcatcactcaggccttcgacaaaatcgccttcttccgccgtaagcttttccgtttcgataggcggtttatcccccattggcatatgggcgttcatatccgcagacttttcctcctgcatggctgtttttgccggttccgtgaacgcttgttcttttgtttcttccatccgctgcgcttccgctgaatacaaaatatcattaagacgaggtactgtttcatgccccggctctgcaaaattcttttgctgtatgtccgcattaacgtatacttccgctcccggtaccggcatttccgatacgatccgctgttcgtattcgcttcgcgcgctgcccaacatcctgtcgatttccatttgcaggctttgtaatacgtttgtgcttgcttcctttatttgcgctgcccccgttttggccttggcaataatacgctccgcctcatgttgcgccatttccatcacttcttccgcttctttctgttttgcggtttccatttcacgtatgcgttccagatattgtttagctgcgttttgggcggcctcgatcactccgttcacctggatcatggagtctgccagagagcccggttcctggtgcctgatctgcatctctttccgtttttcttccatattggccatctgcccctgcaaaccggcaatctgctgctctaactcctgtatccggctttgcttttttccattctcatcagccagtttccggttttcatcgtcgcagtcctggacaagacgtaccaactcgcgttttcccattttctttaattgctggatctccatacggtctttcattctttcttcctttcttatttccggttattgccatcctgccgcccaagtcatctcttcccgggcctgtttcattacaggtttttcctgaataccctctaaacgtttcttgaaattggctgcttctgctttcataccatccagaatcatttgcagggcattcaggtcaataagatactgtttcttcagttcggacattttttcgagcgcccgcttgtgcctcgcgtgttcttgttccatcttcctgcggttttcttccagaattttatccgcctgtctatgggcgttctcaacaatctcttttgcttcgctcgccgcttttctgatcacaaaatgaaggctttgctgtatttccggaatcacctcggaaagcacgtctatccgtccatacgatgccgcagcttccgcacatgggctgttccaactgataatccgctctttttccacctgtttttcaagattagagatcgcgctttccttttgctcgatctggctctgcctgaatttctggtttctttgatttttctcttccagctccgcgatcctgtattggtataatccatccaagcaacgcagcgcatcgatcacctgccgcttgtcataaccgaagattgcccgtggaagggtcagcatttcaaaaaactgaatgatctccggataatcgctttgtggttgcaccatggcaaacaaattttccgtattacccatcgctaaaatttccccgatactttttcttcgccttcagacaagaaaatttcactgatcccgtccatatccttaagcttccttcgcgtgatcagcttgataacgatgcccgccgcagcgacggccgctaataaaattgttcccatgatctcaagatggttcatgttatgtctcctttccccattccactattttttcagcttctttttgtaccagcggatcgatcccaaatcctttaggatgctgagcgcaaataaaactcccacacctgccgacgcagaaaacaaagtgaccgcaaggggtgtcagctcatctttccgttcttctgcttccgtcttttcctgcggaaccgatgtttttacatgcccttcgcccatcgaatttgccggttccagtgttggttcaggctccgcagtctgcgggagttccggcatcaattccggttctcctgtatcggaatctgtcggcccgggcacttggcttgcgatcggcttgccggattcttccgccgcccagccagcttcgtccgttacttccagtattggctctttcgtttctgccgacggagccggttccgcggccagcgtcggcgtgggtccagccgatggctccggcgtgggttcaaccgttggtgtgggcgttggttgcgggaacggttcgggtgtcggctccggcattggttccggctccgtcacatacgccgtaatttcgatataccccgtctccctgtcatccgcgtttacatataagatgatgggatgctcgccaaccggttgctgcgtccctaaaacgccaagttcgaccaattggaatccgccttctacgtctccccatgttccccattctctcgcgctcgctttggagcgttcgaggatctcgctttccagtttgttctgtatgcgcagctcatatacttccttggctgacagcgttacgtcatacgcttgcaggcagtattgatccggccagtcctgatgatggtacccagactggcctgcgagggcggaaaccggcatgtttacaataaataaacatatcagaaatgctatgatgatattacgacactgataatttttcgttttgaccgctcctctctgcacattttttcggtagcttagttgtacagaaaaatcctacgcttgtgtggcttacatcgtgaacaacgcatttttttacgccaacgacgtgattttgcgtttcaccgctttcctgcggatgcttcccaggccgctttcacagccctcaaataagcccttcccatcggtatcgtttctcctgtgtgtagctcgatctggttcctgctgatttgcatgatcttgtcctgcgctacaataaaggaacggtgtgtcctcaaaaacccatgcccatgcaacatgttttctatctttccaaatgtggaatagaattcaaaggcgtcgtttttataatgcacggtgatataatgatcccttgcttcaaaataactgatctcctctacgaaaaccttacgtgtctcccctgcgcatgagaatatgagcgtttccttgcttttcttctggcatctctcatatacttgcaggaatatttcctcgaatctttcttggtttgtctcctctttgacgatataatggaatgcccggacatcaaaggctttcaggataacctcaggggcgctgcttgacgtcagaaagatgatctcgctgttatatccgtattcccgcagtatccgtgccgttgcgaatccatcattccccggcatatcgacatccagataaataaggtcaggatgccgtttactgtcctcaagctcaaacaacatctgattcccgctcaggtacgggtctatctctagttcaatgcgatgcttttggcagatcctggcaagaatatccgcataagacatgatattctctttacgatcgtcacaaagcgctattttcactgttatctcctttaatttccgtattctttcaggtcaatatttgtttccctgtccatcaacgtgccaaccgtcatacacgaaaaatggttttccatttccttttgtacgccgccaaaaaaattgcggagcgggcagttctctaacgggaaccatgggcaatcccctttcggctccaggcaatgactgattttggttgttccttccgttacttccataatctccaacagcgtgatggattcgggtggtcgtgcaaggctatatccgccaagcacgcctttatgtcccacgatcagttttgcctttttcagtttgttcgccgtcgccagcagcgattttttggcaatcttcgtctgctcggatatctctcccgctgacgttattcgccttgtttccgcgagatacatgatgatgcggatcgcataatttgttgtgattgtcagttgcatttttcttctccctggtctcctcgccagcatcttgatgcagttgccgcagcccacccaataacgtagactttttagaccattcgatttatactggttttaatggtgaaatcatgccaatctaccattttcggcatgaaaaatcgttaaatttattcgattttaccttgctcgaaaaagtctaccttttcattcgaacaaaatgaattacatggcctgctatcgaaatatccgcaattctttaccgtactgcacatgtatttgtacggctccctgcagctttcggtcaaacgtatatagccatcaggttatatacgtttcaatgtgttctatctaatttccagacaaaaacgccggtctctgcggaatctataaatttatgataagtacttttgataggttttgaatggcgttaacatatttgtcacatttgttgtgtgatataggtgtgattttttaatatagtcatgaccacccgtaaaacgggtgggtttttgtttcgtttgcttcgctccctctactggctaaagccatacgaaaaagaaccgtcttaaaagacggttcttgcaaagcctaaatcctttttgcctatagtcccgcttcccacggccgttccatccacgcggggatctcacgctttaaatttccccgtttcagacgttcatgaagctcccacagggctgtgttctggtccggcatgcatacgatcgcgtccgcctcttcataggccagccacctgtatgcgagatgttcttctgataatacgatctccccattgtagggcatcccgaaaaaatacattggcaggacgacgatatccggcccccatatctgcgtccattcggcaaacaccgtgctcctcatatcgctcctgctgtcaagcgggtaaagcggccccgaaaccgtgatcccaccttcctccctgcactcgcgcagcgcactctcgatcacgctttcacctgcttctccgccgccgctgatcccctgccatatatccggaatatccgccctccggaacatcgcaaatttccagccgttatgcgccctgcggtatgggaaaacatggatatgataaggcatcctgcccatatgtttttcctcctgattccttttcgttctttttcctattatagcgtgttgcaaaggactttcggcttttgccgataaaacactttgccgcagcttcccgcacttttccgcactttcccttacctttccttctgcgaacgcgctttgcttacatccccgcttcatgctatggtataggcaatcagtcatgcgcatgacctgctaaatatcataaagggaggtgcgcctatatgcaacgcccggctaatcggtctttttaccggggcgagctgatcgcatatggcgtttgccaaaaatgcaggatcatctgtaaatttcgctcgctcacacacggaaaaaatggcgaatatcggtgcccggaatgcggcacgctcataaacgccactgaactcgcaacatcataaaacaaaaactcctgtgcttatattcccggcgacccttcggcttcgaggctgcacaggggttttttgttactttcccttctctttgcgctgttgttcgcgttctctgtgtttttctgtctcttcttctactttgatgcgttcctggctgttttccgcttcatatgcttcttgttccttgcggatctcggttccgtgtatttgagagcggtgtccgtgctttgtcattcctgattcctccttgtttctttagttttctacataatacacaaaatagtctgcttataaacaatgattattatgttgcaattgcaacatacaaaatgctgttttttggttatattataaatatagaaaacaaaggagcaaccgtgatggaaaagtatatgaaaaaccttgaatatgaaactgtgttgccatttgcagagcaggtctcctacctgcccggccaggtagccagcaaaacgattgcgcaaaacgacgccttaagcctgactttatttgcgtttgacaaaggcgaagagatcagtacgcacgaatccgaaggagacgcgctcgtcatcgcccttgacggcagcggcgaagtgacgatcgatgggcaaaagcatatcctgcaggcaggcgattcgatcatcatgccttcaaggcatccgcatgcggtgtatgcgcaggagcgttttaaaatgtttttagtagttgtattccctacgaaaggagatcattgatatgaaggtaacaatcaacagggatggatgtattggctgcggcgtgtgcgaaggcgcttgccctgaggtgttccgtatggcaaacgacggtcttgccgaggtttacggagaggttacgcctgaactggaagacgcagtgcgcgaggcagccgacggctgtccggtcagtgtgatcgaggtagaagaataacaaaaaaccgcttctgtttgaagcggttttttatcgaatcattgagcgccgacggcaggcttgccgcgcggttgagcttttataccgtcggatccagcgtcacctcgagctttaccggctggtgatccgaattttcaaaatccgtgcggatcgtctctaccgttttcacttgcacgttgggcgaaacgatgaatccgtcgatcacgtacacctgcgacgtctcgtaagaccttgtatatggtgcggaaagcaggcggcacgtgggcaggctgtcgtctacggcaaagctgaacccttcgggcagcacgtcgctgccgatcacgcccggcgcccagttttccgtgtccactacaggatattctttcactcccgggaacgtctggttaaagtcgccgcccgcgatcacatagtttcccttttcatactcgctgcgcaaaaggtctgcgagcatctttgtctgcgcgatcttgccttccccttcgtcataggcttccaagtggaggttgaccagcacaagtttagcatccgtaccctcaagcgggaggtattctacgagcagacaccgtttgaggttgcacgtactgattggccatctgaacgaaacgggaagcgcgacacgttgcgcttcatctgttttgaggtcgctgagcgtgaggatcccgctttccacatggccgatcatcgggaccggatatggaacaaagctgcatttataattataggcgaaagccccggacatcccgagcgcatcctcataatacgccgcttcgtcgatataatacgtccgtccggaatttacgtccgtttcctgcaggtaataaatatccgccggcagggatctcagggtatccgcgatccccgcaaggtttccttccacctgctcgcggctttcgggatttacgcccgtgccgccatccatgaaaaaatccgtacttttgtctaatcccgcatagcccgtattcatggtgacaagcgtaaggtcttcacccggagctgcggttcgcgtcccttccggcacgctgagcgtctctacggcatccggcttatactctgtggccgtcaaaaatatgagcagcgctgcaaaaacggccacgatcacaatcactacggtcaagattaccttcaggattttcctcgatctctttttcacggccgctcctccttattctgccgctataaagcgcgcattgtttcccttttgtactctacattcccttcgagcgcagaccttaatttttcgatcattttttcgcggtcttcattaagcgtcccacgcagcgatatataattggacgcatgattgctgcggaagacgctgcctgcgcagtccatgtgttcaagcattaccaaggtctccagcgcgacctcctccggccccaacagtgcgaaccgcccttccttataatcccgctcaagcgggacgccttcttccagcatcaaggtcaatagcccgatataatccggtttcataagcgtaaaggctttccccgttttcaccgcatgctcacgccacaactccttcccgccaatcccgctgatcgcggttacggagagcaggacgcccgcttcctttattttcaatccagcagtgatgatctcctctgcggtttctcctttgttgatctttttcaggatctcgtcgcttccggattccagcccgaggtaaacgattcccaaaccaagctcatgcagcgcggccaattcttccggcgttttgcgcaggatagaatgcggcgatccgtaaattcccacgcgcccgcaacttttaaatttctccctgattagcttcaggatagcttccagccgctccatgggaagaacgagcgcatctccatccgccagaaaaatacgccttacgcctggatattgctccgccatttctgtaaggtcgtcaagcacatccggcagatcgcgcatgtggaactgtttttctttatacatgctgcaaaatgtacatttgttgtgggaacatccgaccgtagcctgcacaatcaggctgtgcgcctcgctgggcggccggaatatactgccttcatactgcatcaatgcttatcctccgatacgtcaaacatataacgcaaatgcggctcccttgcagcctttacttcgtccggcctgccgaccggcgtggtcaccggcgccttatgcaggccttccggatccctttctgcatgctcaagaatatcctttatcgattcaatcgccccatccagcgtttctaaactttccgtttccgtaggttcaaacataagagcctcgtccacaatcaatgggaaatacatcgtcggcggatgtatccccttatcgatcattgctttggcaacgtcgagcgcgcaaacgcccgtatccttttttagctgttttagcgacaatacgaattcatgcatacatggcgcgccatattggatatccgaatatttttcaagcgcgcgcagcatataattcgcattcaaaacggcgttcatggacgcttgccgaaggccgtcgccgcccagggataaaatatagcaaaacgccttaacgatcaccaaaaagttcccgtagaacatctttaccctgccgatcgtctttggcctgttgctgctcaatgtataacaactgtctttcttttccaccaccggcactggaaggtattcctccaaaaacgccttgcagcccacaggaccgcttcccggcccccctcctccatgcggcgtggaaagtgtcttatgcaaattccaatgcactacgtcaaaccccatatcccccggccttgtcacgcccatgatcgcattgaggttggcaccgtcataataaagcaagcctcctgccccatgtataatatcgctgatctcaaggatatctttttcaaactttcccagtgtattcggatttgtaagcatcagtcccgccaccgtgtcgtccacgatcccgcgcaacgcctgcgtatccacatatccgtccggcgtagacggcacgctcaccacgtcaaatccgcacatcgccgcgctcgccggattggtcccatgcgcgctgtcaggcacgatgatcctgcgccgcttttccccgccgtgcgcaagatggtaagcgcgtatcaactggagccccgtccattccccgtgcgcgcctgcggccggctgcatcgtcgtggcctccatgccggaaatctcattcagcatttcctgcatgcggtacaaaatttccaggcatccctgcacgccttcttccggctgcaagggatgaacgtccgtaaatcccgcaagcgatgccatcgcttcatttatctttggattatatttcatcgtgcaggatccgagcggataaaatccattatccacaccgtgcgcccgacgcgaaagcgccgtataatgccgcacaatatccacttccgccacctgcggcaaccgcgccgcttccgtgcgcaacatttcgcccttcggctgatatgtttttgtcaattcattttcaggcaggcttgccgcacggcggccttccacgctcttttcaaaaatcagcttcactccgcatgcgccccctttaccgccccgatcaacctgtcgacctcattcttgcccgtcagctcagtcgcacaccaaaggatccgtccgccgcccaagtcgaggcctcctaggatattttcccgatcaaggatttcctgtagcttagaaggttccaacgggcttttcgtcacgaactcatggaaaaactctcgcccatatacaggttcaaatcctgttttttcaagttcatcctttaaataatgcgcgttggcatagcattgctccgctacctcctgcatcccctgcgcacccatcacgctcatatagaccgcgctcctcaacgcacaccatgcctgattggaacaaatattgctgcccgctttttcccttcggatatgctgctcccgtgcctgcagcgtcagtacaaacgcccgccgtccttcgccgtccactgtctctccgacgatccgccccggcagtttgcgcatgcttgctttgccgcatgccataaatccaaggtacggcccgccaaaggaaagaggaatgcccaatggctgcccttccccgacagcgatatccgccccaagctcggcggctgttttaaaaagaacctctgcaaacgggttcacgccgaggatacattttgcgcccgcttcatgcgccagcccaaacaccgtggcagcatcttcgatgatcccataataattcggcgatgataaaaagacccccgccacagtttcgtcaagcatgtttttcaggctatccatgtccgttacgccgtctttttcaggtattatctcaaattccatacctgccggtacggcatatgtcctcatcgtccggatgacctgcagatgcacggcagccgatacgagcatcttgcttcgtttccggtcacgcaccatcaggcacgcttcgcctgcggcagaagccccgtcataaacagacgcattggatacatccatacccgtcaactcgcaaatcatcgtctgaaattcaaaaatgctttgcaggataccctggctcatttctgcctggtaaggcgtatatgcagtcacgaattcattgcgcatggaaagatcgttaacggcggcaggaataaaatgcgcatatgcgcccgcgcccatgaaaaccgtatcgtatacccgatttttcgctgcaattttttttacttcacgagtaagcgcaagctcgctcatccctttgcctacgtcaagcggacgcataaggcgcacgtttggcgggacatccgagtaaaggtccgcagtatcgtcaacgccaaggctcttttccatcgcggaaatctcctccggcgtattcggaatatatcccattctattcctcctctttgaccaccgcttcatactcttccggcgaaagcagttccgcatcttcttcgttgacacctgaaagctccgcaaaccacgcgccataacagtcgtcattgatcatctccgggctgtccataagcgcttcattgaccgtttcaaccgttcctgcgacaggcgcatagacatcggatgacgccttcactgactcgacgaccgcaagattatcgcccaacgccataacgtctccctgctgcggcagttccgcataaaccaggtttccgagcgtatcctgcgcataatccgtaattccgatgcgcaccttcccgccatccaggaactctacccattcatgtgatttcgtatacttcagattttttggaatattcatcttttatatcctccgatcgttatttattcgctttgtaaaacggaagcttcgtcacttccgctttgagcttcttgccccgcacttccacacacacaacatcttcgtcaaggcccgatggcacgagcgcaagagcaatcgcggcttcaagcgtaggcgacatcgtccccgatgtaacaattcccacttccgcgctgcccgcgaagacttttgcgccttcccgcacgatcccccggtctaaaagttttaaaccgatccgtttccgtagcctcggatgttccagcgcttccctgccgataaattcttgcttatccagcttgaccgcgaatcccagtcccgcttccttgggcgtgatatccgccgaaagctcatgcccataaagcggcataccggcttccagacgcaaagtgtcgcgcgcacccagtccgcaggggatcatccctgcctccgttcccgcttctatcagggcgtcccatacctgccccgcatgtccattgcctgcgtagatttcatatccgtcctcgccggtatatcccgttttggaaatcaggcatggaattccgtttatctgcgcgtctttgacaaacgaataatatctttccggcaccgatttttcatccgtgatccggcttatgatttcctttgcgcgcggtccctgcaaggcaacctgcgagacttgccctgaaacgtctgtaagctgcacatctcccacaagatttttttccatccatgcaaagtccttatccttgttcgcggcgttcacgacagccatatattcttcgtccgccattttataaacaagcaggtcgtccaccgtaccgccgtccgcgtaacacatcgggctgtaacgcacttgtccgttttccatattggaaaattcgttggtcagcaaatggttcaggctccttacggcgtccgttcctttcacgatgaactcccccatgtgcgatacgtcgaaaagccccgctttctccctcacgcacctgtgttcctttaagattccatccctatattgcacaggaagtaaataccccgcaaaaggaaccattttgcctcctgcggccacatgtttttcgtataattccgttttcttttccatccggtcctccaccctgatattcttatatattgatattacaataggatagtcaagaccgcaagcaaacttccccaatccggcaaaatattcctatcttccctcccaagaacgcaactaaaaacgccagtggcataccgacgtttccaacatgtttttttatttgttgccgtaactcgaaaaacttgtttttttgaaatgcgttttgtcgtattgttccagtatttcttgttccaccatgggctgcaccacacattcctcgtgatagcacttcgcaggcgcagcatccggcgtgcatttttcccacgggagctttcccgtccgcgcgaacgccaggaaatcgtcttgtattcctttggcgacctgccttgcctttttcatggacggcgtcagcaggaagatcagtcttcccattcccgcgctgaaattaccgaatacaaacggcacgtcgctggagtggaaggtatgcagcccgcttactttcattgctgccgtttcataatcaaaacggtacatccatacgtcgttccgcgcgctgcgtgcctgggccaaccatacacttcccatgcggaataccatatccgtgaacatcatcgtctttccccgccgtttgccgtaacgttccctgtaataacgcgggatatgctccctgcacgcttcgtcctcatggctcacgcccgcctccatgatccccccgatttctatgatacccgcaaggggcggtatcagcaaaaacgacatctcctctttggtggtgccgatcagcatcggcacgccgctgtcagccgaagcggcagcagggatcggataatccggcacaagctttccgtctacggaaatacggaaagttcctgcgcccagcccgcacgacgaacaaaatgcctgttgctttgcggcaaattctttggccggtatcccccgcagaccttttgccgtatcggtatgtataaacgaaagaaatttccgcgcggtttcccgtccttcctctttgctctgcagcagtgtcggaccgccgctcatcacgatacatcgatgcatcagcccctttgctgcgggcagcgtagagagcgtcgccgttgttgttcctcccgcagactgtccaaatactgtgatattatccggatcaccgccaaacgcgtctatattgcacccgacccacttaagcgcttccaatacgtcgtacaatccgcaattcggctcgcagctttcatccagaaaggaaaaatccaagaagccgagtatcccgattcggtaattgcacgtcacgacgaccacattgccgtatcccgcaagatatgcgccgttgtatgcgtcttcgctgcccgcgccgcccgcaaacgaaccgccgtggataaaaaacaatacgggccgcttttttgaatcggcgcggggggaccagatattgagcgtcaggcaatcctcgcccataaccatttttttgcggttgggctgcggacatatggggccaaactcttttgcctgcctgataccgttccacggaactgctttttgcgcccgcgtaaaacgaaattcaccgaccggcggggcggcgtaagggattcctttccatacatatatgccgttttcgatgcgcccttccacttttcccgctgtcgtttgcacaaccgtatcgcacatacctttcatccctttctatttctcactgaaaacatcatacaccttttccttttattgtcaacaatccgtgccgcaagaaaatgtttttcacgtgtacgtcaacaattttgcgtgacactttttccaatctgttctactttattaatacatagcatagaatgaaacatatagctgtgctaagcggcgcatctgataacactaataataattatggagacaaacctatgacaattgcactggataccatgaaaaaggatgtgcagacgtatcttgatactttcgtgaagagggatatttctccttcgactttcacgctttatacgcgcaatctggcgcatatgctgcacttttttgaatctgacctcaaaaaaacatctattgccccggaagatatgctctcattcaaggattatgttgtcagtcattataaaaatatgactgccatcaatatgctgggaacggcaaaccgttttttccgtttcatccgctgcgaggacttctgtgtggacaacatcaaaaaggaagaacccgactgtccgccggatatcctcaccaaggacgagtaccgtaagctgctggcagtcgctgcgcgcgaagacagtaagctctactacatcatccgcacctttgcctgtacgggcatcaattacagcgacctcgaatttatcacggtggacgccgtgcacgacggttacgccaatgccaggcgcggaaacaaacgctggacgatcatcatcgcccgcaacctgcaaaaacttttgctgcagtactgtgcggaaaacggcatccgcgaaggcatcatcttcagcggcaagggaaacaacaagatcattgaccgcggttatatctgccgccagctcaaggtcttcggctcgatggtccatatcgatgagggcaagcttacaacacgcggcctgcgcctttatttctcccgcacatttttagagagcgaaaaagacgtgatggagctcaatgaattgttgggaaacaagatttattccaaccaccaattgctccccagaaggagcatcgaagaaaaaagccgcgcgcttgcaagacttgagctttaaacagcctccactatatttgttatactcttacaatacacacaggaaaaggagcggatttttcgctccttttccctttcccttttctgttgcaagtttttttgtatcctccggtgcaaaaaacgttgcttttatatttctcttatgatattatattgcaagataatttaaatccattgcgggtttgatatggccttaaatggcggcgtagctcagttggctagagtactcggttcatacccgattggtcggtggttcgaatccactcgccgctaccactatgaaaaaagcatccgcggaaatcggatgcttttttcatcactcaacccgataagaggtcaagtatgattgtaacagacgaacaaaagcaaagaatacagacggcggagcagatgctgagcgaggctacggcttccctcaacctgcctgccttaaaagaagaactctcggccctttccacgcagatggaagcgccggatttctggaacgacgtggagaacgcaaaccgagtcacgaagcaggaaaagcccctgaaagccaaaatcaccttatgcgagaaactgcatgcttcactcgaagatttgaaggtgctcgtagatatggcccaggaggaacaggacgaagaactgttcctggagttgaacgcggagcttgacgaattcgaaaagaacgttaccgacttccacctgcaaacgctcctttcgggtacgtacgacgcaaacaacgctatcatttcgctgcacgcgggcgcaggcggaacagaggcgcaggactggacacagatgctcatgcgcatgtatacgcgctgggccgagcgccacggctatggcgtacgcatcctcgattccctcgacggggatgacgcaggtatcaaaagcgttaccatgttgatctccggcgacaacgcctacggctacctgcgcaacgaaaagggcgtgcaccgcctggtgcgtatttcccccttcgattccaacgcgcggcggcatacctcgttcgcctctcttgacgtaacgcctgaaatcgacgatgcggataacgatatcgaggtaaatcccgacgatatccgcgtagatacttaccgttcttcgggtgcgggcggtcagcacgtcaacaagacctcttctgcgatccgcatcacgcatttcccgacgggcattgtcgtacagtgccagaatgaacggtcccagctccaaaaccgcgagaccgcgatgcgtatgttaaaatccaagcttgctgagaaacgcgaggaagaacggatggcgcaccttgcggagatcaagggcgaccagaaaaaaatcgaatggggcagccagatccgctcctacgtattctgtccttatacgatggtcaaagaccaccgaacaggtgtggaaacgggtaatatcaacgcagttatggacggcgatattgatgattttatcaagggttgcctgatccagggcttctaagagacactttataggcagcgcgtataaaccgcgctgttttttattggaaaagttcacaatttattcataattagacgttcttgcttcgtatctatgaaatttttataatagtatcaatagaattttttcagattggatatgaggaaggtttggtaacggaaaaacaaaaaaagatttggagcctgatcggcaagaacacagcttcctttgcttgttgcatgggctgtatttatttgttcctttttttatttggtcccaaaaatattttgccgtcggtggcagtcgttgtcggcctgatgacttttccgcttatcgatgtaaaaaccaatcatctgcaattttctctggccatttttttcttgtttcccttgattggaatcatttccgttctctctctgttgaacgtctggcttagtatcctgtgtaacttcggcatcgtggtgctcatccttttacttacggtcgagccgcaggacctgaagccatatgttacgttcttgctgtgctatatcttttcgcagggaagtcccgtttcaaatacaggggagttcttttcacgcatgtcctgcctcacaatcggcggactggcaatcgcggttgtgacttattttacatggcggcacaagcaaaaaaacggcgtgcagcatagcttgcacgaacagctccacctttccgttcggcataaaagctttatcctgcgcatggcgcttggacttacgattgccggcatcatcggctttgccctgcatctgaaaaaaccgatgtggatcagtatcgtcgtcttttctctgacacagatcgatatcaaggaatcttaccagcgtatcaagtaccgcgtaatcgcgacgattatcggtattttcctgtttctcctgttctgccagtatctgattccacaggaatatatctttttctttatcatttttctcggttaccttagtacgtgggtcaaggagtataagtatacacaaatcatcaatacgattaacgctatcaatgccaaccttgtgttattcgactacaataccgccatcggaaaccgttttctgctgcttggtatcggtattgccatcgtactcgccatgtattgcctggaccgcatcatccggtattttatcagcgcgcactatgaacatccttctttgccggaacacagcaaacgctccgcaccgccaaacaagaatgatactatgcatacactggaatcctgaactgcctttggcgcggagaaacatgataaaaaaacggataatatattattatccgttttttaatgttcagcccgcctatatggggtatgtaaaaaacgactacatttcatgaagcaggaggaatcaccatgaatttaaaaatcagcgtactttttcgtgccattccgcttttgatgggcgctatctgccttggattcgggctatatgtaaagggaatgggcgttggtgatggatatatcatcgccggaaacgtgctcatgtctctcactgcgatctgtatcgccctgttttccacagcagcgacgatcatccgccagatcatcaaacgttatacaaaagctgacaggatattctatccgatccttggatatgcagccggtattattacgtttatcttaggcgtcatgctttttacatccggaggatcttctgcggatctcgtatccggcaatgtcgtatccggcgtcggcctcattgcatgctgcgtcgcgaccgtggccatttcgtctggaaaattttccaaaatcaccgaaaactcttccaaccttacctatggccagccggcaacatctgcttactccaaagggacttatgccgtttactacagcattcccatcatctgcaccattattgccctgatccgtggaattatattgcttgcaggcggcagcacgcccgaccttgtggcgggacatgtcatgattgggctgggcttgatatgcgcctgcctgatcgcccttgtggctacgatcctgcggcagatacagaatacattcagtcagcaggaacgctggaaatggagcatttttgtcgctgccctcggcacggtatgccttgtgtggggtattctgctcatgattccttacagttcggcaatggtcgcgcctggtttcgtactcatcggcctcggcatgatttgttacagtatctcaagcaaagttcttttgctcgcttccgtatggcggcgtaatgcccctcttgcaaaacgcatccccataatccccgtcatgacggcgttagcctgcctctttttagcggcgtttctgtttgaagcttcttataccaaccctaatttctttgtaccggcccatattatggtcggcctgggcgccgtatgctttacccttttcgctatcgtttcaatccttgaatccggcacctcaaaatcgtgatcctgctcttttaaaaaccgcaacaaaaaacaggagaggatcctctcctgtttttttaattgctctttatttttcgaccggaaaatagatttccgttacaagcttctcttccggcacctcgtgcggattattgagatatttttcatacggctgccccgcgatatgataaccgttatcttctatccatttcacgatcgcaccgtatgtttctcccagatttgaatacgatcccaggtgcgcggccatcgcacatgttccgccttgtattgtccgcgaaaagttatttttctgcgcgacgatcgcgcccacctccgcatccgtactttctgggtcgaactcttggctatggtacattgctatgactccgccatggcatgtgaggttattatcccgcaacgtcctcatcatcttgtcatacagcgtatcgaaatccttgatcgcgataaccccgcgtgcactcacgatctcgaacggttttgtttcaactacctttatttcctgtgttccctgattcataatatcgattcctttcttgagtaaatccatgtcttcccgcattttcgcgagaatattctgctgatgcaggatgccttttttctgttgctcgtatttcgctgcaaaacgcgcggccaccatgttggaatccgcatgcaggagttctgccgtctcttccagcgtaaaaccgtactccttacattttaggatgaaaaacatatccttgaactgcgacgcctcatagtaacggtatcctgtttcatcgcttgtatatgcgggcgcaagcaagccaatccggtcatagtgccgcagcgtcttggtcgtaaccaggcacagcgccgaaaactctcctattgtaaacatcagccttctccttttggtttgggatcgatccttaagactatcatatcctttgcccccagggcaaggtcaagcacttttttaaaaaaagaatgccttgcggcattctctctcatttttcaatttttcttaacgcgtgcatcgccttttcataatcatacttatgtacgtagacataatagatatttgcccttgacggctctccgtagcgcgtcgcgattccggcattcccgttcacgccgcccccgcggccacccgaccatgcatttttcaaatcggcttcgtacttgatctggcaaatcgaaagcgcatttttcagtttcgcaaaaaactgttcatcgctccccatccagacttccttgcggttccacggcatcatattcgctgtttcctccttgtgccacaaaacatatttcttccacgctcaccatatcatactgccaacccaagcgataagcaagaggcatttactcaaacatccttgccgcagcagtttttatattttttgccgctcccgcacgggcacggctcgttcctgccaacctttttttcagcgcgcacgggcatctgcgcctcgccgccgcgcgcgttggtattcatccgccgctgtgcaggtgcattggatacaacggggttgccgtcttcatccacgttggcacgcgcgcccgctacttccttctgttccaccttgctctccaccttgatgtggtacagcatataaatggtctcttcgcggatcgcgtctaccattgcgtcgaacatgtcaaagccttcgatgcggtattcgttgatcgggtcgcgctgtccgagcgccctaaggccgatcccgcgtcggaattggtccattgcgtcgatgtggtccatccacttggaatccaccacacgcagcagcaccatacgctccacgtcgcgcatattgaagcccgcgccgtccatctcctgctctttgcttacataggcttccttcaccgcgtcaagaagctcctgacgcagcacggggatctctgccgtttctttttcgtcgtcgctgtaatgcttcacctttagggcaaatacgcgttcaaagtaagcgtacagatcgtcccagtcccattcctccggatatttccctttgggacaataaacactgatcgcgttgtccaccagtgtttccaccatgccggtgatgttgcccgtgatatcatcgcccatcagcacctgcctgcgctggccatatatgacctcacgctgcttgttcataacatcgtcgtaatcaaggacatgcttccttaagttgaagttgttgctctcaatgcgtttctgcgccgtttcgatctgcttagtcagcatgccgaactcgagcggcatatcgtcatcgtcccctgcaaggcgttccatcatcgccttgatgcggtcgccgccgaaaaggcgcatcaggtcgtcctcaagcgcaataaagaacttagacgaacccgggtcgccctgacgtccgctgcggcccctgagctggttatcgatacggcgggattcgtgccgctcggtaccgatgatcgcaagaccacccaaagcaacgacttcctcgtgctccgcatccgtaatctttttatattttttattaagctccgcgtatttcttgcgtgccgccaggatctccggatcgtccgtcaccgcgtggcttaccgcattctcgatcatttcatcgtccataccgtccgcacgcatctcgttacgcgcaaggtaatcggcattgccgccaaggatgatatccgtaccacggcccgccatattggtagcgatcgtcaccgcgtttttcttaccggcctgcgccacgatctgcgcctcgcgcaagtggtttttagcatttaaaagctcatgcttgattccgcgccgcacaagcagcgacgaaaggtattcgttgtctgcgacggaaaccgtgcccacaaggatcggcctgcctgtctcatgcaacgccgcgatctcgtccgccaccgcattgaattttccttttttcgttccatagatggcatcgttcaaatccttacgcaccatcggacggtgcgtgggaatttcaacgacctgcaggttataaatactttggaattcgtcctcttccgttttcgccgtacccgtcatacccgaaagtttgttatacatacggaagaaattctggaacgtgatggtcgccagcgttttcgactcgcgctccaccttgactccttcttttgcttcgatcgcctggtgcagcccgtccgaatagcggcggccgatcatcagccgtccggtgaactcgtcgacgatgacgacttccttgtcgtccgtcaccacgtattccctgtcacgaatgaacaagcggtgcgcctttagcgcctggttgatgtggtgcacgatctccgtattttcgatgtccgttaaattatcgagcttgaaaaactgctccgcttttctgacgccctcttccgttaagttgatggctttcattttttcatcgacttcgtagtcgtcttcttcttttaacttacgtacgaacctgtccgcctgctggtaaaggtccgtacccttgtcgccctgtcccgaaatgatgagcggcgtacgcgcttcatcgactaagatactgtccacctcgtcgacgatcgcaaaattcaggtcgcgctgcacaaggtcgctcttgcggatgaccatattgtcccgcaggtaatcaaaccccagctcgttattcgttgaataaatgatatcacaagcgtaggccgcctgcttttgcgccttgtccaactcgcgtgtcacaaggcccaccgtataccccaagtaacggaacactttgcccatccattcgctgtcgcgctttgccagatactcgttgactgtgacgatatgcacgcccttgccggagatcgcattgaggaccgcaggaagcgtagctaccagcgttttaccttcaccggtcttcatttccgcgatatttccctgatgcagcacgatgccgcccagtacctgcgcatagaagtgtttcatgccaagaacacgccagcttgcctcgcgtacctgcgcgaacacatcaggcaaaagcgcatccagcgactctccgtcccggtggcgctttttaaacgtttccgtcatggaaacgagctcgtcatcgctcatttcttcataaaccggcgaaagcgcttcgaccttgtctgcaagttttttgaccggacgaagcgccgaatttgaaaacagtcccataaatatagtaaccttctctctttatatacgataattattgatacccaattcattacattttatcaaagttactatgtgaagtaaatcgaatcggttcaaaatctacaaaaagtttataaatacattgtactttagctgccgtttctttataataagcgtaacaaaatctgcggcgaaagattcgcgtccgtggttgcaagccgatgccagtcgcaggcaaaacggtccacgtaagcacgtttttcgtgtgagcatagtgcggctagacgtaagaccgtccgcttatcaaaagcgagaggagtaagagtggcaagacgctgcggggctcccgggcggcgaatgtgggggaaaagaccaggtcgggcgaatcttttgccgcagattttccgttttttaaaggaaacgggcaaggtaatgcagaatatctaaaataatatcaaacggaaggggcgaactacatgaaaatcaatatttccggcaaaaacatcaacatttccaattatttacgcgatatcgtaaataaaaaggcaggtaagctggaacgctacttcaaaccggacacggaaatgcaggtaacgctttccatcgaaaaatcccgccatatcgcggaggtcaccatcgtgtgcgacgggcttgtattgcgcggtgaagaggccaccggcgatatgtattcttccatcgatgcagtgctcaaaaaattggagcgccagatgcgcaagcaccgcaccaaattagagcgcaggctgcatgacgcggccttcgacgaagggacggtatacgattattacgacgaggactttgaagaggacgagccgcagatcgtgcgcaaaaagaaattcgtactgcgtccgatggctgtggaagacgccatcatgcagatggatcttttaggccacaacttctttgttttccgcaatatgcataacaacgaagtcaacgtgctctataaacgcacggacggaaactacggcctgatcgagccgcagcagtaaaaacaagtcaaaaacgccggcattctgccggcgttttttattgcagccagacattttatagtcgatcaaataccgtcattctggaaattctttggaataggtaaataccatgaccgatgcgcccgcctcctttagcggctgcatcgcttcgctgaccgtcgttcccgtcgtataaatatcgtcgaccagtaatatattcttacctgcaatcgcaacgttttccttaagcgcaaaggcgccgcggatattttttctcctctgctccgcatccaggtcgaactgcggttttgtatccctggtacgctcaagcagaactgcacacggcagatccaacaaaacgcccagatgcgtggcaatcatttcgctctggtcgtagccgcgctgcacaaggcggttcctgtggatcggtacaaacgtcaaaagatcagcattcaattcatattcctgcaaaaagtctgccatttgctgcgcaatgaacgcggaatagcgcggcatatcgttatatttaaaccgatggatgagcgaccgtaccggcccctcgtagcggtatgcataaaggataccgcctttatagagaccgtcacggtttttaagcgtctcggcctcgcttatgcatgttttacatgcaatatcgccttcggggatttcccgcgcacagtacacgcactggctgcccgtaagcgtcaattttttgagcagctcataaaacctgttcatcccgcgttatcctcttcagatattgaagttcccgttttaatatggtattgcgcctgctctgctgggcgtttcccaccatatattcaaaggtatgcctgctgccgataatcacaaccttcttttttgcacgcgtcacgcccgtatacagcagattgcgtgcaaaaaacgggttgacggcgtaaagcatgggcatgagtatcacatcaaattcacttccctgcgatttatggatcgtataggcatatgcgccgtccagttcggcaaggtcgggcagttcgtattggcagcgcttcatatcctcaaacagtacgtccgtcacgccgccgtatatcgtttctaccgtgccaatatccccattaaaaacgccttcgcccatctgtaccgccacatcgtcgcgccactcgcgcgcataattgtttttgatctgcatgacgcggtcgccttcgcggaaaatgcggtctccaaacaatatttccgtcttggttttccctttggcgtttaccgtctcccgcaatgcattatttagttccagcgtacccagctcgccttttttgataggcgcgatcacctgcacgtcatcccccttttcccaatattcctgatagagcttacaaagctctgcacgcacctgccccggcgtttcacattccctgaattcaaatgtttcatcatattccccatgagccacgccgtttaaaatatcgtacgccgcatccgcgatcccgcctgcattacggaaacggtgcgtcagcttgacgctgtggatgacgtctgattcgatcacatcccgcatcacgttgcccggccccacggacggaagctggtccgcgtcgcctacaaggatcaggcgtgaaccgtcctttaacgcgctgagcaaattgcggaacaaaaatacgtccagcatggagacctcgtctacaatgaccgcatccgcctccaatggattatcctcgttcctgcggaaaaaacagttgaacgcatcctcgtcataggaatactcgagcaggcggtgcagcgtacaggcggtgcagcctgtcgtttcctgcatgcgttttgccgcgcggcccgtaggcgcgctcagcacgcactccacgcccgaactgcccaatatttcgagcacggctttgagtatcgtcgtctttcccgtacccggcccgcctgtgatcacgcacaccctgctttctaccgccgcggcgaccgcttctttttgctcctccgtcagtgaatattccccggctttctttttgagcagcgcgggaagatcgcgcatcttctctgtgtcagacacctttgccatcgcaaagagtttggccgcgcagcgtgtctccgcccggtaggccgtttccaggaataccacctgcatatccggataatatttcctgagcacgacttcttttgtaaacgcaagcgacaacagcgcgttcgtaacgctgttttcacctacgcgcagccgctgcgccacatgcgggacaagctgactgcggaacacatacgtactgccgcgcgccagcatctttttgagcacgttcaagataccattcttgatccggaacggcgaatcgttcaatatgccgatctgcatggcgatcttgtccgccgtcataaaatcgacgccgcgcacgtggtcgatcaggatatacgggttttttcgcaccttgtccgccgcgtcttctcccagctccgtcacggccagcgtggcttgccgcgtggtaagccccatgcccatcaggtctgcatacacgtattttttcagcgcgtattccttcatcgcgccatgcacgctgtccgcaaggcgcttggatacgccctgcacgcgcgcgagctccctgtggtcgttttcgatcacgtcaaacgtcgccgcgccgaattcttccacgatgcggcgcgaaagcgtctcgcccagccctttgataaagcctccggataaaaacagtacgatatcgtttagatccttgggcagcgtgctttcataggattgtaccgaaaactgcatgccgtatttgctgtgcgttttataggtaccaaaaaagcgcgtgcgttcgccgggctttaagtcgggcatgttgcccaccacgatggtgggctccgccgcgtcgacttccgccacggtataaccgtccgcgctttcatagataatactaagtaccgttccaactatttcagtcgtcaaatctctttcttgatggcctccaccatgtccagcttctcccacggcagatcaaggtcatcgcggccaaagtggccataagccgccgtttgtctgtagattgggcgccggagctgcagcctgtcgatgatcgcgctcgggcgaaggtcgaacagctttgtaacgatgtcggcaatttccgtgctgtgctttttgcccgtcccaaatgtttccacaaatacggaaaccggacgcgctacgccgatcgcatatgcaagctgtatctcgcagcggtctgcaaggcctgccgcaacgatgttcttcgcaacgtaacgcgctgcataagccgcgcttctgtcaaccttggacggatcctttccggaaaaagcaccgccgccgtgacggcccatgccgccgtatgtatcaacgatgatcttacggccggtaagcccgctgtcgcccttcggtccgccaatgacgaaacggcctgtcggattgatgtaaattttcgtatcgtcgtccatcatctctgccggaataatcggtttcactacctgttcgatcatatcgcgcctgatctgcgcctgtgtcgcttccggatcgtgctgcgtcgaaataacgacggcatccacgcgaaccggcttccagttttcatcatattccaccgtcacctgcgatttgccgtccggacgaaggtaatcaagcgagccgtttttcctgacttccgcaaggcgccgtgaaaggccgtgcgctaagtagataggcatcggcataaaagccggcgtttcattgcacgcatatccgaacatcatgccctggtcgcccgcgccgttttcgtcctcgtcgatttcctcttttgcttccaaggatttatcaacgcccattgcgatatccggagactgttcatcaatggatgtgatgacgccgcatgtctcgccgtcaaacccataatccgctttgtcaaaaccgatctgcttgatcgtctcacgcgcaatttttgcgatgtcgacataagcgttcgtcgtgatttcacccgtgaccagtacaagccccgtgttcacagccgtctcgcatgccacgcgcgcggtggggtcctgcgctaaaatagcgtccaatacagaatctgaaatctggtcgcataccttatccggatgtccctcggtaacggattccgaagtaaataatcttctcattgtttttcctccatatattttacataaatatgtatgatttcactaatatcttattatagcaaaggtaagtccggttttcaatcataaaaaaactgcatgatatgcagttttttcgctttctcacacaatattttttcatttgtaaaccatcttatgaggcccatggagccatgcccgggaaaaagatgctcgaaagcatgagcatgataaagcctgcaacaacattaccaagaataacgagcggaatcgccttgaccggttttaaccccaacacgcttgcgatcagcgagcccgtccatacgcccgtgcccggcagggggatcgccacaaagatgaatacgccgagataaccgtatttttcgattccgcctttatgcttctccaccttgcccatcagccagtttgcaaagcggttaaaaaattttaccttactcctctgcatccactttatgatacgttcgataaaaatcacgataaacggcgcaggcagacacgagccgatcaatgcaagaaaatatgtcgtccagaacggtactcccagcccaagtcctaacgggatcgcccccttaagctcgataatcggcaggatcgacgtaccgaataccgtccagtaactaaccgcaggaatcactgcatccatacaaatacccctttttccattttaaaacaatacaatgatactgtatttatgatataatttcaatgaaaactgccccattttagaaatatttaaggaaataaactggtttatgagaaaaattttaggcgctgtgcgtcgggctgacgaacggttctcaatgatccgtccgggcgacaaaattgccgtcgggctttcgggcggcaaagactccatgctgcttttatacgccttgaagctgtatcaaaaatatgtcaaaaaggactacgggctatgcgcggtcacgatcgatttaggctttggcaattacgcgacagaggtcatgcaggaatacgcggacgggctcggggtgccgcttcacatcgttaaaaccaatatctcggatatcgtttttaatatccgcaaagaaaagaacccctgttccctatgcgccaagatgcgtaaaggcgcgttttacgaaaatgccaagatgctgcattgcaataaggcggcgttcgcgcatcacggcgacgacgcggtgcagacgttgctcatgagccttatgtatgaaggccggatgaatacgttctcgcccaagtcctatatgtcgcggcgggatattacgcttgtgcgtccgtttgtgttcctgcgggaaagcgatatcgtctccgccgtcaggaaatatgacgtacccgtcgccaagaatccgtgccccatcgatttttcaaccaagcgggaacaggccaaggatatcgtcaaatatttgaatacgctctattcgggcgcggcggataatatgctctgcgccctcaaaagcacgcaaacttataatctgtgggataaagattattctgagcattaaaaaagagcgtacctaaaaggtacgctcttttgcttttttatctaaatttattcagaaacagattcgcctgtggattccgatccgtttgtggccgtcgccgtacttccgcttaccggcgtataatagcgctcgagcatcttttgcatgagttcgtcctcatccatgatgaaataattcagcttggacgggctggtgacgatcgggtcagggaaattctgccagctatcgtcgcgttcttcgaatgtttccatcctgatattgtcgatagaatctaacttatcgagcacgcccgccatcgcgacgatttggtcaaggccaaggttcgtttgcagcacgttacctgaaagctgcgagaacagcttggaagcggattgtaccgcgcccagcttcttgatctttttggcgatcgccatcatgaattcctgctcgtggcgctggcgcgacatttcaccatcgtccatctgcttcctgttctgcaggtacaggcgcaccgcctcgccttccagggtaatcgtatcacccttgctgccaatatccggataatcctggtccagcgttacttccacgccgcccagcgcttccgcaaggtcagctaagtgttctaaatcgatcgacacaaaatactggaccggtatactaagctgcccgtttacttctatgaggtcttccgtagcgcgcattgcgttctgcggtccccacttggtagtatcgttcccgccgcccaggatatatgcatggttcaatttggtcgtatattccttagattccacttttccggttttctggtcgactttatgcacgaccgtacgcgtatcgcgcggaatggaaaggaaggatatctcattgttttccatatcgatcgtacacagcataatcatatcgctgcgcgcgcccgtcgcgtcctttaccgccgtgccgtcccagtcgatccccagcatgaggatactcaccacattcgggttcttctggtatgtttttccatcgatggtaaccatttcaacatcagcgttcgcgtcaaaatttacatcgtccgttgccaccgcgcttggctgcggcgtattaaatgccgcgatcggatttgattttaaatcagcatacgttccgtaaagtgcgtaactgacaccgcctgcgcaaacaatcaacacaatcagaaccaccgtcagtattttaattccctttttataattcaactgttagtcctcctaacaaaatcacatcgaaatctgttcaatattataatataaatcaacgtgcaatgccactgtttagccaaaatttcttaatttaccctgctttgtccatatcctccgtgggaacgtaatatagcgacagcatcacgcgaagcaattccgcatcgtccatcaggtaataatccacatccttgccaagcactggatcatgcattttttccggccagtttgcgtccttgtccgcaaacgtttccatagtgatatcgtcgatcgacccgatcctgtccagtactcccgccatggcagcgatttgatcaaggctcaaattcgtccggactgtgctgcccgaaagctgtgaaaataacttcaccgctgcgtttaccgcccccagctttttcaccgttttcgccattgccttcataaaatcctgttcatggcgctgcctgtccatttcgcctccctgcatatcatgccggttttgcaggtatttccgtaccgtatccccgcgcagcgtgaccgtctgccctttgcttcctacctccggcatatcctgctccagcgtcacttccacgccattcagcgcatccgcaagctccggcaaatgctccaaatcgatggagacaaaataatccaccggaatgtcgagctgtccgccgcacgcaatgaggtcttctaccgcgcgcatttcgtttttcgccgccgcatcgtcatttgcgagcgctcccaacgcgtatgcatggcataacttggtaagcgacgttttttcctgtatctttcccgtttttttatcaacgtcatgcacggccgtgcgcgtatcgcgcgggatagaatgaaaatcgatcgtattttcctgcatatctaccgtacacagcataatcatatcgctgcgcttgccccaatccttgcgctcctgcgacccgtcccaatccacgcccagcatgaggattgtcactacatttggattttttccataccgcttcccatcgatcgtgacaaactcctccaaagcggcaggctcagtctcccgcccgataaccgtatcttctcctgacgtcgcggtaaacgcctgcattgggttttccttcagggcggcgtaacggttatagagcgcataaccgatcccccctgcgcaaatgccgagcacgatcagtaccgttaccagtattttgatccatttctgatatttcattgagaatatcctccgatttccccaataaaacctctgtcgcttttcggcctttctatcatattacaaaataaaccaattgtgttgatttttatccaatcttcacaaaaatattaaaaaaatgatgcaattggatataaaaaagccgccttatgattaagacggctttccgctctattttgttccctgattaataaccctggttgtaataatcgccacggcggtaatcgtacaccgcgcccgcgctgtaaacgtcgatggactcaagcgccttgcccgtaccgatcgccacgcacgaaaccgcgtcttccgcaacgtagcaagggatcttcgtcctttccgttaaaagcctgtcaaggccgtaaaggagcgaccctccgcccgtcatgcaaatgccgttttccgcgatatccgcagtaagctccggcggcgtgcgctcgagtacgctgtgcatagtttccatgatgcggtcaagcggttcctgcattgcttcgatcgtctcgttggaactaatggtaattgtctttggaagccctgaaatcaggttgcgtcccgttacttccatatatgcttcttccttacgcggaaacgcgctgccaatgttgatcttgatttcctctgccgtacgctcaccgatgagcatattgtattttttcttgatgtatcttgaaatatattcgtcgaacgtatcgcccgcgattttgatggaatcgctgatgaccgcgccgcccagtgagatcacagccatgtccgccgtaccgccgccgatgtctaataccatgtttccttgcggtgcgccgatatcgatgcccgcaccaatcgcggcggcgatcggttcttcgatcaggcacgtatggcgcgcgcccgcttcttccgtcgcctcgatgaccgaacgcttttccacttccgtcacgcccgaaggcacgcacacaacgacgcgcggcttaaaaaacagccttttgccaatcactttacgcaggaaataccgcagcattctctccgtatcatggaaattggaaatcacgccttcgcgaagcggtctgaccgctactatattgcccggcgtacgccccagcatgatgcgcgcctcttcaccaatcgcaagcatcctgcccgaaagcctgtccacagctaccacggacggttcccgcaggacgattccctttcccctcacgtacaccagcaccgtggcagtacccaagtctattcctatatcattaaaatttccgaacacgcccattcacgcaagcctcacttttatcatactttgcaatccatatggcagaacatgcctatatatcatatatgataatacaagcaccattatatttcaactgttttatgacgattttgtcatattctctctcttgaactgcccgcctattgcggttacaataaaatgtgtcggaaaagattttttcaatttggaacgatcaggaggaaacgattattatggattatcaaaaactgcaaaacggcagcgacatacgtggtgttgcgctcggcgaggggacaaacctcacaccgcaggccgcacacgatttatccctcgcgttcgccgcatggttaaaacaaaaaaaggggacttcacatctcaagatcgcgatcggcacggattcgcgcgtcaccggccccgaccttaaaaaagcctgcatcggcggatttttaagcgcaggcgcagacgttgtcgactgtggcatggcttctacgccggccatgttcatgacgacggttacggacggatttttgtgcgacggctctgtgatggtcactgcaagccacctgcctatgaaccgcaacggcctcaaatttttcaccagcgaaggcggccttgagaaagaggacatcgccgaactcatccgcatcgcggacacggccaaggacagcgatgggaacggtaaggtcacgcaagctgatttcatgagcgtatacgcaaagatacttgcagataagatccgcaaggcaacaggtgaagagaagccttttgacgggtttaagatcatcgtcgacgcgggcaacggcgcgggtggtttttatgtggacaaagttttgaaaccccttggggcggatacgcagggcagccagtttttggatcctgacggtacgtttcccaaccacgtgccgaacccggaggacaaaaaagcaatggacagcatcgtaggcgcagtcaaaagaacgggcgcagacttcggcctgattttcgacacggacgtagaccgcgccggcgcggtagacaaaggcggcagcgtgctcaataaaaaccgcctcattgcggcgatctccgccattcttctgaaggaatttcccggcacgactatcgtgacggattccattacgtcaagcggccttgcggaatttatcaaggcgcacggcggcgtgcatcaccgttttaaacgcggttataaaaacgtgatcaatgagtcgatccgtttaaacaaaagcggcacggattcccagcttgccatcgaaacgtccggtcatgcggcgctcaaggagaattatttcctcgacgacggcgcttacctcgttacgcgcctgctgatcgaaatggccaagctgaaaaagaacggtcacagtattatggacctgatcgctgatctgaaggaacctgctgaaagcgaggaattccgcctgaatatcaacgtcgaggatttcaaggcttatggcaacaaggtgatcgacgacctcacagcatacgcaaaacaggatgaaagcttcctgatcgcgcccgacaaccacgaaggtatccgagtttcctttgataaggatcacggcgatggatggttcctcgtccgtttgtccctgcatgatccgctcattcccgtcaatgtggaaagtgacgagcagggcggcgcacgtatcatcacagaaaagctatatgcgtttttaaagcaatacgacaagctggacctcagccccatcgaaacttatttaaacgcataagaacgaatcaaaaaaggcggttgatacaccgccttttttctttacctcttcatcagaacctcgacctgtcgtcgaatttattcgccccgcccgtacgcttcgggccctcctgttcgtttacatttaccttcggatcttcgaagtccttttccctgccgcgaaattcattctgctttgcctggtacatttttttcttcttcctgttgcggttgattaccacgataacgaccacaaccaccacaatgatcacgatcataataatgataccaagaagcatggaactgatgccgctttccgccttgtccgagaccttgtccagcacaaattttccgctcgcgtcctgcttaaaatctatatacaggtcttttgcagtagacggcatttccacgacgtatccatcacccgtggtttccgcgatctttgttgccatgccctgccggaattcgatattcaaaaccgtagcgctgtcctcggccgctccctgcgtgagcatcgtccaggtataggtcttgaacgacgcattgttaaagacaaatttcccgttcgcatccgttatgcctactgccggcgtcggcagttctgcctctgtcaccgctaccgttacgcctgcgatcgctttatcggacgcatctttcacggttgcgcttacgttaaagcttcccgtcgcgggtgttaccgtggccgaagcagacggagttggggcaggcggcttcgaagtaccggcagagtagacctgcaacgcctcttccggtacatatatcgccccaaggtaaaggttcgttacatcctgcccgacggaaatgctgtatttcccgcccatcgcctgttctgtgatgcccgtcgtatttccgcgccctaaatacagcatacccgtgctcagcttgccatttgcatccttcacggaaatgctgtgttcttccaccgtaacgccggggaacgaaaccataccgtccttattcgccgtttgcgaactcttgtctatgatgacagtgtatccttccgcgctctgtccatcctgcgtgtatacataaatcgtcaggttaatatcctggtcctcggacggcgcctgcgtcggttcttccgactgcgtgggcgtaggagtcgacgtgggcgtaggagtcggcgtcggcttaggcgtaggagttggcgtggggctcggtgtgggcgtaggagtcggggaagccgtgggttcctgtgtcggctctacggtatccgtaggctgcggatcctccgtctctgcgaaagccaccggcgcaaacatcgcaagcatcagcacaaccgcaagcaaaatcccaaatatttttttcgtttgtttcattcggttcacctcatagttatgattccatttattatcgtttagacgtattctatcacacaaatgttcctaaacgcaattgaacatcttaaatcccgttcttcaaaaaaatccctgtttttaaaaaacagggatttttatctgctgaaaattctctagtcttcttcgcatgtgcatacgcatgcgctcggcgcatccggaatatcctctttgaccctttccggcaccgaagaaaacaacgtgcttacagattccctctcgtgtatcctgtagaccgcttctgcaaaaagcggcgcaacggaaaccgtgaggaatttctcctgtccgataataaacgggttttccacgctgtctgtggagatcacatattcgatcgggctttcattgatggcttttacgcccttttcgcgcagcatgatatgcgccaggcatgcgacgacacgttttgcgccgcgtgctttgagcatattcgccacgtcgacaagcgtaccgccggaaatggagaagtcgtccacgatgatgcagttttttccttccacatcgccgatcagctccaatatctgagcattttcgtcatggcctgtgcgcgttttgtcgccaattgcaacgggcaccttgaggtaatccgcatatttccgcgcgtcctttgcgaagcctgcatccggcgaaaccacgaccgcattttccataatatccatgcccttaatgtattcgcacaaaatgggcagggaacgcagatggtcgactggaatcttaaagaacccctgtacctgcgcgctgtgcaggtccatcgtgatcacgcggtcagcgcctgcagtctccatgcagtctgcgcatacccgtgcgcggatggaaaccctcggttcatcctttttatcgcccttcgcatacccataatacggaacgatcgccgtaaccgagcttgcgctggcgcgtttaaaggaatccatccaaaataaaagctccactaactcgttgtttggatccaaaccgatagggagcactacataaacgtctttgtcacgtaccgtctctttgatacgtataaagatattgccgtcagaaaaatgtatcacctcggaagcgcccaactccgcccccagatagctgcacattttctttgcgaagggcaagccggaactgcccgcaaatatcttgatatcgggattaccactaagcataaaatcataccatccttgtttcatgtgattatagattcattatagcaccggcgctatgccttttcaatcaaattgcatagttttggatcaaaaatttaatggaatccgtgagcatttcccccgttcgtttttcgcatgcgatcgccgcatagggacgcattttcccatgatagtcgctgccctgcgtaaccatcaggttgtttcttcttgcgatttccagatacctggctacttccgtatcggtatgcgccggataataggcttcaattcccttaaggccaatcttagccatgtcagcgacaagcgtatcgatatcgtccgttttgataaacttcggatgcgccagaaccggtaaaccacccgctccaaggatcaggtccattgcctgctccatattgagtttgcggcgtttcacgtagcaaagtccgttttcatttaaatatttggtgaaagcgtcctgcaggtcgcttgcgtaccccttctccatgagcgccagcgcgacgtgcggcctcccaagtgtattcccgcccgcaaagcgttccacatcttcaaacgtaatattgatgttatgctgctttaaggattcgataatcgcgtataccctgtccacacgagatgtgcgcaagtcttccatcatggtttttaaagccgcgttttcgatatccacgccataccccaaaaggtgcagttcccctaaatgccgcactgagatttccactcctgtgatataccttatcttatgcgccttcgccgtctcgatcgcttctttttgcgcatcgatcgtatcgtgatccgtgatcgaagaaagcgtaagccgcagcttcgcgcattttgtgatgatcacttccggcgtgtccgtaccatccgacgctgtcgaatgcatatgtaaatcctgcatattaattctgtccttctttgtttcatgatgttacaggtgaaaaattagcggctgtaaaagccgctaattcatgacccgtttattcttcttccggctttggcggagatacaatgatcgtctctgccgcctgtgcgtcgatcggttcctcaggcggagcgatcggctccggctctttctccgtgtttgtcttttcctcgatcgtccatgcatccggattttcaatatccagatcatcctcgaacaaacgcttgaattcctctcctgtaagtttttccttgcgcatcagcacctcgccgatattgatgagctttttcaggttcgtactcaggatctccttggcatgcgcataagctccttcgacgatctttgttacttcggagtcgatcttcgccgccgtcgtttccgaatactcaggcgtctgtccaaagtcttttccgaggaacacctcatgccctgaggctaagaacaccggcccgagctcctcgctcataccgtatttcataaccatgtccttcgctgtttccgtcgcacgctgcaggtcgctgatcgctcctgtggaaacatccttaagtgtgagggattccgccacgcggccgcccagcatcatcgtgatctcatcgaccagcttactcttaaacacatgctgcttgtcttcttcgggcagcgtcatcgtgtatcctgccgccataccgcgcgggatgatagatacttcgtgcaccgggtcggtcttgtcgagcacatgcgcaaggatcgcatggcccacttcatggtaagccgtacagcgcttgtcgtcctcagtcatcaccctgctcttcttttccggaccggcgatcacgcgggtgatcgcttcctcgatctccggcatgccgattttcttcttgcgcctgcgcgccgccaggatggccgcctcgttaagtacgttttcaaggtccgcaccgataaaacccggcgtccttcttgcgattaccttaaagtcaacgtctgcttcaaacggcttgcccttggcgtgtaccttcaagatatcttccctgcccttgacgtctgggtaattgacgatgatctgcctgtcaaaacgtcccgcacgcagcaaagccggatccaggatatcctttctgttcgttgccgccatgacgatgattccttcgttgacctcaaacccgtccatctcaacaagcaactggttcagtgtctgttcacgctcgtcatgtccgcccccgaggcctgcgcccctctggcggccgaccgcgtcgatctcgtcgataaagacgatacaaggcgcgttctttttggcattttcaaataagtcgcggacgcgcgaggcgcctacccctacgaacatttccacaaagtcggaaccgctgatcgagaagaacggtacttttgcttctccggcgactgcttttgcaaggagtgtcttaccaccgccgggaggcccgaccagcagcacgcctttcgggatacgcgcgccaagctctttgaaccgcgcggggtttttcaggaactggacgatctccaccaattcctctttttcttcatcagcgccggcaacgtcagcaaaggtcttgtgtgtctcgccgccgtccgtcatcctcgctttgctcttcccaaacgacattgcgccgcctgttccgcctgcgccgccctgcgcgcgccgtatgatgaccatccacaaaacaaggaacaatacgatcaggatcagatatggcaggaactgcaggaaaatattcggttccggcgtcggcacgtagttgatctggaacccgtaatccattgggttcgagctccctgttacctgtgccatgtcctggttaaactgtccgatagactcgggaatcgtcgtcttaaaatcatattcccgcggaaaattatcatctgttattgttgtttcattcgtacgcccgaccagcgtcctgtcctggatcgcaatgtcttttacgtcttttgcagctaccttgtccaaaaactggtaatactgcagttcctccaccgttgaggtttccggattacccagaaactgtgccgctacaatgatgacaacaatgatcaatatatagataaacggccctctaaaaaattttgccaaactttctatcctccttctgggggcgcttcgcttcacaagaggcactcgcagttccccttgcgagatcccctcgctaactgttgattttcttcgcgcaggctggcgctcaaaaatccaatttatttctgacgaccgtaccaggttatgtacttgtacggtctaatatcatacacttatatttctaacaatttccgcgctgtttcaaacaacgcttattcgtaaacgctgcgctttaatacgcctacgctctcataatttctgtatttcgccgcatagtcaagcccatatcccacgacgaactcgtccgggatatcaaacccgacatattttaccggaacatctacttcacgcctgtccggcttattgagcaagcagcatatctcgatgcttgccggttgccttccatgcaaaagtttcgtcaagttgtgcagcgtccagcccgaatcgatgatatcttcaatgatcagcaggtgcttgccccggatgtcctcctgcatatcgtatttgatttgcacgctgcccgtgctcgagctgcctgtgccataactcgataccgccataaaatctatttccatcggaatactgacattgcgcatcaaatcagaaaaaaacacgacgctgccgcgcaatatcccgaccgcgataaaatctttccccgcataatcctcggatatctgatctccgagctccttcacccgttttgcgatctcctcttttgagagcaatattttctcaatgtcccgctctacataatgctccattatgtatcctcctgcttttttaaatattttaaacagtaaacgcgcgccgtattttctctcacgcggcattgctcatcgatcacgtgtccggcaatccagacgatccggctgccgtctgcgagtagcggcgttttgtcacgctcctgcctcggcagctttttatcgataaaataatctttcaatttctttttgccaggcgcgcccaacggaaaaatcgtatctccctgatagcgcgtccgaagcatcaggcgctccggcaatctgtcagcatccacatatgcaacgtttggatcgctgttttcgtaatcgcattcatacacctgagtgcatgttatactgctgccgtccggcaatttattcaccgcctcaaaatcaaacggcatacagaaactcacatctgccgcgcgtccggaaaacccgatcagcagccttccatattccactgcagcacacaagttgttcgaaaggttcacgcgtgagcctgtccggttccgcttcgccagcgtcagcacggagatcacatgtacgttttccacatcctgcgtaatgtggagcttttcacacgccagccggatcatacggcacctgactgtttccggaagctcctggaacgccgcgatatcgatgtctaccacatcatcccgcactgccgcgcacttcaaaaattccttctgcgccacatcccgtatgaattttgcatcgtattccgcaatcacactcaaacggttaagcgcccctgccgcatccgcattgatccgtccctcgatttgcggcatcagcacgttcctaacgaaattgcgggtatattcattctcgtcgtttgtccggtccgtcacatacccgatccctttttccacaaggtattccatgatatccctgcgcctcacgcacaatagcggccggataaaagagccgcttttggggtgtatcccgcgcagcccgtcgataccgctgccgcgcaaaaggtgcataagcacgctttccgcattgtcgcccgagtggtgcgccgtcgcgatcacatctacatcgccgttctcaacaagtctctcaaaatactcctcgcgcgcacgcttggccgcgctttgcttgccgatatgccactcttccgccaatgcaggcacgtccgcagcactcatatagaagggaatattatgttccgcgcagtaacggccgacaaaatccgcatcatctaaggactcctgtcccctgatcccatgctcaaagtggatacacaccacagaaaaaaaagcggaaggcgcaagtaaacaaaggcaagacagcaacgccatggagtccggtcctcccgatacagccacaccaacggtctgtcctgcttcgatcaggttgttttcttgtataaactcccgtacaattttttccatgtcaagatttccctactatatataatatactgtaaaacccaactttacaaccgtatttgcgagggaaaccgcgtcatttttacaaaatatattgtatgcttttcatatgaacacagtatgaacactcgccgccgcccatcctttttgttccgttccgccctggcggcacgcgtcctgtgggatctgcataaaaaaacagcatggcgtttgccatgctgtttcttcgttatttgtttagaatacgcgttttgcgtggatgaacccattcctgaaccaggaaccgaaatccctgtgcatcatcgcgttctggctcgaagatgcgtcgattaccgtaccgtctcccatgtataccgctacatgaccgctcatacagatgatatcgccgcgctgcaggtcatcaatactcttgatcgttttgaaatcagagcttctccagcctgccgatgtcatatagctgatatcatatcctgcctggttcagcgcgtaatagatcagtcccgagcagtcgaacgcattggggcctttcgcgccaagtacataaggctttccaagctgcgcttccagcacatcgataaaccgttcaagcgtagatgacgatgaagtcccgctcgtattgccttcgctggagctgcctgcttcgtcgcctgaagcggtgatcgcatcactggaatacagagcctcttttgtgtaatatccaacgtttccgtcaatacctaactcgttattcttctggaatgcttttaccgccgcttccgtgtccgtaccgaagtatcctgtcgcgcttacgtcgtatcccaggctgtcaaggcgtttctggatctcttccacatccgttcccgaagcgccgatcgtcactgtatacggttttgcatcatccgagaacagcgcctgcagcgtatcgtatgtcgctacccctgttacttcaaggccgtgcttgcgctggaaatagctgactgcctgctgtgtaagcggaccgaagaattccgtcggctcgtcctcgtccatataatgcagctccataagccttgactggagcgtcgcgatgagcggatccgtggtctctggctggatgtcgcctgtaaacagcttttgctgttcattttggactggggcggctgcctcctgctgtgctgcttccgcggcctgcggctgcgcagcggcttgtgtctgctgcggtgcaggcgttgcttccggcgtttgctgcgcttccagtgttgcctcgggcgtcgcttccggcgtttgctgcgcttccggcgttgcctcaggcgtcgcttccggcgtttgctgcgcttccggcgttgcctcaggcgtcgcttccggcgtttgctgcgcttccggcgttgtctcaggcgttgcttccggcgtttgctgcgcttccggtgttgcctcaggcgtcgcttccggcgttactgattctgtctctccctgcgcctcgatgctggaatcgtccgtcggggcttctccctgcgtattttccaatacgagtcctttgtctgccgcaagggtcggtgtgggtgttggctctacggaaggagccggcgttgcctcagcctgctgcggttcctcgattgccgccggcgcatggaataactcgtcgccataggcggccgtcgaaaccaggatggggaccatgaccactgttacaatgatcccaacagcgatcaacagatgctttctttttcttgccctgtaacgatgtacaacagaagatgtatgtcctttgtgtacggaagcttctcgcccgcgaaatatctttgcggttttgaatcttctaaaaatctgtttcataaaaactccttttctgttacaagtttaatacgaattatacgcctatttgtctcggatgtccatatattttttaatacttttgtaatattttgtgtttactttctgcaaaatccccatattaccgcacaaaattcattgtgattttaatattgtttacaattttgttacatttgatcccttgcatcgcctgccggtttctcccccctaataatttatggtataatactattgcttttaagccatcttatatttggttacattattatatataaaacagcaatcccgcgaggtgccgatatgaatcaaatcgaagatattctttcccaattgacattggaacaaaaagcagacctttgttcggggcttaacgcctggaacacttatccgattgccgatcttggtatccctgaaatattgatgactgacggtccccacggccttcggaagcaatatgacgagaacacggccatgcttgagacctccgtgcccgccacctgtttcccaccggccgcgacaacagcctgctcatgggataaggacctgttataccgcataggcgccgcgctgggaagcgaagcgcgcagccagggcatatcgcttgttttaggcccgggtatcaatatcaagcgttcccctttgtgtggccgtaattttgaatacttctctgaggaccctgtcctttcaggggaccttggcgcacacatgatcgacgggatacaaagcacaggcagcggcgcttgtttaaaacattttgccgccaataaccgtgaatacttccgtatggtctccaactctatcgtggaccagcgcgccctgcacgaaatctatttgcagggctttgagcgcgccgttaaaaaatccaagccctatgccgtcatgagcgcttacaatatgctcaatggagactattgcggcgagaaaagagaattgattacggatatcctgcgtgagcattggggcttcgatggtctcgtcgtctccgattggggcgcatgttataaccgcgaaaaagggatcgctgccggaatggatctggaaatgccctattccggcgaagaaaatacacagcgtatcatccgcagcgtacaaaagggcgctctttcggaaaaggcgcttaacgcttgcgtacgccggatcctctcctttgtataccgctgcgaaaaaaataagagcttgccttacgaatgcgatatgcaaaaaaaccacgatcttgcacgcgcggcggcggcacagagcgctgtccttctgaagaacgaaaatggcctcctacccttaaaatcgggcaccaaggtcgcgctgcttggcgagttcgcggaaaatccgagataccagggggccggaagttccatgatcaatcctgcgcaccttgaaaatgccctcgaggaatttcccaagtacggaatcaattttatttacagcaaggggtattctgccgagacggacgaaacagacgaaaacttgcttaacgatgccgtgcacagtgcgcaggaggcggatgttgcggttatttttgccggtcttcccgcacgttacgaaatggaagggatcgaccgcgtacacatctgcatcccccaaaaccaagtggagcttattgaaaaagtcgccgctataaagcctgtcgtcgtactcctgtgtggaggcgcgcctgtggaaatgccgtggcttggctgcgcaacctcccttctcaactgctacctgggcggcgaggcgtctgcctctgctgtggcacagctcctgaccggcgaagtgacccccagcggcaaactggcagaaacatatccccttcatttgagcgatacgcccgcctaccgttttttctcggacgaccgccacaacgtagaataccgcgagagcatttatgtgggctaccgttattacgacgctgcgcaaaaggaagtcctgttcccgttcgggttcggcctttcctatacgacctttgcctactctgacctgcgcctttcgaaagataccatggctgctggcggttccatcacgcttcattttacggtcactaatacgggaaataccgccggagcggaggtcgcacaagtttatatcgggcgctctcccatcgagaaacatttatgcgcgttcgataaagtctttttgcagccgggggaatccagcgaactatccattgtgctgtctgatcgcgacttctctttttaccaggatggctggaagctcttagacgactgttcggtgcttgtaggggcttcctcgcgcgatatccgcttgaaggcaatggtccgtatccctgaggggatacagccgccgtattatcctgccgtggccgatggccactgggatgcggtcacattttacagcctgttcgataagattccgcaaatctcgttcagcctgcatccgtttactatcaacgctacgctcacggactttgacgccgccccaatcggccggcagatccaccggctcgcgcggcggtttgccgaaaaaaatatttcagcggataattatctggggcaacaaattatgctccagcttttagaccagaaccccctgcgcgtgctcgtttccctttcgggcgggttgcttacctatggaatggcgcgtggaatcctcatgattgcaaacggacaattcctgatgggtgtcctcgcctttttcaccgccaaccgcaaacggaaaaaacataaaattaaatcaaaatgatgtttatcgtatagtatgcaggttatatatactatgtcgcagcacaccgtgcagcggcaacaaaaacaatacataccccccaatcagtaaaagaccgatggtgtaccatcggtcttttactatgcgcctgtcgattgtgttataataaaaggaaagtaccgaaagggcgaggtttatgccggatgcatccaaaattattcaaaagctgaaaacatatggcgcaagcggcgcagctagcgtccgtgtttcagatatccatttttatccggaactgcgcgagttatgcgaaatgaacaaatgcggatgctttggcaccaactgggcttgtccgcctgcctgtggcgatgtgcagtcgctcgcaaagcatgtgcagtcttttgcccgcgcagttgcgttccagtatatcggaaatcttgccgattccttcgactttgaagggatgctcgcttccaatgaagccttcaataaaatcgcgcgccgcatacaagaatatctgcaaagaaaaacgcttcggtctttcgtgcttggcgcaggtaagtgtacgctttgtgaaacatgcacctatcccggcgcgccctgccggtggccgcagcgtctgattatctctgtggaggcgtgcggcatcaatgtttcggagttgtgcaatgcggcaggcctttcctacataaacggaccgaataccgtaaccaataccggcctcgtactttattagcacttatttatcgtcatcttcatgcagcttttcttcaaaccggcgaaacgcttcgttttgcgacgcagaaatttcttcatcttctttcatgcgttcggcagcgcttatggtcttttcttttacgattccgtcacttaaaacattaagcccataaatgatggcgaatgccccgagcaaaataccgatgatatccatcgccgcgatccagtgaagcacgatcagcagcactgcgccgaccagcgagatcacgccaatccctacggtcattttccatttgagtgcgccttgctttttcaaagcctgcccttctataatacgtactacgccgaacaccgccagccagacgcttaccaaaagcggcaaaaaaacgatcagcatactgctgccaaacatccatatgagcgcgcccagcgcaatattcatgatagaaactacaacgtttgcggcaaagataccttccgcccatttgcagcagcatccgcagatcagttgcaaaacgcctaccgccatcatcacaatccctgcaatgcctacgacaaatattgccgatattaccggcgccgctaaaagcaggatgcctacgataaacaaaagtatccccaagatcattttcaggatcctgaccgccgtactcattttattttccatatccccattcccctttttagctgtcctgtaccttttgctgcaaggccaggtcgtacttactctcatcgacaagcccgcttaaaatattaagcttcggtttgcttccttcatttacgtccgtctccacaatgacaaggtataggcactgcgattccggatcaatggataccacccagttccattcccgcgaattgttcggcccgaactgagcagttcccgtcttgccgtaaatgccttccctgccgccaagctttgcaagcgccgcagttcccgtcttcataacatcttcgagcgcggccatttgcatgctgatcgtagagtctgacatcgtattttctttaaaaaccgtatgctcgctttcctgatcgatcacctggtccccgttttcatccgtatgggatatatttttgaggatcgtcgggttgagcatgttcccgctgttttcaaacgcggtgtacatgcatgctagctgcaatggactgatctgtagctcgcccgtaccatatgcggtacgtgctagccagtccagactgtattccgaaccgtcgtttaacatgctggacgccgtgaccggaagctcaaaggaaggcgcttcgcccataccgattttttccatatatgccttgaagttatccacgcccacctgcagcgcataatacgcaaaatagatattgtcagacgatttcatcgcatactggaacgatctgtcgccgcccgcaatctcctttgtattgatcggcgggtatacccagcccggcatatccggcgtccatgtataccctaccgtgccatctgtgcgcttttcctctgtaaaaggaagggtcgaactatccgttaatttcccatcttccatcgccgcagccgctgaaaacggcttaaaggtggaacccggcgtatacaccgactgcgtcgcgcggttgagcatcggagaattgctgttgtcccccatatagtgctccaccaccgcctgatcaagcgaaaagttgaacaggttattatcgaacgacggataggataccatcgccttcacatcgccgttcgtataatccatgacaatgacagcgccgctgtcgccttcggcgatattggctgccatcagtgtgtaagcatcctgctgtttttttgaatcgatcgtcagcgtaacgtcgttgccatccgtctttgcgtcctcataaagcgtttccttgcggtttcccctgtcatcctcgatatacaccgccttgccgttcgtaccgcgcagcgtatcttcatattgcttttccagtcctgttttaccgacaatcgaactctccgtgatacccgcctcttcgtttaactggtcttcgtccggcgaccccaggtagccaatgatatgcgccgcatcgtcctttaaaggataataccgcataggcgtcattttgctttcgtccacgccgagtccgtttatggtcgcgatatcctgcttctgctgctccgtaagcgttcccttcgggtatgtcgccaacacttcggatgtaaagcccttctctacggcgttatcatactttttctgtatcttttccggatctatctgataattcgtttgcaaatagcttttcacttcgtcgatattggggcttttctccaaatcgatataaatgctttgcgcgtaatcgttctttgccagcaacgccccatccgctgaaaaaatctccccgcgttttcccgtttgcgtcgttgcgcgtaccttgtccccttcttccagcataggcaggattaggcttggcatataaagcaccgtatacccttgcggccctttgacgatatccgcgctgtaatcataagtgatatcgcccaaaagcccgctcgtcatgctgagcgtataggtaagcccgtattccgtgtccgattcgcccttcttttccacattcctgtcgacgagcttgatgtccgtgatttccagcgcttcatagatgttttcgaaacgcgccacaaattcatccttggatttcacgtcggatgtaagcgtataaacataactgtaggctcccgcataatcctttttcaccagcgcatccacgaacgcatagcccgtactgagcgcgccgtccgtcttcgcgcagcctgcaaatgcgccaaggcaggaggcggtcagaaaaattgctattattatatatgtaagaactctctttcgcataaaaaccgtatccgcataaaatgcggccttcttctgatttttattatgattatactattatttcagaagatttgcaaaaacgtaacgatttatttacaatttcttttcgggcagatttcccccattttccttcttcttcccttcattcccatatcccttgtttcatgcggatttttggtatatttatcccctcgttatatatcccccacttatcatgtttttacgatacaaaacacggtttctcatcttgaaaaattgactttttccccattttgctatatactttggataagtaccgtcctgaaggcagcaacggtatcggaggttttacatgtcactttataaaaagaaaaaagatgatgaaataaatcccaattccaaatttaagggcatactttatacagcgcataagtcgaacttttctgacgaggatttaacgccgatcggttcaaggagcgcacgcaacaaaaagaaagcaaacaagctttccgagatgctttccaagctctcaacggtaaaaaaatccaggacctcgcgcgcacatgatttaaagaagggttccccttcgccggcggcggctcagtctgccggaaccggacgcgttgtattttccggcgggcgcagcagcaaaaatgcaggcaggcgcggcaatatgcgtgatcactttttccgtaacatcggcatcgtatgtgcggcgatcgctttagtatcctgcatcgctatcccaactacctttgcaaaacccacgacagatattacactcaatgataacgggcgtattttgcaggcttctacaagcgcgcgcagcgtgcaggaatttttggatgataacggcataactatcggccccgacgatgttgtttccacggatctttcttctgccgtctacgaagggcagtccatcacgatttaccgcgcgatgcccgttacgatcaagagcaacggccaggagatcgaggttagcatcgtagccgggcataccgtacaggacgcgatcgacaaagccggcgtcgtggtcgctccggacgacgagatatatccctcgcctgattcgcttgtgcgctcgggtatggtgatcgaccatattatcgttaccacacaggaaacgacggaaacacagccgattccgtttgaaaatacgacccgcgacaatgacaaacttgaaaagggcaagacgcagatcgtgcaggaaggcgcggaaggcgtattgcagatcacctacaaagagctttataaaaacggcgcgctgatttcccgcgattccatctcggaagacgtgattcagcagcctgttaaccagatcatggaagttggtacttatgtggagccagagcctacgcctgagcccaagaagtcgagcagcagttccagtaagaaaaacagcagcagttcttccaataaaggaagcagttccagttccaataagggaaattcttccagcaacagcgataccgacctcgacggcaaacaaggcatgaagtttaagctcaccgcatattgctccttctgtaacagcggcaacaaaacttcctccggcacttatccgtcggcaggccggaccgtagcctgcaactcgcttccgctcggtacgcggatctatattgaagggtacggcgaatacgtcgtggaagaccgtggcggtatggccggcgacgtcatcgatatttatctgggcgatcagccgaacgacgatgcatgtaactcttttgggcgaaccggttacaaaaccgtttacgtcatcggttaaagcaggatttagaaacggcaggtgacagcacctgccgttttttgttataattcttatgaataaactaggcaaggagcattccatgaacctgacttctcccaaagagatcgcgcagatcctgacagcaaacaacctgtctccccttaaaaaatttggccagaattttctgtgtgatgaaaatatcgtgggtaagattgcaaacagcatcgggcttacggaaagcgactatgtccttgaaatcggcacaggccttggcgcgctcacacgcgccctttcgctccgcgccaaaaaagtcgtttccgtggagatcgataccggacttttaaagctgcacgaacaaacgctggcaggctgcgataacgtcaccgtattggaaggcgatatcctgaaatgcgatttgaatgacatttgccatacgtattttgacggcgcaagctttcatgtgtgcggaaacctgccttactatatcaccagcaaaatattgatgacgcttctggaaagtgacgcgcccatcctgacgatcacggcaatggtgcaaaaggaagtagcgcaaaggctgtctgcacagccgggcgatacggattacagcgcactgaccgcttcctgcctgtactacggaaaacctgagcttttatttgaggtatcccgccattgtttttatcctgctccggacgtggattccgcgatcatccgctttgtttgcggctccggactttgcgacgcgccgcgcgaggattatgtcaaaatagtgcgcgctgcgttctctatgcgccggaaaaccctgctcaataacctaaaacaacttggcagcgcagatgctgtaattacaattttgaaaaattgcaatatcgatcctaaaatgcgcgcgcagaatctttcccctacccaattttgcagtttggcaaaaaaattctttcaaaaataagcaatctctttgtaatttttttcacaatttgttttacaaatctttcctatagtagtataattgtttttaatcatcataaagtataaaaaacgatatcggattttaggaggttactatggaaacgtatggtttggaaaaattagggattttgaattccacggcggcttggcgcaacctctcccccgcggcgctcgttgaagcggcattaagaaggggcgaaggccagcttagcgacaaaggcgcccttgttgtaacaacagggaagtacacaggacgttctcccgaggataaattcgtcgtcgatacccccggcatccacgacgacatcaaatggggcaaaatcaatgttccgatcgaaaaagcgaaattcgacgcaatcaaggaaaagctgtgcgcttatctccagaaccgcgagatttttatctttgacggttttgcaggcgctgatccggcctacacgaaaaagttccgcatcgtaaacgaactcgccagcgaaaacctgtttatccaccagcttctcatccgtcctacggaagaagagctcgcgtcttatggcgatgctgattttacaatcattgccgctccgggcttcaaatgcattccggaagtcgacggcgtacacagtgaagctgccatcatgatcgactatgaagcaaagctggtggtcatcgccggttcccagtatgccggcgagatcaaaaagagcgtattttctgtcatgaactacctcatgccgaaagaaaacgacgttctgcccatgcactgctcggcaaacatggatccgcagacacacgaaacagcgattttcttcggactttcgggcacaggtaaaacgacgctgtccgccgatccgaaccgcaaactgatcggcgacgacgagcatggctggtccgatcacggcatcttcaattttgagggcggctgctatgcaaaaacgatcaaccttgatcccgaaggagagccggaaatctacaacgcgatcaagtttgggagccttgttgaaaacgtcatcattgatcccgagacccgcgtgcccgatttcttcgacggcagcctcacggaaaatacccgtgtcggttatcccgtagacttcatctccaacgctgcgatcccgggcgtaggcgatatccccaaagtaatgatcttcctgaccgccgatgcgtttggcgtcctgccgcccatcagccgcttggatgagaacgctgcaatgtaccattttgtaacgggcttcacatccaaactggccggtacggagcgcggcgttacagagccgcagccgacgttctccacatgcttcggcgcaccgttcatgccgctcgatcccgcagtgtatgcggaaatgctgggcgaacgcctcaaaaagtacgatacaaaggtatatcttgtcaatacaggctggtccggcggtccttatggcgtcggtagccgcatgaaactgaaatatacccgcgcgatgatcacagccgccttaaacggcgaattggaaaaatctgcgtacaagcatgacgacgtattcaatgtggatgttccgcagagctgccctgatgttccggacgagatcatgaacccgcgcgatacatggcaggataaggctgcatatgacgaagccgcaaagaaacttgccaagatgttcgcggacaattttgcaacgaaatatccagatatgcccaaaaacatcacggacgccggcccgagaggctgatgtagctgtcatttttgacgatcaaagacgccgaatcatcatcggcgtctttttatttgcaaatttttcatgtttcggaaataaataaaaggattaaaggaatctatatagaatatctataatatgggataggttctaaatttgttcacacaacatatcatgatatgtttataattgtttacttattaatattttaggaggcttaacgcatgtcaacaaaacaaaactatgcatggagcgagatcaaaaagggcgcttatttctcggctatgcgcacaatcatcgaaaccggcttttacggtaataatgtatatcctgtggaatctttgaaggaagcatataaacttgcttacgattcccccggaacagtcgtgacagacctgccggtctacgagcctgaaaaaacagggcttccctccgacgccaaaatcctgcttttcaacgatggcaacgtcggcggacgcgcggcggcggcgcgctgcatcctcggcagcaatgactactatggcgaacccgtaaccgaagcaaaattcggtccgatcatccgtgaagcgatctaccagacacgcaacagacagctttatcatgcgcaggcatatatcggccttgcgccggaattcatggtaaaggcacacctctgcattccggagggcgaagaaaacatcatgtattcctggctttacaatttccagtacctgaccgaagagtactataaaatgtacgggcagtccaaagaaattccggaaggagatctttatatcttttccgatccgcagtggtcgcatccggattttccaatgggccttgcgttctttgctcctgagcacaactgtgcctgcctgcttggtatgcgttatttcggcgaacataaaaaaggtacgctgacgctcgcatggggcgtcgcgaaccgcaacggcttcgtttcctgccacggcggacagaagcgttataacttaaaggacggcagcaagttcgtagccggcgtattcggcctttccggcagcggtaaatctacgattacgcacgcgcaccacggcgggaaatacgatatcacggtactgcacgacgacgctttcgttatcgacagaagcgatgcttcctccgtcgccctcgagcccgcatatttcgataaaacgcaggattatccgatggactcagaggacaacaaatatctcgttacagtgcaaaataacggcgtaacgctggatgataaaggcaataaggtcctcgttacggaagatatccgcaatggtaacggacgcgctatgaaatccaagctgtggagtccgaacagggtagacgttttccacgaacctgccaacgcgatcatctggctgatgaaagacccgacgctgccgccggtcatgaagatcgacgatcctgtcctcgcttctacgatgggcgctacgctcgcgacgaagcggacgacggcagagcgccttgctcccggtgttgatccggacgcgctcgttgttgagccgtatgcgaatccctttcgtacctacaggctggcggacgactatatcggtttccgttccctgttcgcagacaagggccttgattgctacatcttcaacacaggccacttcggcgaaaagaaggttacgccgcagatcacgctgggcagcctagaagcgatcatcgaaggcaaggcttccttcaaatcctttggcaacatcgacggcctttcctacctgcccgtcgaagggtttgatcccgatttcagcgacgcagaatacaaaaagcagctcgttgcgcgcatgaaagacaggatcgagttcatctcctcgcgggacgaattcaacaagctgcctgacgaaacgctcgacgtcctcaaaagggtcgtggagcaggcagaaaagatctgaagctgaatatctgtataaacaaaaaccgccgaaaattcggcggtttttttattctaaattttacgcacgtccgtagcgtatccccttgtaaagggagatcgcgctatccagcacaaaggcaaaaatcaggatacagccgaagaaacgggtgaagtaaccaaagaaggcgctcaatatatccgccgcgctgcccaaaagctgcgggttgatcgccgccgcttggctgattatatccatattccaaatagccggatcaaaaaagatcgcgcaggagatgatcaatgccgttacattcagtaccgttgtcacgatccccagccaaagcgtataccttcctaccgcaacacgcagtacttcacggataatcccgagtgcaaagcaaatattaaagagcggcaggaatgccttcagcgtttccaggttgaaaagcggtacaaagtgtaggataccttctgcgtccgtaagccagaaactcatcaggtacggtacaaagttaaataatatgatcaccgctactgtaaacacgatccccgcaatagaatccccttttttgataatcgctttttccgtcgggatcggcttgtcctttaaatcctgcggcttccatgcatccgataccgcttccttgatattcactttgatcgaataccgctcaatgatcacaaagatgatcgttacccatgcaaacccctgcacgagccccatgatgatgtttgcgatcgccgttcctacgcctgcggccgtgccgctgatgaattgcgcctgcgccatatcctgcatatcgatcatccataccgcgccctgcacaatggacgcgatgaccatgccgaccgtaacggcaatgagcactatttttaaaacaaaccagtattgctcataatacgccggcccgatgagatacttcttaccgtcacggtatttttcggccagtgcaaagggcgcgcccagttcctttaggacatcttccgcattttcctgttcggatttgccgttttccgcccgttcttccatcatatcgtcaatgaggccctgaagttcacggctgatatcctccctctgccccgaaggcagccgccgtaccacatcatatatatacctctcgatcatttcttgcgtcgtcatattatccctcccctgtcatgcggccgatgaccgcagacattttatcccactgcaaaagtagtttttcataaatttctccgccttcaggcgttatggcataatatttgcgcggctttgccccgctcgtttcccattcgctttttaacagtccttgtttttcaagtcttctcagcaaggggtatagcgtccctgcctctgtcggcatgcccgcaccgttcaatttctggaccagcgaataaccataacgcggttcattcaactgggaaagcacacacatcacaatcgtcccccgccgcaactcctgcaatagtccggctaaaatttcttccggtttatccatacttgtatcacctccaatagtatgtatcgcacactatatttgcattatactgtgcgtcgtatactattgtcaagtaaccaccataaaaattttaaaaataaaaatagccgggactaaaatcatcccagccaattttctaaaaacaaggccgatttgccaagaggtgactgcataaatatacatccaaagtacgtaatattcgtttttacaaaatcttgaatgaaactttatccaatttttacagtcacactctttctcagtattttacaaaatattcatcaaccacggccaaatatacataaagttattcgacttatccacatagtcatacacaattacttttattaagcctttttttttgaaatctatccacctacttatccacatagtccacatttatgcattttgagcttttgcccgacaaattacagatatgcataaatattctatcagataccacgacttatcagtttatctgccaaaagcgctatgaattcgccgtttgtcggcttatggccgttgcaattaacgcgaaatcccaatgctttattcaaatcttcaatattcccgcgttcccacatgacctcaatcgcatgacggattgcaagctccactttcgtgggcgttacgtcaaaacgctcggctactttcgggtaaagttttttggtaatgctgtaaacgatcatccggtcctccaccgccaggcgcaccgcttcttttaagtactgatatcctttcaggtgcggcgggacaccgatcgccaggaataaatccgtgatgcgctgctcgctattcgcgccttcctgcatgagtaccgcacccgtttcgctgctgtttggctgtttcaaacgcacaacatcccatatcctacgatacataatctcctcctggaacggtttgatcatgtaatatttcgctcccagcataaagcttttacggatcacttcttcactgttgatcgccgataccacgatggcgtcagggtgcgatacttcgcgcatattttccatacgctccaaaaaatcaaacccatcgcacgacggcatcaccaaatcaagcactaccacatcatacgatgtcaatctcagcatctccagcccttcctctgccgactgcacctgatccacctggtggatatcctcttgttttttcaaatacttttccaaatgctccgctgtcttgcagtcatcctctacaatcaatacgtccaaagcttccaacatgttttttcctcctgcaaaattccttaaaaaaacttcctatatattaatatattcaactgcccgtcaaaatattacagatttcgaaaaagttttttgtttggactgtacttttcatgcaaaacgtgtataattggagttgatttatacaatagttcttcattaatgggagaagcgttttgcgtattctgaaaaaaagaagggcactgaatccggctgaaatactggtttttgggtttggtggtatgatcttaataggtacgattttgttatgcctgccgattgcttcaacctcaggtgaatcggtgggttttttaacggctcttttttcttccacctccgctatttgcgtgaccggccttacggttgttgaaatcggcacagcctatacggttttcgggcagtttgttatgctggttctgatccagcttggcggtattgggtttatgacggccacttcaatggtatatatgttacttggacggcgtatcacgctaaaggaccgcatcgtgatccgtgattcccttaatgaatccaatttgcagggcgtagtccgtatgacccgcaacgtactgatcgttacgctgatctcggaagtcgcaggtatgctcctgctttctatccgctttataccggaatacggtgtcagcacagggatctactatagcctgttccattcggtttccgcattttgcaacgcaggtttcgatattttaggactgggcgacagcatcgtttcgtatgcaaaggatccgcttgtcctctccaccatcatgggcctgatcgtagtaggcggtctggggttcttcgtagtggtagagctttaccgcaaggcgcggcagggacgcaagtaccgtttcaccctgcataccaagatcgtgctcatcgctacaggctttttgctcctggctggttttttctttttcttggctatggaatgggacaatcccaaaaccttcgccgcaccgggcgtcaccgacggcgataaagttttaggagccgcatttcaatccgtaacgacccgtaccgcaggatttgcaagtattccgcaggctgatttaacacccgcttctaaaatcgctacggtcgcgctcatgtttatcggcgcatcgccttcgggcacgggcggcgggatcaagaccacgaccgccatcatgctgctggcgctcattgtgacgatcatccgcggcaggcaggatgtcgttctcggcaagcggcgtattaataaacagcttgtcctgcgggccatcaccatcattacgcttgcgatgctttctgtcgccgttgtgacggtgctgatttctattttcgagcagcatcacatcagcgtatccgacatcctctatgaggtaacgtccgctttcggtacggtcggcctttcctgtggcattacggcgtctttatcgcctgtcagccaaatcctgatcatcctgaccatgtttggcggcagggtgggcttctttacagtgtcactcgcgcttgcaaaacgcatgtcgaggcagaagagcagcaatttccgctatccggaagacaagattatgatcggttaactatggcacgccgtccgccattaagacggcaaatggagatattatgaaaaaacaatatgtagtcattggcctcgggcgctttggaacaagcgttgcaaaaactctggtagaacagggagccgacgtgctcgtcattgacaaaaatgaagaaaaaataaatgacgccatgcattatgccacgcacggcgtacaagcggacgccacggatgaaaatgcgttaaaatcccttggcatccgtaactttgacgtcgcgtgcgtatgccttggcgaaatccagtccagtatcatggctgccctcatctgcaaagaacagggtatcgaccttgtgcttgtcaaagcgcagagcgaggtgcatgcaaaggtactttataaaatgggcgtagataaagtggtgttccccgaacgcgatatgggtatccgcgtcgcgcataacctgctttcctccaacatccttgactttatagaactttcggacgattatggcattgccgagctggaagcacacgcgtcatgggtgggcgagacgctcatcgatcttgattttcgtaaaaaatacggcttgagtattatcgcgatccgccatggggaaacggatgtcaacgttaaccccctgcccggcgaccgtatctccgcaggcgacgttgtgatcgtgatcggctccgaagaccaaatcagcaaacttgaagaaagcaaataaatacgaaataaaaaaacggccaatggccgtttttttattctgatcatattacaggatttcgccggattcctgcttatccttcttacccttcataaatccgatccagatgactgctgcaatcgcagcgccaaccagcggcgctacaatgaacagccatacctgctcaagaggctgcccgcccataaaaatcgccggcgcaaggcttctcgccgggttaacggacgttcccgtaagcggaatcccgatgatatggacaaacgccagcgtaaggccaatcacgatacctgcaacagagcccatcttttcaacggatgttacgccaaggatcgtcagcacaaatacaaatgtcaggataacttccacaacaaacgcaccacccatggaaaggcctaccgacgaagcgtcgccaaatccgttctggccaaggcctgtctgcgcgatcccgcccagatccgcgctgttcacgataaacatcaggatagcgctggcaacgatcgcgcccaaaacctgtgcgatcacataaccaataaagtccttaccgctcatacgctttgaaaggagcatcgcaaacgaaaccgccggattgatgtggcatccggaaatgtttccaatgcagtatgccattgcgacgatggaaagaccaaatgcgagtgcaatacccacgattcccgttacgccgccgatgccgcccgaaagcgccgccgttccgcacccaaacaatacgagtacaaacgttccgataaattcagccaagtactttttcattatgatacctcctattaataaaagaaaaactttatactctaccgcacctcgatagcctctttcaggttttttccggctttgaaagcaggaatttttgtttccccgatcttgatcatttctccggtgcggggatttttacactgccgagctgcgcgcgtccttacttcaaacgtcccgaatcctactaactgtacgcgttcatttttcgcaagcgcctcggaaatactttcaagcaatgcgtctgtcaatacttccacatcttttttcataaatcccgtttttgcagccactttttcaaccaaacatttcttattcattcttttcctccttgatatacattatatgaaaaaaacaaaacaaaaaacaaacgattgtctgcctgttttgtattcttgataacggcaggtttcttatgcttaagcaactaaacaccgatatgtatacaatggttactctatacttcttttattttattcattaaaggattaaaagtcaatatacacctgtatatttttaccgtatccgtcctttttttactatttgaaatccaattttatagccattttttacacttcgcacattgtaacttcaatgttgctatagtataatacctatcaggagtggaatactacattgaaagaaaaagtattgcaaccgcggtccctacgggatgaattgattgcggccagtttgacgtttctgaaggatcaccgcttggaggagcttaccatgcgtaagctggcggctctttgtcatgtcactccgcatgcgatctataaccattttgccgataaggatgctttattgcaaaccctcagcgaacatattttagcagatttgacatctacagcaattgaaatcgtcctacagtcttcccaaaatttcgaacaaaaaatttctttgcttgccaatatttatcttacaatgatcgaaaactatccagcccattggcaggttttgcaacaggccaaaaatgctgataaaccttcctatattcttgatcccggcaatggaaaactcatttgcaaaagcaaatatcccggatttcccagtctcaagaccttaaaccggttctgcaagctgcctgctccaattattgatgcccttctcaggaagaaagaccttaaggcgcgtatttcttctgagacgccatcagtgctcgagccggttgaagacgaccctgacgtatgcctggggcaactctccgttttttcatttatatacggcctttcctttctatttggaaacggaagtatccctgacggggaaaaccgtaaagaggcagtgaataagctggtaagctatttctttaagagatatttctgatgtaaaggagccatatccgatggagtccacagtaaaaagatcccgaaacatacagaatcttctgatggaaacaacgattagccatatcgaaaagtatggggtcgacaaaatttccctgcgcaaaatagcagccgaatgtggtgtgacacatgcgaccgcctataaatattatgaaaacaaaaatgcactgatcagcgcgactgttccttatgtgctttcccatatgtatccatatcttgaccgttccgttaaaaaggcatctgatgagcagccgttcgtcgctttgttgaaagcttatgtgcgttacatggtgaagcacccccagtatcattacctgcttcaccccaatacgccgggccaaacttcctggccggcgaagcatgcgctttacaggccgtcctattatgatcacccatacctgccccttgcagaagaatatcttgcacaatgcaagatcccacaaaaagaataccatctgcttattccgcttatttcatccatgctcaatggccttattcttctgcttaacaaaaagtcattcgtttatcatggcgattatggcgatcttgttggtcttctgattttggaacctttgaaattgaagccaaaagaaaagcgaaaagctcactaaagccttatttctaaggaaattttacagaaatattggaaaacagcttgttagcaagcctattttatgataaaatagttttcgctgtaaagaaaataaaaatctggacagatggctgagttggcttaaggcgcacgattggaaatcgtgtgaacgttaatagcgttccgggagttcgaatctccctctgtccgccagaaaaagaagcatataccgtcggtgtaggcttcttttttatctcagcaaatactatttttgttgttattctactgtttgacctttgtccattgtatcaacaacaattcttgaatgattgaaggagcctataagcgtatcaaaaacccgcctgtgcgttctaggctatacagtccctggtttttcgatttcaatatgtttgcgtatcatattatttcagtaaaaaaacaacgctttttgtaaaataattgattctgtatatctgtttttttaaaatagacttaattccgcttgtgttcatcggccacccactcctatatggccgatgcggatgtatgccgcatggcacgttcgggcagtccgcagccaggctgcggctgcaacacttgcggatcaatctttttcgtgcggcggatttaataatatgcgtgacataaatactccgtcctgataccggaaatcaactattccgttgtttttcagggcaatattttgtatggatgcgatccctataccctccccggtacgtttcgccgataaaaaacggccgtttcccgacggtatgatcgtgccttcatagctattttttaccgaaagtactacaacatcttttcctgtgatttccgcacaaatactgatgaacgattctccgtttttttgccggccgcatgcttccagcgcattctccaaaatatttcccacgacaacgcatagctcctgttccggcacagcgagtgtttccggaagttttacgttgtgttcaaaacgaattttctgcgcggcagccaaatccatgtagtagcgtataagcgtgttcgctgcgtggttctcacatatgcggacgctgctttgctgtaagtcctttagctcatggtcgatcatttgtttcaactttggcagttggtctgactcaatataactttttatcaaaagaagatagtgttttttatcatgctggtttctggcagtctcatcgatcaatgcgttgagcgcacggtaatcgcgttcctgtactgagagcataagtttcgaaatacgcagtttttcctgcagctccgcctgttttgccgcctgtgccaaagcgcctaaaataacataataagaaagaagcaggcaggctgaccagacgagaataaccaggaccggcggatctcctgcatattccgaaggggatctgtagtcataagaaataaccgttttatatataatgaagaagagaaagggaattgcccataaaaaacgccagatagatgtggctgctacttttttcccttcctctacaagcggccgtagcattttcccaagcattaagtgcatgagcggcgcaatgatgatcaaaacaatcgtatatgaaacgacaaaagagatatccgtaggcaaaaaatcattcagccaataaatttgcaacacttttccaagagaaaagacacaatccaggcatgtcgtgataaggaaatatgtaaaaacgatttgcggaaccgttgcacggaacatcaaaaactgcgatgcgatcagggcggcaatgaagattaccatagggacaaaacgtcccgcaccttccatctgcccgtgcacatagtataaacaaaggcctgccgcgcccgctacgaccgttgcaaagattgctatttctttccctacagaaaaacgcatacgccttttaaaagtcacgaaaaaaaagtacaaatgaaaaagtgttggggcaataaaaaacaaaagcgcaaaaggcagattcatgcccttccctcctgttccatctccccaaaaatgtagtctgcatatttctggcggattccctggtaccattcttttttgatagggatacgcgcgccgtccgccatctcaaaatccctgtcttttaaaacaagtacatggttaaggttcaccatacagttgcggtaacaacacagaaactgcggaaaaacgagcagcataggagaaaattccgcaaaggacagatagctttttataatttcagattttgtatggatataaatataatggttcgcgtaatctgtgtagacgatatcatcgacccgtactttgcgaagtacgcgtccttccttgatttcaatataatgctgtttctgggataacgccttatcacacaagttcatcgtctggtagaattgctcatagaaaaacggcttaacaagatagtcaaaagcacgtaccctgtaacttttcaccgcataggaggaacttgtggtcgtaaatacgatcagtacgtcgtcatccgtttcacgaattttttgagcgacttccatcccatccatcccatgcatgaaaatgtcgagaaaaacgatatcatatctcctgcctcgaaaatcctttaaaaaatcttctccctgcaataagatatccagttcatattccatcttgttttccctgcaatagcgctctacaaaaccgttcaatagccgtacatccggcaggttgtcatccacgatcgcaattctcaaatcaaatactccctgcggcatcctgtatagcaacctcaggttaccactgttatattactttatcgatattgtatcatattttttccggctgcggaatttgccaaaacaaaaaagcctgcaaaaatgcaggctttttacatcacatctatatacacaaaacacgtatgaccgcatctgccaggcgttgcatatctccttcacaggttttcttcacctcttcaaggtctgtcgctccctgtcctgcggaaaacagggcgcatatcccttcctcataaactttctccgcaccttttcccgccataccattcagcgcaatgcatgggatcccgtattttttggcacgcctggaaataccgacgggcgcttttccgtgcgcactttgccagtccatacgcccttccccaacaaacaccatgtctgaatcctttaataaatcgtcaaaatgtaccgaatcaagaagcaaatcgattcccggcttgagcgtcccgcctaaaaacgccaaaacgccgccgcccagaccgccggccgctcccgctcccgggacgtcggctatccgtatatgcagatctttttcgatgacttccgccatattcataagtcccgcatcaagctcctcaagcattttccctgcaactcctttttgcggaccaaaggtgtatgtggcaccgctttcgccataaagcggattgtccacgtcgcacgctgctaccaattgaatctccggcaggtgctccggcttttcgatacgagccactttccccatatttttggccagcggctctactgatttcccgtccttgccatagaaatgatatccgaacgcagcagccatgccgataccgcaatcgtttgtcgcgctgccgccaagccccagtatgattttatccgcgccacccttcgccgcatgaagcaacagctctcctacgccgtaggtagttgctttatcaggctttttatctcccttcacaagcgtcaggcctgcgcacgccgccatttcaagaacagccgtcccatcgggcaggattccgtatgcggcatccaccttttctcccattggaccgcttaccaaaacggtttgccgctctccgccgcacgcttcaagaaacgcgtctaccattccttccccaccgtccgccaagggcaactcataaatttttgaatccggaatatgtttacgaattgtttccttccatatagaacatacagtctgggcgctcatcgtacctttaaaagaatcaggcgctaaaataaattttttcataccgtcctcctgtttgatggacttttcttgattatattgaaactatatcatactattttgcaaaaaacaacgttactttttgcacaatatttcctcatattttcatttcaatatactcatatatattacttttattcctcatttttttcagcgaatatattcttgtttcagacttggttttatatatttatactaattttttcataatcacaaaccgctataaaacggcttatttacgcgctttttctgtttttctcaaatttgttttccgtttgattccataaatattaaaaacaatgattgacataacgaagtaattatattatattataaatcaagaaacaaaaattaacttaaatccatggctaaattaaagttaattttctcgctagaaaatcttatgaaaattcatcgttgttttatcagaatagtcatcggatcccgcacatcacatgtgcggataggcacgatactccgttacaaaaatttagactggcacatagcgcgcctgaaatgattacagattatataactatcattcagatatttagggttcatcaatcattgttttcactatcgtaactttataatcaatctataaagaaaagagggataaagtgagtatgacaccattgcttcaagcaaacggaatgaccaaaacgtatggcgcaggcgcggttgttgccctcaacaatgtggattttaccataaacgcaggcgaggtccacgctctcatgggggaaaacggcgcaggaaaatctacccttgcaaagctattgagcggaattgaacctgccgacacgggcaaaatctttattaacggtgtggaaaaagagatcaatacgcctttggatgcgatcacaaacgggatctctatcgtgatgcaggaattcaactctatgccgcatttgccggtatacgaaaatatctttttaggacacaatgaactttttaagagaggcgttttctccaaaacagaggcaatcacgcgtacaaacgaattgttgcgcctgtttgatatggagcatcacatcaatcctgaaacattgctgagcgaactttccgtggcagaacaacaaattgtagagatcatcaaagcggtttcttacaattcaaaaattattttctttgacgaaccgacagcttcccttacgaacaacgaagccatcaggctgttcgaagttatgcgtcgtttaaaatcgcaggggatggggctcgtcatcgtctcccatcgtttcagtgaaatatttgagatttccgaccggatcaccgtgctgcgcgacggtcttttgatgctggggaatgaggatatgaggcaaatgaccgagcaaaagctggtcaaagcgatggtcgggcatgagatcaaagaattttacggcgaaaagcttcccctcgaagatggcgtagagaaaaaggtgatgcttaaagtcgaacacctaagcgatacctataattttatcaaagacctttctttcgaagcctataccggcgaaatattaggattctcgggcttggtcggcgccggtcgtacgcagctcgcgcgctgtattttcggcgctgatccgagaaaatctggtacggtcatggtggacggcgtttccgtgaaagagaattcgcctgccagcgcgatccgcgcaggcctttcccttgcgacggaaaacaggaaacaagagggtctgatcctcaacatgagcatcctgcaaaattccgcttttgcaaaaacagccaactcgaaaaccgctttgctcccgcataaatccgagcgcgaggactgcaataggatgatcggcgacctcaacatcaaagtatccagcgccgacaacgccgtcagcagcctttctggcggtaaccagcaaaaggtagttctctccaagtggctgcttacaaaccccaaagtgtttatccttgacgaaccgacgcgtggaatcgatatttcggctaaagttgaaatatacaatatcctgcacaaactggtgtcgcaggggatttgtgtggtcgttatctcttccgagcttccggaactgctggggatctgtgacaggatcattattatgagagacggaaaaattgttgcggatatgaacgacaaagaaaatgaattcttcgaggaaaacatcatgaactttgcttccttcggcacatcgggaagtgaacataattcaacggattcagtggaggtatcataatatgagcaaaaatcaattacccaatcaaggagcttcgaaatggggcgttgtccgcgtgaaataccgcacggagctggccatgggcattatcatggtggcattcttcatcctgatgtgtatcctgacagcaaacttccggaccgcacagaacctgagcaacgttgcttcgcaggttgccatcatcgcgatcctttccatcggccagacctttgtcatgctgacaggcggcatagatctttcggtcggcagcgttctgggaatatccgccatgtcgatggccatgatcatggctgccacgcagaatatcgcgatagcgattgtgatcggactgctcataggccttgcgatcggctcactcaacggattcctcgtttcctacatgcggattccggcattcatttgtacgctgggcatgcagatgattgcgcgcggcgctacctaccttgtctctaacggacgttcggtttccaatattcccgatggcttttccgcaatcgctaaactggaagtcgttccctatgtacgcgtctactatatcgctattgtcgttttgttcatcgtcatggcatggtgccttaacaacacaaaactgggacgttatatttacgcgatcggcagcaatgcaggcgcggcgcgtcttgcaggcgttaatgtcaagcggtttaccctatacccttatatgatcagcggcctgatggcagcactcggcgcattgctgatgtcctcgcgcctgatgggggttgacgccacatatggcgcaaactatgaaatggatacgctggccgcagtcgttatcggcggtgtcgccatgaccggcggcaagggtacgctgattggtactgctatcggcgtggtgttcatgggacttgtcaaaaacggcctagacctgctgggggtatcgccttactggcagacagttacggtaggtatcatcatcattgcggccttgcttatcgaaagcatcagttctatggtacgcgaaaagaaaaaagctacggtggtgtagtcaaatcaatttgaatttcgtttcccgatattaagattaccgggataataataaaaggaggaactttgaatgaaaaagactttagtaactattttggcggttgttctcgttgtcgcttttgcccttgcaggttgtgcgccggctgaaacgactccttcggaatctgcttccgctccggctgcttcagaatctgcggctgaaccggccgcttcggagtccgctgctgcatcgactgacgcaggtggcgcgaaaaagattgcttacctggcgccttccttcaacacacctttctgggtctactgtgaagatggtatcaaagacatatgctccaagcagggttgggaagtaacatcctatgactccaacaacgaagcgtctacacagctcaaaaatgcgcagaatgcaattgcagcaggcgcagacgcgatcatcatctccccaacggacagcgctgcatgccctgctgttttggaggaagctgcaaagtccaacgttcccgttgtgatctgcgatgtcggcaccgactccggtgaattcctcacccagatcgttacaccgaacgaagcaggcgcatatgaagtaggacagtattttgcaaaatatgtcaaagacaacaacttggaaggcgttgtcgcagaaatcacagtcccgctcgcccgcatcaatggtcagaaccgccagaagggtttccagaaggcccttgacgaagctgggatcacgaagacaacggtgcttgaaagcagcgacttctctgtagacgaagcatacggccaggcgaaaaatatcgttagcgcaaatcctgacctgatggctatctggtcacatcattcccaggctacactgggcatcgtaaaggctcttgacgaactcggcctgagcgataaggtcctcgttgcatgctttgacggcgacccggacatcatcgattacttaaaagaaggcaagatcctcgtttgcggcgcacagcagccgatccagatgggacgcgaggcagtcaatgccctgatcgcttcctggaatggcgaagaagttccgaaggaaactccggtagacgttcttctgctgacagccgatacggtaaatgaccagatcgatgaaatcgttgccaatgtttgccctgtaaatgagtaattcttaagcaaagctacaatatatgttgatgagggggaggcatagggggtatgcctccccctcttattacacaatgtcgggccacacgaatacaaagcacgtggccgatccacatgaaaggttggtaacaacaaatgaaaatgccgaatgtaaccaaaatccttgatttaagtcagcctatttaccataactgtcctgcctggccgacctatcttccaaccaacgtaaactatgaggcgcagcatgtgacgcacggttttttggctgaacgtattgattttaacagtcataccggcacgcatctggacgcgccccgccatttcttccctgatgggaaaactgtcgaacaaatggatcttttcagcttccagggcaagggcgtcgtgatcaatttgaaaaacatgaactccccttccattggcgccggacagcttgaacctttttccggcttgctgcaccaaggcgacattgcattgctttatacaggctggggcgaaaaacgcgccatgaccgctgaatatatgtacgaatggccttatatcacaaaggacggcgcgcaatggctcgtcgatcacggtgtcaaaacgatctgtatcgacgggatgagcgcaggcggctggccggagggtacgggccgtcccccccacgaggttttgctttcaaacagcgtcgttatcgtggaagaggtctatatggatgacgaacttcttgaagagagcgaatggtacatcgttgccttccccttaaagctgcaaggttttggcggcgctccgtgccgtgtcgtcgcgatgaagctcgaggactgaggcaaaaaggaggaaatttactttgaaaaaatatgtactcaaggccccctataccatagaagccgaagatgcgcctatccccgaaattacagacgaccaggttctattgcgcatcggatattttgggatctgcggttccgatatccagatgtaccacgggcttcataaatatatgacctaccctgtcgtgatcgggcatgaggtgtcggccacggtagaaaaaacgggcaaaaacgtttcggggtatgcgcccggcgatcttgtgaccgtagagccgcaggtgttttgcggcgaatgctggccgtgcaggatcggacgcttcaacgtgtgccagcatcttcgtgtgatgggcgtacaccaggatggttttgcatgtgaatattttgcgatcgatccttcctaccttcattcgtgcgccggactcgaaccgaaactggccgcgctcatagagcccctcgccgtggggatcggttcggtgaaacgcgccggaaacctgaccggacaaaacgtggtggtcgtgggtgcgggaacgatcggaaacctgaccgcgcaaagcgcgcaggcgctcggcgccacgcgcgtgatggtaacggatatcaatcagaaaaagctggattacgccaaaaagtgcggtatcgaatactgcgttaacacttcggacctgtccttatcggacgcgatcgaccggtatttcggcttgcagcgcgctgacgtgatcatcgactgcgccgcaacgcgcggctcctttgcttccatcctcgaggctgcgcgtcccagttccaagattatcgtgaccggtaatttcaaagtccctgtggaaatcgaaatgcccgtgcttcaacggcaggagatcagcctcatcggacatatgatgtacgtccgcgaggactttgcagacgcgatccgcttcgtagcaagcggcgatataaaacttgacggctttatcaccggtatctatccggcgggcaagctcaaggaagcatttacatttatcgatgaaaatcctgacgatgtgatgaaaatcgtcatttccatgcaggaataaatccaaaggaggtaactacatgataaacgaacaagaacgtttaagattgaacgaattatgtcataaattccgcgtcgacctgatcgaggtgctccactccaagcagacaggccatcccggcggttccctctcggtgtgcgaaatattgactaccctttatttccataccattcaggcgtatccggacgatcccaaaaatccggcccgcgaccgcgtggtgctttccaaaggccatgcagcccccatgctttacagggtgctggccgaaaaaggtttcttccctgtcgatgaaatgaataccctgcgggatttcgaaacgcgcttgcagggccatccctgcgcgcaggacacgcccggcgtagagctgtccaccggcccattgggtctcggactttcggcagcgctcggtatggcgctttccctgcgtcttgacaaaagcgccgcgcacgtgtacgcgattttgggcgacggcgagatcaatgaaggtaccatttgggaagcatgcatgtccgcttccaaatttgcggccgacaatctgaccgccatcctcgactggaacggcgtgcagcttgacggaacagctcagcagatcatgcctatgggcgatatccgcgccaagtttgaatccttcggctggtattgcatcgaatgcgacggacacgacgtaggcgcgctcatagacgcttacgagcaggcgctcgcaaagaaaggcatgcctactatcatattggcgcacacggtcaaaggaaaaggcgtatccttcatggaaggcaaaaacgcatggcacgggaaaccgatcggcgatgcggattataaggccgctatgctcgagctgggaggtgcaaaataatgacaaaagaaatcagagaagtatatggggaagccctggtaaaatatggcaaggacgacaagcggatcgttgtgctggacgccgatgtatgcggctccacgaaatcctgcattttccgcgacgcttgtcctgaccgtttctttaacgtcggcatcgccgaagcaaatatgaccgctatggcgggcgggttcgcggcaagcgggaagatcccctttgtcaataccttcgccgtgttcctgacgagcatcgggctgatctccgcccgcgccttcggttcttattccggcctgccgatcaagctgatgggtgcatacagcggtctttccgacgcttttgacggtccgagccaccatgcgctcgaggatatcgcgatcatgcgcagccttgctaatttcaaggtatatgtagccggcgacgcggtgcagacggattggctggtaaaacatgcgatcgaagatgcttcgcccatgtatatccggctttcgcgcaatgccttcaaagacatctatgcgcccgacgagactttcaccgatgggaaagccaaagtcgtacgcgagggcaaagacgccgcgatcattgcctgcggagccatgatcggttatgcgctggacgctgcggatctcctcgcaaaagagggcatcgaaacgcgcgttgtggatatgttctgtgtaaagccgctcgatcgcacggccgttgtcgacgccgccgcgcagtgcggagccatcgtaacggcggaagagcacaatgtgatcggcggactgggcggcgctgtctgcgaagtattgtgccaggaaaacgcagcttgcccagtgtccttcgtgggcatggacgatacgcacgccgaatgcggcccttatgataacctgatgcaaaaatacggcctgaatgcggaggcgatcgcaaaagcggttcgccaaacggtcgctaaaaaatagccaacaacataatagcctataacggcaaaagaggcagcgaatcatttcctgcctcttttgttattcttcctattagcaaagcttaccgcaagccttaaccggctatttgcattccgcaaacagcctccccatgtcccataacacggtttcatccccaaagctgcccgccttggaaagcatatatttttccgtaccatcctccagcagcagctttgaaaggatcacgccctgcatcacctcacgctgcaaagtaagccccttcggaccgatcccctgcatggcgccaaaaagcgtatccccaccgacaacggaaagtatgcctgcgcccgcattagaaacgcaataccgcgcgatgcgtcccaggccctgtgcaatgcgcaaatgaaggttttccccttcgatcccgtttgccgccgcatattctttcgctgcgcggatatcttcctcgcggtccgccgtatacagcaataccgcaccgttgccatggcttaattcccgtatcttttcttttgcctctttcgtcaaaccatttcccaaataatcgtcaggacgcagcaggcagcttttcatgcctttttctttggcgcatacgacctgccttcgcgtgcgttcgttgatactgccgcaaagtatgatatgcccagactgtttgggagatatctccgtgttctttggcgctgtgccgtcgatatagggagcaacgtacgccgcaaatcccgcacagcccgccagtacgatcttgtctgcgacgggtttaagatgccgcgcgatttccgcaagctcctgctcgctctgagcgtcgcataccaaaataacgggcgtatcttcattctgcggcaattcttccttcgcgaggtcgatcatatgcacaggcagcgtcgtttgccttttaacgatatccactgccctgtcgcttgtcacaggctggaacggatcgcgcgcatacgaggtctttgtaagcagctccccgtttacgcggaagatcccctcttttaaggtgcgtcccatcctcggaaaagccggtacaaaaacaaggatatccctgccggatgccaacagcatcgcggcaagttctgcgccgatatttccgcgcatggtggaatccgtttttttataaaaaaacggaacatgcctgtccgcggcatattccatctgcctatagattttttgatatgctttttccggcgtttcgtggcgtgattccatatccatcacgattacatccgcgtccgtattttcaggaagcccttcgcaaagcgacacaaaaacgcttgctcctttttcggcaaactgtacgcctgcgtcaagggcgcccgtaaaatcatccgccaaaagcattaactgcgtcatcgcttcgccctacgcaagctctggaaacttgttgctcgccatgacaaccgccatttcgatagcttcgaccatgctttcttcgttcgcgcggccttcccccgccctgtcaaacgcagtcccatgatccaccgaagtacggatgatcggaagtcccagcgtgatattgacgccgctcatagattcaaactggtttgtctccggattcattttgaatccgctcaacttcagcggtatatgtccctggtcatggtacatcgcaaccacaatgtcgtattgtttagccattgccttcacaaaaacagtatccggcggcacgggcccgtccacatagcaacccgctgccttcgcttcttctatcgcggggatgatccatttttgctcctcatcgccgaaaagcccgttttccgaacaatgcggatttaaccctgcgacagctatcctcggatttttgattccaagcagcttgagcgcttcatccgccaatttgatcacgctgaaaacacgctccttcgtcaccaggtcgcacgcctttttcaaagaaacatgcgtcgtacaatggatcacccgaagatctttggacgtaagcatcatcgcataatttttacactttgtctggttcgcaaatatttcggtatgtccggcaaactggtgccccgcttcatggatcgcctctttattgattggtccggtcaccacggcatgcgccttccctttaaggacgagctcgatccctttcacaacatagtggtatgccgcgtcgcccgttttggggcttacttctttgtatttccagccctgcggcgacaaaaagcccatatcgataatatctatcgtaccaaacttacccttcgcctgcgacggatcactgatccggtttaacgcaagaccactcttggtaaatgcagccgcatccgccattggttcgtaatcgcccaccacaaccggaatacacttttcataaatatcctgattgcccagcgctttaacggcgatctcagcgcccacaccggccgcatcgcccatcgtaattgcaaggatcggtctcatatttcctccaaacgtctatttggtttcacgcttccgcatcctcaggctttgaataaagggactgttgtcatgctcttttccattctggatcgtctctaccagattggcctgcgatttttccagatgcttcgtcagcaaggttttcagccttctcaaattttcgtcttccaatgccttgaggatatctccatgttccttcattgtctgcaaatatcttgtttttgacagcttatgatgcgttgactgcatcatataataaaacattccgtttgatttcaagttgcggtacaatgtaaacatttgtttattgttcgtcgccgacaaaagcaattggtggaaataagtctcatattcaaagaaatgcttcatgtcgttttccgcgttgatcttataccccatttcattctgcttatctgtgcacttatgcagctcttccagatacagcggaaccgtttttgcataataaatcatgtcctccgcacaataaagctcgatcattttacgcatttcatacgtctcggcaatctcctcgaacgtgagcttcttgaccttcataccgcgcctgggcataaactcgacatagccttcggaaaccaaacgattcagcgcttcgttgatcggcgtgtggctgactcccaattcctccgagagcttactgaccaccaaacgactattctgcgaatattttcccataataatcatatttttcaaatgagaatacgttgaatcaagcaaagatgaattctcttccaaaaccaccagacctcctgttcgcttgcttattttgggttcaaaacttcatgaacttacctacttattcaccttaacattatactgatttactcggataatagcaagggaaaattttccagccgctttgcgagcgcctgcaaaaaacgcgctgcgggagcgccgtctacggcccggtggtcaagcgtgagcgacagggttatacacggatacgtaatcagttcgtcctcctcgatacgctgcctgtaacaaaccgttcccactcctaaaatagccgtctgcggcggattgatgatgggcgtgaataccgtaatacccgttgtccccagattggtcagcgtaaacgtcccgcctgaaagctttgccggttcaatagagccttccttacatccggcgatgagttcctttgtttcgcgcgcgatggcattcaagcttttcctgttggcttgcataacggtcggcaccataagtccgcggtctgtatcaacggaaatgccaatattagtatccgaaaaaacatgcagtccgtcttccttataatgcgcgttgaattcagggaacccgggcagtgtacgcgacagcgcaaacacgatcatatcattgagcgtcgcgcccgcatacggcagtatttccgctttttccttcaccagcttgcggtattcgatcatctgtgacgcgtcgacctccgcagccatcgtaagctgcgccattccatgtatggactgcatcatgttatcggcaatgatcttgcggatatgcgtatgcgctatcacgcgttcctccgtttgtgtcgcggccacatccgcagacggactctgctttaagtacttttccagatccatgcggataatgcgtccgttggggccgctcggcgtgaccgccttcaggtccacgcctttttcttttgccagcttgcgtacgatcggcgaagcaaagacccttccatccggcgccgcttgcgctttaggcgtttctgctgctgcaagagccgtttccggttttccttcaggacttttttcttccttattattgtcctgctccggcgcgcctatactatgcggtaattcgtagctttctccctgctccccgatcacgcatacgacttccttcacgcggatctcgtctccggtctccccgatcatctcgaggaccgttcccgccgcatcgctctcaacagggaatgtcgcctttcccgtctcgatttcaaacaggatatccccctcttttacaacatcgcctttgtttacatgccactcgcccataatgacgctttcttctgtcaggcctttttgcggcattaatataaattttgccataacatactcctcttaatgcttttctacaattttcaatgattagcggatataaagcccgccgtttacgtcgatcactgcgcccgttacatagtccgatagatccgacgccaaaaaatatacgctttttgccacgtcaagcggtgttcccagcctcctgatcggcacggagttcggatcgtcccgtcctttggtcatatccgtttcgatatacccgggcgcgatcgcgttcgcattgatattatacggcgcgcagaacagcgcgtatgattttgcaagggccaggataccgcccttggaagcacagtaactcggcgcaaccttcgggcttcccatttctcccgcccgcgacgccataaaaatcagcttcccgctgccctgtccgatcattttcttcaggcaggcttgcgtgcagagctgcgccccccgcaaattgatatcgatgaggttgtcccatgcgtcctgcccaagctcaagcataggcgtcgcatccacgataccggcgttgttgacaaggatatcgatctttccctgctttgcgcatacgtcctcgaccatcgcgtcaatggattccttggactttacgttcacttccgccgccatcgctttgagccccgcgtcagccagttcgtcagcgctttcctgcgccagttcaaaccgcatatctgcgatcacgaccgtcgcgccatgctccgcaagcaatttcgccgaagcaaagccgatcccgcgggcggcgcctgtaacgatggctatcttatcctttaaatcatcatatttcattatcaaatatccctcccggcatacgccgttaccagagattcccctcctcgttaaacgcaaacggctgcggctcctccaggatttcgatgttcggatttgccttcgcttctgccatcaacgcttccgagatgtaaatttgttcgatatgcgctgtgttcttaatacggatgatacgcgggttatcataatcgatcttattgcagcttttgaccgcgagcgcgatcgtatccctgtcgttatccatcacaataggcatttttacagtcaataacactgtatttgtgatcgcattcggatacgtgacttcaaagtccgtctggtcgtaaagccgtttgctcaccgcgtcaaagacgccgacgcccgcagcgctgccgtgggattcctttgtgagtcccaaaacaaccgcgttctggtttttgagcccgccgtctgcgtatggcgtacagaacacgccgctcacatttgggtccgcgccgtccccgctgatatttttgccgatctcgtcgatcaccagcacatccgcttcttcaaagaggatactgcccattttcgattttgcgatcagcagcagcttcggttcctccgtgacgatctcctccggcatcagcgcatcgatccggtatgtctcgtcgtacgcattctcgatgatccctacgccaaacagcaaattcgaatgcttcatgatcgccttgccgaacaagggaaccaaacggtgcatctcgccaaagcccgccgtatgcgttacctccgcgcccttttgctttccaacgccgatcgtcagcatcttcatcaggccgctttcatacggtccgcgaaaagcggtatgcggcttaatgcggttgacggcgatatagccgtccgcctccgccgcatatttatcgatctgcacaatatggccttcgtccgtttcaccgatcgccttggtctccatcgtcgcgcaaatcggacacccgcagtattcctccgtgatgccatagctttcaaggatcgcctgctggccttccgccgtagcgccgccgtggctgcccatcgccggaaaaatgaaaggctgagcacctttttcctttacaaacgaagcgatctcacgcgtgatcagcgcgatattcgccacgccccgactgccgccggtgataccgatgcgcatgcccggcttgatctgttcctgtatttccgggcggcttaactgctttttgatctcgcccgggatatcctccaggatctcccgttcaaacacctggcggacaagcgccattttcggcagccctacgttatgtaccatcgcgctgtattttgacatattattttccctttcttactatctcttgttaccgctagtacgagcgtgtaagtatgccattttcagaatgtcttgctcttggcagtaggctgttcccattctcacttcgcctttggctcgcgctcatggacatcccttgccggagcactgttagccgacagcgctccctcagatccccaaccgttcgcagcgcagtttttcttcattggtcacattgctggtaggcacatatccttccagcctgactaccttttcattgatcacatccaggatcgtgtccttctgcgcaaagaaatatttttccagttccggacacggcgatacccagttgtgcgagccgatacataccggcggcgcatccagatagtcgaacgccagctccgtcatattgcttgcgatcgtcttggtatagcccccgcgttcacatgcgtcgctaatcaaaatcaggcggttcgttttcttcacgctttcgatgaccgtatcataatcaaacgggatcagcgtgcgtgcgtcgatcacttccgcttccatgccatattttgccgacaattcttccgccgcctcaagcgccggatacagcgtcggcccgatcgtaaggatcgttacgtcactgcctgcgcgcttgatatccgccttgccgatcgggatctcgtaataatcctgcggaacgccgtccggcgcaaactgttctcccatatcatagagcttctggctttcaaagaacatgatcgggtcggacgaacaaagcgcgctcgcgagaaggccttttgcatcatacggcgtagccggatacacgatcttgagacccgggatatgcgtacacagcgacgtccagtcctgcgaatgctgcgcgccgtaaaaagcgcccaccgaaacgcgtaccacgcacggcattttgaggatgccggcgctcatgccctgccattttgcgagctggttgaaaagctcgtccccgcagcgtccgagaaaatcgcaccacatgatctcaggaacggcgcggccgcctgcgagcgcgtatcccaccgccgcattgacgatcgccgattccgcgataggcgcgttgaacatcctatggtagggtatagactcgtataatccctgtaacaccccaaacgagtttccatgctcgcggatatcttcgccaaacatgatcatcgtcggatccacatagaatttatcgatcagggcttcgaagatcgcatcacggtatgtatacagcttgagcgccgaaaccggcttgccgttttcatccgtcgtcttgcggaacttcgtggaaatcttcttatatctggaattgtcttcctttgcgccgatcacttccggctcgccttccgccatgctgacgatgtgctcgttcgagaacatgcactttgcgatcgcgtccggttcgacgacaaaattcatgcgcggcgagaaatcgagatcgaccgtcttcttcaaaatatctgtgatcaggccgcgtgtatcctcttcgatccctttcgcgtcctcttcgctaaacaggccctgctcaatcatctggcggcggtaattcgcaagggaatcctcttccttccaaagatccatctcgtctttggtgcggtacgccatctggtctgttacagagtgccctgtgtggcggtatgtgatcgtatccagaagcaccggtcccttattttcctggatcagcgcttttttgcgtttgaatgcgtcgatcactgcaaatacattatacccgtccacgcgctccgtatgcaactcgtcggcattgaatgccgcgcccacgcgcgcaaggatatcgtaacccatcgtttcctgatccgtctgcccgctcatcgcgtagaaattgtttacataattgaagatgatcggcaagccgcctcgatatccttcttcccacaatgtcttaaactggttcatacatgcaaaattcatggattcccacgtatgccccgtcgataaggaaccgtcgccgctgttgacaacgcagatccctttttccttccttaattttttatacagcgcaacgcccgcgccgactccggcggacgcgcccacgatcgcgttgtttgggtagatgccgaacggcgtgaagaaaacgtgcatggagtttccaagcccgcccgtgaagccgatctcccgcccaaagagctccgtcataaaaccataaaggaagaaatctctggcaagagcccttatatcgtctttatgtgcagagaactgctccacattacgcaagagcttgccttccttaaaatcactcatgatcttatagagctcgtcttcgggaagttcgcggatcgccgacatcccacgcgccagtacttccgcatgcgcgcggtgcgtccccagcgaataatcgttcgtatcgagcacgtacgcttcgcctacggcaaacgcctcctgtccgtgcgagcaatgcgccggtcctgtatatgaatactcgatcccattatacgtttttaccgtgcggatcccttccagcatggtttcaaactcgcggatcagccgcatatcttcaaagatatgcctcaggtcctcttccggaaattgtttttttacatccttcagcgttttttggtatgcgtttaacgggatatcgcggagcttaaggctgcccggcgcgcgcaatgcttttgggtccacaataagtgattttggcatgatcgtaactccttactatttatgatatttaataaaaaagtattatttgcagagagtgaggaatgggggtttgttatttaagctaatctttataaaatttacttaaatttattatagtttttttgtataaatgtgtcaagctgtttttatttatttttataaaaaacagctttgcaaaagcacattttcacatttgtcaaaatatttcatttcttttttacaaaataaggttttgcaaaaaagaaatatttttttgctttttgtattgaaatatttccattcatagattatagtaagttcatacatatatttgagtagatttcttggcgatacccccgcttatcaattacatttaattttttcataataggaccatatttactaaaggaggcaatttcatccaaatggaaatcgttattttaggaggcggccccggcggatatgtagcggcaatccacgccgccaaatcgggggctaaagttaccttaatagaaaaagacaagctggggggcacctgcctgaaccgcggatgcattcccaccaaagccatcctccattccgcaaacctgctgcgcgaggtgcagaccggaaaggagatcggcatcgaaacagaaggggcctccgtcaattttggcgcggtcatgtcgaataaagacaagatcgtttctaaactcacaggcggcgtcggttaccttttaaagaaaaacaacgtgcgcgtgatcgaaggtgaagcgaagttcttagacacacaccgcgtaagcgccggcggaaaagaagtcaaggcggatactttcattgtcgccacaggttcaagtccgtctgatcttccctttgcaaaagcggacggaaaccggatactgaacagcgaccatattatgaggctgacggagttgccgaaatccctcgccatcgtaggcggcggcgtgatcggctgtgaaattgcgcaggcctttgggcgcatgggctgcgaggtaacgattgtggaaatgcttccccgcctgatcgccaacatggacgaggaacaatccgctttgctcgaaaaaacgataaaaagcgacggcgtacatgttttcttaaagcatgcgatccaggcagtaacgcccgaagcaaacggcgttcgcgttacttttaccgcgcctgacgggaaaaaacaggatatcgccgcggaaaaagtactgctcgcggcaggacgcaggccaaacagcgcgggactcgcgcttgacaaagccggcgtcgccatgtcgcccaagggttatatttccaccaatgcccatatgcgtaccaacgtaccgaatatttacgccattggcgatatcacgggaaatatccagcttgcgcatgtcgcatcgcaccaggggatcgtcgcggtaaacaatatcctcggccatccgcagcagatcgaatacggcgcggtgccccagtgcatctatacttcgcccgaactcgcttccgtcggactgacggaaaaagacgcggcgcaaaaaggaaaggtcaaggtcggccgttttatggcggcaggtaacggccgcgcgatgatcgaacgcagcgacggcttttccaagatcatcgccgaccactcgacaggcgtcattcgcggtatccacctggcaggcccgatggtgacggaaatgatctccgggatggcggcgctcgtacaattcgaagcggcgaccagcgatatggaagaagttattttcgcgcatcccagcgtgtccgagatgatacatgaaagtatcctcgacgcggacgggatgtcgatccatcaataaaagccccacgaaatcaagcgtatatatcgtgtatatgcgcgtcctatcataaataaggagggtgaaagagaatggaaaacaacacaatgaaggctcttgtaaaatatgcgctcggcccggggaacatggaaatccgcgatatgccggtgccgaagcccggcccgggacagatcaaaatcaaaatcaaagaagcagggatctgcggcagcgacctgcatatctatcacagcgatattgcgatccccgtgaatcctcccgtgattaccggacatgaattttccggtatcgtggacgaggtcggcgaaggtgtgaccggatataagccgggcgaccctgttgtttccgaaactgcatacgattattgcgggaaatgcgatttctgccgtgaaggctggtataacctgtgtatcgagcgtaaaacgctcggttattggtacaacggcattttcaccaaatataccgtcgttcccgcagaccgcgtgcatcatattccgaaaggcgtcagctttactgcggcagccatgaccgagccgcttgcctgcgttacgcatgcggtgggcgatctgacggtcatcaacccgggcgacgtcgtgttagtatccggccccggctccatcggcatgatggcggcgcaggtcgctaaggcatacggcgcaaccgtgatcgtctcaggtacaaacatcgacgaagaacgcctcgcgcttgcaaaaaaacttggcgcggattatgcgatcaacatccagcaggaaaatctggaagacctgatcatgcgcgtaacggataactatggcgtagacgtggtgctggaatgttcgggcgccgcacccgcgatcaataccgcgctgcgtctggtgaaaaaacgcggctatttcacgcagatcggcctgaccggcaaaaaaatcgaattcgatatcgaagcggtcaactataaggaaatgcatttttccggttccatgggctcgcgcaacgcaagctggcgtatggcgctcaagctgctcggtgagcatcgcgtgaatttggagccgcttgtcacccataagcttcccatcacggactgggagaaggccttcgacctgtttgagaaaaaagccggcggtaaaatattcctgcttcccgtagactgatggcagccttttattctttcaaataattatttaaaataatattatataagtaaaggagaaaaatcatgagagactcgatccacaaatatttccaggttggtaccatccagtggatgagccatccgaaacgcgatgtgctcgaatccattgccacgatcgccaaagacgactttttcgacgcgctcgaagtgtgcaaattcgcagacgacaaggtgcgcgcacaggcaaaggatatcttggagcagtcccatcttaaggtctgctacggcgcgcaaccccgacttttggggccgaagctcaacccgaacgatatcgacgaggccggccgaaaggccgcgcagacgacgctcatcgaagcggtcgacgaagcggaatacctcggcgcaaagggcatcgctttccttgcaggcaagtgggagcaatccaccaaggaccaggcgtatgcgcagcttttaaaaaccacgcgcgccgtatgtgattatgctgccaaaaaaggtatgatcgtggagctcgaagtatttgatttcgatatggacaaggccgcactcatcggccccgcgccgtacgccgcaaaattcgcggcggatatgcgcaccacgcataacaattttggcctgatggtcgacctgagccatttcccgaccacctacgaaaccagccagttcgtcgtgcgtacgctccgtccgtacatcacgcacttccacatcggcaacgccgtcgtgactgaaggctgcgaagcctatggcgaccagcatccgcgctttggctatccaaacagcgcgaacgatacgccgcagcttctggatttcttccgcgtcctcaaggaagagggattcttcaatgcggaaaatccttacgtcctgtcctttgaggtaaagccgtggaaggatgaagatgaggacctgatccttgcaaacaccaagcgcgtgatcaaccgcgcgtgggctcttttggaagactgagaaaggagttaatcttatgacaaaaatcgtaatactcgacggatacacagaaaatccgggcgacttgagctgggacgctctcgccgctcttggcgacctgaccgtatatgaccgtactcccgcagacaggatcgttgagcgcattggtgacgcggacgttgtttatacaaacaaaacgcctatttcccgcgcgacccttgacgcctgcaaaaacgtccgttttatcggcgtgctggctacaggttataatgtgatcgacgtagtggcagccaaagaaaaaggcatcgtcgtctcgaacatcccgacgtacggcacagatgccgtaggccagttcgcgatcgcgatgctgctggaaatctgtcatcatatcggccaccatgacaaagccgtccacgagggacgctggaccaacaacgacgactggtgcttctgggactatcccctcatcgagcttgcaggcaaaacaatgggcatcatcggcttcgggcgtatcggccaggcgacagggcgtatcgcaagagcgctgggtatgaagatcatcgcttacgacagtttcaagagcgacgcaggaaaagccctcggcgaatacgtcgacctggataccctgctcaaaacctcggatgtgatcgcgcttcattgcccgttgttccctgaaacggaagggatcgtcaacaaagataccatcgccaaaatgaaggatggcgtgatcatcttaaacaacagccgcggcccgctcattgtagagcaggatcttaccgacgccctgaatagcggcaaagtatatgctgcgggcctcgatgtcgtatccaccgagcccatcaaggcggataaccccctgctgggcgcgaaaaactgcctgatcacaccgcacatcagttgggctcccaaggaaagccgccagcgtctgatggatattgcggtcgataatttaaaggaattccttgcaggaaaccccgtgaacgttgtcaatccgtaaaggtcatttcatacaaaaacaggctgccgcacctgcggagcctgttttttcattgccgctgttcttttattttttctccaaatcctgcatataccgatatgcttcttccaggagcgcggcagtatccgcgtcttctccctgcttccattccgtttccagaaaggtatcgaccatcttacagccaagctccggcgcggcaaaaaagccgcccatccccagtacattgatgttattgaacgtacgcgccctatccaccgcatagacggactcgcacagcccgcaatatacgcccggatatttgtttgcgatcaagctgacacccatccccgtgccgcacatcacgataccgcggtcaaacttcccaccggagaccgcttcacctaaattgctgccgacttcgtagtattccacaggtttgtcaggactcaaggttcctacgtccgttacttcaaatcccagtttttcgaggtgctttttcacggcttctttgagtgtaaaaccgcttaaatccgaaccgatcactatttttttcattatcttttcctcctcttggaatgatatatctcctgccggcttgttacgctatacacgttgtcctttgcgctaccgcgggcttgtgcccgcagcgcgctttactttattggattgtgttgttttcacgaaatggcatttggtttcctgcctctatattttgtattttcattgtacaacaaagtataatttgcgtcaaccggtcaagaaaacaaaaggatttttcttttcaaaacactacattttgtgataaaatatagtaaatggaaccaaatcctgtagagcaaagcgttttgaggctttcctgatacaggactgcataaaggagggcaatacgtgttttcattggatcagttaacagaattcctcacggcaaacaaggccgattttgagataatcacgacagacgagcctgtcattactgtagaagatgccggaaaatattttccgctcgatgaatgtgcgcctgttttcgtcgtgcaggccgaccaaagccttgccgcactcatcatgaacgcacagcgcgggcaggttaacctgaaagcaatggcatcagaacttggataccatacctttcatctggcgaatcccaaggtcgtcgcgcaggccaccggttataaaacgggcagccttccgcttatcggacataacctctcctgcctgttcgacaagagtcttaccatacacgactatatttacggcggcagcggcgacgctcttcatacgcttaaaatcaagccggaagacgttatccgtttaaaccgtatgcttggttttgtggaataaatttacgcagaataaaaaagccgccttttggcggcttttttatttccgttattttcgaaccctgtgttaggatgtaacgacggcaggagccgcaaactggctgttataaaggtcggcgtagaagccgcccgccttgagtaactgttcgtgcgtaccctgctccacgatatcgccgtctttcatgaccaggatcatgtccgcatccttgatcgtcgacagtctgtgcgcaatgacaaaactcgtcctgccttccatcagcttgtccatcgccttttggatcaaggcttccgtacgcgtatcgaccgagcttgtcgcctcgtccagtatcagcatatccggatcggcgaggatcgcgcgcgcaatggtcagaagctgcttctgcccctgcgagatattggaggcatcctcgttgaggaccatctcgtacccgtgcggcagcgccttgatgaagtggtccgcatacgcggccttcgctgcggcaaacacttcatcgtccgtcgcgtccatccgtccgtaacggatattctccatgatcgtatcgttatacagccacgtatcctgcaacaccatgccaaaatgccgccgcaagtccgcgcgggtaaattccgttgcgtcgtacccgtcgatcaggatcttaccgccattgaggtcatagaagcgcatgagcagcttgatcatcgtcgtcttgcccgctcctgtggggccgacgatcgcgattttctgcccgggttttaccttagcggaaaaatcgttgatgatgatcttgtccggattatagccaaagtgtacgtcttcaaattccacgttgccgtccactttttcaagcttcacaggatgatccgtgtccggcaattcttcggcttcgtttaagaactcgaacacacgctccgaagccgcagccgtctgctgtaggatattcgaaatattcgcaagctgcgataatggcatcgtaaagttgcggacatattgcacgaacgactggatgttaccgaccgtgatcgtgccgttcgccgccaggtaaccgcccagtacgcaaaccgccacataaccgaggtttccgataaaactcatgatcggctgcatcatgcccgacataaagtttgccttccacgccgcgctgtaaagtttcccgttttcttcgttgaatacttcaatgctttcttcttcgccgttataggcggaaataacgttatgtcccgcgtacatttcttctacgtgcccgttgaccgtgcctaagtattcctgctgctgcttaaagaacttctgcgagcgcttgaccacctggaaaatgagtaccaaagcgatcgggatgatacacagcacaacaagcgtcatcagccagttgatcgtcagcatcatgaccagcacgccgatcaccatcgtcacagacgtaacgatctgcgataggctctggtttaaggtctggtttatggtgtccacgtcgtttgtcacgcgcgacagcacgtcgccatggctgtttttgtcaaaatacgaaagcggcagtgtgttcaccttttcgctgatatctttgcgcaaacggtacgtcaccttcatggaaacgcctgtcataatgtatccctggatatagctgaacaacgccgatattccatacagtatcaaaagcgtgatcaatatctggccgatctgtgtaaaatcgatgccggtccccgtgccgtcgatctgccccatcacgccgttaaacaagacggtggtcgcgttacccatcagctttgggccgatgatcgcaaagaccgtggatgcgatcgcaaagataaagactgttatgatcgcgcctttatagctgccgatataccttaaaagccggctcatcgaacccttgaaatcttttgctttcgcgcccgccatagctacgccgccgcccataggcccgcggcctcctcccatcggaggttttttattcgtatgctcactcattgtctaattcctcctccgaaagctgtgataaggcgatctcgcggtatgtctcgcagtttttcatcaattccctgtgcgtgcccttcccgacgattttcccttcatccaaaacgatgatctgctgtgcatccatgatcgtacccacacgctgggcgatgataagcacggtcttgtcctttgtctgttccttgatcgccgcgcgcagcgtcgcgtctgttttaaagtcgagcgccgaaaagctgtcgtcaaaaatatagatattcggatccttgacgagcgcccgtgcgatcgacagcctctgcttctggccgccggagacgtttgcgccgccttgcgaaatactgccctcaaaaccgcgcgcactcttggaaataaattccattgcctgcgcctcttccgccgccttttccagcctctcgtccgtcgcgttttcgtctcccagtcgaaggttggaggcgaccgtccctgaaaacagcacagatttctgcggtacatatccaagctggtcgcgcagttcgtggcgcgttacgtcgcgtacatcaacgccgtctattgtaacggttccgctcgtcacatcgtaaaagcgggggatcaggttcgcgaccgtagacttaccgcttcctgtagaaccgataaaagccgttgtttcgcccggcttggcgacaaaattgatatctgaaagtacattcgcatccgcgcccgggtatgcaaagcacacgtctttgaattcaagcaatcccttggggtctgtgaactttttcgggtttttcggatccttaatcgccggctcggtatccaggacgtctgcaatacggtgcgccgatacggaagcacgcggcagcataatgaacatcatagacatcatcaggaaagccataatgatttgcatcgcatactggatgaacgccatcatgtcgcccacctgcatagaagaagccgcaatctggtttgcccccacccagatgatcagcacggaaacaccgttcataataagcgtcatgattggcatcatccacaccatagcccgattgacaaacaatgacgttttcgtgaggtccttgttcgccttgtcaaaccggtctaattcaaacttctgtgtattgaacgcgcggatgaccatcaagcccgaaaggctctcgcgcatcaccaggttcagcctgtccacaaggctttgcattttcttgaacttcggcatgacgagtacaaaaagcgaaccgatgaacccaagcaggatgatcactgcaagcgcgatgatccacgacatggatgtgctcttgttaagcgccatgattacgccgcccacgcccataatcggcgcatagatgaccatgcggatcatgaggatcagcaccatctgtatctgcgtgatgtcgtttgtgttacgcgtaataagggaagccgtcgagaatttgtcgaattcgacattcgaaaaattttcaaccttggtaaacgtcttttcccgcaggtcgcgcgcaacacccgcgcccgcccttgcggcaagcaatcctacaatgatcgtacatgccgcgctgccaagggcaagcaggagcatcaatccgccattgcttaggatatagttctgctgtattgccgttgtatccatgccaagcgccgcgtactccgccttaaccgcaggaatcgccatctgctgtagtgtactttcgtccataccacccagtttttcttccagcacttcatttaaagactggtaaacctgctgtgcctccggatacgtgttgagcgcggtaaaaaagtccgtgccttccggctgctgtgcgtaatacatcataaactgcattaatgccggtgggatttccgctgttttttccgttccatcctcattttgctgtttatcgagggaaatggtatccgatccgctttgctccgcctccatgatctggttgatcgcattgatggatgcaaaaggctttgcaaagatcgctccaagctccaactgggttttgtcgtctgctttgttctccacataaacattttcattctctagcgccggatattcttttaaataagtatcataatccgcactgtcttttgtcacgagcgtatagctagcctctgccaaagctttcgcgtcatcatccatgaacgcttgcagcgtattcatagtgttttcgctcaccgcttggggcgccgcgctctcgatgccgccctgctgtatcccgtaatcaacgattttggacatatagttgggaagcgacaaatcacagtatgcctgtccgaagagcaggatcactgctgccacaataagtgcggcgtaaggctttaaatacttcagtatgcgcctcatatagtttcttttttcctttctttctttaaaattaaaattttcttgattggtttatgatactgcggttgcataataatgtcaatacgtttttaaaaattattgacacggttgcataaatgtggtaacctcgttgttgaagtatccggaaagaagtatcattgtggctgaaaaaaataccaaaaccagaatcaaacaaattgcgcttgacctgtttcgcgaaaaaggtttcgaaactgttaccatcaacgagatttgcgaaaaaagcggggtcaataagcacaccttttattactatttcaagtccaaagacgatcttttaaacgactaccacgagatatcctacgatatcaatacttcttattttgtggaaatcctgaatgctgaaaatttcgtagaacagctatggctttcctataaacctttttttgaacgcattaacgattccggcacagaaatcgcgcggcagcttttcatcaaaaatcttaaccgcgacgtaggtaccttccgaatcgaccagcggcgggacgcgtctctcgagctgcagcaggacattatcaagaaggcgcaggccgcgggcgagatgcgcaacctctccgagcctaagacgctgctccccttgatgcaccagcttttaatgagcacatcctttgcatgggtgatgtctgacggtgagtttcaatttgacgaagtggcgcgggcggaaatggaaggccttttggatgtgaagcccgagcttcggaaagcgcagcatatcgatctcgacaaaatatggcggaatttaggcccgggccgaccccgccgcaacatgtgcgaaatgcatgaaaaatttcacgagagacacaggcatcgcccttcaaaaacgacggaaaaggaataaataggatgaatataacagcagcttatttcagtcccacaggcgggacaaaacaatatgtaagggaaatcgcttcggctttaagcggtgaatatacggatatcgacctaacgaacagggacgtgcgtatgcaggagcacttttttacggaggatgaccttgtcattctcggcgtacctgtttattatggacgggtaccgcagatcgaaggcgggcttttaaaccgcatgcacggcgaccatacgcctgttatccttgccttaagctatggcaaccgcgcgtttgacgatgctttgctggagctttcggatctttgcgcaaaacaggattttgatacggttgccgcttttgcgggaatcgcgcagcatactttctctgaaaaaatagcaaccggacggccggatgcggacgatcttgcggcggcaaagcgtttcgcgcaagattataaagaaaaacttgcttcgggcgggacttttgagatcacgctgccgggcaagcacccgtaccgttcgtatggcagcgttccgtttgcgcccaaaggcgataaaacatgcacagcctgcggggtatgcgcgaaaacctgccctgcgggtgcgatcgatcccgctgctccgagaaaaacggacacatcgaaatgcatccgttgcctctcctgtgtgaaacagtgtccggcagacgcgcgcaaggtctccggtcccatattccgcgttgccgccaaaaaactggaagaaaaccttacgaaaacgcaaagggagtgcgaagcctttttgccatgatcaagaacacagcggcatcgttcccccctagcgggggttttttatttgcagcacatcgcatggcttgttcgcgagctctgccgcctcgctcaccgctcccacaaaccagctcgcttcgcccgtaacaatgaccaccgcgcggtccgccgccgcgagggcgcagtccggtggagccagtactttcatcgaattataatgctcgatttctatttcatcatctgtaaataataatattttcatcaaatcacccctttatgaatgcataataaatcatctttgcattcacttttcacatttgaatgataaatacagttacaataagtataaagtgcattcataatgaagggataaaacgaaagatgagcgaaaagcatcttttacagatacctgcgaaagcgacggggtctacctatacattgaggttatcgcgcgaactattagacaagctccactatgtcgccagttataacggacgttccgcaaacatggaaattgtccagcttatcaaaaggcacatcgcagaatttgaagccaggcacgggaaaataaacagggatgccggataaatagccggcattttttgtgccattctttttttgtaaatcgctattgacttttctatgtattagcaatacaatatctatgggttaattaaatatgatcacacagtatattgtgtcttgcaggtatccctgattggggaatcattgggaagtcgggtgaaagtcccgcgcggtcccgccgctgtaagagcatagttgcgtacaaaacgccactggggctaagccttgggaaggttgtgcgcagcgtttaaaactcaagccagaataccagcctgcaacggttcactcaaatactgccacggagtatggcaaaagagtcaagcgctcttaactcgggcgtttttttattcttaggctttatccgcattttaagtaaacaagggagaagtatcatgatcaaacaaatcacaaaaagggatggcagtacgcagtccttccaaaaagaaaaaatcacatgggctatctttaaagccgttacagcagtgggcggtgaggattttgacaccgcgcaaaaaatcagcgacgacgtcgtcgatcttgcgaacctgcagttaaaatccgatactgcggatgttgagcagatccaggaccttgtggaaaaagtcctcatcgagggcgggcatgccaaaacggccaaagcctatatcctgtaccgtgaaaaacgccgcgctgcaagggaatccaacgcactcatcggcgcgaccatcgatatgttctccgattaccttgacgacaaggattggcagatcaaggaaaacgccaacacacagaaatccatcaacgggatgaacaactatgtgcgcgaaacgttcaccaagcaatactggctgcacgaaatctatccgcaggaagtgcgcgaggcgcatacgggcggcgatttccatatccatgatcttggtttctttggcccctactgtgccggatgggatttaaagcagcttttgatggacggcttcgggggcgttccgggcaaggtagaatcctcccctgccaaccatttgcgctccttcctcggccaggtcgtaaactccacgttcaccacgcagggcgagacagccggcgcgcaggcatggtcttccattgatacatactgcgccccgtttatccgttacgacaacatgacaaaaaaagaagtcaagcaggcgttgcaggaatttatcttcaatattaacgttcctacgcgcgtgggtttccagtgcccattttccaacctgacgtttgatattgtcgtgccgcgcaccttaaaggacgaagctgttatcacgggcggcaaggtgcggcgcgagacctacggcgatttccagaaggaaatggatctcttcaacgaatgtttttgcgaagtcatgctcgagggagattccaagggccgtgtatttacgttccccatccccaccatcaatgtcacgaacgaatttgattggaacagccctgtggtcaataaatttatggagatcacctgcaaatacggtattccttatttctccaactatatcaactccgacctgagtccggaagacgcactttccatgtgctgccgtctgcgcctcgataccaaggaactccgcaaacgcgggggcggcctgttcggttccaaccccatgacaggctctatcggcgttgtcaccatcaatttgccgcgtatcgggtatcttgccaaatccgagggcgaattcaaggcaaggctgtggcagcttgttatgatggccaaaaacagcctggagatcaagcgtaaaatcatcgaggaccagacagagcgcggcctttatcccttctcggcccattacctgcgcaacatcaaaatgcgtacaggccagtattggttcaaccatttcaatacgatcggcgttttgggcatgaacgaagctttgctcaacttctttggagacggcactgacctgacgaccgaaaaggggcaggaatttgccgtatctatcatgaattatatgcgtgacctgatgacgcagatccaggaagaaacaggccacttttacaatctggaagcaacgcctgcggaaggcacgagctaccgccttgcggagttggataaaaagaaatacccgcagatcatctgcgcgggtgacgaaaaggttccttattatacgaactctacgcagctccccgtcggttttacggatgatatcttcgagacaatggacctgcaggacgagctgcaaagcctgtatacgggcggcacggtgcttcacctgtatttaggcgaacgcatctcagacgtcgaggttgcaaaaaagctgatccagaagattttcaccaactacaagcttccgtatatttccttaacgcctacgttctccatttgccaggaacacgggtatctggacggcgagcagttcacctgcccggaatgcggaggcgatacagaggtttggagccgcgtcgtcggttacctgcgtccggtgcagaacttccacaagggcaaaaagacggaatatgacgaacgcgtaaaatacgcgatcaaagaaaattcactgtgaatatcgcgggacttttaaaaaacgggaccattgattttccgcatcgtctcgcggcggtgatctttacggcaggctgcaattacgattgcggcttttgccataaccgcgccctgcttaagacgacggatttgatggataccggggaagttacggcgtttcttgaaaaacgcgcgggccttctcgacggggtcgtgctctccggcggtgaacccacgctgcaaaaggatcttattccttttgccgaatacctgaaaagcctgaactatgaagtgaagctcgataccaacggcagcaaccctgccgttgtaaaaaagctccttgagcgcggccttctggattatatagcgatggattacaaagcgccgtttgaccgctatgcggaagtttgcggcgggcaagcggatgccaaacctgtgcgcgaaacgctcgatatcctgtttggttcggataccccgtgggagttgcgcacgacagtgatcccgcagctttcccgtgaggatttatatgagatggcctcagcggtggatacgcttcccgcctatgcgctgcagctttaccgtccggtgggcgttgagaaattgcgcatctattccccgcaggaggtcgaaggcctcgcaaaagagcttgcgggcagtcaaccaaacatcttttccagatgttgattacaaaagaaaacccccgtaccttttggcccgggggtttcttttattactttccagcaattgacctcattcttttgcgagggctattttacggatatttttctttttgttgcttccaagactgttcacaagcacggctacataaagcactacgcccgttacgacctgctggaagaaggaatcgatacccatcatctgcataccgttcgtgaggatcatcaggatcaacgtaccgatcacgacgcccaggatcgtaccttcgccgcctttgatgttaacgccgcccaggatgacggcggcaatgacggagaactccatacccacgccgatcgtcggatcagcgctgcccagcctgccgacctgccagatgcccgagaatgccgcgattataccgctcaggatgaagaaaatcatacgcatcttaaatacgttgatacccgcataatatgctgcgctgtcgtttccgccgatcgcgatcgcatatttccccagcaacgttttcttttcgaggaaaataaatacgatgatgaccgccactacaatgaacagtgcaagcgggatactgtcgaagaatttcatcgagttccacgctgtgatcggctttacaagatcgccgctcaccgggatcgcgttacaggcagcaagcgccataccggcggtaatgatccatgttgcgagagtagccatgatcgccggaatttttaatttttccatgatgaccgtgttcagcacgccgatacctgcgccgaataccataatgatcgggatcgccagccacgggttcacgccccatatgcacaggtaaccatagaatactgccgaaagccccataacaccgccgaccgacaggtcgatggccccgcttgcgatgacaaacatcatcgagcaggcaaggagtaggtttggcaggctctggcgaaccatgctcatcatattgcgcatgctgataaacttatcgttctgcgagaaaaagaacacgcacaaggctatcaaaatcaccagaaggacaatattttgttttgaagatcttcctaatttactcattgttcttcctccctcctcatactctgatgcggtcgcggatgatattattcatcaggatcgcaaggacaagcacgacgccccttaccacgttttggatatattctgtcatgccctgcatattcatgatattggtaagtaccgcgataaacagcgcgccaatgagcatgccgaataccgtaccgcgtccgccgttgatgtccgtaccgccaagtactgcaacgatgatacagtctgcgtgcagctccgggaaaatgccgctgtccgcagccgccaggcgggaagtcagcaccacgccggcaaacgccgccatcatgcccgatcccataaacacacgggaaacgactttcttgtcgttaatacccgaaagctttgcggacgtcatgttggaaccgaccgcataaaccttgctgccgaatgtcgttttgctctggatgatcataaagatcacgaccgccacaagcgcgtataccataggaagcggaacgccgccgaccgtctggccgatgattccgatatcctgcgggaggttaaacaccaccgcgccgcccgcgccgatgagcgcgataccgcggcagatatagctgaatgccaacgaaatgatgaaggacggaagcttaaacttcgcgatggaatatccggaaaggaatccgaacgctgccccgatcagtactgaaaacagcgctgccaacagcacagggatacctgcgatggacatgagtccgaataatacggcccccattgcgcctacgccgccgaccgacaggtccaggtttccggaaatgagtaccagcgtgactgccgcgccaaccataatgacgctggatgagtttacaaaaatgttcagtatgttcgtatatccgaaaaatatatcgggctgcaatgcaaaacctacgatacatgctaccacaaaaatcaggaagatcgtcaggttctgtacgccgtcagaggtcattttcaggccttttttctgcgtcagcgttttctctttattcatgatccgcgcctcctcccgtaacaatgtgcataatttcctgagtttttagtttatcgtcattgctcatgatcgcttttacttcaccgtcaaagagaagcacgatcctgtcgcacagccccatgatctccggaagttcgctggagaatacgatcgccgagcatccgtcttttaccatgcggcggatgatctggtatatctcctgcttcgcgccaacgtccacgcccctggtcggttcgtcaagcagcaataccttgggcgccgcgttcaggcacttgcccaaaacgaccttttgctggttaccgcccgaaaggtaggcaacgctttggtttgcgttgcggcacgcaatcccgatttcatcaatataatggtttgcgacttccgtctgcttcgccttattgagtatcccatttttggaaaccgtcttataattcatcatcggggtattggatgcaatggaaagcgcagttgctatcccctgcgtacggcgttcctccggcacgagtgcgattccttttttaagggccttgtccggtgttttgaggtcggctttttccccgtccaccagtacttcgcccatataggagtccgcgccgaaaagcgcgcgcgcgatttctgttttccctgcaccgatcaggccataaaaaccgagtatctcacccttataaagatcgaaactgacatttttcagtttgtctgtcgtcatgccttttacttcgatcgcctttttggttttatccacagcattcggaacataatcctcgacaatgacctttccgatcatcatctgtatcagttcgctgcggtcggcgacctcgctgcgcggctttgtttcaatatgttttccatcgcgcaggaccgtaatgtaatccgcaagctccataatttcttccaaacggtgggaaatatatatgatcgtaatcccctgttttttcaaatctgctatgatttcaaacaggcggttgacttcttcttctgtcaaagccgcggtcggttcgtccatgatgataatgtccgaatccatcgcgagcgcttttgccatttcaacgacctgcctcttggcaacgctcagttcttcaatatactgcttgggcctgatcgtggaatcgatccggctcagtacgtcgaagaccttctggttggaactttttttgatgataccaaattttgtttcctcgagtccgaggcaaatgttttcttccacccgcagcttttcaacaacattcaattcctggaacaggcagccgatgccgcttttcattgcgtcctttgtgcttgagggattgaactcttttccattataaagaatcgtaccggaggtttttggatgcgcgcccgtcaatattttgatcaacgtagacttccccgcaccgttttcaccaaccagacaatggcatgaaccttttacaatgttaaaactaacgtcgtcaagcgccttgacaccggtgaaatgttttgaaatgttttttatttccaaaatatgctcaggcatttgaacctccatttctgatttttaccgtaaacggcaaatctttaactttttgcaggcaggagagataaactctcctgcctgcaatctgtttcttgctttctggtgcctgtaacttacgctactttgttgtccccgaacgtaccaaccaggtccagcttcttttcaggcatgtactgtgtgttgtaccaatcctgcatagactgtacggaatccttgtagtagttgaagtatgtatccggaactgtctcttctacgtatacgtcgttgtccatttcgccgttgatcagcttcatgatcatgtcgacctgtgcatacgcgaatgtctgcggctgcatgccgaggcagtacttgagcgaagacgtcgggtcggcgatcttattgagctcgccgtcggaagcgtctgtcgaagcgatgatctctgtctgcggaacgccgtctaccgctttgccgcggccggctgcttcatatgctgccagggcgccaaggccgttggaaacgttgtcgccgtaaacgatgtttacatccgggtactttgtgattgcgtcggaagtaaccttcgtagctttctcaaggtcgccgcctgcatgttcccagtatgtagcgcctgtgagcgtttcgccggcgctgtttttgaatcctctgtcctctgtgggcagatagtcaacgactgtcttaacgcctgcaaggaacgggccgctgcggttgtcgaagcagaacgcgatgtctgtccagcttacaaggcctacctgaacctgcttgtcaggataaagctcgatccactgtttcgccatgtcagcgcccatctgggaagcaacttcagcttcgtcaatgccgaggaaaggaactttttcgcccttcgccttaacattgtacgtcatgatgttgatgtcagcgtcacgtacttcgttaatgatctcgtcaacgccgtcttccgttaccggatgaaggataataccgtcaacacctttgctgatgaacgtttctactgcagcgatttccttattcaggtcgttatccggatcgataacttcgtatgtagcgccatactcttcttctgcatagattttcgcccacttcgcatcgttaccatgaacgtcatgcttcagcgtgatcggcaccttgccgataacaacgtccgtctttgctgcgccgccctccgcggatgcagttgcagctccagactctgccggactagctgccgactcggaagccgcagcagattcagatgctgccggtgtacccgtgcaagcaatcaaagctactgctacgagcataatcgcaataacgatagccaccaattttgtactctttttcactttcttattcctcctttttcatttatattcaataccggaaaccggtattacacaaattaatctccggtcactgccgtaatgcgctctaaaagcgcgtccagccgttccctgttcatataatagacggacgttccatccgaaaggaccatgaaatacgtatcctgatccctcggtacgatcgtcagcgcaagctgctgtccatccgtaagcgtcgtcttcatctgtgctgcgatatctccgtctttcgcgcccgcttcgtcgcggccatccgccaaaagcagcacatatttatagtaaattcccacgaagtcgtcatagtcgatcagcctgccatttaccgaggctgttttcgcctcgctgttgacttcgaagctatagtcttttccgcctatgttcatctcgatcgcgctgaccgcatctatatttgcccgcaacggcgagataaacagcaggctttgtgcgttcatctgcgtaaaatcgatatccgccgtatacagcatggcgatatcgtcttcaccgccggtgcgtacaaatgttgcagcgccggactcattgccgaattctagcgtctgctggtttccggaggcatccaccaaaatcaatgcttcgtttgcgctgtcaagccccatttcactgacgcttacctgctccaaatccggaaagcctgcgatcgtccatcccttgagcatttcgaggatctcattggtcacaatgcttcttgccggcgcttcatacggataattgagataccagttcttcccgtccgaaacaaggctcacgctcagttctccgtctttatagtaggcgatctgctgtaagttatcgctgtccaccgtaaagacattcttgtcccgataagccgccaggctgccgtcaagctgcgccacattagccgaggccgtaagcgccacgacattgctgtcttgatctttaacgtaagcgctgctgctgcttaccgtaggatttcccactaaaaagctgtactgcgctcccccgtccgttgtcaccttcacatccgctaccggctgctcgaacccgtaaagtccgatttcctgatctaagacgcgcgttatggtaaaatcattcagcgagtcgagcatcagcttcatcttatccgcattggtacggtactgctgcccgttttccgaaacgacccacgcatcatcctcaaggtcgaacgtatacgcgccatattggttcgtaagctcgatgtgcctgatctgctgcccgcccaaggaaagcagcttgccggaaatccgtggattgcccgaggtactgattgctatatatattgcgatcaaagctatcagtacaatgaccagtacgatgagctttttatgctttttcagcattgcctgtcctccccggccgttgcgtcgctatttgttctttctcatgcgccatacgaagatcgcgcctacgaacatcaccagcggcatcaccacgcagcaaatgatcatcagcttgataaaatccgcgccgcggacgaccatgctgtttgagttgattacttttcctgcgatcagagacgattcccgtcccccctgcagccaatccacactgttgacaagtaaatcgccgttcccctgcatggtcaggttcccatccgtcataaaattggaatccccgatcaccaccatgcgggaggttttttcgctgccgcttttttccacggcatatgcaaggtttatcggccccgccgtatcgtccgccgtcatatcgttgctcgcaatggacacatcgctgcgcatccaggaagaggctgacgattgtaacaatggcgttacttttatggtattgtcatgctccgtttccacgagtccgcgcgcaagcggcaacaccacatatttttgatcgttgatcaactgctgcgtgatcgcatggtcgccgtaccgtgggatcaggtacatgttgctcgtcgtcagatagtaagacgagtcttcttcaaatacaaaattatttgaaatatcgatgccgtagtcaagggcgattttgcccagccgttccagcttattggtattcgtattgagcgtcgggtccaccataagcagcatttttccgccctgcgccatatattcctccagcgctgcggcttcggcgtccgaaagatcctccgtcggcgaagcgacgatgaccattgccgcgtcctgcggcacgcttcctttttccagcagcgaaaggttgtctaccgcgtatgcgtcacgctcgagcatagagaccgcctccgtgatatccgtagccgttttcagttcgtcatgcccttgcaggaaataaattttggggagcgtttccgccgttacataacggatcgcgcccgttatctcgctttccccataaaactggtttccgctttcgtttgatacaaacaggtctgtcggtgcgatgaccctgtaacgcccgttcccgttgacgataatcgtaccgttcgcaacggcctttacatcgcccatttcgtatcccgcaaggatccccgggttcttatccacgtccaggaattccacctggagcttgggagagagcttttcatattctttcaggagcgcttccaccatcgcgtccttgttgctttccgaataaactgcgccgatctttaccgtgccgttaagatcgtccgtaaccgctttcgtctcgtcgctgaggacaaaaagctgttggcccgtcatgtcgtacgtccacggcacacggtaagcaagctgtaccccaaagacgacgatgagcgccaccacaacgatccacacgaccgatgtgatcataaattttcttttctttgccgcgataaccgactgctgctttttcatatttgcttccccctcagttaaaccggcgcttttccatactcttgatggtaagcagcacgaacacgaccgtcaggccgatgtagtaacagatcggccccaggctcaacacgccgagcgtaaactggtcgtattgcactgtgatcgcgatcgcagacagcataggcgtcagaaccggtatcgtcatggatttggtaaaggaagcaagcagcaccatgaagaacaaaagcccaaacgacgcgatcgccgccgtgatctggttgtcgaccaaggaagaaataaacaggcataccgagctcatcgccatccccagcaggaaaaatcccaggtaagaggacatcagcgcgccgaagttcgggtcgccgtacgccgcaatgatgccgacatataccaatgttgccgcaagcgcgatcgcgaacagcgttagcgccgccaagaactttccaagtacaatatccgtcattttcagcttggacgttacaagcaccatttccgtgcctgccgcgcgttcctctgcaaacagcttcatggtaagcacagggaaaataataaaagcaaaattcttcaaaaggtcaaacgttcccgccatgtcgccgttcccgccgagcaggttgtagatcgtgaacatgatacccgagagaatgaggaatacccccaaaaagatatatccaaaaggcgttgtaaagtatacggccatttcttttttgtataagtatttcataccttacgcctccctttccctgcgcacgcctgacgccgtcaggttaaggaacacctgctccaacgtaagctgcatgctcttcatttcaaggatgggcagctttgcgctcgcaaacgcataaaaaatacgtttgcgcagctccgccgtatccccggtagagatacaaaaccaactcgcgccgtccttgccctgctccgtatatgtaaattccgaacagtcaagcaagcccgaaagcacgtccgatgcttccttcttgtctgcatcgacaagcaatagaaatcctttttttccgagcgtcccttgctcgagggtttccatgcggtcgaccgcaaccacgcggccttcgtttaaaatcactactttttcgcacaccatatcgatctcggatagaatgtgcgtactgaagatgatcgtatgtttttttccaagttcgatcatcaggttcctgaaatctgcaatctggcgcgggtcgagacccactgtcggttcatccagtatcagtatctcaggcatacccataagcgcccccgcaagcccgacgcgctggcggtatcctttggaaagatgaccgatgacgcgctgctcgacgtgctttacctgcgcaacttccatcacttcgctgatacgcgacgcgcgttcttccttcccgatccctttgatttccgccatgaacttcaaatattccctgacgtccatctcgaggtaaagcggcggaagctcgggcaaaaaaccgatcttggcagcagcctcgcgcggattttccaccacgtcgaccccatccaccaatatgctgccgtccgtcggcatcaggtatccgcagatcattttcatgatcgtggttttccccgcgccgttcggccccaacaggcctacgatctcgcccttattgattttgaagctgacattttctaccgctgttttttcgccgtattttcttgtcaggttactgatctcaatcataccttctcctgcaaccgctttattatgcaatgtttaccgccggcatgactgccggcttgaacgccgagcctgcgcgtaaacttgcaaaggcgtcggcgccaatccgcgctgtcccgcgccggatatcacgaagcgcccgaccgataaatcttactttttcgatcaaatatttttccacttaagaacacctgaaagggtgttctttttttacagatggaaaaagtaaacctttacaggcagagctcgaacatctcgcggatgacagcctcattatagccgtattcctcctgctctccccatgcctgcgccgtcgcaagcgcatccggcgtcatcttgtcgatcgccgcactgtccgtgatcccagcttcgcccagcgtcgtcggcgctccgatcttcttaaaccatgcctcgatcgccgctatccctgcgctcgccgctatcatatcgtccccctcgcgcactccgaatacctcgcgcgcgaactgcgcgtatttcgccgtccgctccttcaggtaataacgcagcgttgccaaaatcgtcaccgacatcgccgcgccatgcggcgtatcgtagaagttcgagagcgaatgccccagaatgtggatgttcgagttcggaagcccgaacccacagtcgtaaaaaccacaccacgcaaacgacgcctgccacatcatcaccgcccgcgcatcatgatcctgcgggtcctttaaaagcctgtccatgcattccatgatcgagcgga

SEQ ID NO: 3 - DNA, 256167 bp, Christensenella sp.
ctattatagtacatttatttgcccaaactgtcaataaaaaatgccttatttttctgtgtttatgtgttattttattctgtttatttggtttttgatgcttttatatctaaaaaacaaaatttttttccccttttccctttacaattgcaacaaatttcgtataattatagtgtaagaaacagtatttttatcgtatccaaaacgaaaaacgacatagcgacaggagaatgcccatgcttgcattgaccagaaaaaaccagattcgtgagctcattcttgaaaagaagaacgttaccgtatccgagcttgcaaaattattttccgttacggaagaaacgatccggcgcgatttgaaatcccttgaagaatccggcgtactcatccgtacatatggcggcgctttcattcaagaaggcgttgtgaatgacatcaaaatggcgcttcgcgaaaatattttggttcccaataaacaaaaaatcgcaaaaaagtgtgcagaatttatccataatggcgataccattaccttggatgcttccaccacagccttccatatctgcaatgagatcaagcatatgcgtctcaccgtacttaccgattctcttaaaattgtaaattatctggctgagtacgataatatcaacctcatcgcgaccggcggtactttgcagcataattatcatagcttcatcggtaaaatggcccggcagaccatccgcgaatactatgtcgacaaagtctttgtttcctgccgttcccttgatatgacacatggcatcaccgaagccagtgaagatattgccgccgttcgaaaattattgatcgaacgtgcaaataaggtctttttgattgcggatcactccaaatttaacaaagtctcttttgtaaatatctgcgattttgacaaaattgattccatcatcgtggatgaacctctttctgacgactggcatgaattcttggaagagcacgaaatcaatctctatgaatgtgagtgatgaatcataatattttttggccgcctgccaaatattgcaggcggttttttattgccgcatgattacaataaaagcggcaccgccatacttagccatgccgcctttaccctgctgtatttctgttttatgttttcggaggattcaaaaacaaatgattatttcttagcagcagcttcttttttcttaaagatttcttttaaggattcttcaaacggtgcatacgcgatcccgtattccgtaatgattcccgtgatgttttgcgcatccgttacatcgaatgcaggattgaacaccttcacccctttcggagccattctttttttataccacatttccgttacttcttctgccggtctgagttcgatatggatatcatccccgcttgcgcagttcatatcgatagtcgaggtcggcgcgcatacatagaacggaataccgtaatacttagcagccatcgccacataagacgttccaattttatttgccgtatcgccatttgccgctaccctgtcacatcctacgaagcaagcgtctacccagccttttttcatgacggatggtgccatgttgtcacagatcagcgtcgtatctattccggattcatgcagttcatacgatgtcagtcttgctccctgtaaaagcggacgcgtttcatcacagaatacgcggaaattatatcctttttcatgccccaaatacatcggcgctgttgcggttccatatttggacgttgccagttgtccggcgttgcaatgtgtaagcaggcccatctccggtttcagcagagataatccatattcaccgatagtcttgcatacccatgtgtcttcttccttgatcctgactgcctcttggtgcagtatctctttgatttccgcaacggatttattcttattggccttgactacgtcctccatgcggtttaaagcccaggaaagattcacagccgtcggacgcgcagagtccagatactctttcgcctttacaaattgggcataaaaatcttcaaacgtattggcactgatctcttttgccgccagataaatgccgattgctgccgccacaccgatagcaggtgcgccacgcacctgcaacaggtaaatggcgtcccaaatacttttctggtctttcaggcgcaaaatctccgtattatacggcagttgcgtttgatcgatgatcaccagtgcgctgccttcatcgtcaagcgccacggtatcataatccataatactttgcttcattcttttcctacctcatccaatgaaatttccgctgcaacggactttaatttgtcaatataatccttgcctgtcttatattgcgtcctgttcatgataaaatcttttgcacacaggatcacgatacgctccgcacgcatacgcttcctttcatcatgtatcgttgtcaggtccttgacctgcgccatccctacggtacggcggttcatttcaagaccggcaacccccgccgtatctgcaagcaccgtatcgaggaaataatccctatatccgggtgtctttgccatcggctcagttacgtttgcatcaaacgcccttataaacttttctttgaacaagtctatgatattgctgactgtgctttcgacccatcctaaataagcagttttttccgcgcggtcgtcaatcgtagcatcgccgtttgcccatgcaaatatcatgtttgcaaccacattaccgatatcatatcccattggtccgtaaaaagcaaactccggatccatcacgcgcgtagagccctgtttgataaataccgaaccggtatgcaaatcaccgtggatcaatgactgcgcgttgttcataaaatcatatttcagctttgctacctcaaggtgcagcgccttatcgtcgtataatgctttcttcacaaaatccgcattcgccggaaacaccaaatttcggccaaggttgtcgtcgtaaggctccgtataaacgagcggttcagatatatctgcacaaagctgcgggttgatatatcgcttcaccatttcttttttctcttttgaatccatcaccctatccgtcgtgagcagcaggctgttaaccaaaaaggttgtgatatcttctgcaaattgtggaaattgttcatgcttcaaaagcgccgcgcgcatgacctggtgatcggaaaggtcctccatcgcaaaacagttcatgacagggtcatacatgtaaatatgcggcacaagccccggacataatttcccttccagcgtcaaaatttcaacttcaattctattgcggtctgtcgacagcttgaaatcagaagatatccttgcttctacacctgcctgtttgacgataaccgatttgcccgttgtttcttcccatatcttaaatacataattcaggttgccgtcgccgatctcttttgccttcaatactgcatcttgggggaacatatctagtttttcttttacatattcgactacgtcatccgtactcatcaaaaaatacttgccaaagtcagccatgatacttacctcctctattggtaacatgatacaatggcgttgttacacccgtcgtaatcatgctgtactattggtggttactaatttttcttacgcgcgtatgtcagggccaatgccgcggcaagtacgccgcctttcacgatgtccattgcataatatggtacggacatcatgataaagccgttatccaataaaccgaccaacgccgcacctgccaaggtgccaaacgggttcgcctttcctgcccctgcaactgagaacccgatatatgccgctgcaacagacggcataagataagcgtctcctgcctttacctgtgaacttccgatatatgccgccagcataatgccgcccagtgccgcaaagatcgccgagaacatatatgccaggacacggtatttgctaacagaaataccggacaaacgtgctgcttccgggttaccgccgacggcgtacatgtaccgcccgtgttttgtataagtcaggaaaaagaaggcaaacacaacgacgatcagcatgatcggaattaaaaattcagcttttccgagcgctttgaactccgccgggatcaggccgggagcctgcgttccatcgggtcgcatcatacgttctgtgatggcgccgccgcgcgtataggtcagcgctacaccctggaaaatgaacatcgtcgccaaactggcaatcatatccataattttcaattttacaatcagcaagcagttgaccgccgcaacggataagcaaacgactaccgtcgttaaaatggacagtcccatgctctgtacgccataccatacgaacattgtcgtaatgaaagcatctgcaaagttggcatttgcaccgatagaaaggtccatgccgttaacggtcaatgagaacgtcaatccaactgcgattaccgtcgtgatcgaaatgtttctgaggatcgttatcatattgtcgcccgtcaaaaacatccccggcattgcgaacgtaaagaatataaacaataccgcgatgattaacaacattccccagtttgtaacaaaatcaagcggggaacctttacttttcttttttaatgcagcctctttcggattcatattaatttcctcccgttgaatagtatagaagctctttttcgccgatgtcctcaacatccagttcagctactattttcccatcgtacatgacataggtacgatccgctatcgccaatatttcgctgaattcacaggaagcgtaaatgatgcctttcccattggcggccagacgctcgataagctcaaaaatatcgcgctttgcccccacatctacaccttttgtcggttcgtcaaagatataaatctcagcatcagaattcagccattttgcaaccgcgaccttttgctggtttccgcctgacaacagggcgactatttgattttcgctgggggttttaatacccagctccttgatcatctgccgtgcgtcttctttttcttttgacttattcacaacagaaagcgcaccggtatactttttcatcgctgcaaccgtaatgttgctgtatacggggtctttgatcaagacgccttcttttctgcgttcctcaggcaccaatgcaagcccgctcttcacggcagcatggggatccttaacggtaatttttttgccgttcaattcgatcgttccgccgctatgcttcaacgcgccgaaaagcgtcttgcaaagttccgttttacccgcgcccacaaggcccgacacgcctacgatctctcccctgcgcaccttcatggaaatatctttgattttctcttccttctccgtcaggttttctacgttcagcaatatttcgccgatctcaaccttttgtttcggaaaattttcatcgaatttacgtcccagcatatattccacgatctggttgaccgtcaggtcttttgtgagcggaaggcttgtaacattttttccatccttcatgatcgtgatttcttcgcagatttcgtaaagttcgttcagcctgtgggaaataaatactacgccgacattttgcttctcgatcagctcacgaaccacgcggaacagttcttctgtttctgtattggaaaggggagccgtaggttcgtcaagtatcaaaaacctacagttttccgctacgcagcgcgcaatcaaaaccatctgcttttgcgcaagggataactccgaaacaaccgtgttgacgttaatgtccacattgaatcgtttcaaaactttttttgcctgcttgcggatatcattccatttcacaaactgctttttccccatctcgttgaccataatattgaacataacgttctccgctacggataaatagggaatcagcgctgtatcgacctcctgatatacaatcgcgattttttgttcaaccgcgtccttcggagacctgatctcgatcggctgcccgtttgcataaatctggcctgtatagtgtgtatttgcccctgccagcaccttcataagagtcgattttccggcgccgtttgcgccgaccaacgcatacgatttgcccgtttccattgtgaaatccacattggacagtgccttgacacccgggaactcgatcgaaatgtctttcatttctatttttacattctccatctgtatcacctgcctatcgtatgtgtaaattaccatgacgataaagaatttaaacttttaattgactctccatctaaccaatgaatctattatgaaaaaataaaacagaattgtttacattagatgatactggcagccccgaagcagatggagtgtctctttttcggggcaagccagtacattttcatttagtagcagtaaatcttaatacttacttatttcccgttttgtgcgcggagcgcatccatccacggtgtgttgagatcagagatgctctccagcgtaccccagccatcaacaacagtgttcaggttttccatcgtgatatctttgttgagctgagaagtcttcacgagctgcgcatccagagtgtaataatccggcgtttcttcgccggccagtttcagggcgatcagcctcatgttagcaatgccgatcagcttcgggtcgacagccgccgtagagatccatacatccggattttcaagcatcaggttaatgtcgtcgttggagatatcaattgtaaacatcgggatatctttacgtcctgcgtcattcaatgcctgcaaaacacctttagcgagttcatcatagcaaccccagatcgcatctacggaaccttccggatacttcggcaggatcgccgctgtcttcgtcgtcatgtcgccgcgcgcgttcgcgctgtcagaaggagcgatcgtttcaagtgtctcgatgaggccttcgccttccatctttgtatagacttcgttgcgtctgtcaagcggaggtacaccagggcccatgaatgtctttaatatcttgcagggttttttgttcactgtttcgatcatatctgtcagggataaggtcgccagcttttgatcatcctgagaagtggatgtaacgcctgcaagaagttcattgtctgcattaccgtccttgaagggcatcgtatcaaatgtagagatcaccatgcctttatcagcagccggtttcagcatctcataggaatatgagagttgtccgtgggaaacgatgataccatcgtaatccttctggatacactgggcaactgtctgctgcgtttttgcatcatcaccgtctgttacgaacgtatcgaccgtaaatccaagagcttcgccttcagatacgcagcctgcgaggaactgctgcgtgtggtcaccgtttgcaaggttacgcacaaccgcgatctttttgccgccctgtacgccttccgggattgtagcatcgccgccggcagcagccgactcggaaggagtctcagccgattctgacggagctgccgcagattcggaaggggctgtgcttgcgctttctgaagctgccggagcagcagtacagcctgcaaatactgttacgagcattgcaacagcaagtaccaatacaactaactttttcataattttcctccttattgaatagcctcaattcatttatgcgtcactccaacacatattaatgaaacttatgaaacgttttaaatttggggcaggattccttccacatccccatgcggactgggaatcacatgtacgccatagaggtctcctactctcttagcggcagtcgcgccggcatcaaccgctgctttcactgcgcctacatctccccgtaccataaccgttaccagccctgagccgatctgctgcttgccaatcaagcggacatttgccgctttcaccattgcgtcagctgcctcaatagccccaatgagtcccttcgtttccaccattcccaaagcttccttttccattgctctgcacctttccttaaaaaccataccttttcagtcatattcgtataatatcgaatattcaggttttacacccgaaagggtgtctttttttgcccttttttgaatgaccgaaaaggtattcttattcattcgttatgtttcgcattatattacttcgttataatcatcgataaagccaacaattgccacatctaccggcggttccggcttaattccaaacatcagcgccgcttccttgcggcctatcatataaacaagatcaccgatccctgcctgtctggtcgcatctcccgcaacaatcaggttcttgtcttctccattttctatcaaacggacagctaagagcttgattcctgtaagccgctcgtcttttatagtggacaccacggtcccttctaccctgcctgtatacatccgctttctcctgctatataaaattcaagtctccatagagcacacaccgccgtgcgcgcgtaaatgatttcgcactggtaagtccctctcccgtaggagtagcaattgtaaatgtcgtatatccctcgccgcctacgccaaatccggcggatgatggcccgtttttcacaaatatcgttgtattaagggcttttgccgccatcgtcaggtgatgtacattcgtggaatgtatcatcgccgagtgcttgcatcccgcctctgcctttaccgcttcgctgattgcttcttcgatggaccgtacccttgcaatccccattacaggcatgagcatttcaactgtaacaaacggatgtcctgccggaacgtcggcaatcacaagccttggttccccgctgaaatccacaccgcttgcttttaagatcaccgcggcatcttttcccaccattttgcggttgattacatattgcccgccttttcgctccaacgttgcatcgacgattctttgtatatcatcgccatatgcccgaaacgctccattccgttccatttcgctcatgagttgctcagcgacggaatcaaatacaaatacttccttttccgccacgcacaatacacaattatcaaagcttgcgccatctacaatatcccgagccgctttcgcgatatctgccgtatcgtctacgatgaccggcggatttcccggccctgcggcaatcaccttcttgcccgtacccattgctactttcactaccgcttccccgcctgtgatagataaaagcttcacatcaggatgcatcatcactttcaagctgtcttccattgtcggttcttttaaggccgttacaagtgaagccggtccgccagccgctacaaccgcttcatgtacgatgcgcagggtttcctgagaacatttttttgccccggggtgcggattgaatactacgccatttcctgcagcgatcatgctgatcgaattattgatgatcgatgacgtcgggtttgttgagggtgtcaccgaagcaatcaccccaaacggagcctgctctatcatagtaaggccataatctcccgtataggcgacagggacaaggtcttccgtccccggcgtgcgctgtgatgccaccgtattctttacaattttatctttcactttgccaaaaccggtttcttcccacgccagctttgccagataccccgcattctttttggtttctttcctgataaaatggatcattttccggcgctgctcaagcgtcattcccgccaaaatatgctgcgcattctttgcagcctcgactgcctggtttgcggtatcgaacaaataatcattattactatttaaattctctgattgacttccaataccagcaaggatttccttcacaatacattcaatcgtctctgtctttatatccatgcataaccgctttcttatacaattttagcaagtcgtgtaatatttatttctatgtgttttttgtttatttatgttgttttatgtggtttgttaattatattgtaagcgcagtttttaattttgtcaatgttttagaaataaaattattataaaacttttttgtgcggatgaatcccgattttaaataaaaataatacggcatttacataaattaaataccgtattattagacatattttaggcaaaagtaaaaatcagtacaaatctttcgcggatttggtgataccgtcgaccgtataataatcgattactcctgcaattgtatcatcggcaatcaattttttatcgtccataaccataacggcagcaccgccgtcattattcgttaagacaatatcgccaattcccgcattcgcgccatccagagcaatatgacgcactccctgcggcctgccattcagatcaaggtattccacgatcatcaacttgtatccattgaatcgttcatctttgattgttgaaaccacattcccaacaacttttgcgattttcaaaacaaatacctgtttattctacgtgcggcagaattccttctacatcgttgtgcggtctcgggattacatgtacgccataaaggtctcccaccctttttgccgctgttgcgccagcgtcaaccgccgctttaacagctccgacgtcgccgcgtaccatgaccgttacgaggccgctgccgatttgctgtttgccgatcagttttacgtttgcagcttttaccattgcgtcagccgcttcgattgccccgatgagcccctttgtttccaccattcctaaagcttctttttccatcttttttctccttacacgtttattactgtttaattttttctgttcattacccaatgtgcggcaggatcgcttccacgtcatcatgcggatgtggaatcacatgcacgccataaaggtctcccaccctttttgctgctgatgcgccagcatcaaccgccgctttaacagctccgacgtcgccgcgtaccatcaccgttacgagaccgctgccgatctgttctttgcctaccagcttgacattcgcagcctttaccatcgcgtccgccgcttcaattgcgccgataagaccttttgtttctaccattcctaaagcttcttttgccatttttcatatcctccgtttacttaaacatgacttactaaacaattgcatttatgatatcaggatgcggcgaagggatcacgacgctcttagacatcagtccctgtacctcatccggactctcgcccgcttttactgcggcttctaccgccgctacgtcgcctgtcagcagcacaaacgatttcccgcccataccacgccccaggcggacttctaccagttttatatccgctgctttcacactggcatcggcagccatcacagccgccgccagggaaaatgtttccaatatgccgatcgcacctacggtgccaacgtcgctgcacgcattgatcgccgtaaaaacattgggatgaacatgcgggatgacgatgctgtcgaccagcgtatcctgtgcgcattctgcgccagctttcacgctttccttcactgccgcaacttctccgccgatgatcgtgataaacttgccggcacacaccgtctgcgccgttatgagctctacttgtgccgcctttagcattgcatcccctgcttcgattccctgcgggatactcaaaacctccagcatacctagtgcattcatcttgcccctccgtttaagcggatctcaatatatgtatccgttatatctgttaccattccgctgatgctcgcatgtaccttagcccccagcgcgctctccggaatgtcggcgatcatctgccctgtgtttaccatgctgcccgtagctacaacgggaacagacggcgcgccaatatgcatcttcaaaggaattctcacccgatccggctgcataacgccgcttgcaaacggagccggcacatcatattttttaacgcccagacggctgatcatacgcgatacaggtacttttttaagttccagccccgggtcgaccctgccatacacttcttttttcggcctgaggcccgccgcccctaaggactgcttgaacatccccatcattttggaaggcttcaacccaaagttgcatgcgaaatacgtgcaaataccacagtcacagcatgaaaaaacgccgttgacgtctcctaaaagcgcgccctgtgcatttgcggcggcacgcatcgccttatgcggttccacgcgtaatcccaatgcatttcgcgggcacaattgcgtgcacatggagcattggcagcacaccgcctgcgccagtttgatatcttccttgctgttattcccttttttagcgatcaggggatgatccttcctgaaaaccagtactccccctgtcgttttggtaaccggtgtttcccagtctcctgacaacgctcccatacaagggccgcccagaatcaggatatattcgctcctgtcctccggtccgcctgcggcagcgatcaaattgctgaccggcgtaccgatgggtacgcagaaggtcgccggattgtccacctcgccgcttaccgtaacaaacttatccgttacgggctcatccttcattgcatgggcaatgttgacaagcgtactgacgttgcagacgactgccccaacatcaagcggcaatccccccgtaggtacgacacgccccgtgatttcataaaccatctgctgctcgtcgcctgccggataataacttttcatctggtgcagcttgatcgtatcatcatggtccagcgcagcctgcaaagcgtccactgcgtcatggtaatgggattttaaacagatatatccctgctgcgcccctgtctgttgcatgactgctcgtattccattgattacatcctgtgcgtaggcagccatgacctgctggtccacccgtaaaagcggctcgcattccgcaccgtttgcaatcacatattcagctttacaattgatttttacgtgggtgggaaatcctgcgccgcctgcgccgacaacccctgcttcacgtacttttccgacaatatccattcaaacgcaccttatacgattctaaaatccccctggagcacacaccttctggagcgtgtaaacgattttgcgctggtaagcccttcgccggtcggcgttgcgatcgtcaacgtcgtatacccttcgccttcaaagcccaaaccggcataagacggcgcgttttttacaaagatcgtcgtgttgagcaccgatgccgctttcgacatattgtgtacgttcgtcgaatggatcaatgccgagtgctgacagcctcgttccgcgataaaggcttcatcgatcgcttcatccacgttggctacgcgcaccatgcccagtacaggcatcaacatttccacgaccacaaacggatgctttttatcgacctctgcgatgatcaaacgcggatctccgctatagcttatcccgctgtccgtaaggatcctgcctgcattactgccaacatatttcctgttgatcacataatgcccgtctttattgacaagtaccgtatcgatgattttccggatatcgtcgccctgcgctttatagcatccaagcggtaacatcgccgaaaccagggaatcaaatatgttgttcatcgcaaaaacttctttttccgcgacgcataatacgttgttatcaaagcttgccccgtcaacgattgcttgcgcggcacgccggatgtccgccgtatcgtctacgataacaggcgggttgcccgggcctgcagcgatcacctttttccccgttttcatagcgacgccgacaaccgcttccccgccagtgatggacaagatcgggatatccttgtgctccatgatgattttaccggactccagcgaaggttccctgaccgtagcgatcagcgccgacggaccgcctgcagccgagatcgcctcgtttaagatacgcatcgtttcctgtgaggcatgctttgctgaaggatgcggattgaataccactgcgttgcccgcagcaatcatgctgatcgaattgttgatgactgtggatgtgggattcgttgacggcgtgatcgatccaatcacgccgaacggagcgccttcgatcagcgtcataccgtgatcccccgtaaatgcgacaggttttaaatcttcgatacccggcgttttctctgcagccagcctattcttcaatattttatgttcatatcggccataaccggtttcttcgttcgcaagctttgcaaggtgttccgcattttgcagcgaagcctgacgcatcgccgcaatcagtatcccgcgtttttccagcgtcatccctgcaagctgcttctgcgaagctttcgccgccgcaaccgcttggttcgcgtcgtcaaacatccatgccgacccgctgcaaccgcacggcgcagcagatgtgacgccctttaaagcgcgctcaaccgcttccttaatcatttccctcaattgaacatccgaatattccatgcctaaacaccctctctatatcttaaaaaatcccatttatttattcttttttttactgcgttccctgcgcgattcacgtacccgctcaaaggtatcctgcacttcctgttcggcagtttctgttcgttccacagcaatcggctccgttacctctgccgcttcttcaacatctacttttactaccgcattgtcctcagatattacgacgatttcttccctcaccacaggctgtgtcaactccggttctttggctttttcctttatgtcgcctgctttgtcaaacaaccgccgtcccagcacgtcaacgctgtcaataattgccacaatcgtattatctaccggcttcccatccgtaagatcggtttgacgcgaagaacttccgcccacgcacatcacgacttcaccttcgcccgcgccaatcgcgtcgatcgtaacaaacggcgcgcctttttcttcgaaggtatccatatcgacgggaacagctaccaatattttcatgccctgcagcttatccgactttctagtgctgacaaggctgccgactactctcgctaattgcatgtttctttctccttttgtcttgatccatagctgtcctttgctttatcgtaagtctgtttttctttgatgtttatgtaatctacgattccataaacgctgtaatcagatgcatactgttttgaagtatccgtctggcgggcgctgcttccgtatgcgcacatcacgatgtccccgtctcctgcgcctacatcgtcgatacagatcacgtattcgcctttttcctcaaacgtctcgatgtcgaccggctgaacgatcaacagctttgcgccggtaagcttatccactttattggtactgacaaccgttcctttcaccctgcctatcagcatatcgttctcctgtcatccaatcgaaatattgagctctgccgcacgttcccgtgcaagcggcgtaataattgcacccgtcgcacacataacggaatgtttcccgcttttgcgcgcttcctcgatgtcattttctgttaccagtgtgagaatacctgtttctttctctcctgcgcagctatattgtgcaacttgcatccccatagaggtcagggaatctatgattgtccctatcttttcaaaaaacgtaccgcgtttaaatttcggcgtatcaaagtccaacaatatgctgacttttctgccccacaaaagcgcacgcagcataacatgctcgataaagccgtcgtcgtctccctcagcaattcgctttaagaggttgagcttcggcgtaaccaaaacgatcctgcccttggaagctgccttttgcagcaacagcttctcgtccgacttatcttcaatacgcattgattccaagccaaaaggaacaaaatcagcatcgccgctcaaagcgcattcaatatcttctccatataacgcaaccagcttttcattcgccgtttttggcgacgggacatatgtcgtaaaaagcgcaagcgtccccacaacatgttcgtcacgaggcatttcccgctcgatgcggtttaaaacgctgtccacgatacagcgaactaattcatcccagttatccgtttgcatcatctatccgacaatctccatataatcgccattcttaatgagcgccgcattcgcttcgtccatatccaaatgcacttccagttcgtggccttcgcctgctcgtaccagtacatcctcgaacaccataggacgcgccccgccaaaacgcaacttgaccgtatcgccatttttcaagtggtattgctcagcctgtgacgccgaaatatgcaaatggcgctttgatatcataaggccccgctcaagttcgacagtccctttcggaccgatcaccttacagcccggtgttccctgcacctcgcccgacatatgcacgacgatcggcacacccagcttaaaggaatccgtagcagatatttcaatttgcgtatccggccgttccggccccaatacccgtactttctcaatacagcctttcggcccttggatggtcactgtctcgtcacacgcaaactggcccggctgtgagagcggtttgataggagtaagctgatagcctgcgccaaacaatgcttcaacgtggccgcgtgacaaatggatatggcggttagacacggccgcaggtacgatccgcctgccagtctgctccatcagccttgcaacaacttccgtttcaataattttcctgattgcgctcttatccatttgattgatacctgttttttaagattgttttccaaaaaattccacagtgttctaaaatcgctggaaaaccagcgtttatcaatacttttatattaatcgttcctgcaggcgttgtcaattacttttttgtgtttttgttgttttatgttgtttctttcgtagttttattttagttcacgaaatattcatttgtttacaatatacctttttgctataatgaggataatcttaaaacaaggacggatcctataccatgagaaaaatcattacctgtatgatcgtattatttctgttttccgcattaatcatgacagcgtgcgctaccatgccttccaatgaatcttcgtcaacaccttcggaacagaaagctgcggatgctgccgcatcaccttcatcttcttctgcatctgatgacaaaagcgtatctccgcaaatagatacaacccttttgtccgatccatggaaaatggaggatttcggcgatattgcggatatgaaaaattaccttttttattattctaatcctgatatcaaaaatgcttctattgttatgacgcgcgctgatcattatgaagaccgcggcgacgaccttacgcaggaattgaaacggaatgtcgatacctatatcaaccagaccctgaaaggttctatgaaggaatccagtgctacagaacctgtttactatgaaatagacggttatcctgccgcttcctttgacgtaaccggtaccttgcaggacggaagcacggcattcacggcgcgcaccgtatttgtagctaccgataaaaaaatcttttgcctgcaactccaggacagcgtagaccatttcgatcaatcttccggtttatttgatcaggtcaaagacagtctctcaatcgtaaaaaattaaagtgaatgggaaataaaaaaaaccgctgtcagcggtttttttattttataaacatcatagaacttttaggaaaaacaattgtgaccgttgtcccacgctccttttcggattcaatcaaaagcccatggccaagcttctcgcataattttttacacaaataaagcccaagtcctgtagagttttcctctttcctgccattgctccccgtaaagcctttttcaaatacgcgccccaattcgttttccgtaattcccatgccattatccgttatgcatagtttaacacaatctcggttggtttctccggttaccataatcacagcatcccgcttatcactgtatttgattgcattgacaaataattggttcaacacgaactcaatccattttgcatccgtatataccgaaaacccctcgaccgcggtttcaagtcgtatatgcttttcaataaatgattgcgcatttctgcgcgcaaccgaaaaaacaacatcctgtaagtctgtctgccgtaccatgtaatccttttcgaccgtattgctgcgcgaataaaacagtacctgctcaaccagttcctctattgctccaatatcttcattgatctcttccgagacccgatccttatggttctctaaaattaactttgaggaagcgatcggcgttttaatttcatgcacccacatctcgatgtattcacggtattcttcctgtgcataacggtactttgcaatctcttccagcatcgccttgttgacgattttcaaaacatcataaaagatcatgcactcgcggatttgcggtttttccattacctccgcaagtagattcttctgcttaagcgaatccaatacctccagcagattcttataaaattgattgcgccttatatagtctgcaaccagaggcgcggccgtacccgtaaccagcaggacggtaaaaaacaataccagcgtcgcatctgccgatagtaacgccagaagcaacggaatcccaataatcagcaacagcccaaaaatcaggaatacgaatttgtcctttagataatcgcttaatttcattggagcaaatatccttgtccccgttttgtttcgattacctccctgagcccttcttcctccattttctttctcagcctgtttatatttacgctcaatgtattatcatctacaaacatattatcattccataaatccttcattaattcctcacgcgatacaatattcccccgcttcgacgcaagcgtatgtaagatgcgcacttcgttttttgtcaattctatatccctgcctgcaaattccaaaacgctgcgtgacagattcaaagcgaagtccccacaattcactttctcctgacttttgttcgcgcgttttaacagtgaattgatacgcgcaagtaatatctgcgtattataaggcttggtcacaaaatcgtccgcccccagattcatactcataagctcatccatttccgtattgcggctggttacgatgataattggaatatccgataccttccgaagctcgcggcaaatagagtatccatccacccccgggaggttgacgtccaaaagcagcaagtcccctttctcggcaagaatgtcgtccactaccgaatgaaaacgttctacaatcgccgtctggtatccataacgctgtaaaaagtcctgaagttcatttctaatcttatggttgtcttctataataattattttcatgtcactattataatcaaaaaggacggctgcaacaatgcaaaaccgcccttataattcttaagaattactgaattttcagttcaaaccagaaaacgcttcctttgccttcctcgctgtctaccccgtaatgcgccgcatgcatatcgagtatacccttcacgatagaaagccccaatcccgtaccaaccgacgcacgcttatgagtcttgtccactttataatagcgctcccagatatacggaatctggctttccggtatcccttcgccgtcatcttctacttcgatcctgacaacactatccttatccttaacaagctgccgtaccgtgatgttttttccttccccggcataggtaatcgcgttattgatcaggttatagattacctgtccgattcgcgtctcatctgcctctacgatgatatcgcgatcgctttcaaatgtgatatggtatccttcctgctcctttagttttgtatagcgggacatgatatcacgtatcatctgcgtcaggtcaaagcgcgttatattgggttcctgcgtccctgactgcagctttgaaaggtccatgacgtcgtttacaagcgtcgtcaggcgccttgcctcgtcaataacaatctgcacgttctccggcgtgttttctcccggcaggtcgcgcatgacttccgcatatcccgtgatcatcgttagcggcgtccgcaggtcatgcgaaatatttgcaatcaattccttcctcaaattgtccaccttggaaagttcattggctgcgtaattcagcgtcgccgcgagttccgcgatctcacggtacccctcgccgtcaaaatacacgtcatattccgctttcgccaattttttagcggctttattgatttttatgatcggtttaccaacattccgtgaaataatgagcgcaataataagcgcgcagccaatgagtatcacagtaatatacaataattgtatccgcagtgtttctactgtggaatcaacgggtgtgatcacggaatttaatgcaagcaacaatgtctgtccgtctgccgcagtaatcgtctgggtatagatcatactttccataatcccattatcctgaggcggcacatcacccatgaaacgttgcgcgtcgtattcactgcccgaaaattttttctgagggagtatccgcagcatgctcccgccattctccttcgtttcctttgccaggatagaaaattgaaaagccggcattttatggatcacgcaatccggcataatatcagaagaatacacgtcctcaccactttcgtccgcaatgcgaatacataggtcgtaccggcgggaaacgcgctcgatcagcgtatcaatatcctcattatcgatgttctgctcgatccactgcgccgtttgtttgatttgaccctgcttgatcgcctggtaaaaatcattcaggaaaacaatctgaaacagccacaacaacaggatcattgcggctgcaaatataaggatatagataaaaattttccatttgatactgatcttcttttgctcaggcttcaaaacggtatccgactccccttaacgtgacaatatagtctcggtaatccccaagtgcgctccgaagaagttttatatgcgtgtcgagcgtcctatcgtcaccataaaaatcatatccccacacctcggtaatgagcttctcccgcgtcagcgcgattcccttgttcttggccatataatacaaaagctcatagcccttgggagataattccgccttcactccatcgacatagacgatcatcgcggatacgtctatcacaattccgccaaactccaatagctgcttttcctgttcgcttttacccgccctggataaaatagcacggacacgcatcatcaattccttaggtgaaaatggttttaccacataatcgtctacgcccaattcaaatccatgtattttatcatattcttcaccgcgtgcggaaagcatcagcaccggcgtatctttgcccaactcacgtattttggaacaagcggaaaaaccgtccagttccggcatcataacatccattataataaaatcgtaatcatgcttttgacacatctcgactgcttccataccatcggcggcctctgctatttcgtagccttcaaactcgccatacttacggatcaaggaacggatattttcttcgtcgtctactacaaggatcttttccatcattattaccgccatttttcttttataatactataataaacgctcaatgtgaacatccggtgaaaagaagtataaaaaaagcagccgcatggctgcccttttttattttaattttgtttgttctaaaaatatttcatattgccgcttcgcatctgtattgcacaggggaatatactctttgacctcacacgaccgcgcacatacttccctcgcctcacgcaaatctttgagcaggccccttccgatccactgtgtcagcacattcccgattccggtcgcatccgccggtcccgcaaatatcttcttcccagtaaaatccgctgtcaactggttcaggaaatcgttctggcttccaccgcctatgatatagattccactataagtatgcgccgtcagcttttcaatcttttctacgacatagcggtacttacacgcgaggctctgcgtcacgatacggacaagctctgcatcatttcgaggggcataaccgttctccctgcataactcggctactaccgcaggcatatccgcaggttcgaacagccgttcatcatccggatcgatatatattccgtcgcattgtatccggcttgccatatctgcgagccctgcaaacgtataatcctttccctgctgcttccagatgcgcacgcattcttgcagtatccacaagcccattacattgcgaatataccttacgcgtccctgtacgccgccttcattgccaaagcccgcttccatgctttccctagtcataatcggctttttgagctccgctcccacgagggaccatgtaccgcttgaaataaagagaaaatcatcatcgccgcgtacaggcgccgctgctaccgcagaggccgtatcatgcgcgccaaccgcatagatatccgccgataccgtgctcagttcatcgcatatctcgcgcgcaacccgtcctaccttatctcctggacatacgatctcggaaaaccagtcctgccgcaggccataagcgcgaaatatatcgtcatcccatttgttttccaggatattatacaggttcgtcacgctggcaatcgtgtattccgtatatttcttcgcccccagcaaataggaaagataatccggcacaaacagtaaatcctgcgcgatcttcaaaatatccccatcctgctcactggctgccagcagatgataacatgtttcaaaacgcgcaaactgctggcccgtcttttgatagacttcatacttcggcatcaatttgtccgcgcgcccgatccagccttccgtcctgctgtcacggtaattgcgcggcgtttccagcagcgtaccgtttttggtgagcagcgcataatcgttgcaccatgaatcgatcgcaacggattctatctttccgtcaaattctttttgcgcgatccggtagcctgccttgatctcgtcaaaaatccgcaaaaaatcccagtatgcccgtccctttaacagtacgatcttgttggggaatctgtatacgggcgtaaacgtcgcctttccattttccagcgagccgacaaacagctttccgccgcttcctccaaggtcgaccgccaatgcaaggttctgactcattagtcttcgatttttgctgccgccattctgactgcgctctcaaaaatatttgccattgcatcgcattctacgcgttctacgatgctgtacgccttattgagcgtcggtccagccgcaacgataccatgctgcggtaaaatgccttccagacccattttctgcgcgcgttcacggttcgccatgaaatactcgtttgttttgatcgcaaggtcttccgtatacgcccacgcctggtggatcacgccgcaatcgcccatcttcatcgttgcttccgttacggaaggaatcggcttgctgaaagctgcaaaacacatcgtaaactgcggatgtgcgtggatgaccgcgccaaattccggaaagtttttcaaaagcagcgtatgcatccggctttctctggatagtttttgcgttccttcaatgatattgcaatcataatcgatgatcatcaagtcttccggattgatacagcagcggtgatgctcggacatcatggacggtgtgatcagtacgcggttatccgcaacacgcacagaaacattgccccctgccgcattcgtaagtttgcggtcatacaagtacttgatgatttccagcatttcttttctctgttccatataagacaattcgcacattttttgatttctcctgttctatttaaaattaattataattcttcgattactacatctttttgcagttctttcgctttttcgatatcaaaaccgaccgtctgattactcattgcacacgtcgcactaagcgctgttgaaaaggccagcatttcatgcaccggcatctgcgtatattccagacagtaaatcagcccagtcagcagggcgtcgccgcatcctgccgtatttccgacctgtaccttaaggccatgcccgcgatacgttttgccttcataacggaatacccagccgtctccgcccatggataccatgataaccggaatatccggcaactcatccagcgccttaaccactccgcttgcatcgcatacgtcgcggcctacgagctctgagagctcctcaagattcggtttgatcatatacggcgcatattctatcccttttttcatgaaagcgccggaactgtccagatatagctttaagcccatttttttggccatctgtaacagcttgacctgtacttctttatcctccacattggaggcatcgccggcaatcaccagtatatcgccctgctgcatatcctgctccatcattcggagcagctcttgtgtcatttcggcggtcagggtcgtgccccgttccgccataaaagtgcaattcctgtcgttatcaaccacgaggtagtttgtcctggattcaggtgtttcgtaccacatatattttgtctgcacgccggactcctcaaggatactgataatctctttccccgtgcttccaaacgcgacgccgaatgtacggttttctacgcccagcagcgaaaaattatacgcaagatgcgtgcctttgccgcccatacatttttctgtttttttgatccggttcatgcaatcgatattgagtgcatcgagataaataattttatccatcgccggattcaatgttactgtattgatcataattactcctacttatctgcaaaatcttttaacttcgcatattgtaatgtgcctgctgatatgataaaataggaaagcagttttaaaggaagccatgccggagtggcggaactggcagacgcacaggacttaaaatcctgcgggagttaaaccccgtaccggttcgatcccggtcttcggcaccacgtcggagcaaagttcgctttgctccgtttttcgttttacaaaaaccttcgcctgcttccttgctcctcctcttccgcgtccgacccgcttcgctgggctcgtaagcggtttgccatttctctgcaaagttcgctttgctccgtttttcgttccacgaaaacacttcgcctgctttcggtgaaaagcccgacacacgcgcatcgggctccactaagtcaaatcaggtatgattttgtgtcagtctgcccttttccttgcgcagattaacgagcacatctgtatagtacttattatatgtacaacaaccaatcctttcctgccgaatcagcagttcgagacaattgtcgcacaatgtgcagaaatgaatatcatcttctttgccctgttcgagctttttcggcagaagcggatctgcaaacgactggcggccaaggccgatcatgtccacaataccattatcaatgtttttggaaccaaccttgaacatcgtgttttcctgaggatctaccatctgtaggtttttgtttcccttgccccataccgaatagttggaaccgatcaacactgtttccggcttcaaaacctttttgaactctttctgccaatacggatgcaggtatgcaatatacgggaagttcttttccgcctgcgttagtgttactgtaatagacggactgcccgcagactgtacgatatactgtgcaccgcgttcctccaatcccttgatcagatcaagcggctctgtcaggtccatgattggagaatccggcccttccgtaccgaatccgcccgggaatccttcccatgcagatactttggagccgatcaggaagttcttgtcgttgacctctttggaaatcctttcatacaaatcaaatgcaaaacgccttctgttctcccagcttccgccgtatttccatttgcgtgtgttgaacggacgcagaatctgcgagccaagatagccgtggcaaagcttcatatcgatgccgtctgcaccaacgtcgtgagcgatcttcgccgcaagcacgaagtcatccatgattttgtcaacttcttcttcggagagcaggtctccgccgtaggtataggacgggcaaactgttacccttctcgagaaattcggattgctaagctcgccggaatgcgtcaactggaatacacacaacgtatctttgttgacttcctttaattttttcataaagttcgtgagcgccgggacatttttctccatgatcatcaactgattcgcacgggaacggctttcctgtgtaatagaaattgcttccagatcgataagtccccagtcgcctttatacaggttctcatatctttgatatgtaaggtcagtcgggttgccatccgcatcagcatccgtgcattccatagcctgtacgaaaagcctgtttttgcactctctctctccaattttgataggtgccagcaatgtttccttataactcatttttctattcctccaataattaatcgtcaaaaacaatacgttctttgatttccggtgaaaccagtaccttgaacaaattcggattttcccgcaattcatgcagtgcactttccagttcctcaagcggaacaatcatcgaaataaacggtttggggtcgatccgcttatactcaagcagcctgatcgcgtcgccccagtcgtttccaatccccgcacacgagccgcttaccttcttttcgcccagaacgaactcgtaaggcggcagcttcgcataatcatccgttgcgcaaacgccgaacgcttcaagttttccaccccttctcagcatctggaatgcctgttcgtaggtgctggaatgtccaaccgcctcaatggcgtaatcagcaccaataccgcccgtcagtttctttacctctgccaccggatcgtccacttctttgatgttgatcgtgtaatcgatccccatatcacgggcaatcttcaaacgtttttcactgtcccccaccaaaatgaccggcgtgcagccgcgcagctttgcaagcaatgcatggatcacacccaatccacagccgatgaccacgcatgaggaagcgatttttgcatccattctcttgctcgcttcaagcgttgccgtcaatggctctacgaaggtagccgtataatcgtccatagaattcggaatcgggtaaatatttttccaaggtgcttttacatattccgcaaatccaccatctgtatggattccaagctgtgtaaatgtctggcacaaaaggccgtcaccccttctgcagaaatagcaggttccgcatgtcaggcaaatatctaccgctacacggtcccctgctttgattccctttgcatttttcccaacttcggcaatttcaccgtatatttcatgtccggtgatgagcggaagctgatcggcagcatatttaccggtgtaaatgctccaatccgatccgcaaattccgcaatatttcaccttgatgagtacttcgtcatcactgatttcaggtacgggaacctgctttaaggccattttattaggagcttccactacttgagctttcatcgttcttcccatttcatcatatcctcactttcatatcactttttgtaatcgcaacaaataatatccatatggtcgttcgtctcgcacaattgatccagataatgcggatcagggatacggtcacaaatcagcatatcgcatgtatcgagccctgctagcttaaccggccctgtcttttcgaacttggtatgatccactacgcaatacgttttctggcttgcacgcatcatgtttcttttaaaggccgcctcgttcatgctcccgtcagtcaatccatattcgatcgaaagaccgtgacaagacacaaacgccttgtccggtataaattccatactcatatgattggccagcgaaccggaaagcgacatgtttttcttattaaaggctcccccgctgcaaataacggttacattattatcaatggaagcggataactgcaaaatacctaccgaatttgtaagcagcgttacattcttatccttatcaatatagcgcatgatattgatcagcgttgagctattgtccacataaatcgtatcgctttcttccacatactgcgctgcttttttacagagcgcaagtttcgtggtatagttttgcatttcgcgcacaaaaacaggatattctaactccttcttttcccccatcaccgcaccgccatgcgtacgcaccagcaagccttgcagttccaactctcttagatccctgcggatcgtttccggaacaacgcaaagcatatccgccagttcattgacttccgcttttccgtttgattccagaaaatctataattttacttttgcgttctgctgcaagcatgaaagcgcctccatagtctccagtcccgattgaatttccttctatatccttttagtccgaatttgtttgtttgagtttgtttttgcccgtttttattataatattacataaacagaaaaatgtcaatagatttatcaatattaatgattcatatgaaagggccaccagcttagctggcggccctgatttgttaaaaatcggcgttttcggcaaggcgggcaggtatcttctctttgaggacctgtgcgctccatgcaattagttttccataatattcgtccataccccaacctgcctttgcttgcagtgtatcccactgcatttcaatagagagaatatcttgttctgcttctgtaagcaccggcagaagctcctgcttggtgtggatatatatcccgctgcgcaggtagtaaactgccagtaaaataaaaaacgtactcttatacaactcttttagttgtgctgcgttggtttcttcattatgtaaaaaggtatggcaacatgcgtgatatatactggatgcgccgattttgacactatcaataatatctctgcgcgatatggggggcagatagtcgtcgagaacaccgtaaacggaaacagtgtcctgcccgaactggaacaactcatgctttggccagctttgcaatacttgtttgtccccaacaaatccacaagccttttctttatggggcatttcggtaaggatatgcttatactgctttaaatcatccaaggtgagggtgtcaagaattacaacaacgtcaatatcgctgtcaatatgcgcttcgccccggcgatagctgccttgcaacccgacaaaaagcaatcgtttctcaaatgcttttttcagtttaccggttaaatcttcgatccatgcttctatattgatcatcaaattctcctgtttggcatgttttcccttatcaagaataagccaatcactacatcggtttaagatttttattcaacctttcaaccatccatgcaatacgacttgctctgcccgcatcggttttcgcatcaagatacgcttttgtataggtcttttttacagatggcgacatagcttgaaaattcgtataagcaggctcgtgtttctctaacagaacagatagatcagcaatttgttcctccgtaatgggtggggctttgggtttatcccactggccgttctttttggcttcttcaattttcgctctgccgtaatcagtcattaaaccttgttttttaagcctatcaacaatggctttgtttttatctgaccacttgctgttttttctgcgcatagaaaaatatttgatatacaatttatcgtcaatactctgcatttgcccatcaatccagccatagcgaagggcttcttcaagagcctcggctgccgttattgtttttggcccgccctgcttgccaagcagcagccaaacgccaccgcttgatatacagttgtctttcagccaatttctaaattcatcctgcaatgcaaattgcaaatattcagacaaaatgcccacctcttaactattttgattggcctgctctcctgtaaatcaattatatatcgccaaatgccaagagggcaagcatggcgcctgccctccgttttcaagccggtacaacacaaatccgaacccgtctccaattggaatcaggttcggattatattgatttggtgcggataacaggagttgaacctgcatgaagttgccttcacacggacctgaaccgtgcgcgtctgccaattccgccatatccgcgatgataaaaaagcgcaattgcgctttttatttggtggagagagatggattcgaaccatcgaaggcgtcgccggcagatttacagtctgctccctttagccactcgggaatctctccacgtatggagctggtgatgggacttgaacccgcaacctgctgattacaaatcagctgctctgccaattgagctacaccagcaggatatatggtgcctccgggcggaatcgaaccaccgacacggggattttcagtcccctgctctaccgactgagctacagaggcaaatggcgacctggaagagactcgaactctcgacctctagcgtgacaggctagcgttctaaccaactgaactaccaggccatacccttgtcctttaaacagaaccttacttattacttctccaacccttattgctctatggtgggccctcagggactcgaaccccggaccaatcggttatgagccgaccgctctgaccaactgagctaagggcccgcaagcaaataagagtaaagcctgctcaaagaaaaataatggtgaccccaccgggaatcgaacccgggttaccgccgtgaaagggcgatgtcttaaccgcttgaccatggggccgttgtgcaaatttcgggtatgtgttttcttggtcggggtggagggactcgaacccccggccccatgctcccaaagcacgtgcgctaccaaactgcgctacaccccgaagcatactctttttatttgcgacgctttataatatactgtatttgagaacaaaagtcaatgatttttcataaattcattcgctatttttatgcttttttcttaaaaactttttcttactgccggcaataaaaaaaagccgttgaaaacggctttttatatcgcttttttactctttgtcgtcgtcatccatcttcggaaagaaatccgccaaagaagatgttgcgccctcaaccggaggaatctcgtaatggaaccgctcttccttttctcttccgtcatcttccttctttgcaggtttttccggttcgtccatgagtgccctgatactaaggctgatacgcttcttagcagggttcacttccataatcttagccgtaaccttatcgccgatccgaagctcctcttccaccttttctagccttctgttcgtgacctgggaaatgtggatcaaaccatctattgtcggctctaacgaaacgaacgcgccaaatggcatgatgcgcacgaccgtcccctctaccgtatcgccaacgatgtatttctcaggcgccttgtcccagggcttgggctccaattgcttgagtccaagagaaatccttttcttttccggatcaacattcatgatcaagacttcgatctcatctccgacattgagaacatccgacggatgttttactttcacccatgaaatatccgtaatatgcagcaggccatctacgccgccaatatccacaaaagctccaaaatctgtcaggcgtttgatcttacctgtaaccttatcacctttcttgaaggtttcatacagcttcttttcttcctcctcagcagcagccttaaggatattcttatgcgagagtacgaaacgtctctggcgcttatcagcttcaataatattgacctgcaattcctgtccaacaaattcgcttaagtcttcaacatatttcaatgacaactgggaagcaggaataaaggcatcatatccttccagtttcgcaagcacgccaccctttactactttatcgactttaacggtatatattgcagtctcatccaaagattcaaccagctctttccatttgagtttggactcaatggattttctggagagaaccacattgccttcgccatcattaagagcaacaacttccgcttcgatttcgtcgcctgcagcaaacaaatcctgcggcgctacatcgccggaagccgtaaggttctcttttttgatgatcccatcagatttataaccaatattgacacatatctcgctgtcggaaatctgaacaaccgttccggttacaatctgccctctcttaatatatacaaacgatttttcgatctcagccatgaaatcttcgtttgcttgtgattgttcttccatggatacatccttttcctccgcagtttctgcatccactactttttcgacatcgctcataagtgtctttacctccctaattaaccaatccggtgtcgatgcaccggcgacaatacttattatatcatgaatcgacacattttcaagtggaagttgctcaatattgtcgatgtaataggttttttcgcaattttttttacagaggttatataatttctccgtgttggaagaatgccttccccctaccaccaaaacgatatccgattgcctggccagcaaggccgcttccttctggcgtttctgcgtggtatcacaaatcgagttgaaaagttcaagttttccaatacgctctttcaaccgcccaaccacttcgtcccaaagctcatgtgtaatcgttgtctgcgcaacaaccaatgcatgctcaagctgcgggaccttttttgcatcttccgtattattgacgacatagacgcatccctgcgcccaccccttgatgccaacgacctcaggatgattctcagcgccaatgataattaccggcatatcgtttgcttcaatcacacgcttatggatgcgcgttacaaaagggcatgtaagatcgagcatctcaaagcccctgcgttttatttcctcgtatacctctttggaaaccccgtgggagcgcacgacaataagcgtgctttcaagctgcggcacgctaagcaggtcttctgtgacgagcacgcccttttcagtaagcgcgtccaccacatctttattatgaatcagttccccgtacgtataaatatgtttgtatgtcccgataatattgtttaccgtatcgactgcacgtgccacgccgaagcaaaatcctgcgtgcttggctacaactatttttgacatgccttctctctcatttcctgcataatattttgcagatattccgtcgcctgtgcaatcgttttgctgttcgtcttttcaccgacaacgctttttaaatcaattgccggatgcgcataaaccttgacctgatggaacagtttataatttccttggatatatacgggaaccaccggaacgtttgcacgcagcgccataagcgccgctcccggttcgaagggtaacaattccccgttctcactgcgcgttccttccggaaatattcctaatattttcccctctttcaaagcgttcataccggtcttgaccgccactaagtcgcttttcccccgggcgatcggtattgcatgcaggcgggtcaggaaaaaattcgcgactttattttggaataattcttccttcgccatataacacaccggctgcgtcaaaatgctgtgtcctaaaatgatgggatcccagttggatttatggttgcaaattacgacacacccgttctttatttgtaaattcttcttgttcatccgccttacaaaaaaacacggcatcactacgatgaacgccaatacgcgggccaggaaatataccatccccttactttcctcccgtgatgtcgccgatgatccaatcgatgacctgctctttatccatactggtcgtatcaaccaaaatcgcatcctccgcctgccgcagcggcgcaaactcgcgcgtggaatcggttttatcccgtgcaataatctcttgttcgatggtatcgatatccgcttgctcgccgcttgcaaggatttcctcatacctgcggcgcgcgcgttcacgcgcggaagcagtaacaaaatatttcttatccgcatccggcaggacatatgtaccgatatcgcgcccatccatgacaacgtcatacctgtttgcgaccatccgctgtatctcaaccagttttagccgcacctgcggtataacggcaatgtcgcttgctccctttgatatacgcgacgtacggagaaaaggcgttgcgtcttgcccgttcaccagtaccttttgcgttccgttctcatattcgatcgccatatccagcgtatcaagcgccggaacgacccgcgcagcatcatcgggctcaattccttgtccgatcatcgcgtaagccgcagcgcggtacatcgcgcccgtatcaagataattgatatgcagttttgctgcaacggcctttgcgaccgtgctttttcccgcgcccgcagggccgtcgattgcgatcttcattatttctgccgcctcaagatcacttcggcaagctctgccagatccttacccttatctccaaatatctgcagagactctatggcttcctgtgtcttgcgctctgcgatctgcatagatttctcaaccccatacagcgttacaaacgtgaacttttcttccgccgcatcctttccgggcgtttttccgagtttttccgcgtcgcccgtcacatcgagaatatcgtcgatgatctgaaacgtcagtccgatatcctcaccataggtatcgagggcgtccagatatttttcgtcaggattacataaaagcaatcccgatgtaagcgccgctttcatgattgccgccgttttgttcctgtgtacggcataaacatcctgcgcgctcagtttctttccttcattttccaaatcccccgcctgtccggagatcataccataaataccggcgctggtagctacctcgagcatcgcttttaagtgcgcttccacattttccgggtatttcattgcatttttcagcatcacttcatatgcataattaagaagtccatcccccgcaaggatcgccatcccctcaccgtatacgacatggctggttggctttcccctgcgcagttcgtcattatccatcgccggaagatcgtcgtggatcaacgaatacgtatgaatcagctcgattgcacacgcgatatccaatgtttctttcatactgccgcccaaaagcgcgttagccatgatattcagcgtcgggcgcaggcgctttccccctgcggaaacgctgtaattcatcgcttccttgatcgtcacgttggtgtccgccgcatccagaagttcaaccagcctttgatcgatctctttcgtgtacttggttacaacatcagacatttaatccatctcactttcttttattatttccagttcgctttcgtactttttaagcagcttcgacgctttatccgctgccgcaatcccttttttataaagcgataccgcatcggcaagtttaatgtcttcctgcgaaatcttttctgaaattccttttaactcatcaatataagcttccaaatctttttccggcattatcttacctctttactctttactccggccaaaaccgttccgtcttttaaaagtatcctgatctcatcccctgcagaaacgtcgtttatgctgcgcacctctgtttcgccaagcatcgccaccgaatatcctcggtcgaacgcgctcatcggacttaaattctcaatcgaagccttataattattatactgcaaaacaagccgatgataaagatgctttattcctgttttgatttgtatgtcgtaattccggaccctgctgcccatattttccacacgggcagccagtacttctttattaagcatccgtgtataattccaaatttgatcttctttttcggttatcaaatccgaaaacctgttttgtattttttctttcagcaaccgcaaattatctgcgatttcgtctcccagaggaatggtaagctctgccgctgcagatggtgtcggcgcgcgcaggtccgccgccatgtccgataaggaataatccgtttcatgccctaccgcactcacaacgggaatacgcgaacggtaaattgccatcacgacagtttcgtcattaaacgcaaacaaatcctctgcgctgccgccgccccgcccgacaatcaaaacatccgcatccgaatggtcgttgaaatactcgatcccgcgcacgatttcccgtggcgcatcgtctccctgcaccttaaccggataaagcatcagcttcaccacagggtttcgcctttgcgcaatatttttgatatcctgcaccgccgcgccctgcgcagaagttacgatccctatttttttcggatatctgggaatcgggcgtttacgttcctcttcaaatacgcctttcttttccagcttttctttgagctgtataaagcgcgcatacagttctcctacgcccgccatctgcagctccttcacgatcagccgataccgtccgtttttgcggtaaatagaaacgtcgccgcgcgcgagcacgatctgcccttctgcaaggatatccgcatatgcaagtgcatcctcgcaatcaaacaacatgcagtcgatcgccgcctggtcgtcccgcaacacgaaataaatggcggattgccggacattaacatccgccacctcgcctttgatccagatttcctgcaaaaacggatcgccggatagtttatctgaaacataagtattgagttgtgctacgcttagtacgagctcatccataaagttcgcctgcatccaccgtgttttccatcagcatcgtgatcgtcatggggccgacgccgccgggtaccggcgtaatataacccgcaatctcgctcacttcgtcaaatttcacgtcgcccttcagcttcccgtcaacacgcgacgtccctacgtcgatcaccacggcgcccggttttacgaattcccctgtgacgaattccggccggccgatggctgcaaccagaatatccgccttggaacaaacgcccggcaggtcctgcgttttcgaatggcaaaccgttaccgtggcattctcattcaatagtaaaatggccacaggcttgcctacgatattgctcctgccgatcacgaccgccgtttttccagcgatatcgatccccgtctttttgatcagcttgataatccctttgggcgtacatgccacaagaccgggcagtcctgtgaacaagctacctgcattctgtacatggaacccatccacgtctttttgtgggttgatgcgctttaatatctcatcctcatcgatatgcttcggtaaggggagctgcacaagcagaccatggatcttaggattgttattgtattgctctaccatagccagcaattcttcctgtgtcgtttcttccggcaaacggttgacctcggaatagatacccacttctgcgcaggccttttccttgttatttacataaatcgtggatccgccgtcgtcgccgacctgtatcacagccagacccggcgtgatcccgcgcgtttcctttaattctttcaccctgtcctttaattgttccctgatctccgcagagagctcttttccactaatgatctgtgcgctcataccttatttcccctttcaaaatctgacgccaacaccgcgagtcctgccgcattgtcggcggaatattctatttttgcgaattgcacgcctgcaatcttttctgccaaataagaacgtattttccggttgctcatcactccgccaaacagcagcacatcggaaagtctcgtatttttcatagcagccttgagcgaaccttccagcgttttagcgatcgcatccagcgctgcgctgcatatatccgcatccgcctctacgccaatcagccgattcatctgggcttctatgcctgaaaaattcatatttgtttcatctgtgctgattttaaagttcagttccttgctgccttgctgcgcgcattcttcaatatgccttcccccgggaaatggcatgttaagtttttgtgccagccggtctatgacctgtcccgcggcaatatcctttgttgaccctatcacttctatgccaaaatcgaccccattccgcaatacctttaaaatttccgttgttccgccggatatatgcgctgccagaaattccttcggacatctgttgccaatcagcgccgctgcgatatgcccatgctggtgcgtcacgtaatacagcttaccacccgttaggctggaagccattgctccggccgccgcactgactgtaaacaccggcatataagagccttcctgcggtcttggcgcgctgctcacgcatactgctgatatatcgccatagtccgccagccgcttttcttcaaatatcctccgcaaattccggatatgaagaaatacagcctgagattgctgcaagcccttttcgccctgcgcaacctcaagcggtattttaatattacacaatatattcttttcctcatccgcaagtgcaacggatgtcgtataacagcttgtatcgattcccagataaaccgccatcaggcatccccttttttcaggtatccgcccaagagtccattgatatacttataggacttgtccgcagaatactttttggcaagttctactgcttcgttaatcgtcaccttatcaggaatctcaagatacaatatctcaaagagcgccagtctcaggattgcaaggtccacctttgcgatcctgtcgattttccacgaatgtgaattctcagaaatgattgtatcgatttcttcccgtctcttcgggaactcttccacaatgctgtcaatgtagcgcatattatcttcgtccagcgtttccgcttccagcacgtcaggcgcctgctcaagactctctttgctcaagacgtctgtaatactgtactcatacaaaagcttcatcgcggcttcgcgtgcgcttcttctgctcatttcatacccctaatcactaaccttactaatttttctttctgaacaaattgaagaaccactcgctgattaacgcccgtatatccggcctcgaccccaaaaaagcgccaattcctacacagatcgcgattaaaagcgttgcccagaaaccaattgtcaggaacaggatcgcaacaatgaggccaattacaataccccaaaacaaacctttgttttcgctcacccattccaaaaatttttctttcattaccgtgcctcccgattgtcaggccgtctttaatccgttttcctttaagccggtaaccataatctttgtctgctttaccgtaatgcccgtatgtttctgcacataatcagcaaggcctgcctgcagctcctttgtcacctcagggatatcaacatccggcaacacggaaatatcaatattgatatcgattgcatcgtcataagaaatcacggtcgttttcagtcccttgacttccttcttttcatgcacgaagcgctcaaccagctcttcaatggccttgactgtgatcagtatactgccactgtcaaacacagccactttcgcagtcttaggcgtcacctttcccgtaccgaagaacataagcataaaacttacgatgatgaccacaataccgatcactgcatacagaaccttataccagattgccccattctgcaacgtataaacaaaatccgacaaactatttggtgtaaacagcccagccaaaatacctaaaaggaatacacacaatgcaatcactgcgatcaggtataccgtgaaaacaatacgcgtgcctgttttcattttcattgaacctacctcctgagaatcataggataaaccgatgattgaatatacccggccttcctattcaaaaggccgggtacaaaaatccgttgcttttttgctatttcactctgggcgcttttaccggctttgcttctttttctttctctttgtccttaggctctgccgtccgcgtcgtttgttctttaaacttgatcccttgaacattgatgtttacttcaacgacctttaaaccggtcatcgtttcgatcgctttcataacgctcatctggatattctgagcaatttcgggaaccggcgtaccatattccacaacaatggcaatatccactgcaacttcttctgtcccgacttctaccttaattcctttggaaagattcttccttccgaccaattcggtaatcccgtctacaaaaccgccgctcattcctgcgacgcccggaacatctaccgctgcgagacctgcaattgtcgcgatcacttcatttgcgaatgtaatcgtgccgttgctctcctttttgattgccgatgtatcttgtgtggataaatttgtatctgccatttccaaatcgcctccgattcattattttgataaaacatttataaccagtatttttcatgaaaaacactaaattataagcattttatactctttccatataatctccggtccttgtgtcgattctgatcttatctccagcattgataaaaagcggaaccatgatcttcgctcctgtttccatgatagcgggtttattacctgccgtcgcggtatcgcctttgaatcccggctccgtctccgtcacctcaagttccacaaaattcggcggttctaccgagaacgcttcccctttaaaaaatttgatcgtcacgttcatattttccgtgatatatggaagcgccgcttctaccttgtcaaaattaaggggcaactgctcatatgtttccgtatccataaaatgatacaactcgccgtcattatacaggtactgcatctcttttctgtccacgcgtgccggcgggaatttctccgtcgggttgaacgttttttccagtacgcttcccgttaccacgtttttgatcttcgtgcgaacaaaagccgctccctttccgggttttacatgctgaaaatcaacaaccacccaaacttgctcgtcaatctcgattgtcataccttttctaaattctccggctgaaatcatgaataccgtacctcctgtttgttataacaaaattaattctttactaaattcatatacgcttccttgtcctgcgatcagcgtatcttctatgcgtacgccgccaagccccggcacatatatcccaggctcaacagtaaataccatatttttctgcaagatataactcgagcgcggatttagtacgggcagttcatgtatctgccgccctacgccgtgccctgtgccgtggttataatactgtccataaccattttgcgcgatataagcgcgtgccgcctcgtcgatccggtacgtatccgtgccaagcctagccgcttcctgcgcgcgcttttgcgcttcattaactatatcatatattttttttgactctccgtcaatatttccgatgccaaaagtacgcgtgatatccgagcaatacccctcaaaacggcacccgaaatccagcgtaagcagatcaccgttacaaattttataagaagacggcgtagcatggggcacagccgaattttttcctcctgccgcaatcgtcggaaatgcaaggtccattccctgctttttcatgcggtattccagctccgccctgatatccagttccgtaatccccggctttatatatggcagcagctcgcgcaaagcggtttcgcttgcccccgccgcaatgcggattttttcaagctccccgtctgtctttaccatacgctcaagcaacatgtcttccgaaatatcgatatactcgatgtctccgaagatgcgctccatttcgcggaattcctttaacgtaacgtttccctgctcgatccccagagccttgcgagcgcgcagacatttccgaatggacataagccgttcttcgccgcctgtgcagatcacttccgcctgatttccgacctcttcacgcgccatttccacaaaccgcgcgtccgtaaagaaccaaacgttctcagacgtgatcaatacctgggaactgtcgccggaaaaacctgtcgcatacgccacgttttccaccgaagtaagaagatatgcatccgccgtattcagtttacgtattttttcaatcaccgtcgtcatttttttgccgcctcatacatgcgcttcattgccagcgcatcctttgcctgcgttcctttggattcacagatgatcaccggttccatgtcctgctcggcgagtatttccgccaatggctcaaagaacggtccccactcccgatcctcgaatgtcaggtgcattttttctcctttgtccgtgtactggatatgcgaaaaatgcacgtgcatatgctttgtcttttcctctcccgcgctatcaagaaggctttttatgaccgcttcataatccgctcgcgttttaagcccgccaagcgtccgtgcgttcaggtgtccaaagtcgatcgccggatagatgcaatcgtcaagactcgccagtatgcccacctctttcagatccgcgatctggttgattttccccatcgtttccgcacagtaaataaaatccctgaaaccttcgcttttcagcgccccaatgatccgttttaaatttttctttacattttcaaaggcaagcgaccgctcgcattttgcacaggaccccggatgaaacacgatcctttgcgctcccaaatagccggccgcaatcgcggattcgcggaaatatactaaatttttttcaaacttttcttccgtatctcctgcaaggttgatatagtacggcgcatggacgctcattgcaactccaaactcctgcgctttgctgcggatcgccgcgcccgtttcttccttcagttttacgccgcgcccaaaggaatattcaaaggcattgagtcccattcccgcaatccatgcgggcgcgtcaaccgtgtgtttatatccctgttcgtaaaaagcgtcagaattacccgccggtccaaatcgtatcatatatatatctctcctgttttagtcgtgcctgcgcagcaaatcccccggcgcaagcggatacgggcaattgatccgtactacctgctgcggatgcggggcgctctcctgcctctccccctccatggattcgatctgctctacccgaaatgccgcgccctgcagcatcggcgaaagcacttccagcgtttccccaacgctgaacttatttctctgttctattgtaactgttccatcctgcgcattatccgtcactttacctgtaaaggtatattttctcaaatcgatatcgcgtcgggtatcctgcccatcctgttttggattaccaaaaaagaatcctgtcgtaaatccgcgcgtcgccgactttaccagctcgtccttcagaccctggtcaaatacatatttttcgccgttttcgtagtaagcgtcaatggcgcggcgatacgcgctgacaaccgaagccacataataggcggatttcatgcgcccctcgattttaaaggaagtaattcccgcgccaatcagctcgggaatatattcaatcatcatcaaatcacgtgaattcatgatatacgtgcccctgttgtcctccatgatattgaaatactgcccgtcataccctttttcgtataagtagtattcccaacggcaaggctgcgcgcacgcgcctttgttcccgctccgtccagtgagcgccgcgctcaaaaggcaccgtccggaatgcgcgacgcacattgctccatgcacaaacgcctctatctcgagcgtatccggcgtatttttacgtattgcctttatttgggcgagcgagacttcgcgcgacaatacgatgcgccttataccctgttcatgccaaaaagcagcagacaaatcattggtcgtatttgcctgcgtactcaaatggactgtgatcggtattttattctgcctgacgatctgcagcaccgcaggatcggaaatgataatcccatccgcgcctatttcagaaagaaatgtgatataagacggcaaaagcggtaactcttccggaaagagtaccgcattgaccgtaatgtatatcttttttccattgccatgggcaaacgcaacggtttccctcaattcatcgtccgtgaaattgtccgcaaatgcccgcaatccaaagttttgccccgccatataaacggcgtccgcaccaaagtagaatgccgtttccatgcattccctgtttccggcgggcgccagcaattctattttactcattgcccgtccgccttctctgcgtttttcgcgtccgcttccgcatacaaatgctggtattctgcaacgttctcgtcgtgttcttccagtgtcttggcaaaaaccatctcgcccgtctgcgggtctttcagcgtaaagtagaagtaatcttcatactcttcgtcaggatacagcgccgcctcgatcgccgccttgctcgggttacagatcggcccgatcggcagtcccatatgcatacgggtattatatggcgtatccgttttcaattcttcatccgtaagtcttagcttttttactccaaggccatacgcaacagccgcatcggagtcaagccgcatctcgttatcgagacggttatggaataccatcgatacctttttgaagtccgcagattttgcttctttttcgatgatggacgcaagcgtcaccacctcgtcgatcggcattccgatctcttccgcacgttcgcggtatgtctgctctttgccttccgcctgctggtcgagtatctcgttaaagcggtcgagttgctttttgatcgcatccgcagccgaggcgttggtatagaaatcatatgtatcaggaaacaagtatccttccaggacatatttcatcccgccgccgttttcctcattttttgcgatcgcatccgcgataaaggaatagtcttcgaatccctcgcctgtcgtagcaatgccaagatattccgtcgtatttttgaggatgccgcttgcgacaaggacgttcgcataatccgttacgctcagtccctcgataaactggatgcgaagcgttcctgctgatgacctccctttttggagtgcataaataatgtcgtcaaaatccatgttcttggaaagctggtacgtccccgctttcagtttggaagtcatatcagaaaagtctacatagaatttaaatacctgtttgttctggatcaggtcgctgtcataaagtatctctgagatcttactcagcgaagaacccttggggatcgtcacctctatcggcgccgtatcattcacatccaccggatcgaaataatgtcctttcacgtaagtaaaaacgccaaagacaatacatgcgaccaaccccagactgattacgaccgtcacaaccggacgcagcttagcccacgctgaagatttcgcctttttcttcttcggcttttcgctgtcgaccaatattttatgcgtctccagctccttattttccttgagatagatatcgttcagttttttcgccaaaccctaaaactccccgttcagtcctcgtcaaacatattcgcgcccacatcgcacgcttcgccaataattttataaacgtcggataccaacgaattaaagcgatattccgccgtaaagaactctgtgatcttcggattaaactgcagcacctcgcccatcttctggattttatccataagctccggcttcggctcctgtcccgtcatatacgcggcctgcgcctcaaactgcagcttcttgtagtccttgatcatgcgcttgttctgctcgtcttcatagacctcgtcttttactttaacatattccttgtattcttcgctttgcttgatgatcgccgcaagctcgttcgccttatcgtaaacatttaccatttttccttctccttatgcttcaataatgatcggcaggatcatcgggttacgctgtgtcatatcatacaggtaattcgataaatcctttttgataaagttcttaagcgtagaccagtcgctcgtcccattgtccttgcacatatcgacaatatccatcacgatattctttgactgctccagaaggtcttccgattccttcatatacacaaatccgcgcgatacaacatccggcgtggaaatgagttcgccggtctcgctcgagatcgtgacgactacgataaacaacccgtctgacgaaagctgcttacgatccctcagtaccacgttcccaacgtcgcctatcccaagtccgtcgatcagcacgcttcctgactgcaccgtatccttttgcaggcccatacggcggttgagttcgatcaccgaaccgatctccggaataaagatgtttttctttttgatccccattttttcagccagcgccgcatgcttataaagatgcctgtactcgccatgcaccggaataaaatatctcggtttcacaagtgaaagcatcagcttcaattcttcctcgcacgcatgtcccgacacatgcaccatgtccaccgcgtcgttgatcacgctcgcacccttgcggtaaagcatgttgatgacgtccgaaacataacgttcgtttccggggatcggagacgccgaaatgatgacaaggtctccttctttgatattgatcttggcatgctgtcccatcgccatgcgcacaaggcctgacatcgtctccccctggctgcccgtcgttaaaataacaatctggttgtcgcgcaggttcttcaggtcgtcaaacgtaacaaacatgtcgtcctctgcgtttaagtaacccagttcacgcgttacgttgacgattttaagcatgctcctgccggaaaggcatatctttttattgaatatcttcgcaacatcgatcacctgctgaagcctgtgcacattcgatgcaaacgacgcaacgatgacccgtccttttgcctgccggaaatagttgacaaaggtttcgcctacttggctttcgctcatggtgaagcctttgcgctccgcattcgtgctgtcggacatcagggcaagcacgccttttttaccgagctccgcaaaacggcttagctccataacctcgccgcatgccggcgtcagatcgattttgaaatcgcctgtgtgcacgatcgttccaatcggcgtcgtgatcgcgagtcccattgcatcatcaatcgaatggctgactttcacgaactcaaccataaaaacgcccgcctttatcttgtctccattcttcacgacatggatatccggctctacgcccggatgctctgtcagctttgcctcgatgagcgccattgtgagcgtggagccatacatcggcacattgatcttctgcaaaatgtacggtacgccgccaatgtggtcttcatgaccgtgtgtaaaaaatataccgcggatcttatcgatatttttctgcaagtacgttgtgtcggcgatgacataatcaacgccaagcatctcttcacgcgggaacatcattcctgcgtcaatcacgatgatatcgtttccaaactctatcaccgtcatgtttttgccaatctcgccgattccgccgagcggtattatttttacggaaggaaccggcttcttttcgttgttgttcttttgctggtccggcttcttcgctttactattcttttgttccaaatatttctctcttttcctgttttcactcattatatcataaacacttcctgtttcacattttcaaattgcacatttccctgcttagaggataaacttttgcaagttttggtactgttcctcatgcttcaaatgctctgtaacataattttcgtcgatcacaacgtctaccgccggctcgatcccatttgcgttaaatgaaatatcattcagcaaattctccatgatcgtgtgcaaacggcgcgcgcctatattttccgtgctctcgttgacaatctgcgcaaattccgcaattttcttaagcgcgccttccgtaaacttaagatttacgccgtctgcggataacagtgcctcgtactgcttcgtgattgcatttttaggctgcgtcaaaatttgctcgaattcctttttcgtcaggttctccagttcgaccttgatggggaaacgtccctgcagctccgggatcaggtctgaaatcttcgccacatggaacgcgcccgctgcgataaacagcatgtagtccgttttcaccggaccgtatttcgtgacgacagtacttccttccacaatcggcagtatatccctctgcacgccttcacgcgaaatatccggtccgcttccggcgccttttcccgcaactttgtcgatctcgtctaaaaaaataataccgtcctgctctgcgcgctcgatcgcggtctgcgtgacctcgtccatatcgatgagcttttccgcctcttcctgctccaatatcttgcgcgcttccggcacgcttaccttgcgttttttcgttttagccggtaaaatacctgaaagcaggtcacccatgctttccccgcccataccgggtatttccatacccatattctgcgtaacttccacttcgatctcgatcatgagcgtatccaattttcctgcacgcaaattggcgcgtacttcgtcccttctcgacatccttttttgtttctcttcatccgtttccgaagggggcgcttcgatctgcggcgcgccaaacagcatccccaaaggattgctattctgccgcgcctgcttatttggtaccaaaatatcgaccaagcggtcttccgcattttgcaccgcgcgatccctgaccgtttcaaaacggctttgcttgaccatacggatcgacgcttccacaaggtcgcgaatcatggattccacatccctgcccacataaccgacttctgtaaattttgtcgcttccaccttcacgaacggcgcgtccatgagcctggacagcctgcgcgcgatctccgttttcccaacgcccgtgggccccatcatgatgatgttttttggcgtgatctcttcgcgcatctcctcgtcgagcttgcttcttctatagcggtttcgaagcgcgatcgctaccgcacgttttgccttgtcctgtccgatgatatatttatcgagctgctctacaatttcttttggcgttaaatatgacatatgatcacctacacttcttccactttgatgttgtcattggtatacacacatatttcgcttgctattttcaagcccttatatgcgatatcctttgcggacatatccgtattttgcatgagggcgcgcgcagcagcaagggcataattcccgcccgaaccgatcgcgcatacgccgtcgtccggttcgatcacttctccggtaccggaaatgatcagcaaattttccttatctgccgcaatcagcattgcctctagctgccgcatcgccttatcgctgcgccattcctgtgccagttccaccgctgctcgctgcaagcttccgccgtattcttccagcttcgcttcgaacttctcggaaagcgcaaacgcgtccgctacgctgcctgcaaatccgatgaccaccttgtcgccaaaaatacggcgcaccttggtggcgctctttttcataatgacgctttcccccatcgtgacctgaccatcgcctgcgatcgcacaggtatctcccttttttaccgctaatattgtcgttgcttttaacatgagcttcctccgcttatatgattccaaaatcctttatcgtttgcttaattttgtctaacgcacgctgtgcaatgcgcgtattcttctcttcttttttcctaatccgctccccgagcggctgcatgatcccaaagttgatattcattggctggaagttcttcgcgaccgcacctgaaacatgattgcacaaagcgccgctcgccgtatcatcggaaaatacaggcagcttcctgtccaaacactcgtaagccgcaaatattcctgccatcaggccgctcgacgcgctttccacatacccttccacgcctgttaattgccccgcgaaccgaatatccgtattatccttcaaacggtaatagcgatcaagcagctttggtgaattcaaaaaagtattgcggtgcattacgccgtaccgcaaaaattccgcattttgcagcgccggtatcaacccaaacacacgtgcctgctcaggaaacttcagatgtgtttgaaaacccactaggttatacatactgccgtttgcgtcttcacgccgcaactgcacaacggcaaatggttcctttcccgtcgccggatcaatgagccctttgggttttaatggtccaaacaacatcgtatcgtgaccgcgggaagccatcgtctcgatgggcatacatccctcgaacaccccgtctgattcaaatccgtgcatatgcgcacactcggcctctaccaaagcacggtaaaaaacttcatactcctcacgcgtcatcgggcaattcacatagtcgtccccgccatgctcatagcgcgacgcaaaaaacgcatgctccatatcgatactttgcgcagaaacgataggcgcggccgcatcgaaaaaatgcatgtactgctcgccggtcatctcttgtatcttgcttgcaagcgcatcggacgtaagcggcccgctcgcgatcaccgtgatctcgcctgcaaaccgtttgagatccgccacctcttccgtgacgatctcgatatccgaatggccctttatcgcttgcgttaccgcctccgaaaaggcatgcctgtcgacggcaagcgctccgcccgccgcaacgctgttctcatccgccatgcgcataatcaggctgcccagcagccgcatttcctgctttaaaagtccgaccgcattatggatcctgtccgaacggagcgaattactgcataccagttccgcaaatccatccgaggaatgcgcgggagatttcctcatcggcttcatctcaaaaagccttaccggaatgccgcgctttgcgagttgatacgcacactcgcagccggcaaggccggcgccgatcacattaactgtctttttttgcatctgtcttctttttctggttcgttacgcactcaggattcgaacactttttatacggtttcccatatctgtatttcgcttccaccatatacgcgccgcattccggacatttttccgcaagcggtttatcccacgaaacaaaatcgcagttcgggtaattctcacaaccgtaaaagctcttgccggacttgcccgcgcgcttaatcaccacattgccgccgcacttcgggcacggtacatccagctttttcacaatcggctttgtgtttttacattccggataattcgggcaagcaaggaactcgccgaaccgaccggttttatataccatgttcgctccgcacttttcacaaattacatccgatatcttttccggtaacttaatgcgttcgatgtttttctcaccgagctctaggtttttttcaaacggtccgtaaaaatcgcggatgatatctttccagtccgcgccatcctgctccacgtcatcaagcttttcttccatatccgccgtaaatgtgatatctacaatgtctgcaaaattcttggccatcaagtccgtgacgatctctcccaattccgtaggtacaaaggattttgcctccttatgcacatagcccctgtcctgtatcgtcgaaataataggcgcataagtactcggacggccaataccgcgttcttccaaaaatttaatcagcgcggcttccgtataacgtgcaggcggctgtgtaaaattttgctttggcgtaatggagatcagctccagcttatcgctcacctcggccttaggcagcatgctctgctcgtcgtcgtccgtctttgagtcatagacggcgagatggcctttaaagaggatacgcgagccactggccttgaacgtttgcccgttggcatcaatatcataactcagcgtttcaaacaatgcgggcatcatctggcttgccaggaatcttgtatagatcagcttgtaaagcttatattgatcgttcgtcaggtacttcttgatatcatcgggcgtattcgtaatatatgtaggacggatcgcttcatgcgcatcctgcgcatttttccgtccacggtatgtatttggtttttccggcacataatctgcgccatatttctgtgtgacatattcccgtgcgctcgcctgcgcttcaccggatacacgcgtagagtccgttctcatatacgtaatgagccctgtcgtattgccgtcggaaagcggcacgccttcatacagcatctgtgcgagcatcatcgtctttttggccgtaaagccaagtttgcccgccgcagcctgctgcaaaaagcttgtcgtgaacggcggcagtgcattttttttacgcgttccgctgtttaccttttgcacaacaaaatccgcgcccttcacagcgtccagaaccgcctgcgcatccgcttccttttccagcttcgttttctttccgtttggtccgtaataccttgcctcaaattcctgatcatcttttttcaggttggcggcaatcgtccaaaattcttccggcttaaaattcctgatctcgttttcgcggtccacgatcactttcaccgctacgctctgtacgcgccccgccgaaagtccctttttaacctttttccataaaagcggactcagcttatagcccaccaagcggtcgagcacacgccgcgcctgctgtgcgtccacacgatccatatcgatcttccgcggctgcttgattgcgtttgtaactgcatccttggtgatttcattgaattctatcctgcaagcatcaccaatatcaatccccagcatatttgcgatatgccaagagatcgcttccccttcacggtcagggtcagtcgcgagatatactgtttttgattttttcgcttcgtccttcagcccctttatgagctgtgcttttccacgtatcgtcgtatattgcggttcaaagttattttccacgtcaacgccgaaagtacttttcggcaaatcacgcaaatgcccgttcgacgctcttacgatataatttttacctaaaaatttttcaatcgtttttgccttcgccggcgattccacgatcaccaggtttttatttgatgccgcacccttcgctttacttctagcggttgtttttttcttagtcccaatcttcttcgtcgctgccgtcttttttgcggcagccgtctcgtttgccattatattcctccaaaaatccttctatctattataccccacttaaggtgcattagctgtaaattaagtgttaattctgaacttatcccccggcaatccttcaatcaggccgttaagttccattatagtcagtaccgtattgatttcgctcacaccgatatcaagttcctgtgcaagctgctccgcactcgaaacttcctttaaaagtaaattgtatatctgcgcctgcaataaatcaagcttattcgtttcattttgtttttttccattacggataacaagggacatcttccatccctggtcgttcatgatatctgccccgcagcgcacaaccattgcgcccgcatccattaaataaagcggcaatttagccatgggggatttcaaatcgcaagcggctgtatagacctcgcgtccttgcgcaagagcatcgtcaaccgtaatcctggctccgctccgttctccgccttccccagcaatcagcacgcgcgacaagcccgatacgatccggttcctttgcggaaaaaactgtgccttaggttcggtccccggtaaaaactccgatacgaccgcgccgttttctatgatcatatcataaagtttcctgttctccttcggatagaccacatccgctccgcagccgagtacagccactgttttcccatgcgcgtcaagcgcccccgcatgtgcggccgtgtcgataccaagggccataccggaaacgattactacgccctgcgaagcaagttccctggaaatttcctttgccacttcaaaaccgttacgcgtcgggcgccgcgaaccgacaatgccgcaagacatatcgtcgaattccggcattttccccttataataaaggagcggcggcggattttcaatctccgcgagcgtatgcggataattttggttcagccttgtcaggatacgaattcctttcttatggcatagcgcaagaatccgttccacataaccatcgtttgcattccgttgcaatatgccggcctgcttttcgccgattccgcgagcaagcctcgcaatatccgcgctgttttcccaggcatttttcaaatcctcaaaagcgttcagcacattgtagaaacgtaccggccctatcccatccgaggatgcaagccacaaccaatatttttcttcctgcgtaatctcagtcatacgcaaaaccccaatattttttatcaagcgaacggtactgcaccgcctccgcgacatgcgccgcctgcacatcgtcgctatggtcaaggtcggcaatcgtacgcgccacaagcaatatacgcgtataggaacgggcgctcagtttcatcttttcaaacgcgacgcgcaaaagctcgtgcgcctgcgcaccgatcctgcaatattccttgatttcagacgaattgagctgcgcattacaatgcttgccgattgccttatagcgctcctcttggcgtatacgcgcttcgttcacgcgcgtacgcacctgcgcgctgctttcctgtctttcactgctgcgcagctcgtcatattttacacggctcatttccacatgcaaatcgatgcggtccagaagcggtccggaaattttcgagagataacggctgatctgcgtagggctgcatcggcattccacatcttcggccccaaagttcccgcatgggcaaggattcatagatgccgcgaacattacgtccgccggataagtgaccttactgtttgcgcgcgaaaccgtgatctttccgtcttcgagcggctgccgcagcgcttccaaaatatcccgccggaattccggcaactcatcaaaatacaataccccgcaatgcgccagactgatttcccccggatgattcttcgttccgccgcccacgatcgctaccgccgaactcatatggtgcggcccgcgaaaaggccgctttttaatgatgccactgtgattctctcgcagctctcccgcaatggagtgcatctttgtgacctccagcgcttcctcaaacgtcaaatccggcataattcccggcaaagcctttgcaagcatacttttgcccgaccccggagagccgataagcaggatattgtgcatgcccgctgctgcgatctccatcgcccgcttggccttttcctgccccttgatatcttggaaatcaatatccgtttcctctgaatcctgcggcgttttccacgcagacggcggaaagaacgccggcgcctgcgctttattcaaaattttcgtgagttccagaaggtttttcacaggcaggatttttacatcctgtatgtagcttgcttcctgtgcgttttcctgcgggacgaccatcatattaaatccacgccgacgcgcctcgatcaccattggcaggataccgtttacaggccgcacgtctccgtttaaggagagttcgccaaataagaccatatactttagaagctccggcaaaacctgctcgctggccgcaagaagccctaccgctattgcaaggtcatatagcggcccttcttttttcaaatccgcaggtgcaaggttcaccgtgatgcgcttggccggatactcaaaccccgaatttttgattgcgctgcgcacgcgttccttgctttccttgatcgccgtatccccaagccctaccagttcataagccggcagcccgttgtatacgtccgtctctacgagcaccgggtaaccatcgatcccgttaagcccgaaactcaaaacctttgctagcatccccatccccctttaagacgctgcttatttatccgtaaaacggccatgtcggcagccaccttagcgctgccagatagttaggatccgtcggaatacctgtaatcaccggatagaacgcaataaacatccccacacatgccgcgacaaatatccatccaaattgcttgccgtacctgaagtcatgctctatgttcttaagccagtaaacgataagcaatatcaggaacggcacggtggcgaaataatggtagataaatacctcgcgcgcgacaaaccaccacggcatgaattgcgaaagcgcggctatcgcaaggaacgtgattccccaatatttgtgttttcccttcgcactgtccacgatcagccagatgcacgcgacgatccccgaccaccagatcagcggattccccatggtcgaaagcgtggacactgtccccgtcacatcgttgtggccattgaagaacagtacgggccttacgtccgccggccagctataccacatggaagagaacggatgcacggtcgccggatcgagcgtcgaatggtaattcagcatatagaactggttaccgaccacgctgtagtggtatttcaggtcaccccaccttatccattcatatgccgttccgtccgtgacctgcgtatacggaatataggacagcaggtaaatcacggctggtatcaatataaagaagaatacacagctagaccatatgatcgccacattatacttatatgttttgacaagtccctcataatcgggcgcgcgactctgctttgcaaaccggtactcctttttccgtttccacatcgtgatcaggaaaattaccagcagccccgcccccgcgtaaatacataaccatttcgtcgccgcgccgatcccaaaaaacaagccgcttaaaaacaatggaacgatcgttttcgatagcttttgtttattgaaattcgcctgcgtaaactggaacatgaacagatacatgagtatgatccacaggatactgtagctgtcgatcgtcccgatcctagtttgtgcaaagtgcataaaatccgccgccaaaaggatcgtcgcgaaagccgcgtattttgtccttttcagcagcattttagcaaataaatagatcaccggtaacatcagcacacctgtgagcgtgcccatgaaccgccatccgaacgggttcatgccaaatagctgtattccaatggacaaaatcagttttccgagcggcggatgcgtgatctcgtatggctggatcccgttgatattctcataggccgtgcgtacatggtaaatctcatcaaaatagaaatccgtcatgtaggtggactcttcaggaatcaaatcctgctcgtcaaacaggttctgcgcatcggcagaattagaaacaatgcgttcaggaacgatccactgcccctccgcattcttaacggcaacctcaagtaccggcaattctccgtcgtccaaaggctgcagtctcaggtactttgcggtgatatccgtatcatagacctgccaacggtacatattcttgaattgatgctcgatcatggtctgcgtctctgtccctttttccaaggtcacgggagaatattgcagaccgtcctgcgaatactcgatattgaatgtttcctcgccatagcccgcataatacttgatctgcgaaatttgctccggctgtgaaaattctattgtgacaggctcggttagcacatctgccgtttcaggtatcttaaaggtcccgagattggtaaaggctacgacagcatagatcgcggtgatgagcagcatgatccatgtatcttttttggtcatatgccttttgttttcggtgaagccatccagcctgagctgctccggacatttggtcgtttcaccgctttcgccttcacctgccaagacgacccgcgcaggctccttgtattttacgcgtccaagcgcaatctgcgtgattacaaaagcagcgaaaacaaagatcgccatgttgagcgccgaaaccgcgactacccacccctgcggaatcacgacctggtaataatataacgtcaggctctggttcaggagcaacgcgataaacgttaaagctgtgcataggataagacgtcggtcgcggataaagatgtaagcgaaaagcaaaaggaccggcaccggaaacaggtaacgttcatgcatcccatgccctagggcaaacactcccatgatgatgaaagcagcgattgcaaataaaaattcctttttcggattcttcaggtacatccacagcgcgtatatgcatactgctacaatcaggatgaagccccatgcgttagcaggcaagccaaggaatacaaggcttgaagcatccaagtaatttacacccagcatgccatacaggttaaacgcattgagcgttacctgcggatattgcccaatcgttcccagcatgcggcttatgagccaggttggttcctgatcccccgcaaacggcaatggcacaaggaaaaacagccccaccattacgccgatcgaaaccaacagcgtcaggacacctttctttttgttttcgtttttcacgatattgcgtatgaatacgtaaagcaggaacggcgcaatcataatggcctgcggctttaacaggaatgcaagcataaacgccgcactggccagcaccagcttatccttgatgaccagccagatggtgagtacgatcatcagcgtcaatataatatccatttgtccccaagcgctggaattgaagatgaccgcagggttcaaaagcaaaaacatgctcaggaaaagcgccgtggaatttccaagtttcttgcgcgccatccggtagacagcgtaagccgcaacgatatcgcatatcatagccggcagacggatgatcattgcaaacaacggcgaagtgatattgatcgaaaacgcatcccgtaaaaagccgaggaaataaagcgcataaacgtaaagcggcgggtaatccgcaaagaaatcgctggtatagaagttttgcaggccgccttcgtaagaatagtttgcccacgacttaaagcagtccatatccgtcatatatccaggaagcgaataagcgatcacaagccttatcacaaacgcaatggctgcaaatataataaatgcaccggtagcggataactgctttttgaagggattaggctgtttttttgcgtggtacaaatataccatcagcatcaagaaaatcacgcctaaaacagtaaaccaaacaataaattcattctgtacttttagttgttcttccattcctgccgtatttcgctcagacgccaaaagcgtttctgatatagtttatcgacatatcaccgccatctacagatacttctgccacgtcaaaacgaaaattgaactcctttatgttattctgcatgatataccattgtgcagtttttacgatcatttgctgttttctatagtcgacggcctctcctgccgttccgtaccgctttgaggaacgcgttttcacctcaacaaaggcaatactgtcgccgtcgcgcgcaatgatatcgatctctcctttttttgcgcggtaatttcgcgccaacacttggataccatgctttttgagatagtcacaggtgaaatcctcccctgctttcccgagcgcaagtctatccatcactttcccaaaatcttccttaaaaaagttttcctgtggatatcgagtatcccatactgcgcgatcgcgtcgtaatgcgccttggtaccgtatcctttatgctttgcaaacgcatattgcggatactgtccgtcatattcccgcatgatccggtccctcgtcaccttagccaaaatagaagccgccgcgatcgtatacaccttggcgtcgcccttgatgagcgacgtatatgggatatccgtcctgatcgtcatcgcgtcggtataaacatgctccggacaaaccgaaaggccgtccaaagcattctcgaatgccatacgcgctgcattcaaaatattgatttcatctattaccttattatctatcacgcttacggaataatcaaccgctttttctactattatatcatatagtgcttcgcggcgtttctcggatacctttttcgagtcgtctatccccaggataaggtcatccaccggcatgatcacgcatgcggctacgaccggtcccgcaagcggtccgcgtcctgcttcatcgatccctgcgatcagatactgcccctgctgccaatgccgcttttcatactgcgtcatatatgcaagtttttctttttgctgttcttcgcgttttcccatttatacacgctccggtttctctaacgaaatccttcccatctttccatttttgaattcatcgagcagcgtctttgcgccgcgctccgtatcaaacgcgccgcccttaagcaggaatccccgcgccttgcagatatcgcaaaggatttcataggaatccttatcaaggtctgttagtttataacgctccgtcagcattttgggagcggatactttcaacaatgagatcaaatggaaggcgagcgcctcctcgtccaggatgtcgagcttgacgctgccgatgagcgcaacgaccgcacctgtattttcatctttgaatttcggccacaacagccctggagtatccatgatctcaagatggtcgtcaattttggcccattgcagggagcgcgttacgcccggcttgtttccttccaataatttttttccgcccgccagacggtttagtattgctgattttcctacgttcggtattcccgccaccatacagcgaagcgttttattcatgcccctgtcgctgtatttttttaagatgccctgcgcgcaatgcaggatgtcttttttcagcgtctgtgtattccccttagttgctgaaaacgcgaccgcccggataccctgcttttcaaagaacgctatccagcttttcgtaatattttcgtcggcaagatccgccttattcaggatataaaagcgtgtctttttggaaaacaagtcttcaaaatcagggtttaatgaacttttaggggcgcgcgcatccaatacttcgatgacgacatcgatcatcttaagcttatccttcagttgcctgcgggcttttgtcatatgccccggataccattgaatatccattatttgcttctccttcagatcgtaaacaaacgagccttgacacacagtctcacaataaaaaacaagggcttaaatgattttaagcccccgccttaacttgcttatttctctctgatcttagcagctttacccactctgtcacgcagatagaaaagctttgccctgcgcacctgaccgtgacgcagcacttcgatcttgtcgatacgaggtgaatggatcgggaacgttctttctacgccgatgccataagacaccctgcggaccgtgatcgtctcggaaagaccgccgcccttcttcgcgattaaatatccctcaaaagcctgtaatctttctctctgtccttcgacaacctttacatatatctttactgtgtctcctacctttaaagccggcacatcagtttttaactgttctgcctctactgccttaataatatcattcattttttaaagcctccttcccctgcagacgttcttacccgcatactcgggcagcggaccatcctaattcaaaaaacattaagagtttaccataacttgacctaataatcaagtttgatttttcaatttttccagaattgccttgtccttctcattaagatcagctttttcaaggagatccggccgtaccgttaaagttttcaagatcgcttgctctctttgccatgcctcaatatttttatggtgtccggataaaagaacctccggcacatccattccccgaaaggacgaaggccgcgtatactgcgggtattccaaaagatcgttgctgaaactttcttcgcttaccgattcatcatttgaaagaaccccgcccacatagcgcatcacgcaatccatgagcaccattgccggcagctcaccgcctgtcaggacataatccccgatcgaaatttcctcgtcgatgcaattgtcgagcacgcgttggtcaacgccttcgtagtgcccgcataggatgtttaatacttcatatccggcaaggcgttccgctgttttctgatcaagcggcctccccgccggcgacatataaatatttacatgccgtttgccttcgtattgttcctccagcatcgcaaaactgtcaaaaagcggttgcggcataaagagcattcccgctcctccgccaaaaggataatcgtctacgcggttatgcttatcatccgtataatccctgaaatttaccgtattgatctcaatcaggccctttgcaatcgccttttcacaaaggctgctgcctgtaaaaccggaaaacatctccggaaaaatcgtgagacaattaaatatcatcatatacgcaaacctcagaaagtcgtcttacatctacgacaatcctgccgttttcaacatctttttccaagacgacttcacggatcgccggaaacatgcagtgcctgccgggccctgtttccaccatataaacatcggcagcgccgttttgaaggatatccttgaggataccaattttattcccttcgccgtcctcaactgcaaggcctaaaagatcgcatacataatatgccccttccggtaattctgcggcatgctctctgtcaatatacaaaattttaccgcgcagcttttctgcagcatcccgatcattatagcccgctagctttaaatacgcataacgcgcgtctacacgcgaagaagatacctcaatcggctcgtagcttccatcgcttgtttgaaaaaacgcctgttccaaataagaaaatcgtgaaagatcatcggtataagcatcaaacttgacctctcctttgatcccttgcggcttgaggatacgccccagttcaaaaaaatccgtcatatgatctcaacaatatatttctttgacgctttcgatgtcgccgccttcacaactgtccggatcgcttttgcgattcttccctgcttaccaatcaccttgcccatatcgtccgaagctacgctcagttcaagaacataagcgttctcttcttcgcgctccacgacctttacagagtccggatcatccacaaggttcctggcgatgtattctaccaattcacgcattcgtcttcacctttattagttgatggcaccgctctttttgagtaatgcacgcgccgtatcagtaggttgtgcgccattgctgatccatccctgtgctttttcgttatcgagcttcaaatccttcgtaagcggattgtagtaacccagttcttcgatataacgtccgtcgcggggcgctctttcgtctgccacaaccatcctgtaaaaaggatttttcttggaacccattctctttagcctgatttttactgacataacaacctccaaaataatttcttgaaataatattatctaccgcttagcggttacgatcctttgatcacatgccgaatggcatcttgcccatcatgccgcgctttttcccgccttttccggaaaactgcttgagcatctttttcatctggtcaaactggttcaaaagtcggttcacttcctgcaccgtggtcccgctgcccgcgctgatccttctcctgcgtgaagcgttgatgacctgtggattgcggcgttcctcgatggtcatggagcgcacgatcgctttggtacgttcaagctgcttttcatcgagggtcatgcccttcagcttgtttccccccggcatcatcgccataatatcgcttaaggaacccatatcctgaagctgctccatctgatccaggaaatcttccagtgtcatctggtctttggatattttcttttgcagctccaaggcgcttttttcttcaaaagccgtttccgctttttcgatcagcgtcagcacatctcccattccgaggattcgcgacgccatgcggtccggataaaacggttcgatatccgtcagtttttcccctacgcccacaaacttgatcggcttacccgttaccgcgcgtacagacattgccgcaccgccgcgggtatcgccgtcgatctttgtaagaatcacgccgtcgatcccaatattgtcgttgaacgtggtcgcggcattgacagcgtcctgccccgtcatcgcatccaaaacaagaagcgtttctgtcggattcgccgtttgcttcaaatccttgagttcgttcatcatctcgtcgtcgatgtgcaaacgccccgccgtatccacgataatgatgtcgcatcccagtttatttgcctgtttcaacgcttccttataaatctttgaagcattgtcctgccccatgtcaaatacatctgcgcctacctgctctcctacaacgtggagctgctttattgcggcgggccgatagatatcgcacgcaaccaaaagcggttttttgcctcgctttttataataaccggcaagttttgcgcaaaaagtcgtcttgcccgcgccctgcagccccatcatcaggataacggtcggcggacttcccgcaagcttgatatcagcctgttttccgcccaagagctctgttaattcgtcgcgcaccagcttgatgacctgctgccccggcgtgaggctgtccagtatccctgacccgatggccttttccgaaagttccttgataaattttttgacgaccaggaagtttacgtccgcttccaaaagcaccagttttacttcacgcatcgccgctttgatatcgccctccgagagtttcccccgcgaagtcaattttcgaaatacattttgcagtttttccgcaatgccttcaaacgccatttatttctcccctaaaagctgccttttcaccaagccgagtttgccttccatatcttcaagcttcacctgcgcgcgctttagcgtatccagcacgccttgccgcgtgatcccgcattcctgcgcgatctctgccagtgaataatcgtcgttataatatagtttgaacaccttagactgtttttccgtcaggaactcgccgtaaaaatcataatacaggctcagtcccaaatttttttcactcttcatagcctaccgcctatcaaaaaacaggtgcatggcatgttgcccctgcacctgtctgattataaacgtttttatcacgcgtgtcaagcacaaaacctttacacctttagccttacaatccgccgctttgcaatcgctgcgccatgtcccggataataccactgcgctccgatcccctgaagtgttctgacgctttcatccgcctgtgcaaaatcctccgcaataggcctgcccatcgttaacaattatctccgccaaaacgcaggggaataatcttcgtcattattccaggatcgcctttgcaaattcttttgcatcaaaaggctgcaaatcgtcaacgccttcccccactccgataaagcgaaccggaacgcccgtcatatccttgactgcgcataccacgccgcccttcgccgtcccgtcaagtttggtcaatacgattcccgtcagcttcacgctttcgttgaatatctccgtctgcgagatcgcattttgtccggttgtcgcatccaccaccaggaatgtctcgcgcgttgcttcagggtaggatttgtcgactacgcggttaatcttttcaagctcgctcatcaggttcttcttattgtgcaggcgtcctgccgtatcgatgatcagcaaatcgatatccgcatgcttgcccgcgtcgatcgcgtcgtacacgactgccgcagggtcggctccttcggcatatttgatcacgcgcgtattcgtgcgctctccccagatggaaagctgctctgccgccgccgcgcggaaggtatccgccgccgcgagcatcactttttttccctgctgtccataataattggcgagttttccgattgccgttgtttttcccacgccgtttacccctacgatcagcatcacggtcggtttcttaacctcaagcggcggcgcgctcatataatctgctaaaatattgatcaatatatccttgatctccgtcgaatcagagattttattctccttgaccgtatcccttagcgattcaatgattttatctgtcgtcgcataaccgatatccgaaaggatcaacgcttcttccagttcctcaaaaaattcttcatccactttcctgaagtttttgatgacattattgaccttagcggaaatattgtccctcgtcttattgacgcgttcttttaacttatcaaaaaatcccaatgcttgttaccctcgctttcgcctgtttaaaactgtaccgatacaatgtccgatacgcccttttcctgcattgccacgccataaagcgtatcgcatatcgccatggaaggttttctgtgtgtaatcacgataaattgcagctcgctcgacaattttttcaagtattcggaaaaacggatgacgttcgcgtcatcgagcggggcgtcgatctcgtccagcaagcaaatgggcgaaggattgatgttaagcattgcaaacaaaagcgcgatcgccgtaagcgccttttccccgccggacaaaagctggatgttctgcagcttctttccgggcggctccgcaatgatctctacgccgcactccataatatcgtcctcgtccaaaagctcaagctgcgcatatccgccgccaaacagctcctggaacacttgtttaaagttctcgttgatctgcgtaaatttagccttaaaactttccttcatgcttgaaagcaaattatcgatcacgatctgcaggtcgtcgcccgctttcacaagatcttcgcgctgcaccgtaagaccgtcaaaccgctcgcgtacacgcgtatagtcttcgatcgcattcgggtttaccgcgcccatatcgcggatgcgccccctgatctcgtctatttccttggtggacgactggaaggcaaagtccgtcctgaatgcgagcgcattcgcataggtaaggccataatcatcccacaatttattttggtaagtctccttggaaacttccattttttccttgtttgcgatcagcttatactttgtctcgattagcccgtccttttgcgctgctagccgtttttgcgcctgctccgtttcctcgagctgcctgtttaagctgtcgcgctcttcgagcttttcctgggaagccttccccgcctgccggacatcctccagaatagtatccatctgggcgcgcagttcggccttttgatgcgtgatccctttcagttccgccgtcaagagctcgttctgacgcagcatattgttaagttcctgcttcgcgtttgcggcagcattacgcacatgctcggcctcgcttaaaagcatatttttctggttgttaagctgcgtctgctctaattccagcgcagacaggccgtccttgatttcagaggtttccaacgctctcctcgctgccgcgccttccatttccgcaagtttattcgtcaacgtatcaaattcttcccgcgccttgataatatctttttgcaatccgtcgatctgctcgcgtgcagtctttatatccaacgaaataccctgcgcagtatcattaagctctgcagtgatcctgtcacggtctgaaagctgctcctgtgccgactttagggcctgctttgctgccgccgcacgcacctccagcgcacgcagatcgtcaagggcctgtttttggacggattgcgctttttcgatctccggatcgattgccgaaagctttttactgtattgctctaattctttcttgttttctgtgatatttttttccaactcctgcgccatgcgcttgcgcgacaaaagtccggtcttggtatttttcaggctgccgccagtaataactccgcctggcttgataaagtcgccttccatcgtcaccgcgcggaacgcatagtcagccgcgcgcatgagtttcgtcgcactatccatatcacgcacgatgaccgtcctgccaagcaggaaatcaaccgcgggcctgatttcatcgctgcactttattgcttcactggcgatgcattccacgccctccatagaaagatgctttttttcttccggctgcaagcggcgcaccttcaaagccttcgttggtaaaaaagtaacgcgtcccaaattattttttcgcaaatgcgcgatcaggtctttggcgtctgtatccgtttccacaacgacgttttgcagggcgtttcctaaaataacctcaataggcgtttcatactttttaggaacctcaataatctccgccagtacgccttttattttccgccctatctccggcgcttcttttgcgcttttcaaaagagaacgtacgctgtcgaaatagccttcatactcttcacgcatatcgtttaaaagcctcatgcgtgattcatcctcattcagcttccttgcgatttccgcccgtccttcggcatatttctgtttctcactttgaagatctgccgccgtatgtgcggactcgttcatcaccttgcgcagttttgcgcctttttcgtcatactctttgacttctttttcaagggcctgcgtcgtatctttgatttcgcttaaatactggttatgcttttcacgctgctgctccgcctcctcgagcttttgtcccagcacttcttccttgacctgtttttcgctcagggaaatattcattgtctgcaaagctgtccgcgcgctttcaacctctcgctttaagtcctcgatcccgctctgtacgtctccgctttgtcccgtgatctgttcaaccgattggcgcatttcaaggatatgcgcatacttttcatcaaggaccgtattcagcccatcgatcttatcattgatctcctctgttttctttacgctttcttcgatcgccatgctgagcgcatcgcgtttttcggcgttttcattgagcgtattgatatgcgtctgctctttttcctccatgaggttcaattgcccgcgcaggcgctcctgctcgctcatctgctgtcccagcgccacattctgcttctcaatctcttcctggataacctgcaattgctttttaatatccgaaacaagcgccgtattcgcggcgatgcgctccgtcatatccccaaattcttgttcgttttccaatatctgctggtcaagtcttgccgtacgctcgtccgtccggtcgcactggtaaaggtacaaattgatttcaagctcttttaaacggtcgcgcagcgaaagataatccttcgcctcgttcatttgcttttcaagcggctcgatctgcgcggaaagttctgaaaggatgtcgtccatcctcgtaatattttcttttgttttttgaagattgcgctccgcttcttccttgcggacgcggtatttcatgatccccgccgcttcttcaaacactttacgacgctgcacggctttgcttgtcagcagttcatcaatcttgccctgcccgatgatcgaatacccttccttaccaatgcccgtgtccctgaaaagttccaggatatccttcagacggcatccgctgttgttgatataatattcgctttcgccggaacggtacatcttgcgccggatggaaatttccgtatagtccatcttgatgcgcatatccgaattgtcgaatatcaggctgacttcacagtaattctttttactgcggctttgcgtcccgttgaaaatcacatcctgcatactgcttccacgcaggtttttggagctttgttcccccaaaacccaacgcaaagcatcggcaatattgctcttgccgctgccgtttggaccgacgacccccgtgatccctttattgataatgatgtccttcttgttacagaaggatttaaagccgtttacttcgattctttttaagaacactgatcttcaggctcgctttcctccaatattcttaccatcgtgtatacctttgcaaattttttcttgaaatagggattcaataacttcagtatcaaaaacgcagcagcagcaaacacgatccctaaaattgccgccaacgcgtcttttaccggaaaaacatcctgcgggatcacatagccaagccatacccccacaaacagcatgatcaaaggaaaaatatacgcgattgccgacgacatcagtgcatttttcgtcgtgaaatgtacctcgacccgctcgccggtctttgcgtgaagcgtattatcgactgtcacggtgatatcattctgtccggcaatcatcccgcatgcgccgcatttggcgcaggccgaggtgcggttgaatttcaaatatgccatatccccttcgatttttgttaccagtcccgcttctttcatccttcaactcccgcaagagccctgatcgccacgcccgccatcaaaagcccgcacaccgacggcacaaatgaaatgctcgccggtacgcgctttccatcctcctgcgccgccgttttataaggcagttcgtcagagcatacgaccgttaggctgtcgatgccgcaattccgcaactgtttccgcaatatctttgcgatcgggtcgcacgtcgtcttgtaaagatccatcacaccgaaacgttcagggtgcaatttatttcccgcgcccatggaagaaacgatttcaatgtttcttcttttacattcacagatcagcgcgactttcgacggaaggctgtctatcgcgtctaccacgtaatcgatgtgccgaccttcaaaaatactgtccgatgtatctgtatcataaaatatatcgtgcacaattacgtcggcatccttgttgatatccaatatccgctcgcgcatcacgtgggttttatgcctgccgatcgtcgaagaaagcgccaccaattgacggttgcagttcgacggcttgacaacgtcgttatctaccaggataagcgtacccacccctgcgcgtgcgatcgcttccgcggcaaacgaacccacgccgcctacgccaaaaacagcgaccgtactattcttcagggtatccaccgcttgctgtccgagcaacgcgattgtccgagacgcatccattttaatcttcttctacccgtatatgcagctcccgcagttgctttttgtccactacgtccggcgccttggacatcaggtcggaagcattctgcaccttcggaaaagcgatcacgtcgcggatcgagtccacgcccgccatcagcatcgcaaggcggtcaagcccataggcaagcccgccatgcggcggcgtgccatatttaagcgcttccagaaggaagccaaaccgatcccatgcttcttccttggaaaatccaagcgcttccagcatcttttcctgtagctccgtgctgtgtattctgatgcttccgccaccgatctcgtttccgttgagcacgatgtcgtatgcctttgcccgtgcgtttgccggatcggaaacgaccttgtccacgtcctcgtccatcggcgatgtaaacggatgatgcttcgctacatagcgtttctcttcctcgctgtattcaaacagcggaaattccgtgacccacagaagatcccatgtatttggctgaatcaactccagcttttcagccagcttcaagcgcagcgcgcccagcgaatcgtacactacggagttcttgtcgcctacaaagaacaggatatcgcccacctgtccgcccgtgcgctgcatgatcgcgtcgatttcctcctgtgtcatgaacttagtgatcggcgaattgagtccgtcctcgcggatggagatccatgccatgccctttgcgccgtatatttttacaaaatcgacaagcgcgtcaatctcgcggcgggccaaaatatttgcacagcctttggcgttgatcgcgcgcacgctgccgccgtttttgacgaccgaactgaatactttaaactcgctgcccgcgacgatatcgctcacatcgttaagctccaggccaaaacgcgtatccggcttgtcgctgccaaaacgatccatcgcctcctggtatgtcaggcgttttagcggaagtttgatatcgatatccatgacgtccctgaaaacacgctgcatcaggccctcgtgcaccgccatgacatcatccgcctctacaaaggacatttccgtatcgatctgcgtgaattccggctggcggtctgcgcgcaggtcctcatcgcgaaaacatttcgtgatctggaaataacggtcatatccggaaatcatcaggatctgtttaaaaagctggggcgattgcggcaacgcgtaaaaacatcccgcatggatacgcgacgggacgagataatcgcgcgcgccttcgggcgtacttttttgcagcataggcgtttcaatatccaaaaatccgttttccgcaagatagttccgcgcaacgtttgcaattttgttgcgcagcatcaaattcttctgcatttccggacggcgcaggtcaagataacggtatttcaagcgcagttcttcgcgcaccttgctcccgtcctctaactcaaacggcggcgtttccgctttgctcagtatcttcagttcgcgtaccttgacttctataagtcccgtaggcagcttcggattgatcgtatcttccgaacgcttcacgatctctccttttacagcaagtacaaattcgctgcggatacttcctaccttatcaaaatcgccctcaaacgcggattcattgaacaccacctgcatgattccggaacggtccctcaggtcgacaaacaccagcccgccaagatcgcggcgcgtatccgcccaacccatcagcgtgacttccctgccgatatcctccgtagtaaattcggcgcaaagcgcggtccttttccagtcctgtaaaaactctcccattgcttactctcctaacaatctaaaaatcatatgataaacattttaatttcgtcttgtttaacggcgcgttcctcacccgtctccatcgttttcaggatcgccgttccctgctccatttcctcttcgccgatcactaccactatctttgcgccgagcttgcccgcatacttaaactgcgccttgatactgcgcgcacaatgatccatatccgtcttgatcccttcgccgcgcaggtcgcgcacgagctggatcgcttttaaacgcgcctcatcgccgtgcgtgcagataaatacatccgtaacggacggctccggtatttcgattccttcgctttccatcaccaaaagcagtcgttcgatgcccatgccgaatccgatccccggcatatccggcccgccgatttgttttaacagcttatcgtaacgtccgccgccgcacaccgttccctgcgcgccgatgctgtccgatatgatctcaaacaccgttttcgtgtaatagtctagcccacgcacaatgaggggattgatcgcatattcgatcctcaatgcttccaggtatttttttaaattctcaaagtgcgtcgcgcattcctcgcaaagatgatcgatcatcttcggcgcatcagccacgatcttccggcagctctccaccttgcaatcaagcacgcgcaaaggattgcgttccatgcggtccctgcacgtctcgcacagctcgccttcgtgttcctttaagtacgccttcagcgtttcgttatactgtggcctgcatttgtcgcagccgatgctgttgatattcagtttcagttgtttgagtccggcttttttaaaaagcgtaagcgccaggttgatgacctccgcatcaatacttgcgtccgccgccccgaatacttcgacgccaaactggtgatgttcacgcagtcggccggactgcggcttttcgtaacggaatacaggcgttgagaggtagtacatcttcgtcggctgcgcgtttgacggtaaaccgccttcaataaacgcgcgcactacgcccgccgttccttccggcttcaatgtgacggagcggtcccctttgtccgtaaacgtatacatttctttttgcacgatatctgtcgtatcgccaacaccgcgtaaaaaaagctccgtatgttcaaacacaggcgtacggatctcgcggtaccctgcaagcgccgtcacttcgcgcgcaatatcttcaatataatgccacttgtaactatcctgcggcaaaacgtcctttgtacccttcggtgcctttactgccaatttcacttcctccaactcatctaaaaaaacaaaaaaccccgcccataaaagggacgaagtcactaaaaaacccgcggtaccacccacattgaaagctgcttaggctttccactctcgcctctaacgcaggcctgcgcctatggctaatcgcgcatgctttcaccataaggactctccggtgttcttccccatatcttaaacgcacggccgctctcagccacggcaaccgctctcttatacgcaaggcacatgggtactctccgtgtcatcgccttttccaataggtatattatatccgcaaacgggaagcgtgtcaataaatcaaatcccttgtcacaccctttaaaacagctctttttttcgctccgccatttcgcgtgtcctctcgatataattcgggatatccttgacattgggagcccgcttcaaaagatttttctccggatacagtttcttcgaaatcccgcccgcgccaaacgccatcacgctcaccgtttcttccatgatatcgatattgtaaacagattccttgcccggctttgcgaacccgacattttccatgtttccgctcatatatttctgcctgtaaaggtaatacggcaaatatcccgcttcgcttaaaaagttctgcgattgttccaccatttccaggaccatccggctatccagcaaatcctggttttccagcgcaaaatccgatgcatttttcagagccagcgtatgcaccgtgacattttccggttcaaaacgcgtcacatccgtaagtgtgcgcagcgtatcttccggcgtttccaagggcaaaccgagtatgatatccgtgttgatgctgtcaaacccataggtctttgcgagctcaaatgcgcggaagaagtcgcccgcgtcgtgcttcctgccgattcgcctgagcgtatcgtcgttcgtggtctgcgcgttgatgctgatacgccctgccccagcgtctttgatacgatcgagcttttctcctgtaatcgtatccggcctccctgcttccaccgtaaattcacgcgggtttggaaaatattcatttaccgccgagagcaactgcgaaaatgcggggggatcaagcgctgtcggcgtcccgccgccgatataaacggcgcgcaggcgataccgctccagcaccggtttcatgagttcaaactcccgcagcagacattccatatattcgtccttcaatttggcattgaactggatatccctggatataaacgaacagtatttgcagcgcgatacgcagaacggaatcccgatatagatatcgatatcctgcgcgtcaatatcggcaagatacggtttttgccggttgatgatcgtttccgccagtgaaattttaggctgggaaacaaaatacgtttcacggaatacacgctttgcttcaccgattccatgctttttttccaactcgcgcatcagtttagtcggccgtatccccgttaaggagccccatggcttatcttccccataaaagctacgcaacacggcataaacaatgcctttcacatggtgcttcttcaactttttggtcagcaaggtaggctccgtcatatcgacctgccgcccgtcctcgcaaaacgtcggctgtatttctatcttttgctttaattgtccgtcaatataatattccgccctgccgcgccatccttctttgccgcgccaaaaaaaatggcgcagtaaatgtccggcattcatttcctcccgcgccactgtctcaatatgtttttcgttcacaaaaagacggatttcttcacagatatcattataaaattccggcgtatcagtatataaagaaaacatatgctacctttgcataaatgggtttgttcgtttttcacgttcaagcgtcgtcgcctcgccgtgcccgggatatacggtataatccttctccacatcctttagaagcgcaagcgacccctgcatttcttcccagtcgcttcccgggaaatctgtacgcccaatcgaacccgcaaacagcgtgtcccccgagaacataacgtcgcctgcaatatagcacacgccgccatgcgtatgccccggcgtatgcattacccgaaatgaaagccccgcaacatcgatcacatctccgtctttcagcagcatatccgcctcgccaaggtcgaccgtgtgtcccagaaacgcacataggttccgcgaaggatggctgagcatatccgcatcgcttttgtgtatggctattttcgccccgaaacggtcccgcagttctcccgcggccgccatgtggtcggcatgcccgtgcgtcagcaggatatgcgaaacgttgagccccagcttatcaatctgcgtcatgatcgcgcgcgccccgtcgcccgggtcgataatgaccgcgtcgcgtgaaccgtcctcacgtacgatataacaattttcaaaaagtccgctttcgcggcccgtaatcaccgtatcaatcaacatttcttaaaattcctttttgctgtccaaaaggatcgttaccggtccgtcgtttataagcgccacatccatcatcgcctggaattgccccgtttcgacctttggccatctttcgcggaatacctccacacattgtgcaaacatatcccttgcggtatcagggggcgcggcatggatatagctcggtctcctgccctttcgcgcgtccccataaagcgtaaactgggaaaccagcaaaagctccccttctatgtccctaagggacaagttcattacatcatccgcatcttcgaagatccgcaagtttaagcacttatcggcgatgtattccatatccctgcggacatcctctctgcttaatccgatcagtaccagaaggcctgtgccgatactgccgacgatattgccttccaccgttacggaagcattttttacccgttgcacaaccgctctcatatcttcaataattgacgcggaacacgtcctttactccctttaagttcctcaatttgttgatcaggtcattgaggtcgtccacagaagtaatattcgacctcagcgaaatattggccatcccgtttttcgcagaatgtgcattgatagctgtgatatccttatttgcattatacatggcctgcgatatctccaccatcagccccggcctgtcgtctgcgatgatctgcacttccacattgtaactggccgtctggtccgccgcccacgccacgtcgatcagcctgtccttgtccacacccatttcctttaggtttttacaatccttcgtatgcacgcatacgccgcgtccgcgtgtgatatagccgacgatatcgtccccgggcaccggattgcagcatttcgcaaaacgcaccgcaagacccgtgcttccttttaccgtaacgtcgtcttccgagcctttgcccgtccgtttgacaattttaagttcatcgcttcccgtatcgattttatttgcaatcttatattgctcgatcagttttagcaggatctgattcaccgtgatcgaaccatatccgaccgctgcaaacatatcgtcctgggaattgagcgtaaagcgcttataaaggacgctcagccagtcgttattgagcagttcatgaaactgatacccctgcctcttcgcttccttttcgagcatctcacggcctttgacgatattttcttccttaagctgttttttaaaccattgtttgatcttgctgcgtgcctgcgttgtcttgacaaatttcagccagtccctgctgggcgtcgccgtattggatgtcaatatctcgataatatcgcccgtgcgcatctggtaatccaacggcaccagcttgccgttcgctttggcccccacgcacttgtttccgattgcgctatggatgctgtatgcaaaatcgagcggcgtcgacccgctaacgaaatcttttacatcacccttgggcgtaaacacgaatacgttgtctgcaaagatatctaccttcagggtctccataaattctttggagtccttcatatcgttttgccattccatcagctcccgcagccacgaaagttttgcgtctatgtcggttccgcccttgacgccttctttatacttccagtgtgcggcaataccatattccgccgtgcggtgcatatcataggtcctgatctgcacttcaaacggttttccgtcgtctcccaaaagcgtcgtatggagcgactgatacatattttgtttcggcactgcgatataatctttaaaacgcagcggtataggcttccacatggtatgaaccagccctaatacgccgtaacaatccttgacgctggaaacgataatacggatcgcgatcaggtcgtatacctcttcaaagaccttgttcttatttttcatctttttgtagatactatagatatgcttgggacggccttcgatttctgccttgatcttcatttccacaagcttgtcttccagctttgcaataacggaattaatctgcttttcccgctccagccgcgtcgaagcgatcttattcgcgatttcaaaatactcgtccggatgcaggaatttcagggacaggtcctcaagctcccacttgatcgcgctgatacccagccgatgtgcgaggggcgcgtagatttccagcgtttccgtcgctttttcgatttgtttgttttccgactggtacttgagcgtacgcatgttgtgcagccgatccgccagcttgatgatgacgacacggatatccgacgccattgccagaaacatcttacgcaggctttcccactgttgctcctcccgcgttttaaaatcgtaatttttgagtttggttacgccgtccaccagcttggcgatctcagggctgaattgcttgctgatatcctccgtcgtaagcgccgtgtcttcaaccgcgtcgtgaaggatcgtggcgatgatcgtcgtattatcaaggccgaggtcggcaacaatatccgcaactgcaagcggatgcgtaaaaaatggttcgccggaatggcggaactgtccttcatgtgctttttccgccatttcaaacgctttgtccacgtctgcatcgtattctaatttatgccgtcttaaaaattccttgtaatagtccgacacccaaaacttccccttttcaactcagtattgcacctgagaatatacgttgtaatccttgagtacttcacgtcctccaaggtcagtaagctcgatcacaaaatttagcgaggatacctttgcgcccgccatctcgaccaattcacacgccgccttcgccgttcctcccgttgccagaaggtcgtcgaagatcgcaacacgcatgcccggttgaatcgcgtctgtatgcatctcaaatttatccgtgccatattccaacctgaattctacatgaaaagcgtcatacggcaattttcccgctttcctgaccggcacaatgccttttctaagtttataggccaccggcgatccgaacaaaaaaccacgggcgtccaggacgacgagcatatccacattctcgtccttcacatgatccgcaaaatcatccgtgacatatgcaaatgcctccgcatccttaatcagggtcgtaatatccctgaaaataaccccctgttcgggaaaatcgttgatatttcttattttttctttcagatccatggcccgcttctccttttaagcaaactttatataaatcacgcttttacaaagatcgcgcttttcgttttttaccataatgtgtattctatcacttttttccatttctagcaatccaatctcgctcagtaccgatactgcaaacgcaacattcgccgcgctgataccatccacgtattttttcaggaaggctacaagcgccccaatatccggaaacgttattttctggtcgctgattccttttaagatcacaaaaagttccaatagcttctccctcggacaaaaatacgcttcctgctccgtctgcgagggcttcacgcattccaaaatatatttttcagctttttcatactgctgcttcagcgtttcatcaaaggaaaacgttcccacgatcatctgcggtttattgtcaaaggaattgatattcagcacgcctacgatgtccgccgttttgggaacgtcgcccgcctgcataccaaacacaacgccgttgactgcccgcttatattcttcaacctggaatttcgcatgcttgtcctcgccgatcggacggatgttcttcatatgcgcattcctcaccaaaacctcaatctgttcgtttttatggccgaacggctttagcttgtcgaattcctgtatcaggcggttgctgatgtctccaaccttaacttccatgtcataatatttcacaggccgaaaggtctcatccgtataatgttcgtccatataggagttcaggcggcgaagtagctgctttaagtgctcttctttgatcgtcagccctgcggcgccggaatgcccgccgaatttctcataaaattgcgactgcgatttcagcgcgtcatagatgtttacgccgtctatactgcgcgccgatccggtatatacgccatcctcttccgtcccacccaaaaggacggtaggacgcacaaacgcttccgctaccttggatgctgccagtcctacaataccgatttcccaatcttttttataaagcagaataatcttgctctcttcgcgtccggcgaccatctgcatcgcttcttccacaaccttttcctgccgcttctgcctgtccgtattcaactcgcatagctgctttgcaagctgttccaatttactttcattggtatcgctcagcagttcgaaggcaatcctagctgtggaaatccttcctgccgcattgatgcgcggcgctaaaacaaaggcaactgtttgcgcatcgatctcattgcgtttgggacacgcttgtgcgatcagcgccgcaatgcccgggtttggatccttgttgatttttttcagcccgagagctgcaatgacgcggttttctcccactagcggcacgatgtccgcaatcgtagcgaacgccgccaaatcgatataggcaagcgcgtgcttgccgagcaatgcctgcgcaattttaaaagcgatgcctgctccgcacaaatccggatacgggtaactttccccagtacacttcgggttcacgataaaatcagctttcggcagaacgtccggacattcgtgatggtccgtcacaatcgttttcatacccagcttatgcgcatgtgcgatctccgcaacgtttgtaatgccgcaatctacagtaatcagaagagacgttcccttcagcttatcgatattggcaatagagaggccgtatccgtgctccatcctgtcaggaaggaaacattccacccttgcccgcagtttcttaagcgcctgaaaaagaatcgcacacgcggaggttccatccgcatcataatcgccgtatacacaaatttttccgtttacggcaatcgtatgcttaatcatactgacaacatctttcatatcccgaaacaggaatggatcgttcaactctttgatagccggattcaaaaaggcatgcgcctctttcgcatcagtgatcccacgggcgcataaaagctgcgctgtaagcctggagacagaaagttccctgctcaattccccaatcagggcctgatcgtttgtcactcgtggtttttgctttagcacatacttcattttcttcaaatccttttgttttcaaaaaagaccctcttgtgtaagaaggtcttttctttcttatgcttttaccgtctttttgtttgtcttctgctgtgtttttttcttcgctccgctcttaccctgttttttctttttcttgtcaaacttatctgccagcagcgcccataaaggtgcagacaggaacacggatgaataaattccggcaataatgccgacaatgatcgggaatgcaaattccttgattgccgcaacgccgaaaatgtaaagcgcaaggatcataataagcgtcgttaccgacgtattgactgttcttgtaagcgtttccttgatacttacatttgcaatttcattacgcgtatactgctttagccccatcactttaaggttgtccctgacacggtcgaagattacgatcgtattattgatcgcatatcccactaccgtcaggcatgctgcaatgaacgcactgttgatctgtatctgtaaaatacagacgatcgcgatcataatcgcaacatcatgcaccagagtcaccactgcgctgataccattataaagctcaaaacggatccaaatatagatcagcatcaatacgcacgcaaccgcaagcgccaaaaatgcatttctgaccaattcgctgcttgttacgccgccaacacggtctaccgaagcaatcgttgcatcgggatatgtttgctgtatttgctcgataatcgcagaattgacgtccgcctgctcgttttcgtctgaaataagacgcatgcgtatctgcgcctgcgtaaagttttcgccagtctgcacgatcggcgaatctcccatacccttgtcctccagcgcttgcttaacgacattggtatcaaaatcaccgttgaattcaattgtcgtaatgttaccgccggtaaagtcaatgcccagattaagtccaccgtttacggctccaaagataatgccgattacgataatcacaacagggacgagtgcaagccacttaaacatttttgtaaacattatgctgcgcccccttcctttttcgccttggctgcagcgcggatttcctttgctttagccataaagacgttcgggtttttgatgttcaggttgacaaacatcttgagtattccgcgcgtaataaggagcgcagagatcatggatacgataatactgatgatcagcgtatacgcaaagctcttaagcgtaccggctccgaatatcgccagaacgattgcacagatcagcgtcgtgacattggagtcaagaattgtcacaaatgcctttctaaaacctgaatccaccgatgtgcgcaatgtttttccggccctgaactcttccttgaagcgttcgaaaataataacgttcgcgtcaaccgccataccgataccaagaatgataccggctatacccggcaaggttagctgtacccccgggacgctccccagcaacaataggacaaagcatacataaaccgccagcgccatgcaggatacgagccccggcaggcggtaaacgatcaacataaagacaaacaggatcgcaaggccgatcagtcctgccataatactgttttgaagcgcgcctacacccagcgtcgcgctcatcgaacggacttctacttctttcaggtcaagcggcagcgcgccgctttcaatctgcaaagcaaggttgtttgcttcctcataagtaaagccctgcgttccgccattgataacaccttccccgccggcaatcaccgtttggactgtcggagatgaaatcgtttcgccgtcgatagtaatcgagatcgcctttccaagatatttcttggttgcttccgcaaaagcctcagcgccctcatcattcaatttgaacgcgactgcatatgcgttccggttatttgaatcctgcgttacctgcgccttttcaatctgttctccctcaaggattgtgttcccatccggatcaacgaatgcaagctttgccggcgtaccgatgaacttcgatacttcatccggatcctttacctcgctgctctcgttgattggtatctcaaccctgattttatccgatccctgtttggtgatcgttgcttccgtatatccctttgcatcgagacgttgccgcaataccagcattgccccgtccattttctgatcaaaattctccactgatgtatcgtctgcctgatacacgacatacacgccgcccgtcaggtctagcccctgctgaataccgctcaatggttttacatcatatattccggctgaaaacccattgacgacaaagacgcacagcaaagcaatcaaaacaaatgtaacgataataccgattgcgcttcgctttttcatccatcgttcctcccaattttagtattaccataaacgtctgaaaacgccgtttcttcgtcaatggtgaaaaacggaactgcccgtgcgtaagcatttgcacaaagcaattccccataaaaactcactaatatattatatagccgcaaagctcaatagtcaattggaaatcaagggatcataaatcgaacaggctcaattggttcgtttccgtaaggcccgtcagcgttcccattttttgcatttcttctatgaccgaggtggaaacctttgcgcgctggcgcaaatcttcaatggaaagaaattccgctttctcccgttcctccgcaatattagccgcaacactgaggccaagtttaggcacagataagaacggcaggcgcaatccttcctcctcaatgataaatttatcaacgtcggattttttgaggtcgaccggcagaaaatgaatgcccctcagatacatctcgcatgctacttccagcattgtagccatattcttttcgttcgcggtcgcacccttccctttattttcgagcatctgccagttctttttgatatcgtctaagccgcccgttacataagatgcgtcgaattctcctgaacgtactgtaaaataggatgcgtaaaacgcctgcggatggtgaaccttacaataggcgatgcggtaagccataataacgtaggccgccgcatgcgcctttggaaacatatatttaatctttttgcaggagtcaatgaaccactgttcaatatgtgcgtcgtccagcgccttttgcatatcctccgtaaatccgttcttggcgaccttcccttttctggttgcctccataatgaagaatgcggttcgcttttcgacaccgcggtcaacaaggtaattcataatatcgtctcgcgtacaaattgcttctttcagggtacatgttcccgctttgatcaaatcctgcgcattacccagccacacgtccgtaccatgggaaagtccgctgatccggataatttcagacatactcgttggtttggtatccatcagcatctgccgcacgaactttgtaccaaattccgggattcccaacgtccctgtctggatccccagtaaatccgccggttttattttgagcggcttcaatcctgaaaacagttccatcgtctgcggatcgtccagcgggatggagagtggatcaatccccgtcatatcctgcaaaagccttatgattgtcggaacatcatggcctaggatatccagtttgatgagtatatcgtgcatagagttaaaatcaaagtgtgtcgttacccattccgcgtccgctttgtctgccggatgctgcacaggtgtaaaatcgtatatctcacggtcgtgcggcacgataacgatcccccccgggtgttgtcccgtcgtttttttaacgccggaaaccccttgcaccaacctgttgatctctgcttcgtttgcgtaggtccccgtttgttccagaaacttttttacataaccatacgcaatcttatcctgcactgcgctgatcgtcccagcgcggaatacatgcccctcgccaaagagcacttccgtatatttatgcgcgaccggctggtattcccctgagaaattaagatcgatatcagggaccttgtccgcatcgattccaaggaatacttcaaacggtatatcatagccgtcctttaaatattttgtaccgcataccggacaatctttatccggcaaatccacaccgaccggataactttccttatccacatcaaaatccgagtgtttacagcttgggcagacatagtgcgggggcagcggattcacttccgtgatccccgtcatcgtagcagcaaggcttgagccgaccgagccccgcgatccaaccaggtacccatcttcatttgatttcttaaccagcctgtgtgcgctgtaataaagtacggaaaatccatgtcccacgatggaatccaactcccgcctgagtcgcgcctctatcatttccggcaacggatcgccatatttttcctttgccgtcttgaatgccagttccgtgatatgctccgcggcgccgtcgatgctcggcatcgccgtttccgactggaataattcgatttcctccgtcatatcggcaattttattagaattttccacaacgacttcatatgcggtgtcttcgccaagataggcaaattccttcagcatttcatctgttgtgcgcagatataatggagcctgctccgtgtcgtcatatccctgcacctgaaaaataatacgccggaaatattcgtcctgcggatcgagaaaatgtacgtcacacgttgcgacaacaggcttattaagtttctttcccaattctacgatccttcggttacaggccctgatatcgtcttcactcgcaaggattccctgtttgaccataaaagcattgttgcctacgggttgtatttcaagatagtcgtaaaacgacgcaatttcttccagtttcttttggcctgcgcctgaaagcagcgcctggtaaagctcgcctgcttcacaggcagagccgataataaggccttccctgtgctcttcgatcaggcttttgggcatacgcggtttgcggtaaaaatgttccagatgcgcatgcgaaatcaacttgtaaagattgcgcagtccttgcttgtctttgcatagaatgatcgtgtggtatggccgtgcattttttccgcccgcatgccccaaaaacaaacggttcacgccttgcatatcctgcgcgtcattctttttgaactcctcaaagcagcgaagcataatctccgccgtacagactgcatcgttgactgcgcgatggtgatccagcgggatacgcagatgcgcggccacagtattcaatttgtgatttttcagagtcggaaaggcaagtcggcacagcgccagcgaatccacaaccttattatgatacgtgataccaaattccttggatttgtgaaaaataaacttcgtatcaaaatccgagttgtgcgcaaccaggaccgcctcttctccgcaaaattccttgaaagcacgcagcgcctcttcgggcagcggcgcatccttgaccatatcgtccgtaatccccgtaagggatacgatcttgggcgggattggtttgagcggctttacaaatgtctggaaacgatctgttttctctccatttttgacacgcacagcgccgatttccgtgatatcgcaattgatatgcgaaagacctgtcgtttcaatatcaaaaactacgtattcgtcgtcaaagctcttcccgccgttggaatcatatatctttttggtatcgtcgatcatatatgcttccacgccatagatcacacggataccgttttgtttggctgcatttgccgcatccgggaaagcctgcacaaccccgtggtctgtaatggcaatcgctttatgcccccactgcgctgcccgtttgataatttcacgcacatcggaaacgccgtcctgcgccgacatctgcgtatgtgtatgcaactccacacgcttctcttgcgccgtgtcttcccgctgcctatgattggaacgctcgattttttgtgccttgatcgttttttcatgctcataggggtcgtcgctgcacatccctgtgaccacgatccattgccccttcttgggcgcggccagctttgtcttatatttactgctctccagaaaaaagcaggtaatgcttgcgctgtaatcgcatactacgaatttatgcttgacaagttcaccgtcttttaattccctgtcttctgtaaaaacaacttccccttcgatcgtacatttttcatccgcccgcagattacaaacctgcgtcgtaaacgccgggacagccgtttccctttccatcctccgcggtacgctttcccgctttgctgcttcttttggcggtgcgtcccttaatgcagaccggctttgccttcttacaggcgcttccggctttttttcttccgccaatacctttcgaacttcttcgccgggttcatattcacccgttgcgtcctgcgttacgcccgaatgtactatggttttcattccataggcatcctgtaagtatttttcaatcgactcctttaaacccatcgacaaaaaaataccctcgcccatatcattatcaaacatgatatgcaggaggctgtccttcatctgcaccgacgcggttttcacaaagggtaaaaccgttggctgcagaaggacaataaggtcttttacgtacttttcgagcgtatccgccgccccgcagaaatcgtctttaaaatccgattggtcaagtaatattgcaatgcctgcgccgcaggatcccgtaagcgccttttttaatttcaaaaactgtacaggcggcagatgcgctgatgttttaaagaaaacctcaagctctgctgcttcctgcgaatactccaccctgtcgaaccgaacggcgtcccgaaagcgcgaatcactgtttatgttatccagaatttttgcgaggtccttgatctgggcgttcaatgctgcttcctttcttcttcaagctccagtatcatgcgccgaagctctggcaaaatattgaattcgtcaaccttccgtataatctccccatgggaaaacaataagccttctcctttgccgccggcgatcccgaggtccgcttcccgcgcttctcccgggccgttcacttcacatcccataacagccaccttgatgggtgctgtgatgtcctgtgtaaaccgttcaatgcttgaaacaattttctcaatatcgatggcgcatctcgcacatgtcgggcaggaaatgatctctacccctgttttgataaggccacagctcttcagaatatcgcgcgcggcatagacttcctgcaccggatcgcccgtaatggacacccgtatcgtatccccgatcccgtcaagcaaaagtgctcctaaaccaaccgacgattttacgatcgcactgttatacgttcctgcctccgtcacgcccaaatgcaaaggatacggtatcagcttggcaatgcccctgtaggatttcacgcataccggaacacttgacgacttgatcgaaacgacaatattatcaaacttggctttctccagtattcgtatattagcaagcgcgctttcgatcagcgcctccggcgtcggtccgccaaatttttccaatatttccttggaaagcgatcctgcatttgcgccgacccttattggcgtgccgtgcgctttcgccgcatccaccacgcgcatgatcttttcttcgctcccaatgtttcccgggttgatacggatcttattcacaccgctttcaattgcagctaccgcaatatttgcatcaaagtgtacgtcagcgacaaaaggaatatggatctgtttcatgattctcggaatacaagcagcacattcctcgtcatagattgcgcttcgcacaatatcgcatccggccttttccagcctgaggatttgccctaccgtttcccgtacgtccttcgtgtcgcttgttgtcatagactggatcgctaccctgttttccccgccgatcatgacgccgccaacattgatttccctcgtcttcatttcttccctcacatctctatcccatcagcctggacacgtcctggaacaccaaaaaaatcgccagtccaaaaactaaaaccatcccgatcagatttaatatcccctcgacctttaccggtgctggttttttacgtatccattccactatataaagtacaatttttcctccgtcaagcgccggtatcggcaacaagttaatgatagccagattgacgctcaaaagtgcagataacgtaagtacgcttataagtccggaagggatgacctgcccgacaatctgcaccacccccacgatacctgccatattctccagcccctgtcccataaagaacaactgtcccagcgcgctgaacatctgccccatcatcaggaacagccactggaaactcatcccaatcgcctcaaaaaaattatacttcacaggcgctgcctgtacgttcatcccgatcaatcggcttccgctttccaattgtccggcaaacggcacctctaatgtcatttccttcccgtcgcggacaatcaccaagcttcttgtttccccgttgtccgcattgatggcctcgttccacgttgcattatcgtgtacctcgataccgttcatgctcttcacggtatcccccggcagtattccgcttttttccgccggcgatccctgctccgttccctgtacctgcaccgtaaactgcggattcggattgatctggaaatcgcccgccgtcataaggacagccgtggagagcacaatcgccagtataatattcatggccggacctgcaatgatcgtaagcaacctgcttttaattgacgccgcgcgaaaatcacccgggaccggatctttttcctcatcgtccgcgaatttattgaacccgccgatgaagaatgggcggattgaaaactccgttccgttacgataccatttgatgagcttcggcccaaagccgatcgcaaattccgatacttttatcccattcttctttgctacgatatagtgcccgaactcatgcgctaccacaagacccgtaagcaccaaaagcgtaacaataatactaacaactacttgcaataaaattcctccataaccaatttcctaaagtatgtccataacatactcccgaatctcggtgtccatggacaatatttcatcgatgctctgcggattcctcccgcagaatttatgcatactgtcctctatgatttccggtatcctgccaaagcatatccggtctttaaggtaaagatcgaccgctgcttcatttgcagtgttgaataccgccgtcgtttttgtctccattgcgtcatacgcgagcttaaggcacggaaaacgctgcatatcaggctctaagaaatcgatcttgctgatttcgtaaaaatctaccggctgcgtacatttgctttccggcatttgcggatataaaagcgccttttcgataggcatcttcatatcgaccggcccaaactgcgcaagcacggagttgtcagagaattcaaccaaagaatgcaccatactttgcggctgcaccaggaccttgatgtcccttggcttcacgcggtacatataatgcgcctcgatcacttccaagcccttgtttgcaagggacgccgaatcgatcgtaattttttgccccatatcccaccgcgggtgttttaatgcgctttccttcggcgcattgtatattttctccttttcccagttgagaaaaggcccccccgaagcagtaatccatatccttcggacgttttctacattatatctttgacccaggcactgaaaaatcgcagaatgctcgctgtccacaggcaacacgagcgtacctgtttcatcaatcattttttttgtaacctcgccgccgcacacaagggattccttgtttgccagtgccactgtaatgcggtttttaaggcattcctcaaacgccggcaatccggcgatcccaaggacggaaagtgccaccaaatcgggctgcccagccatacaagccttctttaaggcatctgcgccgctgatgatttttgcctcataggcaatcgccgcctgcagcctgtcaacgctgccaccgcctgtaagcgcaacatactccggccgtgccagatttgccagcttcgccagatcgtccgtatgcgtatgcgccgatatgcaaacaacttttatttcgtcgggataggaaagcgccacttccagcgtttgccttccaaccgatcccgtgactcccaatatcgcaatttttttcaaatatttctttctcctgttaaataaccgacatcatggataagaggaacaccaccggaatacagaacatcacgctgtccatcctgtctactatgccgccgtgtcctggcagcaatttcccgaaatccttgatattgagcacacgtttcaggtaggatgcggaaaggtcacccagttgcgagatcacagctaaaacagcgcctgcgatcatataatttgccaaaggcaccatcgtgttaagataatgcccattgatgtagatcatattatcaaataccagccagatcagcagcgccgccactacgccgcctacgattccggccacacaacccgccaccgtctttttcggactgatcgcaggacatagcttccgtttaccgaaggccattccgaaaaagtatgcgaacgtgtctgaaaacatcgcaggaaggaatatcatcaacagcaaaatgagcatcccatagtaaggctctgctgccagcggcgttgaaatccagcctgtgacaaacccggggtacgtcgccgttaagattagcgcatagaacaggacaaagaacatttgcggatagacaaacgtcaataccgtgtctcctacgctttgcgccgtatgctttttcgagaacatcgcaataataaacgtcgccatgctgcataccacaaacaataccaaaacaattaccggcgtaaagcagggaaccataaagcgcatgagtacaggccttgcagcaaactcgaacaaaaacaatgctgccatcatccccgcaaacacgaaactgacagactttacgacaggtttcccattgccatccatcgcgcggaccacttcaaattggctcatcagcgccaccaccaccgcgaaaaccgcaagcacccagctctgtataaaaaatgcgagcgccacgatcacaataatcggtatcgcaaccaatattctttttaacatatcctaccctttcagtccgccgtatcttctttggcgcccctgatattctatcagcgctttttcatattccgcttcatcgaaatccggccaatagaccggcgtgaagtaaaattccgcatatgcaagctggtacagcaggtaattggacagacgctcttcaccgcttgtacggatcatatagtcaggatccggctgtcccgccgtttccaaatgatcggagatcatctgtgtatcgatcgcttcaatatcgatcgtgccgtccttcgcttcccctgcaattttcctgaccgcttccgcgatttctgcacgcgagccataattaagcgcgatattaagggtcatgcccgtgttgtttttcgtctttcccttggcgttttcaagcacggcaatcacttccttggggagcttcgtaatatcccctatggtattgaatattacatttttctcgtgcatctcgtcaagttctttctgtaaatattctattaacaatcccatgagcgccccaacctcatccttgggacgtttccagttctccgtcgaaaacgcatacagcgtcagatacctgattccgatatcgctgctcatgcggataatcgtttttaccttcgacatccccgcacggtgtcccgcaacacgcggcatcatacgttttttcgcccatctgccattgccgtccataatgatggctacgtgtgcgggcagattttccatatccaaatgtgtcagctcagcttttctcttctttgaaaaaagacccaatatcccttcactccctgcgttttaaaaatgaaatcccaaagcatctagcagccttgggatctctcgtcaatttctgttttaaattcacctactaccagctcatatgcgtcatttaacttccgtacacgcagtacacgcacagaatccgtattttcgtatggcttatacgaccggtaacagaccacctgaaaaggaatcccgtccttttccagtatcttagaaacttgatcaagaggtagccccaaaagctgcatcatatctcaagaatttccttttcctttgcctgcaatacttcctctacctttttgatctttttgtctgtcagatcctggatttccttttccagtatatcataatcatcctcagtcagcgtgctcgctttcttttccttcttgaatacctcgtttgcgtcccggcgtatcgcgcggatcgcaatctttgaatcttctgcttttttcttggcaagctttacaagctcctggcgtttttcgcccgtcacttcaggaaacgccagacggatcaccttaccgtcgttcgccggattgatgccgaggtccgaagactggatcgctttctccacttcatggaggatgcttgcgtcccacaaagagatcaccaacagtctcggctcgggggcagagatgttgcccacctggctgattggcgtaggcgttccgtaataatctaccataattccgtcaaggagctgcgcgtttgccctccccgcgcggatgcttaccaattcttttttaagaacgttcagcgtcttttccattttttcgtctgctacgtttagtgcttcatgttccagttgcatatcaaaatccattcctttcatcatttttcagattgcataaaaatggtcttcattttctacattatattgtatctcaaaacaccataaaacacaatgctaacttagcggcggatcacttaattgtcgtgccgatttcttctccattgaccacgcgctggatactgtccttttcgtttacgccgaatacaatgatcgggatatgattatccatgcacagtgtgatcgcagtattatccatgacggagaggcctttgttgatcacgtccatataagaaatatattcaaatttttgtgcattgggatttgttttcgggtcgctgtcgtataccgcgtctacgtttttggccagcataataaggtccacttccatttccgcagcgcgcagtgccgccgccgtatccgttgagaaatacgggttacctgtgccgcaggcaaaaatgaccaccctgcccttttccagatgcttcatcgcttttctgcggatataaggctccgcgatctgccgcatctcgattgccgtctgtacgcgtgtctgcagtcccttttcttccagcgcatcctgcaaagcgagcgcgttaatgaccgttgccagcatacccatatagtcggccgtcgtacggtccatgtgcgcgcctacgcgcgcgccccgccatatgttgccgccgccgacaataatgccgacttcaacgccctgctgcgcgattgcaataatctggtccgcaacgtttcccacaatttcgaaatccaggggatgatttttctccgagcacagcgcttcgccgcttattttcataatgactcttttatatttcggttccatgatttcctcctagccatattttgttaaaaaaaagagaacacgaaagtgttctcttttttagtcttaaagaccagcttgctccataacttccttctggaaatcatcctgccgcttttcaagtccttcgcccatttcatatctcgtgaaacggcggatcgaaatcttttcaccgatcttgccaacctgttcattgagcagatcctggatcgttttatccggatctttcacaaacggctgatccagcaggcaaatttccttcttgtattttttgatcctgccttctaccatcttctcaacgacgtttgcaggctttccttcgttcattgcctgagcggttaagatttccttttccttttcaagtaccgccggctccacttcgtcttccgaaacatagagcggattggaagccgcgatatgcatcgcgatatcttttaccaacgcctgaaaattatctgtctttgcaacaaagtctgtttcgcagtttacttccacgagcacgccgatcttaccacccatatggatgtaagaaccgacaacgccttcagccgcaatcctgcctgcttttttaacagcagcagcaaggcccttttccctcaaaatctcacttgctttttcaatgtcgccattcgcttcgctaagcgcatttttgcaatccatcatgcctgcgcccgatctctcgcgcagcgtctttacatcacttgctgaaatcatggatatattacctccaaaatattataaacctattatttttcttccagtacttcttccgcggcagcctggatgtcctcagcgatttcctctacgggcatatcctgcgtcgcttcttcaacttttccttcttcctcttcgatctctacttcgctttgaggaaggatttcttttgcgatatcatccgcgatctcttctgctgctgccgcttcgatttcttcatccgtcgcaactactgccgcttcctgcgccgcttcttcttccatctgttcgccctgcttgccttccagtacagcgtccgccatcttggaagcaatcagcttgaccgcgcggattgcgtcgtcattacccgggatcggataatctacttcgtccggatcacagttcgtatcaacgatcgctacaaccggaatacccaagttccttgcttccgcaatcgcaattctttcttttcttgggtctacgataaagagcgctcccggcaggtccttcatttcgcggataccgccaaggtttttcagcagcttttctttctcgtgcatgagctggatcacttccttcttcggaagaaggtccatatctccgtttgtttccatttcttcgatcttgttcagtctgcctacgcggcttctgatcgtcttgaagtttgtgagcatgcctccgagccatctgttcgctacataaaactgaccgcagcgtttcgcttcggactcgatagaatcctgcgcctgttttttcgttccaacaaaaagcaccgacttattgtccatcgcgatgtcgcggacaaaatagtaggctttttccacttctttgactgttttctgaagatcgatgatgtagataccgtttctttccgtgaagataaaacgcttcatcttcgggttccaacggcgggtctggtgtccgaaatgcacacctgcttctaagagttgcttcattgaaataactgacatattaaataaacctcctcgtttatgcctccctgcgcttcttcttcagcataaccgtttccggcacgagtactgaaatctgcccaggtgcgttatcgtttgatattataccacaaagaaaacagggaatgcaaggatattattccttgccgtcctcttcgccttcttcgtcgtcttcataataaagctgctggaaaatattccacagttcgtctaattcctgctctgtttcgatcggcacataaacgtcgccgtcatcgccttcttcgatacgcataataagtacttcccccacgtcgaattcttccattttttcaacgggcgtaaaagcgacataaaaactgtcgtccacttcaaaggtcaacaggtgctcaaactgtaatacgttaccatcctcgtcctgcatttcgatcaagttcaattcttcactcatagcttttcttccctttccggatcatttcatattgagatgctgtccatatacccttgcaggatatataccgcagcaattttatccactacccttttacgctttttgcggctcatatcagcttccaaaagtgtcctgtgcgcgctctttgtcgtcaggcgttcatcccagtagatcagttgtttaccgctcgcctctttcagcttttccgcaaatttctgtactttttccgcttgctcgccaatcgttccattcatgttcttcggcaatccgcatacgatcctgtcaacatcgctttcctgcatcaatttaaccagatactcgatatccttttgctcgtcttccgtgcgcgtataggtttccaggccctgcgccgtgatcataagcagatccgaaagcgcgataccaatccgcttatcccctacatccagtccaattattcttcccaaacgattctcccttactcaaaaaatcacgtccaaataccttgcggacgtgattcctttaatccattagatttgtttgatataaaaactgaccagttcttccagaagttcgtccctgtctacgctcgcgatcagcgaacgcgcgtttttatatcccgtgatataggtcgggtctccggatacgatatatccgatcaactgatttaccggatcataccctttttcacgcatcgcctcgctgacgatccgaatgatgccgcgaaccggattctcaagctctttatcaaagttaaactgcatggttttatctaaatcagacatttccccgcctccaacaattttctgctacggtaatgattgctaccagtttcattatagcctacttctttcaatctgtaaatcaatattattgctttatttggccattttgcttgtccgaatccaccctgtccacgcgccggcagagcaacttcaactggtcgatcacatagtctagctgctccttggtcgtcgtctcccccatggtaaacctgagcgcacatttcgtttcatcctctgccctgcccattgcacggagcacatgcgacggttcaagcgacccgctcgcacatgcagacccgcttgagcactccacccctgcgagatccaagctcacaagcgccgcttcggattccacgcccctaagcgataaattcacattgcccggcagccgcctgtccggatgcccattcaaaacggcacgcggcagctcttttcgtatcctgcccatcatataatcgcgcaatccggccagccgtgccgattcttcccgcatactgtttacggcaacgtccatcgccttcgccatacctatgatctccggaacattttccgtgcctgctcgttttctgcgttcctgcgccccgccatacagcaaaggaccaatcttcacgccctcgcgtacatatagcgcgcccacgcccttgggtccataaaatttgtgggctgacagcgaaagcaagtctatcctgtccttctgcacgtcaatgggcaaacatcctgctgcctgcaccgcatccgtgtggaaaagcacgcccgctgcctttgtcacctcgcctatctctccgacggggtttaccgtacccacctcattgtttgcataaatcacggataccagcacagtatcctgccgcaaggccgcctctacttgcgcggcgctgaccgcgccataccggtcgaccggcaggatcgtgacctcatacccacgtctgctcaaatagccgcatgtatgcaggacggcatggtgctccgccgcagtcgtgattatatgcttgcctttttcagcattggcttccatcacgcccgcaagagcccaattatcgctttctgttccacatgccgtaaaatagacttcgcgtttggataacgcgcccaggttcgcagcaaggctgccgcgcgcccgcataatagcgtcgcctgcttcccgtccgctccggtaaaggctggacgggttaccaaaccgcgccttaaaataaggcatcattgcctcaagcacttcatcctttacatatgtagtcgcggcataatctaaatatattttgtccatttatcgttctcttaatcttaaattaaccaagtgagataaacgatcccatcgcgccggtttttccatgatcccttctgtgcgaataaaacagatcgtcgcggcaataggtgcataaatcagcacaggtaacattttccgcacagattccaccagcttccatttgcctgagcaatgcgcgctgcaggtctacatacgtctttccgttttcctgcgcgaccacttcaccgccgaatctttccaaaaacggctgcgcaacgtcgcgctgtacctcaaaacaacatttcatgatatgcgggccgattccaaccagaatattttgaggatcacagccgcattgtcctgtaaacatcctgacgatattcagtgtaatcccgtaataaacgccgcgccaccccgcatggctcacgcacgccaccttttgcaccggatcaaagaaaaacaagggcacgcaatccgcatgcagcgttactgccgtgatgcccttttcccgcaccacaagtgcatcgcatggcggcaaatccgtatcccgcgtgatccctttccctgcatcgccctcgcctgccaggtatacgccgtcgccgtgcgcataattgacaagcgtcagcctctcatacggcacatccaaaacgcggcatacccgccgaaaattttcttccttgttcttcggattgttttcacgcgtccggctcaaattaagggaggaataaactcccccgctcactccgccgacccgcgtcgtaaaacaatgcttttccaagcctgcatcaagaaaagccggaatgacaaaataaacggttccatccttttccctctgctcaaacccatgctgcacaagccccaaaaagtcagccatttatttctccgtcaaaagtttattgagttcttccttgaaggtgttgatatccttaaactgcctgtagaccgacgcaaaacgcacatatgctacttcgtccagtttcctcagaccgtccattacgatctcgcccacttcatgtgaagtgatctcctgcttgggcgaattataaacgatacgctcaatttcattgatcagcgtttcgatttcatcataggaaacctcacgcttttcgcaggcctttacaacgcccttcttgatcttttcaatatcgaacgcctcacgtttgccatcctttttgactacaaataccggcaggctttccaccttttcataggtggtaaagcgctttccacagtgcaggcattcgcggcggcggcggatagatgtcccttcgtctaccgggcgcgagtccacaaccttactttccgcaaaatcacaataaatacacttcaatcttttttcctccacatatcttgagaagaatatgattacaattctgtatattataccatatttagttataaaaagcacctttttcaggtgctttggtgtgtgtttattttgtttcgcatagattcaagaattttcttttcaacttttgatatataggattgggatagtcccatcaaatgtgcaacttccttttgcgtcttttccggatatcctttgagtccaaaacggtaattgacgatttcctgctgctgttccggcaaatgcaataacagcgattccaaggttttccggttttcttcctgctcgacaatattccagactgtatcgccctccgttccgagcagtccttccaatgtcaggtcgtcgctttcctcctgcattgccatagtttggtccagcgatatttccttggatgtgtatgcattggtgcgaagatacataagcatttcattcttaatgcacgttgaggcatatgtgctgaatttaaccttttttgtttcgtcatagctttcagcagctttgatcagtccgatgctgcctactgataccaagtcttcctgcttaatatggtaattagaatatttccgggcaagcatcgttaccagtccaagattattttcaatcatttcatccttcgcgtttattccggatttttctttttccggttgttcagttttacgagaaatgacagaaatccccttcatttttttagcaaatgctcccttttattgacttgatataattatatcatgcgatatttcaattattttgtcgttttatgtcgtatattttaatgaaatattatttatttttaatgaagatgggttatttgtataataaaaaaggcttcccatcaaaagtggaaagccttttaccattctgcaattaataatcgctccggttccttctaggcttctttttaaggaaagacgggatttccaaatcttcgtctccaaacatgtccagaccatcgtctgcgctttttccaccgcccgcactctggggttcaggaatatcaagcgaaggtttttgcctgctcaccggtgccgaaaacggttccgcgtcaagcggctcgtcatccgtaaaactaatcgtttctttcaatttcggtttgcccgacacgtcgatcctgttatccgcagcagaagttcccacttcctgcggctgtgcgtcaaatcccgtagcaatcactgtaatacgaacttcatcatcaagtgaaggatcaatacatacgccgaagaatacgtccgcctcagggtccgctccctcctggataattttagcagcttcctggatttcatacatccccagcgatggatcacccgttacattaaagatgatcccgcgcgctccttcgatcgtcgtatcaagaagcgggctgttgattgcctgctttgcggcttcgactgtcttgttttcgccatagccaatgccgatgcccatatgagccacgcccctgagcgtcattacctttttcacatcggcaaagtcgagattgataagcgccggtttaccaatcaggtcgataatcccctggatcccctggcgaagcacatcatccgcaacgcggaatgcgtctacaagaggcgtatccttgccaaccgtattgagcagtttatcgttcggtatcgtaacgattgtatctacaacagatttcagggtttcaaaccctacgtcagctgcttttgccctcgggtgtccttcaaaccagaacggctttgttacaaacccgatcgtaagcgcattgctttctttcgcaatatccgcgaccacaggcgccgcgcctgtgcccgttccgccgccaagcccgcaggcgacaaatacaagatcggaaccttttaccgcttgttcaagctcttcgcggctttcctccgccgctttccggcctgtatccggatcggcacctgagccaagccctttagtcagcttctcgccgatttgtattttctggtctgctttggataagaaaagcgcctgtttatccgtgttaacggcaatcagctccgcgcccttcacgccaaattctatcatgcggtttacggcattgttacctgcgccgcctacaccaaaaacgcgtatttttgcgaaattttcactgttattgtcaaattcgagtgacatctatcttcctccttgagtgtgaataaattattcaaacagtatatcctgtcccttactaaatagtcccttttttcttgttgggggtttgctttggatatatccatcatatgcatattgcataagcgcatacgccgaatgcatatccggcggcatgagctttgtattaggcactttaatcagattgaccgatcttccggccacagctctgaaaaagctatcaaaccctttcataaatgccagtccgccgcccgtcaggtaaatttcaatttttcttccaatattactttccactctcgacagcactttaccaatatgtaaaatcaaatgttctaccctggaatctataatttcctttaacaggtcatacggatatttcttcaatttcccttccgcatcctttgcgaacaactgcgaaatactattgttatccgacagtccgaacgtatatctcctcttcaattgctccgccgtatcgcgctccactttcatggcataggcaatatcgttggtaatatgaccgccgcccatcggaatcgttgcaaaaaacaagatagaatctccataaacaagcgatacatcggtactataataaccgatatcgaccaaaaccgcaagcgaatcacgcttatcctccggcaacaaatacaatgcctccgcaagtggttcaggaataaaataatctacacgcacacccaaatggttcaaaaggtccattgcatcgttcaagaaaaatttattcgcaagcgtaaacgacacgcaaccgcgcagtcgcttggaaggaatatcataaggttccagataaacattgttatcatcaagcaaaaaccacgcgggccattcatggaccagcgtcaagtctgacataatatcaaaatttcttgccttctcaattagcaaatcaatatcacgctctgcaacacgtcccttcacaggaacctgcgccttgcggtttattactttcataaaagcccctggaattccaacatccgcattccggatacgaaagcccgcttgcctttcacaagactccagcgcttgttcgacagcggctatgacctctttggaatctacccagtttgtctttttgataccggcataaggaatttgggaatacccaagaacttcaagccccatacgctgctttttttcagcaaccacacatgctattttcgaagttccaaactcaattaccgttttgaaatctctcattcaaaaaccaaccttcaggtgttcttttcctgcagcttataaatcgccattttttttatcatatcacaattagaaaaaaaacaaaacacttttataaatatatgtcacaatttcgttgcattttcgcaatcaatagacaaatatcaacaaaaatgttctgtttgcatgtttattcctgtaccgccggctcaggggaactgtccgggtcaggctgcgcctgctgcgcggccgcatcatccgtcatacggtaagtaccgctcgtgccgcttgttacatcatatacgccgcttgtatttccatccgccgcgagcttgggcagcatctttttgatccacttcatcttatcggcaattttgtccgattgtccgaacttgattgtcatcccatcataagactgcatcttgatgttgttgacatccgacaagtcgatggtggagatcgtagaaaacaagtcctttgcttcaagctctttgaggatatccgagagaaccgatattttgaaggtatcctccgtatcgatcggcttgcctaaattcaccgaattgatcgcgataccgttcacaacgggatattgctgcgccggctgtgcatctaacatctcaagtacgttcgcttccccgtcaatcagccaatatttatccgcgtaaaggatcaatgcctttggcgtacgttccgataccttgatcacaagcgtcttgggataatcttttgcgatgctttccacttgcaagtatggctccgtctcaacattctcttttattttttctgtatccaccaaaaacatatgcgtcttcggcggaacatctgccagtttgaccacgtaactcgtatcaaacttcactgtcccttgcaccttaacatcttccacctggaaatacacataaataaagtaacctgctcccgcaagtatcaatatcgtcaaaacaactgccaaaatagtttttcctacgctgcgtttgtgttgttttttcatcctttgcccttactcctctgttctcttagccatcatgatccgccgtgactgctttgatatgttgagcataatccctatcatacacataaatatcacgagcgatgaacttccataactgataaacggcagcgataccccggtaggcggcagcgacgctgttacaactcctacattgataatgacttgcagggcgatcaccgtagtaacgccggtagcgagcatcgtcccaaacagatccggcgcctgtgccgccgtttttattcctcggtagatcaggaaaataaacagggccagcaggacgatcacgccaatcagtcccaattcctccgcgatgatcgaaaaaataaaatccgattccccatacggaagccatgaaagcttctgtgtgccgttgccgattccctgcccaaacaatccgccagaaccgattccatacagcgactgcacgacctgataaccgccctccgtggaattctgccacggatccaaaaaggtggtgatacgatccacgcggtaatccttcatcatcatcagcgcaaacccgcccacgacccccacgccgccgagcgccaacaggtgccatgccttcgcgccgcccacaaagatcataataaagatcagcgcacacaggacgatgatcgctgagaaattcggctggaagtacagcaggatacaaatcgggatcagcgccagaagcgccggaaccacaccataacgaaaggtattcatccggttccggttcacatagatgaccgaagccacaaacacgatcaatgcgactttcgcgatctctgcaggctgtaggctgggaagcggtccgatctctatccaccgcttagatccgttgatctccttgccaacttcggggatgaacacagccacaaggcaaagacccgcaatgacgagcaacacatacctgaatttcataagctttttgtaatcgaaaaacataaagaagatcatgaaaacaagcccgatcgccgcgccgataagctgctttttaaatagcgccagaccatcataatcatatagctttgacgattgcgccatatagtaactcgcgctgaaaaccatcagcaagccatatgcgatgagaatcagcgttacaatcaataaagaataatctatcgaccccttttgcaggagattcgtttttcgcatcctataaacctttcacgatttccttgaacacctcgccgcgctgttcaaagttttcaaacatatcccaactcgcgcacgccggagaaagcaaaacattgtctcccgcttccgcgatgctgtatgctttcaggaccgcgtcctcaaacccgttcgccttgatataattctcatagccgcagctttgcgccgtatcaatgatcttttgcgccgtatccccaaggactaggaccgctttgatcattggtgtaaattccatgaacagtggtacaaaatcattctttttgtcatatccgcctaagatgagcaccgtgggctcggtcatcgcatggatcgcgttgatcgttgcatcaggattggtacctttcgaatcattgataaatgatacgccgtttactttacgcacaaattcaatgcggtgctctacacccggaaacgtccgcagcgtatccgctaccacttccgtccgtataccgtaaagacacgcaagcgcagtcgcagcaagtgcattttccaaattgtgttttcccggaatatgcaattcatgtgctggcatgattactctctctacgccattcaccgcaaagcaaatactgccgtttcgcacatacgcaccatcaagcaaaatttgctccgtactgaaccaaaaaacctgcgccttaatatccggtgccaaattccgtacaatctcattgtcataattgagcacgcagaaatcttccggtgtctggtttttaaatatctttgctttcgccgcaatataattttccatcgtaccgtaacggtccaggtggtcttccgtgatattcaggatcgcgctttccttgggacggtatgtatcaatcgtatcaagctgaagcgccgccgtttcagccacaacaacgtcacccggctgggtcttcagcgcttcctgcgtgatcggtacgcctatattgcccaatacatgcgtatgtatccctgcatttttaaatatttcgccggtgagcgctgtggttgtggtttttccgtttgtacctgtgatagcgataaaatccgcttttgataccgaaaatcccagctctatttccgcaagcaccggtttgttcagctcatatgcacgcctgataaacggcaatccgagcgggacgcccgggcttaagacgagcatatccatttcttccacttggtctgttgggtcaatccccaacatatcgtggtactgataatcgtctaattcttttaataattcagccggaatatcttcacgccgcttcacatcataaatcgttacgtccgcgcccaaagcacacaaaagcgctgcggatgaaacgccgctctttgccatccctatgaccaaaacttttttatttttgtaatccatttccagcctcccaaaagtcatgcaaagaataacaataaacttcccacacttagcagcattgttgcaatcatatatccagcaactacctttgtttcgtgtacgcccgcaagctcaaagtggtgatggagcggagccatgcggaatacacgcttgccgcgcagcttaaaagaacctacttgtatgatgacagaaatcgccgatagcacaaacataaatcccatgatcggaaggaataactgcatttccgtagcgatccccatggccgtcagcgccgctcccaaaaggaaagagcccgtatcgcccataaataccttggccggatacacgttgaagcacaaaaaagcgatacacgtgcctattactgcggccgcaaacatcgtcatattagacatatccgattgcatttccggactgatcatcgccgctcccagcacgctgaaaataaaaatcaacagaaaggtagcagaattaatcaaggtaatgcctgttgcgagaccgtccaggccgtctgtcaaattgacgctgtttaccatagcgatcagtacgaacattgtaaagggcataaaccagaccccaagctgccactctgttccggcaaccggaaggtatattgttttgatatcaagccagaaataagccatgcacgaaaccgctgccgccgcaaccaattgcaggacgattttctgccatgccctaagacccagtgagcgttttttgaagagcttaagcccatcgtccaaaaatccgattaccgcaaaggcaagtaccgtaacaatagcaaaaacagtatagcggatatcccccgacgaaaaaacaaaacttccgcaaacgataccgatcatcatgatcacgccgcccatcgtcggcgttccttcttttaccagatgtgtttgcggcccgtcgtccctcacatgctgtcccgctttcgccctttttaaaagcggtatgattatcttagccgcaacaaatgttattgcaaacgaaattaatatcgtcaataacatattcatcataaagtccataaagccttattccttttcgtcttcttttttctctttgaagcccaattcgttcaatatttcctcaacaacaactttttcatcaaagtcatgcttcacacccttgatttcctgataatcctcatgcccttttcccgcaagcaatatgatatcttttggctgtgcatttttgatcgcccatttgatcgcctcgcgccgatcttcgatgcgcgtatattccccgcccgattccttcgtgccttcttcgatctggtcgatgattgccgcaggctcttcaaagcgcggattatcggatgtcagcactgtaaaatccgaatactctccggcaattttccccatgattggacgtttgctcgcatccctgtttccaccgcaacctacgattgtaacaatgcgccctggcgcaaaacccttgatcgtggacaaggcgtttttcaagctgtccggcgtatgggcataatcgaggataataccaaaatcctggccgtgtgtacccaagggctggaaacgtcccgcgaccggatgcatttcctttaggccctgctcgatataatgcggactaatgcccagcgcatatgccgctacaatcgcgcccagcgcgttatatacggtaaactgtcccggaatgcccacttcgatctgcagggtgttagcgcccatctccactgtaaaattgacgccttcgtgcgtgatctcgatttcttttgccatatactgcacaggctgcatcacactgtacttgataacctcgctttttgccgccgccatcatattagcagcgctgtcgtcgtcaatatttatgactgacttttgagattgttcaaacagtaagcttttcgcatggatgtaattatcccacgttttgtgaaaatccatatgatcctgtgtcaaattcgtaaaaatacccacgtcgaaagtaatgccgaaaacccgcttgagctccaaagaatgggaagacacttccatcacagcgatgtcgcaatggtcatccgccatcttcttcaataatctctgtagatcaatggactccggcgttgtacgttccgtatgtatttcccgctcgccgatcatgttgacgatcgtaccgatgaggcctactttatatccggcatgctccgcgatggatttcagcatgtatgtcgttgtcgtcttgccgttggtaccggtaacgcccaccattgtcatccgctgtgccggattcccaaaaaaattacacgccgcaagcgccattgcctcacggtcatttttaacgatcacctgcggaaccttcagttcggcctggtattctgtaacgacaaccgccgccgcacccttcctcacggcgtccggcgcatatttatgcccgtcctccgcaaaaccggcgatacagaaaaaaaggtcgccgcgctttacattacgggagtcatatttcaaatctttaatatcaatatcttcgttacttcttatgtcacacctgataccgcgaaatatttcagacagtctcatttttcgtgacctcctctataaacaaaagtattataccacaaaatattgtatcccgctactgcgccgtgtctatttgtagtttgaactctaccgttactgtagtgcccttttctacctgtaatccggctgtcggtttctggttctgcgcccttccgtcgccaagggctacaaattttaatcctgcgcctatcgccgcgtcacgcgcctcatccacgctcattccagtaaaatccggtacggtgaccatttccgcagtgggggccgcctccgtcttcgtttccatattgagcgttacagtcgaccctgcatatacttcctcatccggggcaggcatctggctcaggacgttgccgcttccatccagttttacggacaatcccgcatcggcaagcatatcctttgctgcctgcatttccattccaacaacattgggcacgacaactttctgcgcgctgcgagccgcctcgtcgtcaggggcgatattgttgtttttcagaatatcctcaagcactttttttgcatacggcgcacataccgtatcatcattatccccggaagcaatgccgttggctgtgatcataacgagataccttgggctttctgccggcgcaaaggcaaagaaggaagaaaccactttgtcctgcactggcgtatcactatcgtaaaacatagatgagccgcttataccgcctactgaatatcctgtaatctgcgcttcgcttccatcaccgttttgtatataatccagcatcatcgtcttgatctgcgatgcgacatccgcggtcactgtctgcccctttacttccgcgtcgtatgtttccaccatattaccattgctgtccgcaagccccaagaccagcctcggcgtatagagcgttccgccgttcaggatcgacgccaatgcgtttgccatctgtatctgcgatactttcatgttttcgcccgcacccataagagcaacatcggcctgacgcgcatattttttttgcatcacgtcgccgaccgtatcggttgcaaaatcgatacccgttttttcaccgaatccaaaagctttcaagtactggtaaaacgtatccttccccagtgcatttgcttgctgcgcctctgcgatgctgcaatggtttcccactgcctgcaacacattttgcgtgccatgcacagcgctgcacgatattttttccccgtctatgacatccgagccattgcaggtatattctcccgctgcattctcatttatcgctgctgccgccgtgaagatcccaaacaggctgcccggttcgtatggcgttgcggttatggtgttaacggataatgccgcaagtgccgttgcatcgtcgcgcggcgggtcgttcaggtcgaattgcgggatattagccatcgcaagaatctcgcctgtcgtcacgtccatcaccagcccttgcacgctgtttgaagagtgatcagtataaagcgcgttgcaggaatcctccagtatgctttgcgccatttcgtctattgtaagaacaacgctctgcccatcctgcggttcgatgatcatttcctgtccattggggacgccgctgccgtcctttgccgtttccgtcacctggcggccctgtcgcccttctaaaatgctgttgtagcgtttctcgatgcccgtttgccctacgccgtcctgcgtcgtatagccgatcacctgcgaagcaaaatccttgttcagatagaacctcttaacatcgtctagcaggctgacgccttttagattcagatttttgatctcctcagactgctcggtcgtgatctggcgcttgagccatatttcctttttttccgtattggtcgccttagcgtatacatcctccctcggcatctccaaaatacgcgaaagttcgtccgctatctgatccgcattttccgccttcgcaattgtttccggctgcaatgcaaccgtatctgccgcagcgctctgtgcaaggacatacatattcctgtcgtagattgatccgcgttttgcatccacctcgacgtcgcgcgtccactgcttctgcgctttttcctgcagccattctccctgcaataaagaccaatatcccactcggcacatgagcaggataatgagtatagacaatatgattaatataaccagcaaccttttcctagttaccaatacccgtgacgttgacaatgtttactcctgtttaattctggaaccatcctttgatcgtgtccaaaattgtgttgataaagccgccaaatccacttgccgcgtcattcggctgcgtacttcccatatctgtttgcgtcatatccgtgcttccttccgccgtaaccgtgtcctgcatccctgaaacatccgccgtatcctgcagttccggctccacaaatacgatctggctatctttcggctccgacatccccatcgccgccgcctgctggcgaatgctgcttaggtcctccttcagcgatacttccatctttgccttgtcaagatcctgcgaaagcgactgtatgcgcgattctatctgcgcgttctggtaattgaggttgctgatctgtgaatagcgaatcaatattcccgctaaaacagcaaacacgaccgcaatcaggatgatcgtggaaacgactccttttttctttggcgtctcatattccacagcgatcggctttattccattatatgcgctccgatccgttgtttccaccatatcaaagccatgaatcggttttctcctcggctgcgttgggcgagctacagtacgttcgtatgtcctctcatatggccgctcgtacgaaggtgcgtatgccgccctttgctgcgtacgattgtatccgtttctcgggttctggcgtacattacgttcccgcatagactcgcggtatccgtagcttcctcccgcaggcgcactaacctcatacgccggcgtcaacttcctgccgcctacaatgtttttgactcctgtttggcggatctgttcccgcgtatcatatacttcgcggcgctgctgtgccggacgagccgcctgcgtacgttgctgcttcgcgcgttcatacgccattcgctcttcatatgcctttttcctttgcatggcaattttctgcatattataagcctgcatatcggtaatccggcccatacgctgctgcgcgttccgattcgccgtattgctgcgcggtatttgtattctttcataattgtgcgctttttgcggtatcgcgttcatgctacatttcctttcgtctatctcttttcaactacacgcagtttcgcgctgcgcgctctcggattttcttccagttctttttctcccgggatgatcggctttctggtcaccagctttacctggcttgtctttccgcatacgcatattggaaaatctttgggacattcgcatggatcgaacaattttttaaacgtttgcttcacgatcctgtcttctaaggaatggaaggtgatcaccgccagccttcccccgctgcggagcgcttccacataatcctcgagcgctttccccagccccgtcagctctgcattgacttcgatgcgtatcgcctgaaaggttcgtttcgccggatgcgggccgtctcgccgcgccgccgccggtatcgcgtttttaatgatttgcgcaagctcgcctgtcgtttctatcgttttatccgaccgcgcccctgcaatgaattttgcaatgcgggccgcccatttttcctcgccgtactcccgcaggatgcgcgccagttccttttccggatattcgtttacaaccgtcttcgcgctcagttcgttttccaggttcatccgcatatcgagcggagcatcctgctgatatgaaaaccccctgtcactttcatccagttggaaggatgaaacgcccaaatcgagtaccgcgccgtctatgccatcaatatcattttccataaggatgtccttaatattcttaaagtcgtcgtggacaaacagtatattcttttggaatccatccagcctcttcctgcaccggccgatcgccgctgtgtccttgtcgattccgatcaacctgccatccggtaatatccgttccagtattccttgcgaatgaccgccgccccccatcgtaccatcgacaatcgtctgtccgttttcaaggcaaagcgcgtctaatgtttccgagtataataccgggatgtgacagctttgtgaaatcatattcccaactccgccaattttgcgagcgtctcttcataatctttgtatgcgctgtcgttatattccgcccagccctctttggaccagatttccgcccttgtcatcacgccgatgatcaccgtttccttgaccgcgccgatatggtcgcgcaaacgctgcggcagtaggatccttccctgtttgtcgccttcgcattcgcacgcgcttgcgaacagcatacgcgtaaaactctgcgccgcgacatcggataccggaaggtctttcagtttacccgcgaaattttcccattctgttttggagaatacaaacaggcattttcctacgcccttcgtaacgataaagctttcgcccagatcgtcgcgaaatttcgcaggcataaatactctgccctttgcgtctaaattgtgcgaatattctccgatcagcattttcgcggcaaactccttttcaccacatttaaccacttttcaccacttgtaatcaaattttaacactataccccccattatgcaagcgtttttcatgaaaacaacaaaaaaacgcaaaaaatattttttgcgttttttctgcatcgttatcagttttttcaggccttagtttagatgattttcttcagtttgaaatcaagataatccgcagacgtcaaattgtaatttacaccctcgattttaaagtccgtcaagtggatattttttaaaacatcgccgtgcaaatgtccaaacactacttcttttacaccatattccttcagtatctgatgaaattccgtatcccgcatattttcataaaccggcgggaagtgcatcatcacgattttgactttatccgtttgtttcgccgcgctgtcaagggacattttcagccggagcttctctcgttcgtagatcttccggtcgctttcgcaaaagctgttatcctgcgggaacatccacccgcgactgccgcaaaaaatataatcgccaaaagcgatactgttgttttgcaaaataaacgtgttgttgcttaaaagtgtatttacctgcgtcatggatccccaccaataatcgtggttgcccttgagcaggattttctttcccggcaatccgcagaccgcgtcaaggtcgggtttcgcgtcctgcaatttcatcgcccaactgatatcgcccggaatgagcacgacgtcttcttctttcacacgcgcattccagtcgctgctgatcttctcaaaatggtttttccagtggtcgccgaaaatatccatcgccttcggctgtgcattcgacagatgcaagtccccaatcgcatacacgttcatgcgccctgtcccccggcgatcatcttctccatatatgcaataatttcttcttttccttttttatccgccgaactgaccggcacgatcgcaacttccatatcaatatcgagcgccccatcaatatactttgccatctgcatcacatagttgaaacgcttggacttggcgatcttatccgcctttgtcgccgcgatcatgaacggtaccttataatgtgccgcccattgtatcatcgccagatcgtcctgagtcggcttatgcctgatatcgacaaggatcacaagcgccttcaggcttttcgcaacgtcaaaataatcctgcatcatttctgcccaagactcctgttccgactttgaaacacgggcaaacccatatcccggcagatcgacaaggtagaatacatcgttgaccaggaaataattgatcagacgcgtttttcccggctgtttgctgacataggcaagttttgagttgttcgcaagataattgatcagcgacgactttcctacattggattttcccgcaaaagcgatctcaggaagatcgcctccgggatagtccgcgctctttttcatgcttttataaaaaactgcttttttgatttccactattttttctccgccacgatcgcattcttcagaacatcgtctatctttgtcgcaaaaataaacgtaagctggtcgcggacggactggggcaattcttccagatccccctggttatccttcggcaggatgatcgtatgtatccccgcccgcaaagccgctaacgctttttctttgataccgccgatcttaagcaccctgccagtcagagtgatttcccccgtcatggccacatcgtggcggacggggcgctttgtgagcgccgatacgagcgcagtcaccatcgtgacccccgcagacggcccatccttggggattgccccctcgggcacgtggatatgcagatccgtcttttcattgatatcgagcggcagcttcaattttttcatcatcgcgcgcacgacggaaatgcccgtcttcgccgattctttcatcacgtctccaagctgacccgtaagctcgaccttgcccgtccccgggatcaccgacgcttccacgggcattgtctgcccgccaacagccgtccatgcaagccccgttacaacacctacggtatcttgtctgatcatgtcgttttcgctgcgcctcggatgtcctaaaaattctttcaggtttttttgcgacacagaaatcttttccgcgccggtttccacaatctttacagccgccttccgcatgatcgcggcaagttcgcgctctaagctgcgtaccccgctctccgccgtatacaaatggatgatatccataatcgccgcatcagataccttcacctgcgacggctttaagccatgggctttcgcttgcttggacaacaaatgctttttcgcgatatttagcttttccacatccgtataactgtcgatctgtatgatctccatcctgtcataaagcggccgcgggatcgtgctgatatcgttagccgtcgtgatgaacatgacctttgaaaggtcaaagtcgatatccagataatgatctctgaacgtattattgatctccggatccagcacttccagcatcgcagacgccggatctcccctgaaatcactggacatcttgtctatctcatcgagcaggaaaagcgggttcatactgtccgcttgtttaatagacgaaataatcctgcccggtatcgcgccgatatatgtcctgcggtgtccgcgtatttccgcttcatcccgcacgccgccaagcgacatccttacaaagtgcttatcgagcgcacgtgcgatcgaccgggcgatggatgttttgcccactccgggaggtcccgccaggcataagatcggcccgcgcatatcatttttcagtttacgcacagccaaaaactcaatgattctgtcctttactttttccaatccgtaatgatccgcatccagtatttttcgtgcgtttttcagatccagattatccaccgtatattttccccacggcaaactaacgatccaatcaatatagctgcggatgacactgatctccggcgaccctggagccatcttcaccatccgcgataattctttttccgctttattgcgcgcttcgtccgagagcggcaattcctttatctttttccgaagctcttcaacttcgtcttcatcattttccgtttccccaagttccttttggatgaccttcatctgttctcgcaggaaatattccctttgagatttatcgatctgctgtttgacggacgaagcaatctccttgtcgatctccaagatatcgatttcctttttcaagatatccgccacaagctgcaagcgttccaactcgtcgatacaatcaagcaccctttgtttgtcatcgagcttgattgcaacattagaggcgatcatatcggcaaatttacccggctcttctatttcgccgatcgtaaagagcgtttcgcccggaacgcgtgcgccaagggatgcaaacctctcaaacagatccgtgatacggcgcatatatgcttctttcagcacttcctgcgccctgtcgatatggttttcgtccggaatcggctcaacttccgccttgatgtacggctctttttccgcataggaaagaatgcgggcacgccgctcgccctccaccagcacgcgcaacgtatcgcccggcagcttgagcacctgctttaccctggcgatcgtaccaatctcatgcacgtccgcaatctccggcgattcaattttcaaatccttttgcgtgacaagaaaaatatcccgtccttgtacaacgcattcttctacagccgcaacggacgcttcccttcccacatcaaaatgcaacaccatataggggaatatcacgagcccccgtaaagccaccatgggcataattactttttccaacttactttctgctcctttattctgcattatcctttaaattataccttatattgtttctcatttcaaacgcctcgcttttattttccatattcagaagcgcttgaaatacttttcttttatattaatacccttgcctataaaaccagtaacatcaaggaaattgctctgcaaataaaaagcgcaccgtttccgcggtgcgctttcattgcattacttaaattattttgactttacaaccgcgtgagctgcagccagtctcgcaatcggcacgcggaacggcgagcaggatacatagttgaggccgaggctgtcgcagaattcaacagtggacgggtctccaccgtgttcgccgcagataccgagtttgatatcggggcgagttttcctacccagttcagcggccattttcacgagcttgcctacgccgtcctgatccagtttcgcaaacggatcggattcgtagattttcttcgtataatagtcatcgaggaatttacctgcgtcgtcacgtgagaaaccgaacgtcatctgcgttaagtcattcgtgccaaacgagaagaactcagcttcctcagcgatttcgtcagccgttacagcagctctcggcacttcgatcatcgtaccaactttgtagtcgatcttcttgcctttctcttccatgactttttcagcagtctcaacaacaaagtctttgacatatttgagttccttcttgtcgccgaccagcggaatcatgatttccggaacgatgtcatagcctgtctccgcgatcgtttcgatcgcagcttccataaccgctcttgtctgcataaccgcgatttccgggaacgtaacggccagacggcagccacggtgtccgagcatcgggttaaattcgtgcaggctgtcgataatcgcctgaagggcgtcaacgctcatgttcatctcttttgcaagagccgcaatgtcgtcagcagctgtaggcaggaattcatgcagcggcggatccaggaagcggatcgtaacagggttccctttcattgctttatagatgcccttaaaatcttccttctgcatcggcagaagttttgcaagagctttttctctttgctcaaccgtcttggagacgatcatttcacgcatagcagcgatcctatcttccgcgaagaacatgtgctctgtacggcacaggccgataccttccgcgccaaattcgatcgcctgctccgcgtcatgcggcgtatctgcattcgttcttactttcagtctcctgatggaatcagcccaacccattaccgtagcgaaatcgcctgtaacctgcgcttcttccgtttcgattgcctcaccgtatacgttacctgtggaaccatccagcgaaatccagtctccttctttataaaccgtaccgtcttccgttgtcatcgtcttagcggattccacgattttcagttcgccgcagcccgcgacgcagcacgtacccattccacgcgcaacaaccgcagcgtgggacgtcataccgccgcgcgccgtcaggataccttcggaagcgtacataccttcgatatcttccggggatgtctcctgtctcgccaatacaactttttcaccttttgccgcagcagccgtcgcgtcgtcagccgtaaaataaattttaccgcatgcagcgcctggggatgccggaaggccctttgcgatcggttttgccgatttgagcgcagccgcgttaaactgcgggtgcagcagggaatcgagctgcttcggctccactttgaggattgcttcttccttcgtcaatttcccttcgtttacaaggtcaacagcgattttgagagccgccggagcagtcctcttgccattccttgtctgcagcatgtagagcttgcctccttcgatcgtgaattccatatcctgcatatctctgtaatggtcttccagggattgcgcaatctttacaaactggtcatatacttcgggcatctggtcctgaagatgcgagatcggctgcggcgtcctgataccggcaacaacgtcttcgccctgtgcattcatcaggtactcgccatacagtttcttttcgcctgtagaagggttcctcgtgaaagcaacgcccgtaccgcaatcgtcgcccatgttaccgaataccatcgcctgtacgttgactgccgtaccccagcttgccggaatatcgttcatacggcggtatacgatcgccctcgggttgtcccatgaacggaacacggccgtaacagactccaaaagctgctctttcgcatcctgcgggaagtctttgcccatttcctgcttatagatcgctttatatttctttacgagttctttcaagtcgtcagcatccagttccgtatcgagctttacgcctttagcgtctttcatcgactgcagctcgtgctcgaatttctctttgtcgatgcacataacaacatcggagaacatctggatgaatcttctgtagctgtcataagcaaagcgcggattaccggatttcttcgctacgccttcaaccgcgatatcgttgaggccgaggttaagtatcgtgtccatcatacccggcatggaagcgcgggcacccgagcgaacggatacgaggaacggattttccggatcaccgaatttctttcccgtgacttcttccgtcttcgccattgcatcataaatctggtttaccacttcgtcggcaatcactttgccgtcttcatagtatttcgtgcaggcttccgtagaaacgataaagccctgaggtaccggcaggccgagattcgtcatttcagccaggttagcgcctttacccccgagaaggtttctcatggaagcgtcaccttctttaaaaaggtatacatacttgttagacattcttaaaactcctcctgaacaataatattatttgaaattttttgcaaaatagtatagcaccaagcagaatccaacgtttattatacatgaagaattgggataaaacaacatctttacaaagaattttcaggtaaacatttcatcgttttcaagcggatttccatcatcgaatccagatattttgccataagtgcaacaactccctttgcatcctcctccgaggttctgatttcggatacctgcttgggcttcaaagcactcatttcccgcatatttccaaggacgctgcgcgctaccttgacgctgcgcacatgcggcttgcagtttgcgcacacttccccgccctcctcaagcgaaaaataggccggatcgccgcttgactgccgtccgcacaccgtgcactctccaatcgatggaaagatacccatcagggccgttacgcgcgcaaaaaaatacgcaagggcgaccgcccacgggagctgccttaattccattgcgtaaagcgcatagataagcgttaaaaacaaatcctcatagtccgccgtatgcgtcaggagcttatccgtaagttcaagcatcacacacgcggacgcataggcatcgtaatcgttttgcacgcggaaaaattcctggcgcaaaagcgcattcgtcaaaaataatttatcgccttttttataaaactcgtattctccgcaggacaggggctgcgcagccgaagcaaactcgcttttcagcctgcgcgctccgcgcgcctgcgcgtttattttaccgtctgagcgcgaaaaaagcgtgaggattttatcgtaatccttataatccgttgtgcgcagcacgatgcagtaatgcttttccattatacgtcctgatagccaagcgtgcgcagtacggaaatcttgttgcgccagtccggcttgactttgacccagacctgcaaaaacaccttggagtcaaacaacatctgcatatcctcgcgtgccgcagacgcaatttttttcagcatcctgccgcctgcgccgatgatgatgcccttgtgcgaatccttttcgcagtagatcacagcgtcgatattgagaatgtcctttttttcgtcatattgcagtttttcgatctctacgccgataccgtgcggaatttccttgcctatgcttttcaaagccttttcacgtatcagttccgccgcgatcacgcgttccggctggtccgagatcatgtccgccggatagtacatcgggccttccacgagatatgccttcaattccccgaccagcgcggcaagccctaagccctgtgcggctgaaatccgcaggatctttttgccgaacggctttaaggactcttccacttcctctaggcgctgctcgtctaccgcatcgatcttattgagcgcgatcacaagcggcgccgcgcccttttccgtcagtttttttaaaatctccatatcacgttcgcgcgcgcccacttttgcgtctacgataaagagcactgcgtctacatcccgcgcggcgctttccgccgttttgaccatgaattcgcccagcttgtttttgggcgtatgcagtcccggcgtatccataaatatcatctggaaatcctcgcgcgtcacgacgcccgtaatcctgtttcgcgtcgtctgcggctttttggatacgatcgcgatcttcgttccgacgagtgcgtttaacagcgtcgattttccgacgttcgggctgcctaaaagtgcaataaatcctgatttgaattccattttttcctctttctaaaatacgaacatttctgccagttcaaagacgatgactgtaataccaatacccatgaacgcccccaccaaaacttccgcaaacgtatgtaccttcgtttccatacggctttccgccacgatcagtgccagcaccgccgcgaacgtcgatgaaataggatcccccgatacaaaagcgattgccgtaaacagcgcaaaggcaaacgcggtatgcccgctcggcatcccgccctgcacatagtttccgccttttttcatggaacgtgattttaaaataataacggcaataaagaccaataccagcgcggcaaaggtgatatatcccgagatattattgatgtagtttaccgacaaataggaataggtatacagcttccggaaaaataccagatacccgatcaccagcgcgctcattgccgccacgaacaccgcgccggcagcaacgtccttcgccaccctggccagttcgttatattcgccgcgcgaagcgatatccaccgctgcttcgatcgccgtattgaaaagctctgcaaaaaatacgaatgcaatcgatatcgtaagcgccatcatttcaaaacgcgtcacctgcgtgagaagcgcagcaacgatgaccacgacagccagcgccacatggatcttcatgttgcgttccattttgaaagattgtaaaaaaccattgatcgcatggttgaaactgttcatcaatgatttctttggtctgtattttttaaccggttccttgtcttccatttacctacctgccaatatttaccgaatccagaatttctttttgcctgcctgtcatgcttttttcgtcgctcggcgtcatatggtcatacccgagcaaatgcagcgtgccgtgcaatgccaaaaaagccgtttcccgcataagcgaatgcccatactcttctgcctgctgctgcgcgcgctccagggagatcgcaatgtcgcccagaaacacatccccgtccagcatctccagctccagcctatcggcgcaatccgcaaaaaagccgtcgagctcataggccggaaaggaaagcacatccgtcggcctgtcaatattgcggaactcgctgtttaaattcctgatcccctcattatccgtaaacaggatattcaggcagcagggccttccagcctcgctttgcgccgcttccagcgccgcttgtacggccttgctgatctcccctgtcaattcgactttttcctgctcgtcaaagaatgttatcttcatcttccgctccgtgtatcttgatctccggatacttgatcctctgatggtagacaccgtcgaaaacgttgataaacgcttccgcgatatcccttaaatcccgcctgttgagcggcgcatgatccagaagtccttcatcatagcgtgctttgatgagtttatgtaccatgtcctcgatctcttccctgcttgggtcgtcgaggcttctgaccgccgcttccacgatatccgcaagcatcacaatcgcgccttcctttgtatccggcggattgcccgcatagctgtagtcttcgatattggtgttctcgtcctcttttaacgcctcgtagtagaagtatcccaccgtaccgttcccatgatggttacggacgatctcgatgatctctcccggcattttatacttttttagcattgcaacgccgtctggaacatgcttgcggataatcgccgcactttccttagggcttatcttatcatgcgggttgatattattcctctggttttccttgaaaaacatgggattgttcaccttgcccacatcgtggaaatatgctcccacacgggcaagcagggaaaatcctcctactgcgttgcatcccgcctccgcgaggtttgcgaccagtatactgtgatggtaggtccccggcgcttcgatcatcagccgcttggtaagcggatgcgtcggatcggaaagctcgagcagctttgtaggcgttgtcagcttgaacgcattttcaagcaatgggagcacgccaatactgataatcccgcacataatcccgctgatggcgatcatcgccatgctgttgagcatctgctgcatactgggcgcctgatctcccatcaccggcacctgtagcatccacacgatcagcgccacgacagctcccgggatcgcggcggcaagtccgcccagcaccaacctggaacggtaacgcatatccttgagcgtatatacggcaaagaagctgcccatcattgtaatgagcagcatcatgagcgatgcttcgctgaacatctcctgcccgcctgtcgtcacgctcacaagcagcagcgataaaaatacgctgtatatcaacgcgtttttgggcgacagcaatacggcacccaaaatgacgaacaggaatatgggaaaaatatgtatcgccaccatttgcgtcagcgtcgtaacgccgtaagcaacagccgtcaggatcgccaggatcgctatcttcttggtattcatcagcagccgcctgttgaataccgcgaggaatacggcatataacacgtacgtcaagataatataagaaatgatgccaagatatgggcgaaccgaagtggattccgtactgagcagccccaaagactttaagacattgtactccgcttcccctacgatctcgccctttacaacgatgttttgtccgctcttgtatagtttgggcgttacaagcgccgccgctttgtcgcgcgcttcttttgtagcaacctcgtcaaagactacgtttgacgtaaggtcgttcgatatgaccgccaccataaggctgcgcatcgtttccgtaaggtccagcttctcttcgattgcctgtaccgcatcatttttcatcgagtccaactcgtcgctggcgatccctttggaaagaagattttccacctcttccgccacggcctcctgtaaattggaaagctgcttgcttgtcaggctgatgatatgatatagttgggtattgtcgatgtaatcaggcagcagctccttgatccctgtcaattgctcctgcgtgaggatcgtatcccaatctacgttcgccggatcaaaggctgccatggcatatggcgtcggaaccggcgcgggcgtgaccgcaggatccgtgattcccgcgttcgcctgctctaccttgtcgatctccttttgcgcagcgtccgctttttcctgttctttctggtcatatatactctcggcctgtgcgcgcgctttctcaaacgcagcaaaatcttccgtgatcttcttattcgtctgttgcgtgatatccgcgtcttttttgtacgacggtccaacctgcgcctgcgcttcttcaatctttgcttgtgttgtcacttcatcgaccacgtcctttggcgcagtgatcgtttgcgttgatatctcgcctacggtgatatcatatgtttgcggcgtaatcgaaaccagcgcgatcgcgatacatacgcccagcgatcccacggccatcaataaattcacaaatgcttttttacttctctcgtttttgaaagccataaaatccccttaccgcttttttatacgatggtgttttcccgcctgttttcgtatttttcgaacgctttaacaatgcttttcacaagcggatgcctgacaacgtccttattcgtcaggttcacgatcccgatatggtcgatattctttaaaatccctgtcactttcttcagtcctgacgaacgttcccttggcaggtcaatctgcgtgatgtcccccgtcacgaccacctttgaattttcgccgaaacgcgtcaggaacattttcatctgttccatcgtacagttctgtgcctcgtcgaggataataaacgcgtcgttcaaggttctcccgcgcatgtacgcaagcggcgccacctcgatcgcccctttttccgcaagccgcgcatacgcttccgcgcccataaaatcgtatagcgcatcgtataacgggcgcagatacggatcgaccttgttttgcatatccccgggcaggaaccccagcttttcgcctgcttccactgccggcctcgtcaatatgatacgggatatctgcttattcttaagcgctactacggccatcgccatcgcaagataggtttttcccgttcccgcaggccctacgcataccacaaccgtattgtccttgatcgccttgatatattccttctgaccgtacgatttacacttgatctgtttgccgcgcgcagtgatcgccacgacgtcggacatcatctcgctgaccagctcctgatgcccttcctgtacaagctccaccgcataactgatcgtgctttcgcctatcgtttcattcttattatacatctttttcagtacttcgataatatccgccgcttcctgcgccgcctttggtgttcctgcaatacagataccgtgctccgtcgcacggatcgccacccctgtctgtgctgaaatgatattgatattctcgtcgaagctgccaaacacccccgacatctggtctatgctgtcgaatgaaatgtcgatattcgtttgcttttccgccaagctatttgtcctccaattatgtttatccataataccgccatgataacgtataaatcatatcatattttcctgcaaaacaccaacaaaaaacgggctaccataaaatgcagcccgtctcgattcttaagcttaatgctttctttttctcgcagcctcagcttttttctttctctttacgctgggtttttcataatgctcacgtttcctgatctcagccagaactccggctcttgcacatttgcgcttgaatctccgaagagcactttccagtgtttcgttttcgcctacgcgtatctcagacattatctcccctcctcccgtactctgtccccgcctttaaataggaactgggagttatttcataccactgtattatagtaaaatccacctattctgtcaacagctatttcacgggcttcaaaaccattttgaggatcaatcccgtaaatttgccaaaaaccctgcccagcatcgtgcgcagcgtacgcacgtccatatccgcgccatccgataacatttcgaatttgtcgccaaacattttataacgcaaactcgtttccttaagcccattgcgcagataaaacgccttgcgcttttttctctgttccacgttcggcgcatcggcagttataagctcaatatccaaaaataaatgttttttgccaatccgctctttgagcagtgcaagcgcgctgctgccatagcctttccccctggatgtcccatccacggcgaaatagttcagcagaacacggttaccatattccgccgtgaccatcagcccgacaaaccgtttcccgtccacaagggataaaagttcaactttcccctttcgataccctttaagcagcatcgcaaagggaaattgctcattttttgggaaagcctctttatagagctcccgaaaggcagtaaggtgctcttccggcattctgatcaaatccatttttgccgttcctgtcgttagtcaacccgggggccactccatataccttccgccgagaagatgcatatgaaggtggggcacggtctgccctccgtttttgccggtgttaaagaccagccggaagccgtcctctgccagtcccttttctctcgcgatcctctgtgctgtttccgtcatgcggttcacgtatttgaaatcttctcccgcaatatccatgatactttcaaagtgttttttaggaataatcagtatatgcacgggcgcctgcggcttgatatcggtaaacgcatataccatatcgtcttcatataccttatccgacgggatctctcccgctatgatcttacaaaacaaacaatctgccatttccatcactcctcttctatttgtttaccgtacagtataccattttcgtacttatttaacaaaaccttcttcatttcattgggctttccttttgcgtgcacgcgcaggtagcggtctgtgtacccctcgcacacgccgtccttgatctcctgttcgaaaaggacttcctgcgccgtgccaaggaaccgcatggcgtactcgccttccatcgcctttcctgctccgatcaagaggttcgccctctcgcggcgcgcctgcatgggaacgctcccgtccatttccgccgccggcgtccccgctctctccgaatatggaaacacatggatacgcgcaaatgcgatctctttgacatacgcacacgtctgcttaaagttctcctccgtctcccccggaaaaccggtaatcacatccgtcgtaatagccggattttcatagacggagcgaatatttccaatatactgcgcaaactgttttgcggtatatttgcggttcatacgcgcaagcacgctgtcacatccgctctgcagcgaaacatggaagtggggacatatcttttccaaaccgcgcagttcctttaaaaacggcaactccaaaatatgcggttccagtgagcccagtcggatacgccttattccggatactgcgttcagcccgctgagcatatcgatcagcgccgcgccgctgtcctgcccgaaggaagagatatggatgcccgtcaggacgatctcctgagcgcctgacgccgcgagtgcgcgcgcctcttttaagatgctctccagactgcgcgaacggacccgcccccgcacatacggaatgatacaatagctgcaaaaattgttgcagccctcctgtattttgatatatccccgcgtaagctccccgctcgtgtgtacgctcaaatcctcaaaaggttcgccattcccgatttcccgcacgccgttcgcccctgacccattcaggcatccattgacaatcccgacaatctttcccctgtcttccgttccaagcacggcgctcacgccctctatcgcaaggattcccttgctgtcgcgctgcgacaggcacccgcatacgcaaatcgccgcttgcggatgtttgctgtggatacgccggatcatattgcgtgactttttatccgccatatttgtgacggtgcatgtgttaatgaggtatacatccgcactttcgtcaaagccgacatgctcaaaccccgcagccgtaagcagctccatcatcgcgttggtatcatattgatttactttacatccgagcgtatacgccgcgaccttcatgcgcacccctccatcaggtgataagagatcatggctgtcgccgcaagccccgccgtctcactgcgcaaaataagcgcgccaaggctgcacacctttgcgcccgcgttcgtcagcatggttacttcattttccgtgaatccgccctccggaccaatcacgacaaaaatgtcctgcatgttcttttcctcatgcagcacatcgctgatcagtacgtttttttcgttctcatatgccagcaaaacaagcccgcctgcctctttgagccgtattgcaagatctttcagcggtacgatcccgccaacgtcgggcacgcgtgaccgtccgcactgcttggctgcctcaagggcgatccgccattccctctgtaccagcttgaccgccgatttttcgtccggccgttttacacaccgctcgcttaggaacggtataaaatcatacgcgcccatttcgctgcatttttgcaccacataatccaggtggtcgcttttgatgaccgcctgacaaatatggatgcgtatttttggttctgccgctgacatgcttgcctcgaggatatcgatagacacactgtcttcattgatccccgatatcctgcctttataatcaatgccgcttccgtcaaaaaggatcagcaggtcgccttctcccattcgcagtacgcgcgtcatgtgccttgcttcctgtccgtggaccacgaccgtttgatcccctgctgcgaccttgtcgataaaaaaccttctcatcccctgtacttacaggcgatcgcgcgccactctccatcctgcataatctgtatgaccttatacccttccgcctcgatggacgttctcacatcgtcaagacgcgaatcgatgatacccgaacaaagatacataccgcccaccttcatataacgcttggcgacggggttgaggctgatcacaacgtccgcaatgatattcgcgacgacgatatccgctttttcgtccttcggcacctcggaaagcaggtcggatttttgtgcgccgataacgttttcacatgcgttgagcgcggcgttttcctttgttacttttaccgcgacaggatcaaggtcgagcgcatagaccttttttgcgccgagcttcgcggcggcgatggaaaggatcccgctcccacagcccgcatcgatcacagtcatatcctgttccatatattcttcgagcaagtgcacgcacatacgcgtcgtttcatggttccctgttccaaaagccatgcccgggtcgatctcaatgacgatctcgtcttttttcgcttcatattcttcccacgtcggtttgattacaaaaaaatcagatattttcacaggcttaaaataagccttccacgcattctcccaatcctgctcatggacgatatcggttttgacctcaagcgttccgagcggcacgcccaactccattccacggatttctcccaggcggcggcgaatgtctttcgtaaaatcattttccgttccatcgcatggaaaaaacgcggcaacacaaaacggcaccttctttaagatctcgtccgacagataatcccacggcagtccgtctttggcacatgcctcgttatctccttcgatcgccacgccatgcgcgcctgcttccagaagcagcgcggatataatctcttccgcttccttttgcgtaaaaacgctgacctttaaccaatccatgctacaacgttctcctaacaattttagttcttcctattatacccataaaccgttcttgatgcaaacgccgcgcttaacatttgtttgcataaaaaaccggaatccctcccttcggattccggcttttatcattgtttcccgcttccttttatcgcatttgggcgggctgcattccgccgcctctgccgcccatagcgactgtatcgtcagtggtaacgcttacctgagatgttccattcagcgcaatatcataagatataccttcctcgatatcggaacttgagaacaggatcatctggcatgtctgcacaagctctgtcgaaaaaagttccgttccgtttgcgctgaccgatacggtatcccctgcttttccgttcaggccggccataatatatttctgcgctccgtccgtcggagcggagatgttcgcccctgtcgcaaacacggtcccgccgttcattgtgacgccgctgtctgcgtcaaggccgccgttcgcatcatttacggccccgaaggtaacgatcgtaccgccgttgatctcaatggaaccattggaatcgattccgtctcctcctgcattgatataaatcgttcccccattgatcataatctcgctcactccgtcgttgttggcattgaccccgtcgtcgtaagccgtgatattgattgttccgctttctatcgtcaggtgcatttcacttgcgatcccttcttccaccgtaccgttgacttcgagggtcccttcgccgttgatcgtataggagacacatccgtaaagcgcgccgtcataatcgctttcccccgcatcctccagcgtgtttaccgtgccatccgccaggtttacggttgcgcttgaagcatccttgatcaatattgcgggccctgcgttgcttttgagcgatacgccgtttaacacaagcgtgacctcttcccccggcgcatcgaccgttaccgatccgtctgttgtcacgccggagataatatacgttccggcctctgatatcgtaacatccgcgccctccgcctgcgcccctgttccgtcgatctgtgcgttatcgccattaagttctatggtcgtacctccttgcgtatcaagcgcagatgagacagtatccgcagaacttatttctcctgtatttgttgttacagtggacgaagtattgctacagcttacaatagccacgcaaagaaatacgattaatatggccgctaatatgaccgcgattatttttttcattgcctgttccagcctttcttttttgatatccatattatggcccatctatgtgatagataaatggaaatattgttatcgcaatctgaaatttatgtgctggtccggaaatctttagaaatcgatggatactaaaaaaccccgccatgtaagcgaggttttttactgcaatttgtgagccggtaattacatcattgcgcccatcactgtgccaaccagcgccgcagcggctactgccacaatgataacggaaataattgccaggatcgttacgatcataccgaggattttgcccgctttcgcctggctgtccgccggatttgctttgaccgctttcgcacccattacccatgcaatgataccgagtacgataccaataaatccaacaaaggggatctgcgcaaaggaaagacctgtgcaaactgctgctatgattccgagaattaatgctgtcataattaatatatacctcctgtttctttattggtcacgcatgtgaccaaatacattatatccatctttcacataactgtcaactcaaatggcacaatatcttgcgcttcccacatttttttgtacttttactcccgctataaaaaagaaggaatccaaatggattctttcttttaaaatgcatcttttggttttataaactcaatttccctgtcctttgctttgagcttgtcctcaaaatcccgcaatacttttttctgtttctcactcagctttttaggaatctgtacgtttgcacgtacgtaaagatcccctgtccggttgctgttcagatatttgatgcctttgcccttgagccggaaaaccgtgcccggctgcgttcccgcttcgatcttatagcgcactttaccgtccagtaccggcacttcgatatcgtcgccgagcgcagcctgcatcatgctgatattcatatcgagatacaggtcgtacccgagccgctcaaacagtttgtgcggttttacggaaattacgatttgcaggtcacccgccggaccgccgcgcttgcccgcatttccttccccgcgcatggtaagcacctgtccattgtcgatccccgccggcacgttgatcataaccgtacgctgtttctgccgcgttcctctgcctttacagtcttcgcagggagaatccacgatcgttccttccccgccgcaggtcgggcacgtctggacattgacaaaattgccgaacatcgtctgctgctgtacccgctgttgaccgctgccattacatgtcgggcacgtccggcgctctgttcccggttttgcgcccgtgccgccgcacgtatcgcatttttccagccggtttatcgtgacctcctgctttacgccttctgccgcctgttcaaaactgatacgcatattaacacggatatcgcttccgcgctgtggcccgtttggctgctgacgcatacctccgccgccgaagatattttcaaaaatatccccgaagccaccaaacccttcaaagccaccgaagccgccctgtccgccaaaaccgcccgcgccgttgaagtccgcactgccataagtatcatactgttggcgtttctggtcgtcgctcaggacctggtatgcttcattcacttccttgaatttctgcgctgccgcgtcattatccttattcatatccggatgatacttcttcgccagttttctgtatgcacttttgatctcgtctgcactggcgcttttatccacgcccagtgtttcataatagtccttagccaagtgtcatatacctctcccaaagattctgtaaccctcgaaaagccaaagcataatgctctggcttttgcgaggtgccttactgattaccgatgtgcggtcagtctttcttttcgtcgtcttttttgtcgtcgtccaccacttcatagtcggcatccacgacattgtcgtcctgctttgcgtcagccgcgccgttcgggttatagtttgggtcaaatcccgcaccgcctgcgccgcctgccgccgcgttcggatctccgcccgcctgctggtagatcttgccgaatgtctcaaacgatacgttctgcagcttttccgtagccgatttgatctggtcgatgtctgtcgtcttaagcgcttcctttgccgccgccagttcgtcctcgatcttctttttatcgtctgcggatactttatcgcccaggtcttttaatgtcttctctgtctggtataccagagaatcggcattattgcgcgcttccacttcggctttacgttctttatcttcctgcgcaaacttctcagcttcggccaccgccttatcgatatcttcgtccgacaggtttgtggacgctgtgatcgtgatcttctgttccttgcccgtgcccatatccttagcggatacgtttacgataccgttcgcatcgatgtcgaacgtgacctcgatctgcggtacgcccctcggcgcgggcgcgatacccgtaagctggaatttaccgagcgtcttattatatgccgccatttcgcgttcaccctgcaatacatggatttccacgctcgtctgtccatctgctgccgtagagaacacttggctcttctttgcaggaatcgtcgtattcctttcgatcagcttcgtggatacgccgcccattgtttcgatgcccagcgaaagcggggtaacgtccaaaagcagtacgtcttttacttcgccgcccagaacgcctgcctgaatcgccgcgcccatcgctacgcattcatcagggttgattcctttaaacggctctttgcccgtgatacgctttaccatatcctgcactgcagggatacgggacgaaccgcctaccagaagtaccttgtcgatctccgagctcttaatccccgcatccttgattgcattggacgtcggcccttccgtttccttaacaaggtccgccgtcagctcgtcgaatttcgatctcgtcaggttcaggtccagatgcttaggacctgttgcatccgccgtaataaacggcaggttgatatttgtctgcatcacgccggaaagctcgatcttcgctttttcagccgcttccttcaaacgctgcaacgcgatcttatcggccccgaggtcgatgccgtcgcttttcttgaattccgctaccatccaggctacgatcttatcgtcaaagtcgtcgccgccgagacggttgttgccgcttgtcgcaagcacttcgataacgccgtcaccaatctccaaaagggatacgtcaaaagttccgccgccaaggtcgtaaaccaatattttctggttgtggtctttttcaaggccgtatgccagcgctgccgccgttggctcgtttacgatacgcaatacttcaaggcctgcgatcttaccggaatccttcgtcgcctgccgctgcgcgtccgaaaaatacgccggtactgtgatgactgcctgcgtcaccgtttcgccaaggtacgcctctgcgtccgctttcagtttctgcaggatcatcgccgagatttcctgcggagaatacgttttcccctcgatcgtgatctttctgtccgtacccatgtcgcgtttgatagacatgaccgtatgatccggattcgtaacggcctggcgctttgccacctgtcctacaagccgttcccccgtattcgaaaatgccacaacggacgctgttgtccgtccgccctctgcgttggggataacaacggcttcgccgccttccataaccgctacgcaggagttcgtcgtccctaaatcgattcctattactttacccatttatttcgtcctcctaaatatgttttccattctcacaatttttattgtaaagcgtccatgacgctttgctcttccttttattttgccactttgaccatcgaatgccggagcaccttgccttttatgcggtatcctttttgcagcacctctacgatactattcggctcacagttttcttcctccacctgcatgaccgcattgtgcaattcgggatcgaactggccgcccgcctcgatttcttccactcccagattcttaagcgcttctgcaaattggcgcatgatcattcctacgccgtcggcaaaagcctggtcttcgcattccgccatgagcgcccgctcaaaattgtcgagtacgggaagcatcgcggtcgcggcgtccgccacgccgttttggtaagaattcgcagataaatccgcattcctctttttataattttcaaagtcggcccgttcgcggatcaaggcgttcacatactcttccttttccgcttccagcgttttgagctgttctgaaagctgttcttcctgcgcgttccctgcctcgcatgcttcctgcgccggctgctccgtttcagtttcttttaccgtttcttcttcggctatatccggttccttctttgtttcttcttgcttctttgcttccgtgtgtttcttttgtgccaatttactttacctgccttatttatttcttatcgtctgtctccagaagacacgatagaatatcgctcaaactcattcccacgtaattgagaaccgagagtacccgcgcgtagtccatacgcgtcggcccgattacgccgaaagaaccgatcttttccccgccgatcttataggtcgccgttacgatgctcatatccttgaaatcgtcgtaaggattttccttgccgatgcgtatcgagaactctaaatcagccgcgctggacataacctggtaaagcatatccttcgtttccaaaagctgcaggaaatgctgtgccttcgccgtatccttgtattcaggatagttgaagatgttctgcgcgccgccgaacacaagttcctttttctcacggctcatgttgatcgcgtccagcacttctcccatgatgaccttctgctcattgagcgcatccacgcacgcgttgctgatgatctctcccgcttcttttaaggaagtactttggacccagtccgtcagcatattggaaagaatttcaagctggtgcgcatccatagcgatcgggataccgatcattttatcccgcacaaggccactgtccgtaacaaagacaagcagcgctttggtctccgtgatcttcacgatctggatacgccgcagctttgcgtcttccatgttcggcgcggttaccatcgagatatgcttggtcatatccgaaagcgccttagctgccgattccagcacctcgccgatctctccgatccgcgcgtcgaaataattgcggatgaaaagcgcctcgtccttcgtgatgcggccgatatgcatcagcttgtccacgtaaaggcggtacgccttatcgctgggcgttcttcccgcagaggtatgcggctggcccaaaaagcccatttcctcaaggtcggacatctcgttgcggatggtcgcgggactgtaatcaaggtccggcttcttggagagcgtacgcgatccgacaggaatgcccgtatcgatataatcatcgataatggcttttaagattttcaattttctgtccgataattccacgtcgaagctcgcctctctgcccgtttcaccggcggttttccgcgtccccgcaaaacccgtttgctccgcacaccttcgctccgcttcggtgtcgacgggcttttgcaggggctttcatccgcctttcctaatttatatacacaaaaaaccggtctcaaaccgatttgttagcactcgccatcgtcgagtgctaattccttgatataaagataccaccgcgtgcggtggttgtcaagttcgattgataaaattatagcggatattcatgaacttactatgaatgaatcctacaggcttgcaatgagtatggaaacaagctggttttgcaggtcaaaccctttttttgtgggcataacgcaatcgttttgcaccacgcacaatccctgcccgcaggcctttttaagctcgggcgcataggccgtcagaaaatcttccccgaagtgccgtttataatcatataagaggaaaccttttttaagacgcagcttgagcatgatatactcgatcttgcgctgcgtatcatcaataaagtccgactgttcgtagcgcagcttgccctttcccatatgttcaatatattcatcgatactgcttgtgttggcgaaccgcaggcgctcgatacacgaatgcgcagacacccccaagccaatataatccttgaggttccagtatttcatgttatgggcgcattcatacccgccgatcgcgaaattggatatctcatagtttgtgtatcctttgttatcgaggatcgtttgcgccatatggtacatgcgcagatccgtatcttcatccgcgggcgttacttcccccgcttccaccctctgtgccagcggcgttccctgttcgattttcagcgcgtatgcagaaatatgctccggcttcttatgcaacgcataaaaaagggtcgcttcccagtcctggaccgtctgtcccggcagcgcatagatcacgtcgatattgatattttcaaatcccgcttcgcgcgcccagccaaaggcattgtcgaacatttccacggtatgctgccgcccgagcgccttaagataactgtcctgcgccgcctgcaagccaatgctcaggcggttgatgcccgcctccttgtatgctgtgagcttttccctggtaagcgagcacggattggcctccagcgttacttcggcgtcgcttgtaagcttaaaatcgcggcgcacaatatccatcatccgccggatatattcttcgtcgatcagcgacggcgtaccgccgccaaagaatacggagtccacagcctggttatacatcccgccgataagctgtgtttccttttgcagcgcatgcatatacgggccgaccagcgagcgcctgtccgtcgatataaagtcgcaatatgcacattttttaatacaaaacggtatatgaaaataaagtcccaacataaaacttctagtccattttcaaaacgctcatgaacgcctcggacgggacctctacgctccctacctggcgcatacgtttcttaccttctttttgcttttcgagcagcttcttcttgcgcgaaatatcaccgccataacacttggccagcacgtctttgcgcagcgccttgaccgtctcgcgcgcaataatcttaccgccgatcgccgcctggatcggtatttcgaacatctggcgcgggatcacttccttgagtttttccgcaatgatcctgccgcgggcatacgcacggtccttgtgcacaatcaatgaaagcgcgtcgcacatctccccgttcagaaggatatccagcttcacaaggtcgctcttttcatatcccttgacctcgtagtccatagacgcatagccgcgcgtcctcgactttaagttatcaaaaaaatcatagatgatctcgtttaaggggatctcgtagtgcagcagcacacgcgtcgactcaatatattccatattcttgaacgtgccgcgcttctcctggcaaagctccatcactgcgcccacataggtatccggcgtcatgacgcttaccttggctacaggctcctccatatattcgatcgtagaaacgtcgggcaggtttgtcgggttttcgatctcgatctcttccccgctcatcaggtggacgcggtacgagacactgggcgccgtcgtgacaaggtcgaggtcaaactcccgctccaaacgctcctggatgatttccatatgcaaaagccccaagaaaccgcatcggaaaccaaaccccagcgcaacggaaacctccggatcgtaaagcagcgacgcatcgtttaggtgcagtttttcaagcgcgtcgcgcagatcgtcatatttcgcgccgtctgccggataaataccgcaatagaccatcggcgtgatttttttataaccgggcagaggcgcctttgcaggatttgacacatccgttaccgtatcgcccacgcgcgtatccgcaacattcttgatacttgccgcaatatatcctacgtcgcccgccttgagctcctttgaaggaatcagctccggtgcaaaaatgcctacctccgtcgtctcgaacgtccttcccgaagccataaatttgattttcgtgccttcggatacttttccgtccatcaggcgtacataactgatcgcgcctttgtaattgtcgtaataagaatcgaacaccagcgcctttaatggagcgttctcatccccccccggcggcggcagtttttctacgatcgcgcgcagcacctgctccacgttctccccgcttttcgcgctgatacgcggcgcgtccgaagcgtccagccccagcacgtcctcgatctccgtggcgatttcatccggacgtgcgctgggcaaatcgactttattgatcaccggtatgatctccaggttattgtccatcgcaaggtagacgtttgcaagcgtctgcgcttcgatcccctggctcgcgtccacgacaagcaccgcgccctcgcacgctgcgagcgaacgcgagacttcgtacgtaaagtccacatgccccggcgtatcgatcagattcagttcgtactcctgcccgtccttttcatagagcatacgcacggcctgcgatttgatcgtgatgccgcgctcgcgctccaaatccatcgtatccaaaagctgctcttttaaatccctgctcgccaccgttcccgtcatttcgatcaggcggtccgccaatgtggatttgccgtggtctatatgcgctatgatgcaaaagttccgtatatatttttgatagtcgttactcatttactcacctcaatactattccaaaatatatcatacgaaaatacggcttaaaatgcaataaaattcctgcgcatttgtaaattgaaatatgctataatgaaaaaaagaatcatggaaagcgaggcgttttcttatgggccaatatgacgaattgatcggtcttttgaaccaaaaggggtttcatgcacaattttttgaggattccgcttccgccagggacgcggtaatggagcttttggaaggcgtacagtccgtcgggatcggcggcagtatgacgcttaacgagacgggcatttttgaagcggtagtgggcagcggtaaaacggtatattcccaggtgatcgagaaacaaaaggaaaatcccgacgtaaaaaccgtatggcgcagcgcaatgattgccgatgcatacctcacctccaccaacgcgctgacagcgcagggcgatctcatcaatatcgatggaaacggcaaccgcgtggccgccatgtttttcgggccggataaagtgatcgttgtttgcggggtcaacaaaatcaccaaagggccgcacgacgcgatcgcacgcatcaaaaaagaagcctgccccaaaaacgcacagcgcctcggccttgggacgccatgcgccctcaaaggcaaatgcgaagagtgctccacagcgcagcgtatgtgcaatgtaacggtgcgcatccagtacccgcccagagataaggaaatacatatccttttgatcaatgaagatctgggttattaataaccggtacaaaatacaattttgggaggatccctattatgacatatcaggaaagctacgaccaatggaaaaatgcccttgcggggacggaatatgaagcggagctggccgaaatggcggcggatggcgaaaacctgcaggacagcttttataaggaaatggaatttggcacggccggtatgcgcggcatcatcggccttggccgcaaccgcatgaatatctttacggtcaaacgcgcgacacaggctcttgccaacaatatactgaaaaacggcgaccctaaggcgggcgtcgccattgcttacgacaccaggaaaagcagcgacgtctttgcgcgcgaaacggcgggcgttttgtgccagaacggtatcaacgtgttcatgtacgatacgccgcacagcgtcccgcagctttcttttacgatactcgaactgaaaaccacggcgggcgtcgtgatcaccgccagccataacccgccggaatacaatggatacaaggtctatggcgaggacggcgggcagtgccctgttgcagattccgaccgcattacggaatacatcggccagatcggcgatatgttccatatcgattccatgcctcttgacctggcggaacgcgaaggactgctcacttatatcggattggaacttgacgaaatttatttcaaaaaagtggaggacttgtgcctgatccctgatatcgtaaaagaacaggcagacacgctcaacatcgtttacacccccctgcacggcacagggaacatccctgtcaggcgcgtcctgaaggaccttggatataaaaatatccatgtcgtgcccgagcaggagcatcccgatccggcttttcctacggtaaaagcccccaatccggaagagcgccaatgctttgaccttgccatggcgcttgccaacaaaaccaacgcaaacctgatcctcgcaaccgatccggacagcgatcgtctcggcgttgcggtccgcaacgatgcaaacgactttaccaccctctccggcaacgagatcggctgcctgctcatggactatgtcctttcgcaaaagcaaccgtcctttaccggcgacgaatttgtcgtcaagtccatcgtgtccacagacctcgccgatgcgatcgccgcacactacggcgttgagctgcggagcgtgttcaccggttttaagttcatcgcggagcagatcaaactctccgaacggacaggcaaagggaaattcgtatttggttatgaggaaagctatggctttttgcagggcgcgttcgtgcgcgataaggatgcggtacaggctgccatgatggtcgcggaagccgcgtgctggtatacatccaagggtatgaccctgttcgaagctgtgaacgccatgtacgaaaaatacggctggtttgaagaactcgtcgtctccaagacgctttacggcaaagaagggatcgagaagatacaaaacgctgttaaaacattgcgggcggattatccggcgaagatcggcgattttacagtgctggccgtgcgcgattatttaaagcaggagcgcaccgatatggtcacaggcgaaaaaacgcctattccgatggaaacgtcaaacgtgctgtattttgagctggacggcgcacgcttcatcatccggccttccggcacggagcccaaactgaaatcatatctttccgcttcttcccctgacaaaaaccaagccgaatacttgcttggcaagctgaaaacagacgcggtagagctcatcgaaaaattgacggactaaaaaacgataacgcaaaagccgtcccttcggacggcttttttgtattccttacagttttagtcttttttcagccttaccgtgaattcgcttcccgctccaagctcgcttttaacggtgatctccccttcatacagcgaggcgatgtgcttcgcgatcgccagtccgagtcccgtcccgctgaccgcgcctgcgccggaattttttgcgcggtagaaacgttcgaagatacgttccgtctcttcctccggaataccgattccctcgtctttgacgcggatataaacgtttcccgcatcctcactgaggccaacttcaatatgcccgccttttttgctgtactttgcggcattgtcgcacagattcaggatcagctccttcatacgcgccttattagccttaatagtcgcttgtcccttgacctgcatctcaagtccgcccttttcgatcttattctcaagtaggcgcaccacatcatgcgccacgctctccaactcaacctgctccacgctctcatcgatcgtgatctgttccagttcagataactgtagcgtgtcgtttatcagtcccatcaggcggtcggattcctccgtgatccgctttgcatactccattaccttttgtttatcctcgaccatatcattttcgatgagctgtgcaaagccattgatggacgtaagaggcgtctttaattcatgcgatacgttggccgcaaaatcgcgccggatacgttctgacttttcaatatccgttatatcgctgatcagtacaagcatgccgcatccattgttttggtttacaaaggagctgtcggttacgatactggtataaaagcggtaagtcctgccgttcagctcgtcacgtacttcaaaatgcttgtttttcttgtgcgacatcgatttttcaagctttttgagcacatcctgcctgcggataaagtgcaggatattttcactccccacatctcccggcgcacccaatatttccttggctgcggagttgatgagcagtacgttcattttttcatcgacgatcagcagtccctcgcttaagctgtcaatgatgatcgcagttttcttattttccgcttttacccgctcgatatagcggttgagccgctcggcgagccgggtaaaagcctgtatgatatcttcaaattccggatacgcgctttgcagggcgagcttatcgcttttcccgctgacatacgcctgcaccgaattgcaaagctttccaaaaggtcttaagacgctttgcgcaaagcggcctgaaaagaccaccgcaatcataaccaatacgataaacatcaatatgataagcggcagcgtacggttgatgattgcggcaacgttggtaagcggcattgcattgcgcacgatcacgccgctttccaattgtttggccacataaatcatttcatagccctttgtgcttgaatacctgacttcatggccaaaggccccgtttagcgcctctcgcacctccggacggtcaagatggttggtataagcttcgctttcctgcggcgcatccgcaaggacgctgccgtcctgcgcgataaacgtgacgcggttattctgtccgtatgcctgctggtattgcttcgcaatctgctggtagtccggatttttgtcatcgcctatcgcaagcgcgatcgcgttcacattccctttcagcacttccgccatatcgcccgcatatgtgctccgaaagctgaatgtcgataccagcaccgttaccacaagggcgaccaccagcatacatgttgtaaataatataatttttttcttcacgttttatacctcaaaacgatatccgacgccgcgcacagtcttgatataatcgccgcggtctcccagtttcttcctcagcgtcttgatgtgcatatccacagtacgcgtctcgatatccgtttcgattccccatatcttattgagcagcatctcgcgcgtgagtaccatacctgcgttgatcataaaataccgcagcatctcaaattccttaaaggtaagttctgttttctcgccgtcaacatacaggatgtggcctgccgtatccatcataagcccgccttgcgtgatattctcgcctgccgacttcgctgcgggtttgtttgcgcggcggattacggcgttcacgcgggcgatgagctccagcacgccgaagggcttggtgatataatcgtccgcgcccaggttaagacccgataccttatccacttctgtcgtacgcgcggtaaggaaaatcgtggggacatcaaaatctttcttttcattcaatctatggaacacttcaaacccgtcgataccgggcagcataatgtcaagcagtacagcctgcggtttttcctgctgtccatagtctgccagcatatcttccccgcattcatacgcgcacacatcaaagcctgccgattgcaatgtgcaggtaatcagctcccgcagagccgcatcatcttctactacagatataaaagccataagcgattcacctcggttttattatatcacagccttacaaaatacgtttgtccttatgtacgcccgtttcggaaaacatagcccattccgcaatattttccgcatggtcgccgatccgttccagatatttcgcgatcatcaggaaatcgacgatctggtcgatcttctccttgtcctcgattgccatattgagaagctcggtttttactacgtcgtataagcgatccacctcgttatcaagctggattacctgctccgccatatccatatcgcggtgcacgtacgaatccacggccatatgtaccatttgcgccgtagtttttcccattttctggatatgctgcggacggtctatcgtcagatctttacaaatactaagcgtgatctccgaaatatccgccgcctggtcgcagatacgctcgatatccgtgatcatcttaagagcggtggaaatcatacgcaaatcctttgcaaccggctgctgcttcataatcagcttcatggaacggctttcgatctggcgcgccattgcatccacagcatcgtcatcctcaatgatttcccgcgcgccaacggtatcgcactgctcaatgacgcgcaatacctttgtaatcgtctcttcggccattgccgccatgcggatcagatcaaggttcaggttttccagttctatatcaaatttatttctcatttctttactttctcctcttttccggccgccattttcttatccaaaacgtccggtaatgtaatcctctgtccgcttatccttgggcatgctgaacaaatcctccgttttcgcatattccaccatttcacccaaaaggaaaaacgccgtgcggtcggaaatacggaccgcctgctgcatattatgcgtaacgatgacgaccgtatatttctttttcagttcgctcataaggtcctcgatcttggtcgtggagatcggatcgagcgctgaggtcggctcgtccatcaaaatcacctctggcgataccgcgatcgcacgcgcgatgcatagacgctgctgctgtccgcctgataagcccagcgcgcttttctttaaacggtcgcgcacttcttcccacagtgccgccccttttaagctgttttcgacgatcccgtcgaggtcgctgcggtttttgatcccgtggattcgcgggccataagcaatattatcataaatactcatcggaaaaggatttggcttctggaacaccatccccacctttttacgcaggatcgtcacgtctactttcgggtcataaatattttcgccgtcaagcaggacgtctcccgtgatctttaccccttcgatcaggtcgttcatgcggttcaatgtttttaaatatgtggatttcccgcatcctgacggcccgatcagggcagtgatcttcccttcttcgatatccatgtttatacttttcagggcatggttttgcccataatacaaatccaggtcctttgtttctattttaatagtcaaagcttcgtcccccgtcatttattcctgctcgaaaaccgcttgctcagataatttgtcagcaggttgatggccagcacgatcacaaccagcaccgccgcgataccaaaggccgcatcattttgccccttggccgcataggtgtaaagctgtacggtaagcgtcgcccccgactccatcatgtgcccaaagaaattgcccggcatgttggtaccgataccggatgtaaaaagcaatgccgccgattcccctacgatcctgccgatcgccagaatgatcgcagtaatgatccccggtatggcgccgggcaggatgatcgtacggatcatgtgccattttgtcgtgccgaccccaagcgccccttcgcgatattcattgggtactgtctttaatgcttcctgcgtcgtacgcacgataatcggcaaaatcatcagcaccagcgtcagcgcgcctgccagtatggaatatccgagttgcagcgtcacaccgaagaacactgcgccgaacagcccgtaaagtacggacgggatacccgccagcgtttccgttgtaaattcgataatgcgcacgatttttccgcgctttgcatattcgtttaagtagattgccgcgcctacgccaataggcgttgcgatcagcagtgtaataccgatcatgtaaagcgtattcaaaatacttggcaggatgcctaccgtcttgttcagcgcgcttggagcggtagacaggaattcccagtttacctgtggtaatccgcgtatcatgatatatgcaagcaggtaaaacagaatcactaccgtgaggatcgcgcaggcatagatcgcaaatacctgtgcgccatccttcggacggcgttttctcttcatcaggctgatgtcgtttgataatttctcgaggctacttctcattgcccgccgcctcctttttcaatatcgtattcagaaggacattgatgaccataatgaagataaacaaaaccagtccgatcgaaaacagcgcttccctgtgcaggcccgaagcataactcatttccgacacgatacccgtggtcaggaaacggacgctgttaaagagccccggcatattcaccacattgccggatacgaggatgatcgccatcgcttcgccaagcgcacggccgatccctaaaaccacgcccgtgatgatccccgacttcgccgccggaatctgcaccttgaaaatggtctgcatttttgtcgcacccgtagcaagcgacgcttccatatagtcacgcggtactgcctttagggacgtgatactgatattcacgaccgtgggcaggatcatgatcgtgagtacgatgatgcccgaaagcatgtttgcgccacctgtaaacgtatgcgtcggatcgtttgcgtataaaagcgtttccagctttgaaatttgcggaaccagcaggatcatgccgagcagcccgtacacgacggacgggatacccgccaaaagctcaatcgccggcttgacaatccccgcaagttttttatgcgccacctcggatacgaatacggccgccatcaatgcgatcggcacgccgatcaatattgtaatgcccgtacctaccagggatgttaaaatcatcggcaggataccgaattttggatccaccgccgtaggcgcccactgcgttccgaacagaaaatccttgaggccgatcgtaaacattgccggcgcgcccgaaataatcatgtatatcgtgatcaccaaaacggccactaccgcgaatgcaccgcatacgataaaaacgcctttcattgtcttttcaagggcgctttttgtttttcttccgcccatgattgtcatagtattattcatggatactccttcccctctttccataactgcctaaagaggcgccggatttgcctgcgcccctttcggaaaaaatcttagaggaaaagttatgaaatcgtgattaacttgttatccgcgacgatctgctgtccttccggtcccagtacgaaatccaggaatgcctgtacctcgcttcggagctcttctccgtcttttgtgatcatgaggaacggtcttgaaagcgggtagcttccgtccttaatcgcttcttccgttgccggagcgccgtcgacgtttaatgctgccaccgtatcatcgagagcctcgagcgatacatagccgatcgctgcaggcgtagcggacactgctgttttgaccgcaccggtttcattcaattcctgcgcatatttgcacttatccgcaacatcgagcagttcttcaaacgcaccgcgcgttcccgaggatgcctcgcggccaatgactacgatcggctgatcttcgccgcccaggtctttccagttgttgatttcgccggtatatacctttgcgaggtcttccttactgatctccgttaccttgttcgcaggattgaccacgatcgcgatcccatcgatcgccattttgttttccttaaggcccgtttcttctgatttcagttcccgtgaaacgtttccgatatcggatttgccttcctggacgtctttgacgcccacagaagacccgccaagctgtacgtccaccgttacgtcaggatattttgccataaacgcctctttcagcgcatttgcaattgtttccatggacgtggaaccggacatctgtaccttgcctgaaactgcttcatctgccgccgcggattcggaagcggacgctgcagccgattgggacggcgcctccgaagcggattcgcttgcagcctgggagggctgctgtgcggccgggttgccgctgcatcctgcaaaagcaaacactgcgatcagtacaagagctgttaccattgctaattttttcattcttgtttctccttatgttaaatttataaaagattaactttccaggtacatttgcattataaaaggccaatgtaaaatcacaacgcaggttttgtaaaatacatgtaaaagaaaaatgccgtggcttttgccacggcatttccgttattgctatgatcttatgctgtttgaataattttgttgtagctctctttcatcaggctctctatcgccgcggtccaggatgaggactgttcgcaatacctgcgcgcaacgtctttggctgttttacccgagtataatcttccgccttcggtcaggtacttcgtcccgagcaggccggccatgtattccacacaatccgccttgctgtcaaaagccatataaccgccgcgcccatttttcaagccgcctaggttgttttggcggcgggccaatgaactggaaccatttccgctttcctgtttcgtgatgctgatcaaaaacagtgcgttaacgccgtacttgctttccattgccgcgaaggtttcccccaagcccgcgagtcccgttccgctaaggacgagttcgagccggtccgcatcataggctgtcaattgtgtcaggtctgagccgtatgtatagttgtaggcgggagctgtcattgctgtggcatccgcagggatgtacctgatttcgccatcttcttccaaaatcgcgttccagtctgtgttcacgcctgtcatatagacattgaccaccgttcccgacctcagattcgataccgtttccccattctctgccggaatgtcttttacttccgtctccatgattgtcatgctttgctgcgtttcaattgtttgtccttccacatgctcttcctctgttgccgtgtctgccgcctccggcagttcttctgcataggcgggaaccgccatagccagcatcagaatcgtgatcaagaagaatgttcccaaaaggatcattccattcttcaaccattttgtggtactcaacaaatcaccagtctttctatatttaaatttctgtctgctagtcccaaaaaacaggctaacgcgtttgattttaccacaaagtgtaatatttgtaaagttttcttgatttcgctttaatattttgcctgttttttaacgcttatcccccacttcgaaccataacctttttagtcctattttatgtatccggcaggcattttgacgattttacaaaccaaaaaaggactcccccgttgggcagcccttctatgtacctggaaaatatttttattcttcttctaaagtgaccttctcgatcacgatatcggcaagcggtttatcggaaaaatccgtcttcatggacgcgatctcatccacttcctccatgccctccacgaccttgccgaacgccgcatactggccgtccaggtgcggcgcgtccgcatgcatgatgaaaaactgcgaccctgccgagttggggtccatgctgcgcgccatagagatcacgccgcgcttatgttttaaggaattttcaacgccgttcgaagcaaactcaccttcgatcgagtatcccgggccgcctgttcccgtcccgttcgggcaccctccctgtatcataaatcctttgataacccgatggaacgtaaggccgtcatagaatccctcggatacgagttttttaaaattttccactgttttcggggcagcatgctcgtcgagtttgattttaatcgtcccgccgcctttgattttcataagaaccatttgttctatgcctcccggtttccagatgcatattgcagcatctgatttatgcccttcattataaggcattctatgacatttgtaaaccgtgcgcccctaattttaaacatttgtttaccaaaccacgcgcccaagcatggagttgagaaacgcgatggccacgccaaaattcgttatcggaacccctgccttccgcgcttttttgatcttggaaagcatattcttacgattgaccatgcagccgccgcagtggatgatcaatttgtattttttaaggtcgtccggaaatccgtgccccgccgtattttcaaagaccagctccccgcctgcgtaatcattcagccaattcggcagtttttcccgcgcgatatcgcctttttgcgcgtggtgcgtacacgactccgcgatcagcacatggtcgcccggccttaagccggcgatcgccctcgcaccttccacaaagacgtggatatctcccttatattttgccatcagcatcgaaaaagacgtaagcgggatatcctttggcaggtgttcgtttacatatttaaacacctgtgaatccgtaatcaccagtttgggcgcgtgctttaactccgcaagcataggcgtaaggtcttccgtctttatggataccaccctgcatccgttgtcaagcaaatcccgtgtcacctgtacctgcggtaaaataagccttccctttggcgcctggatatcctgcggcatgacaagcaggacaacatctcccgcatgcaccatgtcaccggtgatcgtaggctgttcatacgcttccacgttatcaatgatcagctgctttaaagcgccgatcccctctcccgttttcgcgttgaccacaaccgccttttcaccgacgggagcggccgcctgcgcttcctgtccttcaaatatattgtatgcggtaagaataggggtgcctttttccctgagccgttccatatatcccttttccagtgacaagtcaagatcacccacgcggatcacaaaaaccgcaatatccgttttatcgatcacttcatccgtttttttgatgcgcgcctgcgcaagggcagtcgtatcgtcaaggcccgccgtatcaatgaatacgaccggaccgacgggcaaaagttccatcgctttataaacgggatcggttgtcgttcccgcgacgtccgacacaagcgcgatatcctgccctgtgatcgcgttgatgacgcttgatttccccgcgtttgttttaccaaaaaacgcgatatgcagcctgttggcgcgcggcgtttcatttagtttcgacatagttatactcctgtattttacatagttcctccgccatcccttgcccgtctacttgctcaaacacccaactgcgctatgcgccgttaaactcgcatacgccgggcaaggcactgccggacgcgcatccagcttccaatccctcaaaaccggaaatccctctcgcccgcctcgatcttggcgatatattcacgcgctttttcgcgtaccgtatcatttggtatctgctttagctgccgctcgatcagctcgttcgccatctgcttgaattcgtcgtcgccgtagtctgtcgcatactccttgagcgtgatgagcgcgttcggctggcaaatattgccgatctgccccgtcttggcaaggcgcataaaccggtcgcccgtcctgccctggcggtagcacgccgtgcaaaaacttgggatatatccgtcgcggatcagctcttttgtcatctctatggggctgcggtgatcctcgatctcgaattgtggctgctgcgtacccatcgtgtagccgcccacgcccgtcgcgctgcctgcgcttacctgcgaaatccccagcttgatgacgctgtcgcggaacgccccgccttcacgcgtggaaaggatcatgcccgtatatggtacggtcatgcgcaggatcgccacgatctttttaaagtcgtcgtcgctgaccgcgtgttcataatcggttttcttcacatcgcccgcgtcgcggatccgcagcatggaaagcgtatgcggccctacgccaaataccgcttccagatgctctgcatgcatgatctgcccgacaaggtcaaagtgccaatcgtaaagtccgtaaagcacgcccagccccacgtcgtcgatccccgcctccatcgcgcggtcgtgcgcggtcgtatggtattcgtagttgctcttgggtcccttcggatgctggtattcgtacgtcggcttatggtacgtctcctggaagaggatatacgtgccgattcccgcatccttcaattttttataattttccactgttgtcgccgcgatattgacgttcacacgccggatcgcgccgttatcgaaatggatggaatagatcgtcttgatactctcaagcaggtattccatcgtattgttgaccggatcctcgcctgtttcaagcgcaagacgtttatgccccattttttccagcgcctttacctcctgcacgatctcctcctgcgtcagctttttccgctccatgcacgacgaatggtgatagccgcagtagcggcattcgttcacgcaataatcggacaggtaaagcggcgcgaacatcacgatgcggtttccgtaaatatgctttttgatctccatcgccaccgcgaacatgtcgccgatcagttccccgtccgtgacaaagctgagcaccgacgcctcctcgtgcgaaagccccttaaattcacgcgcctttgcaatgatccgttttacttcctgtttgtcctgcgctttttcccgcgccgctaaaagcgtgcgctcgatctcctgttgatccataaattctgccgccgtcataccttttacatcataagccattttttactccccctagtctgcttgcagcccaagctctgataatttttgttccaattccctaaactgctgcttaagcggaacgtcttgcgcgtccctgcccggatagatatcgtaaagtttcctgtattcataaggcgtcgccttctgcatgatcacgtccgccccgcaaaggagcgcgcctgccatcccgcctttcacattcagcgcggtcgtagacggcaggtggcatcttggcagcaaaagccgcgcaagagcgagcaccttcagcgtcttatgcgcatcgccgtcccccgctttcccgaccgcggtgtccggatgagcgatgaacgggccgatccccgccatctccacgccttcgcgccgcagcgtaagcagatcctccgccaaaatcccgtccgtttgcccgggaagcccaaccatgaacccgccgcccagctcgaaccccagcgctttgatcctgcgctgcgcttgcaggcggttttcaagcggcacgccatgcaaggaccggtaaagcgccacgtccgccgtctcgtgtttcaataaaaagcggtctgcccctgcgtcgcgcatccgtttgtattcatcaagacttcgctcgccgatggaaagcgttaccgcgcagtttgcgcgctgtttgatacgccgcacaatatccgcaagcatctccgccgtataatacatatcctcgccgctttgcaggatgaccgtacggtatacatccgccgcagcaaccgccgcttccaccagttcgtccggcagcatacggtagcgcaccgccccgtccatctgcgcgttgatgccgcagtatgcgcacgaacaccggcaataattggaaaactcgatgatcccccgcacaaacacatggtttccgtattcttccgttttcacttgatttgccgccgcaaataacgcatcgtctgccgcgtcatcttgcaatatccctgcgatcacatgcgcctgcggatgcttggtatccagaatatgttttccaaattcgtattttgccatattttctccccaaatcaaaaatgctgtccctttgaacacaaaagaacagcacaaaaccatcgtttcgtaaagccgtccttccgttcagaatcgttccttgcggtcagaagtctcttacattattatatagtatagatacccgtttcaggtaccggtaatccggaatttatctggatagtccggcaatcgcacagcccttcagcaccgcgaggtcgaccgagatcacatccgcttcgatcccccgcttcgagaggaacggcagcaggttcgtcagcgcctcatgctttaagccaaacatcttgtcatacgtcgttccttcgatcgtcatacatacgcggttgttgcttttacacgttttcacagccattgccgccatctgcagcgcgagcagcctgcccgccctcttggtcaggttcagcaatatttcatatgccgcttccgcatctttttcatccgtaaaataatccgcgaccacgccttttcggtcagtcaaaaattcgttcacctgcatcgtattgagctgtccgtcaaaggtttttgtaaacacgccctccgcgctggctgagcgcaaagtaaacccgcacaggttgcccagatatccgccgctcgtcattttctcgaacacgcctacgcccgggttttgcaggctgttgtcaaaggcgatatcaatgtcgctgcgcggggctttattgtagctgcccgcttctgcattgactaccgtcacgccatccgcgtcgtatccgttcatttttttgatgttgccgatggattccatatagcagctattgctgcccgtaccaaggatcgttcccgtgaaagagccgtatccctccactaatttttccgctttccccgcaagcgccgtggcaacggaatcgtttaatacgatcacgctgcaatcccgcgcgcccagagcggcaagactggcgcaaatctcctgtccgagcagctttcctcccgcacccttcactttgacttcctttgtgatatcgacgatctcggcatcgatattaggcagcgtcttcgcgcggtaagcaaacgagatcacaatatcttttgtgacgcttgtaagcgggaagatcagctccgcaagcctatcaaaaaactcctgcgcttccagttcgcgctctgcgcctggaattttataacgaaagatttcctcggtgaaaaaactgccgtcctctaagaatttcgctaccgcgatacgcaggttcgtccctcccgcatccacgcacaataccggtttttcgcgccgcacattgtctcttagcgcaagataggaaggcagcatcaggagcgagcttggctcgccgcacagcccttttttcatttcgtcgatgtactggtcgatttcctcttccaaaacgaccgtttcataattcagccggtgtttctctaaaaatgcctttgcttccaaaaccatactcccttttttaaattatcctgctttatattatactgaatattatactgaaaaaccagcagtttgcaacgacgctttgttcccattccactttttcccggcacgccttgagcctttttcttttttctgctataatatttaaggtttattccaaaaaagcgtatttttgtatgatacgtaaaaaaggtgggaaattttatgtccagattagtaggaaccatttcacggggtatccgtaccccgatcatccgtcagggcgacgaccttgcgcagatggtcgccgattccgtgatcgaagcggcgaacgcttttgacggtggttttgcaattcatgaccgtgacgttatcgcggtaacggaagccgtcgtagcgcgcgcgcagggtaattatgcgtccgttgacgatatcgctgccgatgtccatgaaaaattcggcgacgagccggtaggccttattttcccgatcaccagccgtaaccgttttgcgatctgcctgcgcgggattgcgcgcggcgcaaagaagatcgtgatgatgctctcttatccgtccgacgaagtgggcaatcatcttatttcgctggatcagctcgatgaaaaaggcgtgaacccgtggaccgatatcttagaccttaaaaaataccgcgaattgttcggcgtaaacctgcaccccttcacgggtatggattatgtggaatattacgcgtccgtgatcaacgaagaaggcgcggaggtggaattcgtatttgcaaacaacccgaccgtcatcttgaattatacgaaaaacgtcttgtgctgcgatatccatacgcgcgagcgcagcaaacgcaaactgcttgacgcaggcgcagggaaagtgtatacgctttgcgatatcttgaataagccggtaaacggaagcggattcaatccggattacggccttttgggttccaataaatccacggaaacgaccgtaaagctgtttccgcgcgactgtgaccgattcgtttcggatgtgcagcagaagatgaaagacgcaaccggcaaaaccgtggaagtcatggtttacggcgacggcgcattcaaagaccctgtcggaaaaatctgggagcttgccgatccggtcgtatcccccggttatacttccggtctcgagggcgttcccaacgaactgaagctgaaatatctggcggacaatgattttgcggggcttaccggcgaagatctgcaaaaagcgatcaccgcgcatatccagaaaaaggatcgggaccttaaaggatccatggcttcgcagggcacgacgccccgccgtcttacggacctgatcggttcgctgtgcgaccttacatccggcagcggggataaagggactcctgttgtattcgtacaaggttatttcgataattactccgacgagatataaagcgcacatccaaaacgcggccttcgtcatgcgggccgcgttttttgtttgccgcgtttgctcaatccgcgacaagccatttgccccccgataaatatttctttctttgctctacccctttactaatttagcacaatgaattataataccattattgtgaaaaaatttataatcaggagaaaaatgttatgaaaaaaatacttcttttgactcttgtctctatccttgcggtagcctgctttattggctgtgcgcctgcaacacaggagcccagcacatccgcttctgccgataccggcgcttctgcttccgcagacggcagcgccgccgaagcagataattcccttcagaatatccttgataaaggcgaattcgttatgggcatggatgaaagtttcccgccgatgggcttccgcgacgagaacggtaatatcaccggttttgacgttgaaatggcgcaggccgttgcagaccacatgggtatcgaggtcaaattccagccaatcaactggagttccaatgtgttggagctgaacgcaggaaacgttgacctcctgtggaatggttttacgatcacggacgagcgtaaggaaaagctcctgatgagcgatccttatatggaaaatacgcaggttgtcgttgtccctgccgattcccctatcaaaaagctgacagaccttgcgggcaagaagctcgcggtgcaggacggttcttccgcacagatcgcaattgccgaaaacgaagagcttgcaaattctattggcgaacaagtagatttcaaggataatgtaacagcacttttggacgtttctgccggtacggtagatgcgcttgcggtcgattccgtcgttgcaaattactacacttccaaaacgcccggcgaatatgttatactggaagaaacacttgcgccggaagaatacggcatcggcttcagaaaaggcgaagaatctttcatgaacgctgttatggatgctctgaaagaaatgaaggaagacggtacggctgcccagatcagtgaaaaatggttcggcaaggacgttactaccttctaagcggaccggctttttcaaaaacgggcagtgttttccgatgctgccctatttttttatttaggagtcattatctatggaaaaagtgttaagtttgtctgccgagcttgcacagggcctcggtattacgcttgccctgtttgccctgacgctcgtaatcgctatcccgcttgggttcttagggtctcaggtcagcctgtatgccaaaaacaaattcggccgcggcatttacaacgtttatttgattatcatgcgcggtacaccgctcatattgcaggtcgtctttttgttctttggtattaatttgctgcttcttcccgcattgggagtgcccgcaagcgtattccgtttgggacgttttgaatctgctttgatctcctttgtgctcaactataccgcttactttagtgaaattttccgtggcggcgtccagtcgctcaaccgcgggcaatatgaagcggcgtctgtactcgggctttccaagggcgttaccatgcgcaagatcgtggtgccgcaggtgttcaaaatcgtcatgccctcgcttggcaacgaagtgatcaccctcgtgaaagatacggcgcttgtcaacattatcgcgttaagcgatctattgcagatcgcctattcggcctccacgcgtgaagtctccattcttccgcttttagtggccgcgatcttctacctgatcataaacgccgtcgtttccctggtactcaaaaagatcgaaaaccgtatggactattacaggatataaggtgaatgcaatgggtatattggaagtcaaaaatttatataaaagcttcggcaaaaccgaggtgctgaaaaatatcgacctgtcgctggaaaagggtgaaacgctcgcgatcatcgggccgtccggctcaggcaaaagcacgctgctccggtgtatcaattgcctggagcgcgccgaaaaaggcacgatcattcttgatggcatcacgattgccaaggaaacggacggtaaaacgcagtatttgaaagatgaggagcttacgcgggcgcgtttgcaccttgggatggtgttccagaatttcaacctgtttccgcaccttaacgtattgcaaaacctgacgctcgcccctatgagcgtggataagaaatctaaggaagaagcagaaaccaaggcatttgaattgcttggtaaggtcggccttttagaccgcgcagaggcttatccctgcgagctttcgggcggacaaagccagcgtgtcgcaatcgcgcgtgcgcttgccatggaccccgatatcctttgcttcgacgagccgacctccgcgctcgatccggaactcacgggcgaggttttgcaggtcatcaaagagcttgcggcagagcatatgaccatgctcatcgtcacgcatgagatggggtttgccaaggaagttgcaagcaatgtcatattcatggacgacggtcgggttctggaacgcggtactcctcaggaattgcttgtcaatccaaaagaagaacgcattagggcgttcctcaataaattattaagtgtgtgaggtgtcgatatgaaggtgttgaattttggttctttgaacgtagactacgtatatgacgttccccattttgtcatgcccggtgaaaccctcacctcctttgcgcgcaatatttttgcaggcggtaaaggccttaaccagtccattgccaccaaaaaagccggcgcggacgtttaccatgcgggcagcgtgggctatgacggcgatattttattggaggcgctcagggaagcgcacgtaaacagcgattttgtcttgaagcgcgaggacgcgccatccggccatacggtcatccaggttgattcaaacggacagaattgcatcatcgtattcggcggcaccaaccgccagattcccgaagagcaaatggacgacacgctttcccactttgatgccggcgatttcctgcttctgcaaaacgagctgaacgacatcggttatctcatcgataaagcatatgaaaaaggcatgaatatcgttctcaatccctctcctatcgatgcagccatcaatacccttcccttggagaaggtgaagtattttatcgtcaacgagattgaaggtgcgcaaatcgcagggacggatgtgatcgacgatatcattccaatgattgcaaaaaaatatccaaatgcgaatatcctgatgacgcttggctcggaaggctcgcggtattacgacggcaacaagacatatacgcagggtatcttccctgtcaaagtggtagatacaaccgccgcgggagacacgttcctcggatactttgtctatggtgtttcaagcggtcttccaatcgaagatacgcttcgcctggcggcgcgcgcttcttccatcaccgtcgcgggaaaaggcgcggcgggctccattcccacgctcgatatggttcttgcacaggaaaaataataatcacacattgcataaaagacggattttttatccgtcttttgttttattttcttttttgaagtgttaagatattactagcaaaatgaatggctgaaacgctcggaggacaatacatgattacaaagctggagcaagaatatacaatacgcgcgcttgacgtggatttgaaaggcgtatggcggccgtccgccatcctgacgcgtatgcaggaaatcgccgaggaccacgcaattgccgtgggtgcgggacgcgccgatctcgtggacgaaaaagggcttgcatggatgctcacgcgcctgcacctgaaaatgacaaaataccccgccctgacggagcatatcaaggtcgtgacatggccggccaaaccgaccaagctgttttttatccgccacacgatgttttttagtgaagacggggaggaattggggcgcgccacttccctgtgggtgctctttaatatccgcgaacggtatttatgccgcacgggggagatcggcgaaaactatccttacgacctcgcacacggcgttgcccttccagagccaaccaagatcaagatgcctaacgatatgcagcatatgtgcagccgcacagttttatatagcgatacggatatgaacgggcatatgaacaatgccaaatatgcggattgggtatgcgagctttttgcccccgatacgctgaaaaacgaccagatgtccgacctgcgcattaactacatcgctgaaacgtatatggacgataccgtcgatatatactgcaagcaggtcgaaaacaccttttttgtgtgcggcaaacgcaatggcgatactgtttttgacgcggcaatcgagtggaaaagcaatattggagggatcagaaaatgacaaaacgcattggtatcctgacaagcggcggcgactgcccgggcctgaacgcagcgatccgcggcgtggcaaaggccgcttacgagcgcatggaaaatgtcgagatcatcggcgtgatggatggtttttccggcctgatcaatggtcaataccgcctgatgaagcaagaggaattttccggtattttaacgctgggcggcaccatcctcggcacgatacgcacgccttttaaggatatgcgcaagatcggcgatgacaatgtggacaaggttgctaacatggtccgcaattatgagacgatgaagcttgactgcctatgcaccttgggcggtaacggtacacacaaaacggcaaacctgctctcagaggagggccttaatatcgtcggactccccaaaacgatcgacaatgacatctggggtacggatgtgacctttggattccatacggctgtgggcatcgcaacagacgtgatcgaccgtatccacacaactgcagccagccatggccgcgttatgatcgtagaggtcatgggcaacaaagccggatggcttaccctgtatgccgggatcgccggcggcgcagatgtggttttgattcctgagatgccatacgaccgcggggcggtcatcgaggcagtaacccggcgcgcagaacgtggaaaagcgttttccatcatcgcccttgccgaaggcgcggtcaggaatgacgaatccagtatgaaacgtaaagatatcgtcaaaaaacttgccgaggaaggctaccgtagcgtttcagaccgtttggcccatgcaatcgaatccacaaccggtgcggaaacacgcgtggttgtccccggccatatccagcgcggcggcagcccaagcgcttatgaccgcatcctcgccacgcagttcggcgtacaggcggccgagcttatttatcaaaaaaaattcggctatacggtcgcgatgcaaaaaaacaagctgacccagaatccgttaaaagacgttgccggcaaaaccaagctcgtctcccctgcggatgatatggtgcggatcgcacgcaacatgggtctgtgctttggcgactgaccatcgttgataaaaaaaccttccgcatgatgacgcggaaggcttttttattcattgcttaaccctaaaccagcagcgcgccgtaagcggccgcttcctgatccgtcacgcctgcacgccccgcgtaacagcgcaggaatgctcttaccagttccgtgttttgcgccttcacaatcaccggcttttttacaaacatcgaaagcgtggacacaaaactccacatatcgaaatcaaggtccatattacgaaaatccaccgcgaccacgtctgcttctgtctcccctgcgggtaccgcatccatcaggcagtaatagtccccgccatgtatgcccgatacaacagcatccgtacatacatccatctcgcatacttttgcgcttccatcccatatcacactcatataggcggatgccagcctttgctttttttcctcctgcacagccggaatagccgcaccgtcgatcgcttccctgagcgcggcgatatgcttttcgctgcttccgcagcagccgcccaaaagccttaccccgcaatcgatgaacccctgcgccatgcgcgcgaaatcctgcggcttttgcctgaataccgcaacgcccgactccatctccggcaatccggcattcggtttggcgcacaacatcggcgcgacctgtcccatcatttctacagggtcaaggaggctttccggaccacccgaacaattcgccccgacaagagtcgcccccattgcgctcaaaaccgctgcgcagacatccggggtgttccctgacatcgtatagccgttttcatatgtcatgttcgtgatgatctcaaggccgcccagttcttgcgccgctacgacacccgcacgcatttcgtttaagtccgtaaacgtttcaaaattaacaatcttgactcccgcatctttcatcggctttagctgctgcttgaaatactccacggctgtctcaaatttcatatcacccgccggctcaaaaaacagtccggtcggacccagcgacgcagccaccataacctccctgcctccggcgcaggagagcgccagctttacgccttcataattgatctcataaagcttttcactgaggccgtgcgccgcaagctgcggtacattcccgcaaaatgtgttagtctgaatcacgtcagatcccgcatcgatataactcatatatacgtcccgcacctcgtccggtttggtaaggttccattcctccgaactctctccgccctcaagtcccctttgctgcagcatcacgcctttggaaccatcgtacagtaaaacatcttttttacatttttcagccagctttcccatgtttatctccttatgtcttgcttagtctcattcacaaatttattatagcttaaatctttttccaatgctacgataatcctgaataaatagtgcgtaggctgtgtataattaactatcataaaatatcacaaggaggggttccccatgaccagtctttctatcgatcgcgaccgcaagctgctccattttgagatcatcggcgcgatcatcgtatgcattttagctcctgtcttccatttcctgttcgaatggtcgggcgataaccatttcgtcggattatttgcggcagtcaacgaaagcgtctgggagcatacgaaaatcgtttattttccgttcttattttataccattgccgaatattttatcctaaaaccggacttccgccgtttttttgcggcaaaaacaatttccatgtcgttgatccttcttttgatgatcacgtttttctatacatattccggcatgttcggcatcgaatcccttgcggtagatattgtctttacctttgtactgacgatccttgctttttatatctcctaccgtctgtaccgctcaggacgtaactttgaccggtgctttttcctgatcatcgctttatttgcagcagtactcattatggagctggtattcaccgccctgccgccgcgcatcccgctgttccaagattccgtgacgtcgggcttcggttttcccagtttataaaattccgataaatttagaaaatattggaatattttgtcttgcttgtgcatatagacatataagaggtttttttatgtgtacctctgaatgtctataccgaaaagcaaaaaaccggctttcttcttccaaagacgccggttttttgctttatagcttgttcttatgttttatgccttccacaaaccgtgcaggttgcagtaagcaaatacttcgatttcgtcactgtccacgacgaactctgcacgcggcgcttcacccggctcaagcacatgcctctgcatgagcttgggcgtttcaaccgcgatccattcgatatagtgctcttccgtcatcggatgctctacgctgccaatctggacctttaatttatttccgtccttctcatagacaggaacgtgcttttcctgcgccgcatccacagtatttggaaccagttttaccatcggtttaccgcagcaaacaagctggccgccgccgtctttgatcagtccgacaatattgccgcataactcacacctgtaaaaattcgctttttctttcataatactcacctctcataatattggaatagtagaaaaccaagaatccaatgttctaacttacgctattattaaacgccgctaaagggcattaaacgctatttcttatttctcctggaaaaataggagcggtaatgcagcagttgttttccagggaacaggtattcataaaggtccaaaaaataatcgtccgtcatgctcgcgatataatccacaacaatctggtttggctcttctttcaggtattgttcctttaaacccgccgcgcgagcaaagccgctgaacacatggttgatatgatggcggaatatcggtgaatccccgtcgcctttgataaagtcctccagcagtttttcatacgcctgttcaaacatgctgcgtatggtcggatacggctcgtttctatcctgcggctcgtaaatacgcttgaaattcacctgcttttcatacgcgagggcctccgcatattcctcgtcaagcttgatatatggcttttgatagctgtttgaaacgacgttcgtaatgatattgttgataaaatccgaatttgtggagccaagcacatcgttttcagaaaacggttcgtgtgtgccgatctttaaaatttgcgcgtcctgcctgtcttttccaagatatgcgatcacgtctgccagccgcaccacacagccctccaacgttgccggcacaagggcgcccgtagccgcttcctgcgtataacactgctccatctggcggtcaaattccaagaacatcccttctttatccgcagattcgtaggggcgcggacggtattccccgctcaccttttccccgttgtggcacaggataccgtttaatacctgcaggcttaaattaagcgagagcactttatctaagatacgcgcgctgtgtacgttatggttaaagtacctccccgtattttcatggtatattttcgacaggaaccgctcgcccgcatgtccgaacggcgtatggccgaggtcgtgcccgagcgcaatcgcctcgattaggtcaaggtttaaattaagcatgcgtccaatattgcgcgcgattcgcgaaacaagctggacatgcaggatacgccgggtgatatcatcgtttttgtataaggaaaacacctgcgttttatccgcatagcggttaaagaaacggcaataaaggatacgctcacagtcctttgcaaaattcggcctctggatacggaatttctccgtttcccgccgcgcagagctttggtcccgcgtcgcatatttatacatctcgtcctgctttttcttaaggtccgcaaaaatagctttttccacttcaggatcaagatcaagatactttttttcacggtcgtttctcatcatcctgccgtccttttcgtttttattatagcatagatcccttttgctgtcagtgatttcctttgttttcgtttggcgcatatgcagtatgtgtatcaatatatcataatactatattgatggaggatatgatctctcatgaaaaaaaacactttaggaacattggctcttgtctttggttccctgtttattttagcagcatgcgctgccgctcccccgtccgtttccgagacggaaggcgacgagttgatgctcgcggcaaagggcgagatcaccaatattgaaacgaatggtgataccacaagtatcacggtagacggcagcaatataaaatccaacgcggcctaccggctcctcatcgcgcaccttcaaaatgaaacgcctgttatcgaggacggtaacgcctcagcctacacggatggccttctccatgtcggggaccaggtggcggtatatcttaccccgaacgcccccgtgacagcttccgagccgccgcaggcaacgccggaaaaaattgtcataacagagcgcgcatcggaaggtacatcaggcgtgggaagcgccgttccgtccgatgtcaaaacggaatatgaaggcagcatcacggagatcacgcaggacggcgaatattacctcgtatatgtccagaaagaagaaaacggcgaacctacgggcgatttacgcgcagtcgtttcgggcgataccgagatcgtttccgaaaaaagggaagcaagcggcttgaagcctgaggaattaaaggtcggcgataaggtcacagtcacgacgaacggcaccgcgaccttctcaatcccgccgcaggcctccgcgcagaagatcttgattcatgatgcggaagggaaataagcttttttatatccgcaatccgaattttgttttgatgcgattgagcttcttgccccacggcacaaggatcaataccaaaaaagccactgtggaaacgcaatgcgacaggttaaacggaacccctgccaggtaagcggccagcgccccttgccatgtgataggtgaaacaaagccgacgatataccacgaatccatgataaaaccgaacagaaatgctgaaactgcgccataaacataaaccgcaatccccttgcggaagcagccgtgttcctgcaaaagtcccgcaaaaaatcctaccatgccccatgcgtacatttgccatggcgtccacgctccctgcccaaaaaacaaattggacgcaagcgcgctgagcgcgcccacaaggaagccgctttgcctgccaaagtatatcgccgctacgatcacaatggcggaaacaggagtaaagttcggaaagggcgcaaagacgatacgcccaacgacagcgaccgccgccaataccgcaatgggcatcatatccctgggacgtggttttttcatctcaaagcgcaggaaaaacggaagcaaggcgcatatggcaaccataatactaagcagcgccgcgttttccacctcaaacagggcgcacaaaaacagtactgtgggtacggcggtaagcgataccggctgcagccatttaagcgctttatacataccgaaacacgtccttcaaggttacgcagtccggaagtatcccccgcgtcatgcggtttacagaggtcgtataaaaattatttcccaggaaaaacgccctgccttcgtccgaacataccacatcgccgccaaacatcatggagcaccggtccgcatgtaccgccgcaaattccaggtcgtgtgttacaagtacgatcgcaaccccttctttagctaatcgtttccaaatacgacccagttcattcttcgcaaaagcatcaatacccttgaccggttcatccaaaaacagcacattcggctttaaaagcagcagcttcgcgatcgccgctttctgcatctccccgccgctcaggtcataaggatgtttttccaggagctgcgacaggccgaatgcctgcgccatatttgtcacatcctgctctgtatatccaaacccctccgcgttctccatgagatcggcccgcagcgtatcgcatacaaacattgtttttggattttgcatcaagactgccgcgcgcgtatcatctgccggacgcaccttccctcttgctggtttgaataatccggccagcacgcccagcagcgtgcttttgccgcttccattaccgcctaagatgcagtgtatttcgctctttctgatctcgatcccaagccccttcaatacaaaatcatcctgcctgccatagcgaaaccaaatatccttcgcgctgaccgccactcttttggatgacttttccatctgccgcggagccgtatcgtgaatcttgtcatggaacgtgcttagaaatatccgaccttcttttacactgagcgggatgtcgctcgtcttgcccatgcctgccgcaagccgtgcagccgcaggcagcgccggaataaacgtttcttctttcctgcatatgcaccattcggaaaacgctccggggcttccaaaaaatttcttttccgcttcctctaaataaagcacgctgtctgctatgggaagcacgtcttccagcctgtgctcggataaaacaaccgtttttccaagctccccgttgatacgcttaagcgtctgcaaaaattcttttgccgcgattggatccaactgtgcggtcggttcgtcaagtatgatcacctccggctgcattgccataactgaggccagattgagtatctgtttttgtccgccggaaagttcgttcacattcttttcaaaccaagggcctatgccgaaaaagtgagccgtttccgcaacccgccttcgtatcacccctgtcggcagtcccagattttccagcccgaacgcaagctcgtgccataccgtatccgttacgatctggttttccgggtcctgcatcacgaagccgaccatcgcggccgactctgttacagacaggcggctcgcctcacgcccgtcaaagaaaacatgtcccgtttgctttccgtgcggcgcgatctcttttttcaagcaacgcaaaagcgtcgtttttccacagcccgaacgtccgcacaccagcaggaacgcgccttttcttatagaaaagccaatgttcttaagggcatattccaccccttccggatacaggaacgaaagaccgtctactgtaattttttccatacgagttgttcccttccttccaggatcaacggataaaaaagcaggatacaatacgggatatatgcccatacatttgtttcaagcccctttaagtacgggtaatacatgaatttcccgccaaaaaatatgatacaggcaatgctgagcacagccagtatacatattatgacaagggaaaccacatcatgccggcccattttaaaaattgaaaacgttgtacgcttctttgcgccatacccgcgcgcgcgcatggaatccgccgtctcgatactttcctccatgctccaccctaccagcacggacgcactgcgcacgccatttttgaaatgctgctttttcctttcccgccgcaagtccatcccatcctgcgcatccataatgcagcgcgccttatatgtggtttgcgggatcagttttaaggtcatggataccattaaagctgtcgtgggaagtaattttccaaacagatacaggaatttgtcgttcgtcatcaacgccgcatagcatgaaaaccatataaatacgttaagcagcataaggcccgcgcatagcccgtagagaaacgcttccagcgtaacaggttcgtcaaacaggtaaaacaggacggtaagcccgcgatggttaaagagcggattcaatacagcaatgattatgaacattacaagcaggaatttaagcgaggaaaagtatttacgcgccccgcttaagtagactgcgtaaatacttcccgctatgaacgaaatcaaaagataggccggctgcagcgtgagcatcgtacacacaagcgcggccgccagatataaaaaaatcacactcggatggtagatcgtaaagatatgccgcatggttacgccccaatatccgctcccatatcacaggtgtaacgccacttgatattatctccgtccgcaagcgtatatttggtacagccaacgcccggatattccccgttcacactgtacatccatccgctctgtggcccgcaatctccctcgcccaaggaattgatggacgaaatataactttttccgctaaacgttatccctgttgctttgagcgcgtcgtacacgctcgccccctggtcaagcgtcacctttttgcttcccaggatcgttccgcctgaagaaaccgcattcgcgaggtccgcatcagcattgagcgccgtttggcagtcgatagaaatcgtgcaggtgatcgtattcgcctgttcctgtaccggttccggtgtcttttggggggcgggcgtgtttgccgccccgttccccgcgccatttaccggcgcatcagcgctgtccccgtccgccgcttttttatccttgtcccccacagaagcgcttgccgtcggatcaaggcttgcctgcgtaccggcaccgcttgttggtgccgccgatacggatggcgatggatcggcaggcgcgcttgccgttgcagaaacagacggtgccgccgaaacagccgccgcttccggcgttgcgctggtgtcaggctgtccagccggcgcgcagcctgccagtattcctatacacagcaggccggccagcaatatactccatatctttttcatcatatctttttccttttaccgctccctgcgccgcctgcggctccatactgccgttacagatgcagccgcaaccgcaatgacaagcaagatgacataaccgctcatatcctgtgtatctcctgtcttgggcgcggttgttttcgaggttgtttctgccgtttcagctacgccgccatcggccttctcagctaaagcgtataaactgaaatggtcggtctcaaagtaagccatattgccttccaccgtgacctggtattctacgcgcgtgccgtccgcattgatgcggtatacaatgagttttgtcttgtcaaatccttccggaatcgggataccgatgcgcaccttcccgttcggctggaccaggttgccgttaacatccgacagcttgatttcgtacaatacgaatttcgccgcgtcttttccgagcgatttttgtgccaactggaagcctgcgccggattcgaccttttccgtctttatcgttgttcctttcggtactgtcgtcgtatccgtatcaatcgtgatccccgtacttttatccgtatccgtgaccggtttcatccatccttccaaagtaccggaaacactgtagacgttataccccgaggctgtgagcctgctgtaagcgaccagcgcgcggaagccctgctctgtcgcaagtgcgttcgcctccctgttgtccgtataaccaaacctgttatcctgcgtcacgaagctcagcagattttggtatacgctgttcccgttcttcacaaaccttgcgtcgctgtccgcgtcgataccgagcgaagtaagcgcgatcactaccattgccgcgtcgttgctgttttccgagccataatatacgaatccaccgttatcagactgcatagaagacaggcaaccgagtgcatcgtcgatagcggacgatacctccgctttgtctttgtaaggcgcgagcgccgatatgacgagagccgtcatactcgcttcggaatcacctggcatatatgaccatcccccgtctgcgtttttatgcgaaagcagatattccaccgctttttcacgcgtattcgccgcgccggacgcaagcgtatagttgcctgaatcgtatgcaagcaatgcgaacgcctgtgcattgacactgtccatacgcgaagaaggcaatccagcgataatatccacatattgctgcgcatccataccgagcgccgtcatcatcatgactactcgttcataatccgtcgcattgtttgcgcggatgtgcgcgatcgattccttgataaagtttactttagcggcctctgaaccgaacaccttgtccatacccgcatagaccgccatatcaaatgctatccagtccgatgcggaatcctcgtaagacggatttgcatagcttccggcaaccgccgacatcacgtcattcgcggatgcattgctgcgtgcgccctgtaattcaacagtaacgggctgcgcgaccgtctccccgccctgcgtaaagagcagcatgacctgctcttccactgcgccaaacgcggtgtttttccttacaagcttgtatcttccaaggggttcctccgcactggtcacataattattttcccccgcctcgcggtacatgacttcaatatttccgtccggcgtcgcgccatccttcagctttgcgacgagcggggtaatatccgtgttttcttccactgtattggggatcgttacatggctttcgtacttcgccgcttcctgctttaaagccgttttgtcggcttcctcttttgcttgcgctgccagcagctcttcaagcttagccgccgcctgatccttggtcaacgctatttttgcagcggcggcatccgttgcttcgtgcgtgccgccaatgtagtttccaatccccttggcttttgttccgaggcttgtttcgctgttcccgtaacagtctttcaaagtcaggaggttgtcgttatacgaccagatcgtaccttcaaaactacctgcaaacccgccgttatagctccaaccgggcgtcaatgtacctgtgcttacgcactctttgaccgtacccgaagcagacccaacgaacccgccgaaatagtatccgtagccatcctctatcgcaacgacgttgcctgtcgcatagcaacgttctgccgacgtccccatgcctatgctgcctgcgaagccgcctgtcgtataaccgcccaccacgttacccgtggcatggcttttataaatactggcgtcaccaaagttgcttcccacaaaaccgcccgtagagttgccgccgaaaacattgcccgttgcttcgcattgcgtgatatagcctttgttccagcccacaaagccgccgacgtgtcctgattccgtcgtatctgcgccgcccgtcgccgccgtaacctcgacgctcgccgaacagttgtcaatcgcgctgtacgccgatttcccgtccttctgtccgccgtcattcagcccgacaagtccacctgcatccgtctgcttgatatataccgtcccaagcgcatccagcctgccggatacggaacagttcccgatcaggttcgccgtgccgttttctacatttgcgcgcgctgtaccgaccagtatgccgatccggctgccgcctgttacgttcgcgttttccacctttaaattgagcaaagacgcgtcctcgattacgccgaacaatccgacattctcacttcccgtccctttttcgatcctgaggctctctattttatatccattgccgtcgaaaatcccgctgaaaggaaccgaagcgtttccgatcggctctgccgttacgcctgcaagatcgatgtttgctgtcagcttataattcttcgcccagtcgaccgcttggttcgtactttccataagtgcaaccaactgttctttggtcgtaatcgtttcatattgtaccggagcaggtgctgtcatttccgcccacgccggcgcctggtagcggttcgccgccgtaccctcgtaccagaggatcttatcccctgccttgacctgcgcggaggatatccctacggcagacggtttatcgttgacagtgaacatccagccatccggtgcattgagcgttttcccgttgattgtctccacgaatgtgcctgtcgagttttgtttcgcggtatacgtcatctgtccggcagcctgcgccgcctgcattacctgttctgccgtaatcgtttcgccctcgacctgtaccgtaaacggtacttcgggcttattaaactggtactttgcagcatcccatgtcgcgatcaatacctgtacggaaattggttcgctggcaggcgtatctgctgcgggcgccgcgtttttcagataaggatatccattgttgatgatcttgccatccgcacccgcgtccagtgcccatgcgctgccgagcgccgtggcaaacgcctgcgttttcatatcggatgcaggttttgcagccactcctgcaatgccgctcaccgcctcggtatccggttttaatttatcggaattgtaatacccgttcgtaacgctgccgacactgctaaaggagaagcccttcccccccacgagcgggccgcccgtaccggcagttgctttcacgtcattggatgcatacacgtttgtaagcgaaccgggactggaaagcatgcctgcaaagccgcccagctcattattgccctcgactgttcccgtcgcatagcaatcggagatagtcccttcttctacgccgccaacaaagccgccgacccatttataaccggaaacgcccgtagcagcaaaactctcgctgatcgttcccgcccctccgtttcgtccagcgagtccgccgaccatcgttcccgtaccctgataggttacactgccgccggaaacgccgcattttttcacggttccctcattgtttcccacaaggccgcccgtacggttgttatatttggaaacgaccgtagagccattggagaaacagctttctaccgttcctttgttattggagaccaacgcggcaggatagtgcatgctgttacttaccgtatcctcgaccgacgcgtttacaagcgtcaggtttcggaccgtgccgccttcgccgacatagccaaacagcgcttcaccggaaatggaaagattcttgatactgtgcccgtttccgtcaaaaatacctgtaagcgccttatcccccgatgcgccgttattatattttccaataaccttgcctgcctggcccgtcatatcgatatcgtttgccagcttataattttttgtaaggtctgccgtggttccggcaagcgcaagcagctcgtccggcgtggagatcaggataaagccctgctcgtccttattaacgtagctgtatgccgcgctttttgctgactccttactgtccgtatagctgtcgcttccggcaggtgcgacagcctgtacggtgaaatagtaatcccccgattgcgtgataatgcttttgaattccttggacgtttccgtaacgcccgtataggtatcaataaggctcgtatccttataaagctttaccgtataagaatccgcgccggataccgccccccacgacgcgaccgcttccgtccatataaggccggatggctgtgcaagctctgccggaccggatgggtctgtaccgccgccgttttccggcgcttccacattgacaaggtatgggtatccgttgttcttgctgtcgtcctgcgtccacgcgctgccaagcgttcctgcaagtgcttttaattcgcttgccgttttcccctgaaaataactcccctgcgctttttccgttccattcccctggataaccgattccgaagaatagaaggattgcgacacatagctgctcatgaagaagccgtcgccgaaaaaccgtccaaaatagttgttcgtccctgttgaagtcaccgaagcgatcgtatagcatgacgtgtatttcgcgtcggactctgatccgacaaaaccgccgacatactttgcccctgcgacactgccggcagaaaaacaattttccatcgttccgctatacccaaatccgacaaagccgccaacctgctcgcttgcagaatccactgcggctgttgtatagcactcgctgattttccccggggtataacaatatccgacaaaaccgccgacgccttttcctttgcctgcgaccgtctgggaaacactgccgtcggaaacaaagcattgcgttacgttccctttactgtatccggcaaaaccgccgacgtaacccatagtctgcgtagaggctgatcctaccgaagtattttttacggcacagccccggaccgtccctgcattatagccaatcagcccccccacatattggtctcctgcgatactgctgtttttcagcgtcaggtctttgaccgtcccattgttgtatccaaaaagtcctgcgtagctgccgaatgtaatctgaaggttgctgaccgtttgtccgttcccgtcaaacgtccccgtaaactgcgtagtgctgttgccgatcggctgtgccgctacgccgctcatatcaatgggcgctgtcagcctcaggtttgcgctccaataggaagaatcgttcattaccgccaacaaatcgtcagccgaagcaatcagcgtataatcgccgtccgttccaagggatagcgcattgatatccgtgtctgcgtcaatcgccatggccgccatctccggtgtttccggcgatgcggaagcgacaggctcgacgctttggcttggctgcaccgtgtccgtggcttccggcgctaaagtcgcctcaggcgtaaccgttggcgccggcgcagcagacgccgtcgtatctgcaaccggcgtttcctgcaccatatccgttatatccggcgtttgcgtccccaacggcgtatctgccgccatggacgttgccgccatggaaaacaccatgaaaaccgccagtaaaattgctaaaatcctttttttgccattcatatccattcttcctttccgttatctgttggcggcaacaaaaaagctcccgccgcaatcggcagaagcatacatttacacatttaaaatgtataaagaaaaagcccgtccttcccgccgaaagactcacaacaatcattcgggcaggtcttccgacttcggggtcgcctgcttttttacgccttcccaacaaaactgtcagtggcctttgtaaaaagcatctcccatcacggcagcgggggctgtgccggactcacaccggcttccctattattcttttcagaacccaaacaatataatctatttaattcgtaatcagcatatcataaaaaaatctcctgcgcaacctgagagcgttgcgccttgcaaacaaaaaaggcggaaaatccgccttcctgccttgcaaaaaaatttatttgtcacccattaacatgaccatcacggccttttgcgcatgcatacggttttccgcttcatcaaagatttcccccgcatgcgcttcgaatacgcccgtcgtaatttcctcttccctgtgcgcgggcaggcagtgctgcaccatcgcatccttctttgcgaccgccattacatcttcgttgatctgaatgccggcgaacgcctttttacgcgcttcaacctgcgcctcatggcccatggacgcccaaacgtccgtgaacagcacatccgcatccttggccgccgcataaatgtcctccgagatcgaaaacttcggattgcccttcgcaaattccagcaccgacgcatccggcatatagtctccggggatcgcgcacgcgacttccatgcctaccgtaagaccgcctacgatcagtgaattcgccatattgtttccgtcgccgatatacgccattttaaggccgtcaaagctctttttatattcacgtatcgtcatcaggtccgcaaggacctggcacggatgcgcataatccgtaaggccgttgatgatcgggatactgccgtactgcgcaaggtcttccacttccttttgcgcataggtccggatcatgataccatccaggtaccgcgacagtacgcgcgccgtatcctccaccggctctcctcgtccgatctgcaaatcatttgaagaaaggaacagtggatatccgccgagctggtacatccccacttcaaaggatacgcgcgtacgcgtagacgatttctggaagatcatgcccagcgtttttcccgcgagaacgggatgcttgatcccttttttattttcatccttgagcttatccgccagatcaagtatttcaatgatctgttctttggataaatcgctcattttcagtaaatgtttcatgccataaacctcatttccatttcaatagtataattatacatctaaatgaatatttatgcaataagttttttatactatctttccgcctgctgttcacagtatgcgcagcgatatacgccgcgctctgtatccgtcaattgaaagacatgcggcagttcctgttccactgccgtaatacagcgcgggtttttacattttacgatattgacgactcgctcgggaagtttcagattcatttttctgatgatctttccgccgtcgatgatattcactgtgatgttcgggtcgataaagcccagcatatcgaggtctgtttcgatttcatcctcgattttgataatatcctttttgcccatgcggttgcttttaacgttcttgatgatcgcaacggcgcaatcgagtttgtcgagccccaaatagttatagatactcatggccttccctgccttgatatggtcgatgaccacgcctctttccacactatcgatactaagcattacgcatttacccccaacatcgtcataataagagccatacggacatactttccgaaccgcgcctgcttgaaataggcggcgcgcgggtcattatccacttccacggagatctcgtttaccctggggagcggatgcataacgatcatatcgtccttcgcctttttcatcttttccatatcgaggatatagctgtcgcgcaggcggatataatcctcttcattgaaaaagcgttcgcgctgtacgcgcgtcatatacaggatatctaggtctgagatgatctcctctaagcgttcgtactgcacatacgttacattttcgttgtttttcagcacgtcttcttttacatagcgcggcaccttgagttctatgggagaaatcagtacaaatttgatatttttataccttgaaagcgcacggatcagcgagtgtaccgtccgtccgaatttaaggtccccgcataggccgatcgtgaggttctccagccgtccttttaaggatcggatcgtcaaaaggtcggtaagcgtctgcgtcggatgctggtgcccgccgtcgcccgcattgatgatcgggatatccacgttctgcgacgccaccatagccgagccttcctttggatggcgcatggcaatgatatccgcatagcattccactgtgcgcaccgtatccgccacgctttcgcctttggacgccgagctgttgtccgcccctgcaaagccgatcacgtcgccgcccaattcgtgcatcgccgcttcaaagctcaggcgcgtgcgcgtggaaggctcaaaaaaaagtgtagccagttttttataccggcacacttccctgtacttttccggattcgcgataatgtcgcctgccagatcgagcagttcatcgatctcctctaccgtaatgtccattggatcaagtaaatgtttcatgatttctcctgttcctttccagtttgcataaaaaaacgtcttcctgtattgacagaaagacggtatcattgcgtaacgatatgcccaaaccttatcagcctctctgtaccaatttaaaggttttttgtgcttctattattttactacacatcggaagcgatatcaatataaaatctataaattttttgagtttaatgtttatgcccgatgaccggtgtctacattaaatataacaaacgtgctttgaacgccaatgaaaggaagtgaccgcaatggtagctaaaatggttcgtcagtttgttgcattaggagctgtgatcgcccttggcatcacgatacttgcttttggatttggcaccgcgccgctttccgttcaggtgctccaggatagctttgcaagccaaagtgcaagccaaagcgaaacggttaaatagctttttcttttctctccacttttttattgatagaaggcgctttccatatgggaagcgcctttgcttttttacatcaacggggcaaatacgcgcaagatcgcctgcatcaggcgcacataccattttcggcgccgcacagcgtcataggaaacctcctggcaaatgggcatggtattcaggtagtcctcttttacctgcatgactgcggcagtccggtacatccagacgccgcactcataatgcagaaacaaactgcggtaatcaaggttcaccgttcccacgatcgccagttcatcgtcgcaaacaaacgttttggaatggataaagcccggcgtgtattcgtaaatgcgtatccctgcttcaagtagctgctcgtaataagcgcgcgtcaccatgaacaccatttttttatccggaatatgcggcgtcgtgacgcgcacgtccacgccgctctttgccgcgtttgtgagcgccgcgatcagttcgttatccaatatcaggtaaggcgtgttgatataaaggtaatgctttgcgcgcgtgatcatgttaagatatacgttctcgctgacatattcattgtccattgggtcgtcggcgtaaggctgcacataaccattcgggccgcattcaagcatgaaccgttcgtgcgggacgaatacggaacaatcgctgtcttcgttcgtcataaagttccacgcctgcaaaaacatcatcgtaagcggccatgcgcccgtgcctttgagcatgacggcagcatctttccaccgcccgaaccggctgaccgcattgatatattcatccgccaggttcgccccgccgcagaacgccgtatgcccgtcgatcgccgtgatcttcctatggtcgcggttgttgaaaatcgaggacagctcgggctttaacgtattgaacacaacgcacttgatccccatttcccgcagccgcttgtaataacggaacggaagggtacgcgcgcagcccatatcgtcatacataaaacgcacatccacgccctgcgccacttttcttttcaatatatcgaggatactgtcccacatcacgccttcctgcacgatgaaatattccataaagatatagcgttccgctttttcaagttcttctttcaggcgctcataaaaatcctctccgcatggaaaatactccgtctcggtcttgtcgcataccggaaacatacttgcgttgcggatatagtccgactgccgcgcggcacccatgctcgtttgcccgagcgcctgcgaaacagcctcgttttgctcaagcaggcaattggtcttttcataaacgtcctttgccttgttcagcatttttttggagagcttgcgctggctgaaaaagatataaagcaaaatgcccaatacaggaagcaccaggatcgggatgatccatgccagcttataggaagaattttgccgcttattgacaatatatagcgccatcaaaagactgatcacaaaaaaaatattccgcagtatctgggattcctcatcaaaataatagaaaatactgatgataatgaatgcctgtatgccgattaaggcaaatacgataaacaggcggctggtaaaaagactcaggaattttttcatgctgttctccattcttccgatgtccttgctctcaatcattttacgacaaacctctgtgctttgcaatggcaaacaaaaagaccgcacgattgcgtgcggtcccttgttttgttctttcttattcgtattgttcgccatatccgtacttttccacgacatagtcgatgtccttatcgcccctgccgctgcaatttacgaggatagaaccttttttgttttccttggcgtatttcatcgcataggcaatggcgtgcgcgctttcgatcgcagggatgatcccctcatagcgcgaaagcttgaaaaacgcttccatcgtttcgtcgtctgtcgccgtcacataattgacccgccccagatcgtgcaaaaatgcgtgttcaggccctaccgacggataatcaagcccgctcgccacggaatataccggagctgcctcgccctgttcatcctgcaaaagataactctcaaagccatgcagcgttcccttttttccgtacgtgatggtcgctgcgtgctcgcccacttctttgcccctgcccatgggctctacgccgtatatctccaccggatcatccaggaacggtgtaaaaagtcccagtgagttactgccgccgcctacgcacgcgcaaatcgcgtccggcaggttgcccgtcatttccagaaactgctcgcgcgcttcctgtccgacgaccatctggaagtcgcgcaccatcatcggaaacggatgcggccccactgcgctgccgatgcaatagatcgcgtccttataatcccgtgcgtatgcctcaaacgcagaatcgaccgcttccttgagcgtcgctgccccgcgcgacacaggcacgaccttcgcgcccagtatcttcatacgcgtcacattgggcgcctgctttgcaatatcgacctcgcccatgtgtatctcgcattccagtccaaagaatgccgccgccgtcgcaagcgcgacgccatgctgccctgcgcctgtttctgcgatcagctttttcttgcccatatatttggcgagcagtccctcgcccatgcagtgattgagtttatgcgcgcccgtatggtttaagtcctcgcgctttaaatagatctggaccctgcccagcatcctcgacaaacgctcgcagtgatataccggcgtaggccgtccctggaattcgcggcggatcctcctcagttcgttgataaactgtgcggaattgcatatggtttcatacgcctccgtaatctcttcaaacgcaggaacaagctccggcggcaaaattgccccgccgtattcgccaaattttccattttcatccggataatttttcagataagttctgtaatccatctctattctctccatttctattctatgggcgttcgcccgctctttcggggaacgtttccccgctactctatatcggctttcccgccgaccttctctcattataaacaacttttacctgtttgtaaacatccggatatgcttcccgttcagggcatttgcggcaggctgtcaaatcccttctgtaattcctcgtccgtcgggatatagtcgttcatttttccatcgtgaaacgcttcatatgccgtcatatcgaagtagcccgttcccgtgaggccaaagaggatcgtttttgcttcgccggattccttgcataaaagagcttcatcgatcgccgcgcggatcgcatgtgcggattccggcgcgggcaggatcgtctccttttttgcaaacagcaccgccgcttcaaacaccttgctctgctctgcggataccgcttccatatagccgtcatgatacagcttggataagatgggcgacatcccgtggtagcgcaggccgcccgcatggttcgccgagggcatgaacccgcttccgagcgtatacatctttgccatcggcgtgatcttgcccgtatcgcagaaatcgtatgcgtacctgccgcgcgtaaacgacgggcaggacgcaggttctaccgctacgatccgcgggctggattttcccgttaatttatcctgcatgaacggcgcgatcaggccgccgaggttggaaccgccgcccgcgcatccgatgaccacatccggatattcatccagcttttccatcgcgatcttggattccagaccgatgatcgactgatgcagcagtacctggttcaagaccgagccgagcacgtaacggtacccttcggaggtgaccgctttttccaccgcctctgagatcgcgcagccaaggcttccgcctgtttccggattctcagcgagtatcttcctgcccacctgcgtcgtctcgctcggacttgcgatgacatccgcgtcaaacgtctgcatgaccgccttacggaacggtttttgccggtaggatacctttaccatgaataccgtaagcggcaatccgaaatacgaacacgcctccgccagcgccgtgccccactggcccgcgcccgtttccgtcgtcagccctttcagtccctggtccttagcgtaatacgcctgtgcgatcgccgagttcagcttgtgactgcccgacgtgttgttgccctcgaatttgtaatagatctttgcgggcgtacccaattctttttcaaggttatacgccctgatgagcggcgacggacggtatatcttatacatctccatgatctcttccggaatatcgatatagcgcgtctcattatccatttcctggtgcgcgagtttttcgcagaataccggatagagatcctcctgtgtcgccggctgcatcgttgcagggttgatcataggatccggcaattctttcatatctgcgcgcaggttataccactgcctgggcatctcgtcttctgttaaatagagtctgtgcggaacttttaccattgttttgttctcccttcaaatttgtattgagccgccctgccgcatgttgtcacgttcgggcgcagcttaccattttcgggataaaaaaaagcttttatcccagttttcctaggacaaaagcttataaaacttctgcggtgccacctaaattgacgcatgaacgccctctcataacagtctatcaactgctgtccctcataacggtgggatgccgtcaggtattactcggccttgacgcctttctccctgccctcatcagtccattcgccgaaaatcctgtgctgcgatgatcacaccgtccatcgctctctcaaaagcggttttttaggctactcctctgaatcgttggtttctttatttatgattttgtattttaccagacacttttttggatgtcaagcaaaattttacttttgcatcgcttttaattccgccgccgtgatccggtaatttttgtcgcggcagtcctgctctataaagcgtccctcctgcgcccgttcgttcgtcgaatcgtaaaacaggaacggcaccggctccccgccgtgcgcgcccgtatccgaaaacgtaaaatggtcggaagcgacggaaagggtgtaatcaccttcgatccctgcaaggaaatcctttaaaaatacgcggtctatcgattcgatggcctgcattttttccacaggctggagctcgtgcgaaaggtcgtccgtttcctggatatgcacataaatatcgtcgtattcgttgactgccttgaccgccttttccagcttttcctcaaggaaatcgtcaaagctgcgtccctcgcgcttggtcccgatgttcggaagtcccgcgatggtcgtgataccgtccatcaaaagcgtttccgaaagcgcgacgcgcccccttgtgtcccccttgatctccggcatgatggaatccccccagaaccacagcccgttggcggcgatccctttatcctgcataaaatcataggattttttcatgagttcaaaaaacttcgcctgtttgccgctcattcttaaaaaaggcgcgatgtcctgcccgatgatatcgtgcgcaggctcgaggtctaacggatacaagtcttttccatccttcacgattaacgtattgcggaacgaaccgcaataaacaagcttatattcctcgtcgaataccgcctgcgccaactccttcatcacaggctccgcgatctccgtcgcaatatcgtatgcgctgtagcttttaatacggctcgtctcaaaggaatcgccctcaaacgtcaccaaattacagcggatatacaggtcgttgtcattcatcggcagccccagccctgccgcttcgatgatcgaacggccgcggtacgtatgcggatcgaaccccaaaaggctcaggttcgcaactgcgctccccacttcaagcccgtcggggatcgtcaggcacgtgccgctgagcgactttctgcacagcgcgtccagattgggcgtatgcgcatattctaaaggcgttttatgatcgagcgcggcattcggcctgtctgccgagccgtctaaaaccagtgtgatttttttcatgtccttttcctctcttgtgcaaaatccttttccaccctattatacgctacttacagccgctaatcaatgcgttttacaccgcagcacggcacgttttaccagcttgaataactccgcagccgcaattaccgacaacgcgcacgctacgatcttcagccacattgtaagcggcaggggcaccgtcccaaaaagcgcgccgccgaattgcgtgatcactacttgcaaggcaaaggtcacgagaaaaacaagcagcatcagtttgttatttccgatgtttttgaacatgctcgtatccgaaagctccctgctgttaaaggcgttgaacagttgaaataccacgaacagcgtaaacagaacagtcggtacctgactgatcggggctcccaggaaattccatgtatgctgcgccatgaacaccgcagatataaaaatgccgttgaaggcgatccgtcccagcatgcccttggtcacgatactttgatcgcgggcgatcggcgaacgcttcatcaggtcctcgcggatcggctccaatccaagtgtcagtgccggcggaccgtccatgatgatattgatccacaaaagctgcagcgcggaaaaaggcgaaacgaatcccatcaggatggagcacagcaccacgatcacggacgataggttgaccgtcagttggaactggataaatcgctggaaattttcgtaaatcccgcgcccccactgtaccgccttaacgatcgtggaaaacgagtcgtccagaagcacgatgtcgcttgcttccttggaaacctctgtgcccgatatccccattgcgatccccacgtccgcatttttcagcgcaggtgcgtcgttaatgccgtctcccgtgactgcgaccacttctccatttgctttcagtgcgttcacgacacgcattttaacagtaggcgtgctgcgtgcgatcacgcggattttggggagcatttccctgagctgttcctcgctcaagtcttcaagcgtccctgcttccaccgcgatatgcccctgcgaaagcaaatccagctcgtttgcaatggccgtcgccgttacaagattgtcccccgtgagcattttgagttcgatccccgcgctacggcagcgctctgccgcagccaacacatcctcacgcagcgggtctgtgatcgcggcaaagccatcgtagttcataccgctttcaattttcttcctgccgctttcatagtctgccatatccgcaagttctttatgcgcaaaggcaatcacgcggcagcttttttcctgataaacgagcatatccgcttcgatttgcttcctttgtgtttcatccaaagcacacatagcgatcactttttcagggctgccctttgtataggcgacatgcccgtcttccccgcagacaatggtcgtcatgttttttgtctccgagctgaatggaaagacgcaggcgacctcagctgcctcgcgcatttgccgatagtcctgccctgccttttgcgcggcaacaaggagcgcgcattccgtcgggttaccgataaaatccgccgatgcagagcagcttaaatccgccgtaccattgacacaaaaattatgcaggatcgcctggtcggtaagctcttccggttttacgataccgccctgcgttcctaccgccagcacggtcatcctgttttgcgtaagcgtgcccgttttatccgaacagatgatgctgacgcatcccaccgtctcgcaggcaaccatctttttgacgagcgcgttttgccccgccatcttgatgatattgagagccagcgacaccgctacgatcgtcggcagcccttccggtactgccgctacgatgagcacgatactcgtaataaatgcctcggataccgtatccagcgacgctgtaccgtttgccaggaaaatcaatatctggattacaaaaacggcggcggcggcaaccgctcccagcatggtgatcagctttcccaacttattgagtttttcctgcaaaggcgtacttgccttttccgttcctgcgagttcccgcgcgattttgccgaattccgttccgtcccctacggctgttacaaccatcacgccgcttccacccgtaataaaacagccggaataaagcatgttggcacgctccgcgacaggcgtcttttcgcttgggaaaaccgcctcagcgtctttttccgcagggacgctttcccccgtcagggacgcttcgtccgccgacagtcccttgctctgtatcagccgcccgtccgcaggcagcttatcgcctgtctcaagatgcaggatatcgcccacgaccacatttttttgcggaatcaattgcacctgtccttcgcgcacgactttcacaagaatatcctggtttattttgctcaatgcctcaaacgccttagcgctttttccttccatgatgacggtaatcacaacggaaagtaaaatcgcgacaaatattcccacacactccaaaaagtccgcttcgccgccggatacaccgcgcgcgatattgacaccaagcgcgatcagtcctgcaacgatgagcatgacgatcatcggttccgtagccgcgtcctttaagcgttttaacaacgagtccggcttttcgcgcgtaaattcgttcacgccgtattttccggcgttttcttccacctgcgcgtttgtcaacccccgtccggcgtctgtacccagcctcttaagggtttgactgctttcttcctgaaatgcctgcatacctgattttcctcccgagtagaatcagctacacgcgcccgcatagcgcgcatagacgtgaccgaatgccataacataataaaaagaccggatattgccccaaagcagcatccggtcttgccctttttaaataaaaaagaccacacgtatactccttttacagaagcaatacgtgagtctcgttaatgaaggcaagccaggcgataagcgccagtatgttgacttgccgcatacggcggagccgtatgccaactactccctcacgaagtattttcattatgttatttatgctaccacatgccgcgccccaagtcaacggccagatgcccgtatgtttattttccacagccgttggttattgatatcagcagtgttccaataaaaacattcgtaaacaaaggtcgtgatattatgcctgaaaaagaaatcaactttgaccatgcgccgcgcatacgcaaaaagtttttgcctctgctggcggggatcgtctggggcatcgcctcaacagccgttctgtccatcggcatcccgtccatggtggaaaactggacgatgccgtggctgtgcatcctcattgcggcggtgatcttcttcctctttttcaaatttgtattcttccgcctgttcaaaaaacatatgcggcgaatcgattccttcgaaaaagacaagatttgcgcctttgccttttttgacgtcaagggttatatcatcatggcgtgtatgatcacctttgggatcgtgctccgctcccttgacgttctgccccatgtatatttgggcgtgctgtatacgggcctcggctttgcgatggtaggcgcggtcgttggcttcctttccacgtttatcacgcggcatatatacgaacgcaaggagcgatcaaactaaaaaaacgcggtttcccgcgtttttttattattgcatcttttccccgaccagcttattgacaagcccgccgtctgccttgcccttcacaagcggcatcagctccttcatgatcctgcctttatcctgcggcgcagccgtttcgatccccagcttaccaaatacttccgcaataatggcgcgtatctgctcttcgtccatctgggcgggcgcaaattcctttaaaacggcgacccgtttttcattcatatcaataagatcctgccgctctgccttcttcgcacccgcaaggctttcctccgcctgcttgatctcctttaagataatcgtattttcttcctcttcgctcaaatccgcacgcttgtcctttgccttggccttcatcgccgataaaagcagcgttaacgtttccttgcgctccgtatccttggccttcatcgctgcgatcatttccttttgtacctgttcaatcttgctcattttttgtaccctctccgtgttattccaataaaatatgcatttattataccacgcttttcgactgttttacagtacctgcatgcttgcacaaacgtccggaaccctttaaaatgaaaagcaggcatatcataaaggggggttctccatgaatcttagttttttaggcgccgcacacgaggtaacgggcagttgttattacctgcgggcgtgcggcaagaatatactgatcgactgcggtatgaagcagggtcctgaccaataccaggagcaagccttgtctttttccgcagcagaagttgactgtgtgcttttaacgcatgcgcatatcgaccattcggggctgctgccccttttataccgcaacggttttcgtggtgatatttatgccacgggcgcaacgacggatttatgcggcatcatgctgcgcgacagcgcgcatatccagatgttcgaggccgaatggcgcaaccgcaagggcaaacgcgcggggcgtgcagagtatgtgcccctttacgaaatggacgatgcgctcggcgttctttcctgttttgttccctgcaggtacgaaaacgatattgagatttatgacgggatttccgtccgcttcaccgacgcagggcacctgctcggctctgcaagcattaccatcgacatcacggagcagggcgttcaaaaaaccatcgtcttttccggcgatatcggaaattcagaccagcccctgatccgtgacccgcaatatcttaccaatgcggattacgttgtgatggagagcacgtacggtgaccgcagccacggcgtaaagccggattacgtgacagagcttgccgccatgatccagaaaaccttcgaccgcggcgggaacctcgtgatcccttcctttgccgtcggacgtacgcaggagctcctttatttcatgcgcattataaagcagcaagccctcgtcgccgggcacggcaatttcaccgtatatgtggacagccccctcgcgatcgaagcgaccaatattttcaatgaaaacagccgcggctattttgacgaagaagctacggagctgatccaaaaccatatcaaccccattgcctttccggggttgaaaacgtctgtcaccagcgaagattccaaaatgatcaatgcggacaagcagcccaaggtcatcgtctccgcaagcggcatgtgtgatgcgggacgcatcaagcatcatttgaagcataacctctggcggcgggaatgcaccgtgcttttcgtcggttaccaggccgttgggaccttgggacgtgcgatcctcgacggcgcggcgcaggtcaagctgttcggcgaggacgtctccgtcttggctgagatacgcacgctcgaagggatcagcgcccacgcggacaacgccggacttttgcgttgggccggcagcttctctcccccgccgcagcgcgtattcgtgacgcacgggcaagcggaggtatgcgatttctttgcaggccggttaaaggatgagttggggctcaacgcctttgccccctatccggatgcacgctttgacctcgcttccaatacggttctaagcgaagggatcaaggaaaaagtacgcgccaaaacgccgtcacgtccgcaaaccgtattcgaccgacttgtcgccgcgggcgagcggctcatgcaggtcatccgcaaaaaccacggcggcgcaaacaaaagccttgccaaattcaccgatcagatcaacagcctctctgataaatgggagagataacggaggaaaatctatgttcagaaaaagatctgcatttattctctctgtcctatcccttttcgttttgtttacagggtgcagcttgtttgtacctgcttatgattttacagacgattcccatcaacagatcaatctggatggtattatatatcggacagagaatcatcccgatttccaagatcccaagaacggatgggtgctggacggcggcggacagcaaatgatcgggcatataaaaaatcttgaccaaaacttatattttaaccgaacagacaaacaccgtatcatgctacgcatgcacgcacaggacacttttatgcagagcatgatgcccgcggaaacacagtttttccggcaggatatacaattgcccgcgtttggtcttgatacgacggatgccattcattttcttgtatacgatcgtggaaaagcggtggtcgacattgagacgagaacccgtaacgtaatcgaaacgatctttgaattgcgtacgcaggctggcaaacccgcaaaaaatattattcctgacggatatttcggcgaggatgtatcgcgccgcgttggctatttacattttaccaacgatgaatggacaccgacaggatggtatcaatacggctcgatctacgctcttaaggacgcatattatatcgatacgcagcaaaatacttatgtccctctcagtagcgaactattatcagccctcactggcaaagagtatcctcctgccgatgtgtatattgcgcaaaagctaaacaactgaagaagccggccatacactccatgaccggctttgctttttatcattaatgtccgtgttcatcctcggtattctccggcttcttgaggccttcgatcttgataccgttcttttccgcataatcccacagcgccgcctggatcgcttcttccgccaaaacggagcaatgcacttttacgggcggaagcccgtcgagcgcttccataacggcacggttcgtgactgtgagcgcctcctgcacggttttccctttgatcatttcggtcgccatactgcttgtcgccacggctgcgccgcagccaaacgtcttaaactttacgtcgcgtatgatccccgcatcgtccacgtccaaaaatatcctcataatatccccgcacttcgcgttgccgaccgtgccgacgccgctcgcgtgttcaagttctcccatatttctcgggtgctggaaatgatccaatactttttcactatacatagttatttcttcctttcttttctctcacgcagaagttgtcaattttttgtttgtcttccacattctgtcagtaggctgttcccgccgcctcactcgccctcatcgctccatcacgcctcgtcggcgttatttcgcctgcgatttcataaagtcatcgtagagcggcgacatattcctgatttgcgctaccaccgttttcagggtgtccacaacataatccatttcttccattgtattcgtttcattaagcgttaatcgaagcgagccgtgcgcgatctcgtgcggtagcccgatggcgagcagcacatgcgacggatcgagcgaacccgatgtgcaggcagaaccgctggagccgcatattccacttaaatccagcatcagcaggagcgattctccctcgatgaaccggaaacaaaagtttgcgttgttgggcagccttttatgcctgtccccattgaggcgcacatactcgatttcgtttaatacccgatcgatcagatgatcgcgcaacgcgatctccttttccgtccgctccttcagggtagcggcttcgatctcgaccgcttttgcaagacctacgatgcccgggacattctccgtgcccgcccgtttgccgcgttcctgcgctccgccgtgaatgaagggtcttaatttcacgcccttgcgcacatataaaaagccgatgcctttggggccgtttaatttatgtccgcttgcgctcagcatatcgatgttgcattcgtttacgtcgatgggcacctggcaatacgcctgcaccgcgtccgtatggaacacgatcccatgttttttcgcgatcgcgccgatttcctttatgggttcgatggtaccgatctcgttattcgcatacatgatggaaatgaggatcgtcttatccgtgatcgccgcttccagctcctccggttttacaaacccgtattcatccacgtcaagatatgtcacgtcatacccctgcgtttcgaggtattcgcacgtatgcaaaaccgcatggtgctcgatcctgctcgtaatgatatgattgcctttctttttatatgcctgcgccgtggatacgagcgcccagttatccgattcgctgcctcccgccgtgaaataaatttcctcgggttttgcgcccagcgtatccgcaatcaccttacgcgcgccgtctaccacgtccttgttttcagccgcaaactggtagatgctggatggattcccaaatttctcagaaaaataaggaagcatggcctgtactacctcgcttcgggccgccgttgtcgctgcattgtccaaataaataaactttcccatctttgcgttactcctcttgaaaattttatatccctgccgcatctttatgggaagaacatgcgccgttctcctgctccaataaagtactcagcttgatttcgtctacgatttcattgataccgtcgttcaaacgctgccaaacatatttggacgcgcacgagccggattgctcgcagcctcccccgccgcctataagcgccggacaatcgatggggcttaaatccccttccagcgcgcgcagaatatctcctaccgagatatcgtccggctgcttcgccagcacataccccccttgtgcgccgcgtatactgctcaccagtcccgccttcttgagtttacctacaagctgctccaaatagctttccgaaatgctttgccgcgcggcgacgctgctgatggagaccgcttcccgcctgccgttttgcgctaagtcgatcattgcgcgcaatccatacctgccctttgtcgataatttcattcctgcggctctcctttccaatttgtgttcctaattcccactattttactctgatatattaatacaccttacgccaaatgtcaaacacaatttctactattttactgcgaattgaaatttttttatattcgattttaaaaacgccgcgttttgtgtatcatataggtatagaagaatttgattgaaagggttttgtatgtccattttcaagagttttgccggctattataagccctacaaaaattggtatcttcgttgcgcccatcgatgtgctcgtcaactttacggaacaattccaaaaaggcttcgcaggcttcaagcggtttttggaaatcatccataccgagccggatatcaaggaaaaaaagaacgcccggtccttaaaggacgtacgcgacgtgacgctcaaatcccttcggagcgcgatcggcatcgtgcagcaggacgtatatatgttcggcgataatatccgcgacaatatcgcctatggcaagcccggcgcgacggacgaagaaatttttgaagcggccaaaaacgccaatatacatgatttcattacgagcctgcccgacggctacgataccagcgtgggaaaacgcggcgtccgcctttcgggcggccagaagcagcgcatcgccattgcgcgcgtgttcctcaaaaacccgagtatcctcatcctcgacgaagcgacctccgcgctcgataacgagagcgaacgccacatccagatgtcgctcgaaaaactttcacgtggccgtaccacgatcgtgatcgcccaccggttgagcaccatccgaaacgcggacgagatcattgtcatgagcagcgaagggatacaggaacgcggcacgcacgcagtgcttttagaaaaaaacggcatctacgccaattattataatatgcagttcgagggattgaatgactgaaaaaaaagattgcggcaatgcgaaaactttataccgtgacgatgagcgcaaggtgatcgtgcgcctgctgccgcgcggcggcaagcctgtaccgattgacgccccgtgcgacgggtatatactgcgcgacgtttattcgccttatgctttccaggaaaaggttcgtatcttcgaaagcggccttgacgaccgcgcagtggagctgctcaaggctttcaccatacaccgcaacgccgaacggctaagcggttccggttccctgcttttttcgggaagcgacgagcagtctctttccttttttgcgcttgcaaaggacggtaatgacttcctgctgaaaacgcctgtggaattttatgagaaattacgcgcggatatggattctcccgtattcgaaaccaagggctttacggtcgtggacgaccaatggatatcaaacagggtgtccttctgaaagtattttttgctttttaggatatcctgccaaggtaacgacaatgcccgcaacggcaaacagggcgatcagcaaatacgccgttttataccggaacgcatccgcgaagatccccatcaaaatcggtcccaacgtcgatcccgcactatagaccgcctggtaaaagcccatggcgaccgcttttttgtcctctccgaaattgctgattgcattggccataaatatcgcggtcagggacgcatacccaagcccgcctatgaactgcacaacaaccagcaacggtatgtttgtgacaaacgggatcgcgaccgtattaaacaacagcaaaccaaaaccgatcacgctggttttccttcctcccagccgcttgcctgccttggtcgccacaaaaaacgaaccgatgacggacgcgccgatgaataccgcgctcacgatcccgacttcaatgccgcttgcgccgatgtcctgcgccattttcggcgtaaatgcaaacgcggtcgcaaacaccagcgctttgatcagtatccccagaacggacgaagtgatcaggcgcttatcccgcacaacagacaggatcgtcttgatatccaccgtttccttgggcgcggacttctcctttacgaatgcggagatgatgaagccgaccaccgctacggctgcgcttacaaaaaacagcatgcggatgcccgcctggtcgtacagaacgccgcctactacaaaggccgccaaaatccccacttccactacgccgcccagtacgcccatcgccttgcccgcttcttcccttttgtaatatttcgcgtacaacaacgtaaaggaaacgtacatcgtgcttgcaaagccggagatcgcgttccctacaaacagcatgaccggagacggaaacgcccacatcacaatggatgcaactgcggtaaacaacatgcccagcatgataaacggtttttgtttgccgattgcttcggatttgatgccgaccggaaagcgcagcaaaaactgcacaaaggaatgcgcgccgaaaataacgcccgcaagcgtcgccgtgagccccagcgaaatcaggaacggcgttaaaaacggaatatacaggtacagggaaaaccaaaaaatgcatgtaacggcgagcaggatcaatcttttcatacgctttcccctttttgattgtttatggatattgataaacgccgctcccatgggtgtaaaccatacttcattgcttttttgccctgccttctatataatacatatatgcattggtgtatttaggagaagaactatgaaaatatctgccaagggacgctatggcctgtccgccatgatctatctcgccttccatgcgggcacgtccaaatatgttaccgtccttacaatttctgagaatttggatatttccaagatttatctggagcaggtttttgctttgcttaaaaaagcggggcttgtcaattccgtcaaaggttcgggcggcggttaccagctttcccgtgacgcttccctcatcactgcgttcgatatactggacgcgatcgaattaacgctctttgaagcgacggaaagcgcgcttggtgaaaaaggcgcgcatatcaacagcgccctcaattcactgttatgggataagctggacagcgcggtgcgcgataccctgcgttccgttcacctgagcgaacttacggagtgcgccctcgcaagcaagcagggcggcgaatatatgtattttatataagaaaggttttctgatgaatatgcaaatcataaaacaactacaggaagacatacgtaccggcagcttttcctgtgtctgctatgacgaaaacggacgcatttccggcgcatccggaaagcggctgcgtcctctctgggatctttcccggcaaactgacctgaagggtaaatatgtcggcgacaaggtcatcggcaaggccgccgccatgatcctcatcgcgtacggcgcagcctatgcttatgcgaagctgatgagcgtatccgcgcaaaaggaatttgaaaagcatggtattgcgtttgcatgcgagacaaccgcgcctacgatcaaaaacgccgcgggcgacggtatgtgtcctatggaagcagccatgcaggagtttgacgacccgcgcgccgcagtcgaccggatcgaccggatgatcaacggaaaataaggaaggaattgtcatgaattacaggaagctcggcaacacaggcttttccgtcagcgaagtcggtatcggcggagaatacctggaggatgaaagtcaaaaaactacgatagacacgatgcacgccgcaatggatatgggcgtcaatatccttgatatttttatgtccgagccgcatgtgcgcaccaacctcggcctggggatcaaagatcggcgcggcaagatatacgtgcaagggcatatttgttctgtgtgggaaaacgggcaatacggccggtcgcgcgaccttgccaagagcaagtttttcatagacgacctgtttacgcgccttgataccgattatatcgatatcggcatgctgcattatgtggatacaatggaggactggcagcacgcacagcaaaacggtatcgtcgactatatgctcgagctcaaaaagcaggaacgtttccgcgcgctgggcgtcagctcgcacgatccgctcgtcgcacaggaaatgatcagatccggcgtgttcgaggtgctcatgttcagtatcaatccgatatttgatttggttctcaaccgccccaatacgatcgattgccttttcagcgacggtcttggcgagtttgaccatatttcgatagacgaaaaccgcgccgccctctacaccctgtgcgaagaaaaaggcgtgggcatcaccgtcatgaaaacgttgggggcgggcaggctgctgaaagccgaaagctctcctttcaaggtacctatgacggtaaaccagtgtatctattacgcgctttcgcggccggctgtctcgagcgtgctcatcggcgcgcgcagcgtcaaagaaatcgagcaagcggtcagctattgcgaagcgagcgatgaacaaaaggattacagcgcaattttttcgcatatggcaaacgaacgggacggcgcgtgcatgtactgcaaccactgcctgccctgccctgtgaaaatcgacgtcgcttcgactacgcgccttttggatggagcgcgccagcacggcatgagcgatcccttaaagaccgaatactctttgctgccgaataaggcctccgcgtgcatcgcttgcggcgcatgcgaaaaacgctgtcccttcgcggttcatatcatacaaaatatgaaggaagcggcagcgctctttgaagcataaattttgaaataacaacaagacgatatgacagaaggaagggtaatttgccttccgagcctgcgcgcaggcttgcaaaggcatcggaatcaaatcacgccttccttctgccgcacattttttatggctcccatatatgtccatatcatatatgtcggcgccatttttagttacaattgcttattcttccgcaaacatgggcgtcgacaaataccgctcacccgtatccggcagcaacgctacgatcgttttccctgcgttatccggtctctgcgcaagctgtaaggccgcccagactgccgcgccggaggaaatgcctaccagcacgccttcccctctcgcgagttccctgccggtctcataggcatcctcgccttttaccgtgatgatctcatcgtaaatttttgtatcgagcacctccggcacaaagcctgcgccgatcccctgcaaagggtgcggccccgcgatacctttggaaagcacaggcgacgcttccggttccaccgctacaattttcacatttggatttttagattttaaatattcgcccgttccggtgatcgttccgcccgtaccgatgcccgctacgaaaatatcgatctttccgtccgtatcttcccatatttcggggcctgtcgtcttcctgtgcacctccggattcgccggatttacaaattgcccggggataaaggaattcgggatctcttttgcaagctcttccgcttttgcgatcgcgcccttcattccctttgcgccttccgtcagtacaagctccgcaccgtatgccttcagcaggttcctgcgctccacactcatcgtttcgggcatggtgaggatcgtgcgatagccgcgcgcagacgcgacgcttgcaagtccgatgcccgtattgccgcttgtcggttcgatgatcgttgccccctgcttcaatttcccctgcttttccgcttcgtcgatcattgcccgggcgatcctgtccttaacgctccctgccggattgaagtattccagcttagccagcagcgttgctttcagcccatgttttttctcataattgctgagctccagaagcggcgttttgccgatcaattccggtaaacttttataaatcattgccatctctttttcctccgttttatgcaagggcctgctcgaggtcgtacagaatatcgtcgatatgctccgtgccaatcgacaaacgaacggtattcggcctgatgccctgctgtaaaagttcttcctccgtaagctgcgaatgcgtcgtgctcgccggatgaatcaccagcgatttcacgtccgcgacgttcgcgagcagcgagaatatttttagcttgtcgataaagtcgcacgcttctttttcgccgcctttgacttcgaccgtaaaaatggaaccgccgccgttcggaaaatatctttcatacagttcgctatacccgctctcctgaagcgacggatggttcacgcgctctatcttcggatggtttttcaaatattcgatcacctttttcgtgttgtaggcatgacgctccacgcgcagggaaagcgtctccaagccctgcaaaaagataaaggcatggatgggcgataatgtcgcgcccgtatcccgcagcaggatcgcgcgtattttggtcacgaaagccgccgggccgaccgcatccacaaagctgatgccgtggtagctggggttcggatccacgaggctcccaaacttcccgcttgccttccagtcgaatttcccgccgtcaatgatcacgccgccgatggtcgtcccatgtccgccgatgaacttcgtcgccgaatgcaccacgatatccgcgccgtgctcgagcggccggaacaaatacggtgttgcaaaggtgttgtccaccacgagcggtatcttgttttcgtgcgcgatctccgcaaccttttctacgtcgacgaggctcgaattcggattccccatcgtctcgatgaaaatcgcctttgtattttcctgcaccgcacgcgcaaaactgccttcttcatccggatcgacgaacgtcgccgtaatcccatactgcggaagcgtatgtgcgagcaggttatacgtcccgccatacaccgtctttgcgcatacgatatggtctcccgccgcagccaggttttgtatcgtgtaggtgatggccgccgcgcccgaagcgaccgccagcgccgctacgccgccctcgagggccgcgatccgcttttcaaatatatcctgtgtcggatttgtgagtctgccgtagatattgcccgcatccgaaagattgaagcgcgagcgtgcatgttcgctgtcatggaacacatacgacgccgtctggtagatgggcaccgcgcgcgcatccgttgccgcgtcgggttcttcctgcccgacatgtaactgcaaagtctcgaattttaattccctgccttcaaaaacgctcattatttttctccttatttgttaaaacctatatgatctcgcccatatacattttttcatatgggcattccctattttcgtttttcgcccttacaacatcgccgcattcgctgctttgcagacttgcttttccgcattctttgcccgtacatgacgtcctccattccccacaaaacatattaaacatatatgttttatttgaatttgttgtttttatcttaccagagccttttttatttgtcaaccaattttttaatttattttctacgcatacgcagcttatggttttccaaataaaaaacgttccggatatccggaacgtttttgggccttttgtctttatttatgaatcagcttatccacctggtcatatacccattcctgctgcttacattcatagggcaactgtttccaatactggtcggtcatcgagtaaaacgcattgatcgatgcaaattcatccgtcagcacccgtacggaaaggtcgtccgacgggtggaaataagcgatcgtgttttccttgacccagatattgagattggaaataaaagacttcgagcctatcggcctaagcccaatttccactttaggatcatcctttactgttctcatgaagtattcaatttcctgtagcagaaacttgctcggtaccctgatcggcctgccaagcaaatacgaaaatgtcggcgcatccataatgacctgctcacgcaaatccctgatatactccgcgctgaacacaatgcgcgtcatactgtcacccgccagaaatttctttgtattcaccgtgcaattcctgtaaaactgctgtacttttttgacttcagccgacgaaagatcgagtgctataagtacatcgtctatcgttgcgctggaaaacgtaatgaacggcgcagattccgcgatcgcgtactggtccatactgtttgtgagataagtacccttatctcccccgcggaaatcggaacaaatatccctgctctccaagtggcgcataagctcgctgaacttatccatatggctttccaggaacatgtcgaactggtgcacggtcatcgggtcttcatacacagccgtatacatatttgcaggattgttgtcaaagctgcttcccacaaggacaagctttcccttgatgctgtaaatgtagtcgtaaaacggaatgtccacgtcatacgtatagtacgcatgcgaattcgtcgacaaaaacatcggcaaccaatattggaacatgttataaatctgctccgccggccggttcaaataaaacatcatggtgagctggtggtttttcttttccgcctcgataaattttttctgcgagacggtaaggtcactggtcagcgaatgaaaaatacgtgaatccgcatcgtatccccatacctgctccccgccagggagctttaaaagtacatcgaggaaatcgtgaatcgcgtcgcgtttgccggacggccccctgtaaattttataggaagcggaatacaagcttttgtccgtttccttttccttgtatttgtggtcaaattcttcggaaagcagccatgaagcgacgagggaatatatctcatctcttcccttgatttccgcattgttcatcgctccaaaaaagcgttccagctttttaagcccctgctgttcgttaaaatccaggatcgcattgacaacgtcctggaaataagccgattttgcatgcagttttgtccgcccgtttttccatctgctgatcacagtccggtcgacatgtaccgccccagccagctttgtcccctgaaggtagagcatatccattagatatcccagaggcgtctgagcatgttccgccataatcgttcccccttcagcgaagcccatatatttattaataaaccagattccttagttcgaacaatgatttacacatgttcaccggctgatatttgctccagataatctatgatatcccctatcgtaacgaattgttttaccttttcttcgtcaatctcgatcttgaattcttcctcaaaggcacagatcaggtctataaaatcaaatgaattgatattcaggtccctcaaaagatgtgtttccctgcctaaggtactgggatcgatgcattcatgttcgccgatgatctcaatcacgcgctgctccagcatttgtcttacgctcctatatgttccctcttgatttttttcgtcgtcgtgcgctcaaagtccgtttccctgatcttcacaccgctcacttgcttgtaagccggaagttttttattcagcgcatcaacgtccgcgtccagcttgctccggatatccgtgatcgcgtgctgcacgatataatcgcgatcaagaaaaacctcggccataatcctgtcgctttcgccgtaggcaacgatctctttgatatatggtatggcgcggaacgtttcctcgatctcctccggcgaaatattcttgccgtttgaaaggatgatgaggttcttgatcctgcccgtcacatacaaaaaaccgtctggatcgagacgcccaaggtcgcccgttttataccagccgttgtcaaaagcttttttggtttcgatatcgtcttcaaaatatccaagcattatatttgcgccgcgcacgaggatttccccttcgcccgtctcgtccggcctgttgattttgacttcgttgcaggaaagggccacgcccacgcttttgtcgttataataatcattgcggttttccgcaacgataggcgcacattccgttacgccgtatccattcatgatatgcacgcccagttcccggaagcccgccgcgatcttttcatccaaaaaagccccgccgcagatacaaaactcaagctctccccccagtgcgctgagcacttcggcaaacaacttgcgccgcaaatcgatgcgcagccttctcagcgcgttgctcaccttaaggcctgccgtcagctttttatccttgcccgatttctttgccgccgcccataccttatggtacatggattccaggatcatcggaacgacaaaaagattgaccggtttaaattcctgaatatccttgagtatattttttaaattatcgttgataaaaatggtatatccggcaaatacgccgcaaagcacgtttgctgtaaaaccaaacgtatggtggagcggaagcataagcaaagacctgcccgtaaggttgatcttctgtcttgctgcgactgcatccgccatcaggtttgcatgcgagagcataacgcccttgcttctccctgtcgtacccgacgtataaacgattgccgccattttatgcacgtctaccgtatggtctaaaaagctacggtcgccgccttcgatcctttgttttccctcttcacataaagctgcaaagccgttttcgccgcaatccgccatgtttatgcataatttcaggccgccgccgatttcttccgcaatgtccctgtacttatcggaatagacgaggacgctgcaatggctgcgcgtaagcacctccgccacttcctccccggaaaggtccttatccacaggaacgatcacattccctccgtttaccacggcaaaatatgcgaccagccacgcataactgttttcacccagcactgcgatatgcgcgccatgaaaccctcgcgccaatagcgccgtcccaaacgcctggatatcttccttaaaatcgatgtagcttttcgcagccaccgatgccttcccgtcgcgaaacataaaagcagcagcgccggagtattcatgcgctgcatagtctaccagttccttcatgctttcaagcaccggcacctcgtaatcagggtaatttttcacggtcaaactccttcaatacgataatcaacttttttaactatatcatatccctgtattttcttcaattactactctgctcttttattcaaaatgccgcgtaaaaatgtcgctgtccgcaagaaggctttccaccgtttcaaatccaagccgccggagcagctctaccacatacggattatcgataggcgttgcgtaagtcgcgccgttcccatattcgtcgacatgcctcttaccatcttcgcggcccaggatcgccttaggccctcctacacaaccgcccacgcatcccattccttcatagaagtttgccttcgcctcccccgcaagaatactgccgatcatggccttacatgccggaacgccgtccgcatgctgggtatgcaccgtgatcttcctttgcggactgatccgttctaccgtcttcctgaccgcttcgcttacgccgccgctgcgcgcatagatcctgcccgcgcgcgacgaatggtctttgtagctttcttccatatcggccggatcgatcttaagcgccgaaagcatatccctgacttcctcgaaggtcagtacataatccaccgcgcctgcaatatctttttcccgcgcttccgcctttttggcgatacatggcccgatgaatacggtggttgcgtccggatgcagcgctttgatcgttcgtccgcatgccaccattggggaaacagaccccggcacatgcggcatcagttcatgataaattttgcggatcatcgcgatccacatcgggcagcagcagcttgtgagctggtaatccgattctttcacgatgttatggtcaaattccatcgcttctttgagcgtaaggatatcagcaaacaacgccacctcgatcatgccgtcaaagcccattttcttaaacgcgctccgcagctttcccggcgttacgttttcctcaaactgtcctaaaaacgccggagcgaccagtgcgtaggtcagtccttcccgctccttccgcaacgcccttaaaactgccatgatatccttgcttgccgtaaggcgcttgtccttgcaatgatcaacgcatgcacagcatcccacgcacacacgcgggtctattttgataccgccttcctgattgggcgcgatcgcgtcaaacgaacattcgtccgcacacgcgacctgctcttccggcgagcaaccgcaattgctgaatttccagatcacaggctgcttttccggatacagcaggcaatcaagctccgaaagcccttttcgttccctgcgtatcttctcgatctcctgcgcgcttcttccccggatgtccgcatcaagcagccttttatatatttcttcaaatgtcgtcatagtatttatattcccctatcaatctgtctttattctacattaaaacacaagcggccgcctgaaacaattatcttgctgccgctcgtatgctcttgttattttccgtggttacatatgttcgccaggttcacctgtcagcaccgctttttcgatgtcctcgattttatattcgctattgtgttcgataggcacccattccgtacgcggattaaagaccgcaacgagcgcaatcaccatcatggacagcataaagaccggatacagacaaatcgcacgcagcatagggcgtatcttccgtttttcgagtttcagcgtcaaaaatgccgtcagcatagcaacgccccagtttccgattgccatggcgatcaggaccggaatcccaaacggctggagcgccggattcaaaaacaacatagaggccgccgcaacgttaagcggcagcgcaaagcccgtcgccggtataaagaacatataccacagcaggtcaaaggccttcaggtctccgccgcgtatcgtcttgatgattcgcgaaaaatataaggggatacactgcataccaccgatcatccaacgaaaacgctgtttgatggatacccctgccgaactgggctgttcgtcatagaacaccgctttttttgcgggtaatatctttttccccgcgcaaatctgctggatagaaaattccacgtcttccgtaagggaataagttgtccagccttccttgcccagcgcctccagcttaaacgcgaaacctgtgccgcctaccatgctggaaaagcccaatttatggcgcgcgccgtggtaaaaacgctgcaacatcagccagtataccgaatatacctcgctgatccatgaatcgtggatattttttgtatcgcgatagccgatcgccacatccgcctcggaacacagcgcacggttcatttcagtaagaaaatccttagcggcaaggttatctgcgtcaaatacgcatactgcgtcaaaatccgccctgtgctcgctgagcagtcttcccaacccaaagtgcagcgcatatcctttaccgcgcttctccgcgtcaaaacgttcatagacctgtgcgccgtaagaacgcgccacatctgccgtcttgtccgtgcagttgtccgctaccacaaaaacgcggtaaccgtcttcgccgtagtcttgcgcccgaaggctggcaagcaggttgccgatcacgcgctgttcgttacgcgcgcaaataagcaccgcaaagcgatgccttttttcttccttttgcttcaattctttcgatggaaataaccccgcaaacgcggtgacagcaagccagatcatgatcggcgctgaaaacaccgacaaaataatcacgacccactgacagatggtaaaccaaacactcatacccattttcccttatcattactttcttacgacctgatcctattatatcagaaaaacaggcaaaactctttaagaattccttaaatctgccaattaaccttattcttcttcgatcatatggtccacaaataaaattccgtccaaatggtcaagctcatggcaaagacactttgcgagctcgtcctcgccctccaccgtaattttattgccgttttcatcaagcgcatgcacagtgacagatttcggacgcaacgtctttccaaaacgctccggcacgctgaggcagccttcctcgcattctcgcagtccgtcctgcttcgtaatcacgggattgaccagctttttaaggccgtcccccatatcgatcaccaccaaccgcttcaatatgccaatttgcggcgcggcaagacccagtcccttttcagcatacatggtctccgccatatcctcaaggatcatcctgatcctgtccgttacctccgttacttccctgctttgcttgcgcaggatgtcgtcgcctatgatgcgtagttttctttgtgccacgtttccttctcctaatcttcaaacaacggcgtactgaaatagcgttccgccgtgtccggcaatacggtcactaccgttttcccttcgcccagtttttctgccagtttgagcgcagccgccacatttgtgccgcttgatatcccacacatgagcccctcgatccgcgctaagtccttggccgtcctgatcgcctcgtcatcggtcacgatgcacacaccgtcgtaaatttcagtatttaggttttccggaatcaagccgtcgccaatgcccatctgcaaatgtgttccaatactgcctcccgaaaggatcgccgcattttccggctccaccgcccaaatcaccatatccgggttctgcgccttcaatacttcgccgatcccgctgatcgtgccgcccgtccctacgccgctgcaaaaaccgtgtatcggtccggatacctgttccaatatctcgagcgccgtatggtgcctgtgtaccatggggttcgcaggattgataaactgctgcggtacatatacgcgcggatcctcttccgccatcttcagagccgttttcaggcatttgtcgatacaatcgccgatattcccgtcgtcatgcaccatgatcacttccgccccatagtgccggacgagcttgcgcctttcctcgctcacggaatccggcatgatgatgatcgttcgatatccttttaccgcccccaccagcgcaagcccgatcccctggttcccgcttgtgggttccacgatgaccgtgtccttgcgtatctgtccgcttttttccgcctcttctatcatgttgtaggccgtccgcgttttgatagaaccgccaatattaaggccctcatattttaccagaacctgcgcgccgtcctttgccatatgctttaaccggatcattggcgtgtggccgatcgcttccagaacattatcgtagatcatgctttctcccatctgctgcccatacttttgatacccattattatatactggttttgtttatttggaaactcttttccataaaccgtatgaatgccatacttcgcaataaaaaaggctgcggaataaaccgcagccttttgaaaaaaacttatacgtccattgtgagcgtcagcaagacatcgttgtattttgccacctgccccaaaatctcctctgtcagcacggtacccgctgtcaggctgaacgttccgtcgccgctcgttacatcatttttcacgaccttccccagcaaatatgccttggactcctcttccagcgcactcggagctaccggagcgggttcttcctctgcggccggagccggcgtcattgccttaaacagcgcatcgctgcctgtctggtcgataaacaccatcttacccgcaagcgtcgcgatcttgtctccgctgtattcttcaccattgtcaagataaagcgtatcgatcgcgcctgtcttttcatcaaagctgaaatccgtgatcccgccgatcacattacccgtgctggaaagcactgtcgcccccaaaataaagaatcccttttcgatctcttccaaaatctctttcgattcatagattttctttgcgttatcgatggtcgaagtcataatatagtctgccccgatccccatgatgtttttggtcgcgatcgcacgaaatccatatccgctgttatccttcaaaatcaggtactctaccgtccgcttacccgcgtcgatcataaaatcctgtgcaatcccattctcaaggccttctttgatgcccattactttgagtcccaatgtctctgacgattttttcatttttctactctccaatccatatcttttctataaataacttatttgtttatttatcctgtttgctggtgccctcaaggatcgtacccttgatttcgtggaatacgtcgtgcgatatcttttcgctttttacgatctcaccgtctttcaggtagttgcggtaaacatccacttcgtatcctttccggccggtgatcgtcgtttttcgttcgcccgcgggcatatcgtccgtataaatgatttccggttttggtatgtcgacctctttcaggatattgttttccagttcgatatcgtattcgctaggctgtccaaaaatttcgactacgacggaacgctggtacataaaagccccaaggtacatcgggtattcgctggtattcttgattttcaggtccttatcgtcccagttgagcgtcgcatccagcccgatcggcaaataggcggacggccatgaatggtgcacccgttctacaatctccatatccgccagcagcgcggcattgtaaagcgtccccgcgacctggcagataccgccgcccagttcgtccgtgagctttttcccatccatgatcgccggtgccgctttgaaccctttttcagccgtgcgctcacccaccagttcattaatggaaagcgtttctcccggctgcaggataagcccgttgatggccttacacatcaacctgatatttacatcgcggttttcattatttgctgcgatcgtttcacagcgcccgattagaaccgtattttgctcgagttcttcttccgtcatttccggattgagcctctgccccgtcacattgacgtcgctcatatcgcccgcctctaaatttaattcaatttgcgcgcatacggcatccgcatccgccatggaaccaaccttgctttccgtataggtaaattcgtgagtcgacaaattaaatttcgccgttgcgtctgtgggcttggtatcatttttattgaggaacgcctttacgttttcttcaagcacagtcttatcaatggtaatactgctctctgcctgctgtccttcgtgtacgcggtcataatccgcaaatacgttgccgctccgcgaataatcgtaagcttccctaagcacctcttgcgcgttgccgctaacccccaggtcttccgccgtaaattctttgatgtcgccattatatgtgaccttgatcttgatatcttcaagatctttacgttctttttctaacacttgttcctgggcctgctttaaggtctgtcctccgatatcaaagccatttacgaccgtaccgtcggcaaatgcgtcattatccgtgaccttatgcatgccgccgtacgccccggtaaggagcagcgccgccgccagaatcactaccaacagaatattcagggcatattgttttttatcgttacgcacatttttgcgcttcagcttttccgatgccctcatttacttcatcttctctttcaaagtcattaatatgagccgcatttgctgcttttcctgcggcgtcatcaaatatcctgcgttcaatatcttgaataccttcttgagcgcgtcatcataaaagcccactttgatcagcgcgcgcaattcttcaatatccgcttttttctggtcgaacggtgtttcgatcttctccttcagcttttccgacgcgcggtttgcggttgcaagaatatcgtcctggctcgaatccacgctctcttcacggtccgcctgttcctcttccggccttccctgccctgcctgcactccaggctcttccgtcacttcttctttctcaggttcctgccctatatccgccttgacttccgcttcttgtgtgatatccgcatccgcttcagtttcagtctcgctttcttcccaagcgtcttcctgcggcgtttcttcttcatcttccttctctgccagaaggatttccgctatcaccggttcttcatttctttcccattcctcagattcagcaagacttacgtcttcgttttcctgtatagcaaattcttcccctgtcgcctcatctgcattctccggtccatgatccgtcaattccgcttcctcaatccaaacgctttcctcttcttcctgctgcagttcttccgttacatattcgtcttccatatatgcgtcttccgcttgtgtatcggcttccgcggcattgccttcttcctcatcgtcatcccaatcgtctgaaggcaggaacgcaaacgcttcttccgcgcccttatacgcttcctcttgttcctcccaagcgtctagagcatctatcccgtttgcaaacgtatccactctatccgctgccaaaactttctcttcttccgtctctgtttcttcaggcaatacgaaagaagcggcattttcgtcctgcttctctgtcggcgccttgacagcagacaattcttccgcctcacgcatttgcgcttccaactgggcatatgcttcttcccgttgtctttcctcttgctcggccagccttttttcctcttttataatgcgcttttcttcttttttctttttcctgatctttgcgtggtgctgggctgctactatcgccacatagacaacgactagtacaacgacagcagcaagcgctgtcaataaaaccaatttaaaattatcaaagagactgatgtaataatacaacaacaatccagctacacatcccagaatgaccgcaatgaccattcccagcctgtatcccggattatccctgttgattatacaagccaaaatcactccggtcgcagccaaagcaataatgataatgacgtttatgtccaaccagtgtctcccgctcttttattatttctgccgtacaatttttagaatacatatcaagaaaggtattgtattaaagtatacgcttttcatctactcccgataaaaatgtgtattctttttaagactttaacattttcatgttcctttgtcaagaattgggaggtacttgaaaccgctttaaacccattaaaaagcggcttttaccaaaggcaaaaaagaccgcagctccgcagccttttttatatacaattgtaaccgcctcaactcctgtggttcacggaatccttaagggacttccccgccctgaacgcgggtactgtggactgggggatggcgatcttcttcttggtctgcggatcgactcccgccctcgcggcacggacacgcggctcgaacattccaaagccaacgatctgcacgcgttccccgcttttcaaagcatctgtaatagaagcgagcagcgcttcaacgacagtctccgtttcgcgtttggagaattgcgcgcgctgtgcggcaacctcaataagttgttttttattcatatatatcatctccttacttatgacggtcactgtattgcccttatactccctgccgccgaatgttttttatggtcttgttattgctgtgttctcaaccaggcagccttccgaaagcgtagaaatgctcctgccaatatggggtatcgatacgagaatacccaataggctttccgcagtggagcatatagccattccctacataaaaggcgacatgcgtaaccggccaattcgcatcatgtgttccctcaaaaaagatgaggtctcccggacgcgcgtcctgctgccctacaggggcgcataaatcgaacaacccctgggcgttggtacgctctaaggaaaacacccctgaattgtttagtacccagcatacgtaaccgctgcagtcaaaggatgtctcaggtgtcgagccgccccatacgtacggcatcccaatatattccttggcttcggcgatcagggcaagatacgtctcgtcattgtaaagctcccctggataaccgttggtcccaccgtccgtcaaatgtatctctggccggtcatcgcgggtaggcgcggtgagcgacagctctcccgccgcgatatatgccatcgcaccgctgtccgccatcacagcattgaatctgccattaacattcgtcgcatatacgtcaagcacctgtccaatggcaacgtcctggattacgccggcctctgcttcgggcagtgcaaagagtttcgtatcacacaatacggctccctgctttacaggatttctagtgctgccctgctcttcaaacgctccctcaggcaaagtaaagggcaggcctgtgtctatgttctgcggtacctcgccattttgcggcagtataagcggtataccggtcgccagtccggttatctgcatgccaaaaatgatgcatgtggcagtaagggccgcaacagccttacacagttttttcctcttacatccagccttccagtccattttaagatacccctttagatttctaaagtaagcgccagcagcacgtcgctgtgctttgcagtctgcgccagcaactcttccgtaaggacagtacccgccgtgatgcgcagcgtaccgtcccccgatgtaacgtcctcgcgcacgaccttgcccagcaaatatgccatagattcctgctcgagcaagctgtgccgcggcgagctttcttcttccggcacaggcgttggaggcgtcagtatggagctgccggtgggatccaaaaacaccatcttaccggccagtgaagcgatcttttgtccgtcgtatgcctgtccgttgtccaaaatcagcgtatcgagcccgccggacttctcatcaaagctgaaatctgttacgcgccctacgatatcccctgcgctggaaagcgctgtggaaccgagtataaagaatcccttctcgatgacttccaaaatctcttttgattcgtacatcttcttcgcgttctctaccgtaggcgtcatcacataatccgcgccgatccccagtacgtcccctatagctatggccctgaacccgtacccgtccgaatccttcaaaatcaggtattgcacgctcttgttgcccgcatcaatcatgaaatcctgcgccaggccgctttccaatccttcgcgtatgcccatgaccttcagtcccagtacttcagatgcctttttcatttcttattccctcccgtttgtttctttaatatttgtatgatcgacttgagtttcacacgctcgtcgactgtatagccatactctttatacagcgccttttgtgcctttttcagcgccgcctgcggctgctttgcgctgatcaggcactttaatacctgcaactgcgccgcctttttgatctccacatcgtttgtatgcttcaaaacatcgttaaactgtttggccgcgtagatataatccctcttacccttgagcgcatatgcttgcttaagcgcgccttccaccacgcgctgcgtccataggccctcttcctttgtttcctgctgcggctcttttgctaccgtctttatcgtctccggtgtttcctgttcgttcggtttttggatacgttccgcgatgtggatctcctcccatgggatcgccttgcgcggcaccgcgtccggtacgctctgcatttccgtcacagcctgtatattgcgctttttctgcctccgtaaccgcagcgtcaatatgatgatcgctgttataaggataatgattcccgcccctacgcacaccagcaggatattatctgataaaaaacggatgaccggcgggctggtatcttcctctaccggcataagcggaacagcgcttcccgtgcccgcagctgtttcgcttgcctgcggggatgcagtcacggacggcgtaaccgccggagcagacgtctgctcggctgcctgcgttccttccggagtcggcgccatagacacctgtgtaccgaatgtaagcgtattaagctgcgcgaccgcaccgtttaaatactgatcgtcacccgcttgcttgtagatgagcgtcaccgtatacatgctttcgccataaaccgacgcatagatgcggatggaatatgcctctgccgtgctttcccctgataccatggatgcggcttgtcccgcgacctcatcttttccgagttccccaaatgtatatccttctgataattgctgcataagctctgccacacgtgcctctgcctgctgcgccccgtctgtttccgccggcgcgggcgttaccacgatttttaaggaatacgctaaggacagcaatccttgcgtcccgtccttcgtatatacgccggtcaaaaacgctacatccggttcaccctgcgcacttttgagcatcgtttcgtctgtcatgttggtatccgcaggcgtatagtaatacacattgctgccgtccggaatctcaatcgcaaacccctccgccgcatacggctttgcctgcgctgccgtccccgccagcaatatccccagcgcgatgatacatgctatgaccttttgttttccgtatttcttatgcttcattttctctcttctctgagcgcgagcagcagcacgttgagcttatgccgttccccttcgtcaagatcatagcccgcgttcagtatttggaatatctttttagtcgcttcttccttttggccttctttcacaatttcctgcaggatttttatttcgtttgttttggcgctgtccttttctttgaccggaaggccaagcactgtcttcttcacttcgttctgttgtccatctatagccgccacagctttgagttcttgctgcagttcttctgctggccacagtaccgggtcctgctgtgtttcgtccagcttttcctgaggcggcaaagcatccgcctgtggctgccgctgcgccatggcgacgatatccgcaagcttcatcagtttttcatcctcattcggtaattcctgtttttttgcttcccatttatctgccgccgtttttttgctgccggccttcgtcttcatatactgctgcgccaccgtgatacataaatacaacaacaccagcaatacgcttgaaagccctatactcagaacaatggtcgccgcgttcctaaagtaaataacatagaaatacagcaactgccccgccgcgtttcccagcaccactgccgccattgcgccgcgccggtatcccttgtccttcagccctgcgcataccgcgatcatccctatcactgccagaagcagtatcgttatcgtattcaaccgttatcctctcccgcttcctgtgccatctgcccttctcctgcctgatcctcctcttcctgcttctttcgcaggatcaataacaccaatatcacgattcccagcaccacgatcccaaggatcattgcccacatcatcgcgtccattcccatgatctttttgctcacgttgagctctgtgccgcttacgcctgcgatccctttgggcaggttgctgtccgttccctcgcgtacggcgaccaccgtcgcctctcccgtattttcgtcaatcttcacttccacgatcacgctggcgatccctacgcgtgctaccacgcgcaccgtgccatcttccccgatctcaagatccgttgcctggtcgtatgccagctcaaaatcactgctcgcaaggatgttcccgttgtcgtctttcacatagacagtatgcatccccggttccacgcttttgaaaatttcccagccattgctgttcgtacggccataatatacccttgaatgaagctccagcggcaggtttgccgccgcctgcccattcgtatacgtcaccttgatcgccacatcgataggcggcgcgctttgcataggcgcctccgccgcttgtatatgcgtccccgagaccgagggacttgcggaaagcgcaatagtttcttcaggcgcagaggtctcctcccctgacggtacaggagacggcgtaagcgtttccgttggcacaggcgcctccgtctccggcggcgacggttcgggcgggatatcggcgagtacaaatttaatatcgtccccatcatccggtatatgcagaacgccctgcgccggcgcataaccctgcttggtgattttgtaggtatgctcacccgcatataaatccttgagcaccgcatgcccgatcgcatccgtacgtaccgcctgcccctcgatggtcattaccgcgtctttcaccggcgcgtcgcgcatatccaccacataaagattcacatcatatttattacgctgcatcacttcagaaacactgtggcgtttgttttgggaaatacttatttctcctgttttatccttatgcgtttcatgtgtaagcgcgtatgtatattctccttgcgcaagctgcatggtcacctgccctttcgcgttggtatgcgctgtgaccggcacggtacgcgctgattcctgtcctttgggcgccactgttacaagcgtgcctccaaccggatcccccgcatcattcgtgaccgtaaaatccacgtacaccaggttgtccccacgggtcaggagtacttccctgccgacgaacgttcctgtaaaggttatctctatctcctcgctgtcatagtacccgactttggttaccacaaatatgtacttcttgcccgatgcatccggcgggaccggcagtttaacgcctgcctgtccgttttcgtttgtcaccgcaacagcgatactatccacattctccggcaccgtcttcacgactgcgccttctacaggctggcgtgtcgccgcgtccagcaccgtaaacagcagtttgttcagcgtatccgtttccacggtcaccatgactccatcctcagcctgtccttccggccctgcctccggcgcaggcgcggcaaaacacacgcccgtaaaaagtgtggcgagcattgtaagtatgatgatgactgctgccgttttcttcatgtttatcctcttcttttagttctttacgataatattcagccgcgcgcctgccgtgccgacttccttcttctcatctatcgtgtaggccgtgaaaactgctgtcgcgggatatacgccctgttttaggctgcgtaatagctttgcatcctcaacaaaataccccggggaaataaggcctgacttgtataccgtttcccctgtgtcgtccagctttatttccactgcgaacgcatagctgttgcccgggatgttttcaatccgcagattgccctccgactccccgttttcaaacacagggtttgagttgatggaaatgttcagcatgctgtccgctacgatcgtattcagccgttcgcggatctcctcttcgctcatgtcgggtaaaattcccatctgcgcgttttcttccgcgatgatatcctgttccttttgctgttcctgctgctgcggcgcccatacgaacacatacagcagcgtcaaaaggatcgcggccataattatgatcagcaccaccagcaacgtccgatttccttttttctttcttgtctcttccatctcttttccctttatgccattacagtgagcgtgatttttgcgcccgcgcttcctgcttccagctcgctgtccgcttcgatcgcatggaatgtcgccgtacatggatagattccctttggcagaggcctaccaagcgttgccttttcgatgtaatatcccggctcgatgatccccgacgaatataccacttcccctgtgtcgtcccgcgtaatatctacctgcatcaggtacttgtttcccttgatattctcaatccccaatattccttccgcgcttccgttttcaaaaaccggattcgaattgatggatatgttcagcatcccgtccgctacgatctggttcagcgccgcttccacatcctcccggctcttgtacgaaagttgcccttccagcgcgtttaggtccctctgcgtctttgttttgggcaatgtgtcaaatacgccgtttgcgtataacagccccgccaatactgccaaaaccgcgacgatcaccaccgccacgatccagccttttttcttcttttcagccattttccttgcttcctttgcttgtctttccctcgaaaaccggatttgcacagggaacgccgccgcatgttccccctgcaaaaccggctttcaccggttttgcgttttccgtcacggagttgtcggatccgatgcgtcaaactgcgagatcacgatctcgatcttgaatgcgtttgttttgccgtccgtcgtgtaatcctttgcaatgccgcctgcctgcgcgtcaatgctgatgggcgcgacgccgtccttctcgatctcaagcaacgcctggtcggtcggtacgacgcccaccgtgccggagcttgtgttcgccagcgtaccgaacgtcgcgccgcccattgtaagcagcatctggttcttttcagcagcctttgcatccgacgggtcgatcgcgtcgttcagaccccacgcgttcgttgcgcccgggtttgcgatgcgtgctaccatcttgtctaccttgatcttgtacgccttcgcctgctgctctgccgtccatccttcgtccccgccggacgttgtgtttgtgatcgtcacgcccgaggtcggccagaatgttttcggacccgcagttgtttccgagctgtcgccctgcaccaccagcgggatcacgatcggcaccgtcgccgatacgttcaccggcgctacctgcgatacctctaccgtcaccagcgacgacgagcgccccggctccgatcccatgcctacatccggcaccgtacctgctgcaaagcccatgcccgccacagacagtaccatcactgcgcacagcgcgatcgccactatcatttttgtctttttcatcttctttctcctttcacttgagaaatttatgtttttaggttgcccttaattaaggcgatatatatgaacagcttccgctgttttttcctcagttcagcacatagatcgtgatcttcgctcccgccgtgcctattgcttccagcgtttccggatcgacagccgtaaaagttgccgtgcatgggtacgtgccctttccaagcgccattcccagcttgtcgttttctatatactgcccctgcttgatccccttggattcgtacaccgcttcgcctgtgtcgtcccgcgtgatcgttacggtcatgtaatacggattgttcggcacgttctcgatacgcaggttgccttccgccttgccatcttcaaacaccggattcgagttaatggaaatattgaacatcccgtctgccacgatttgatttaaaagcgcttcgatatcctcttggctcttgtcctttaaaaagccgtcccgcgccgcgtcgtcgaggtcgaaccgtttgcttcctgccgatatgttctggtagatcagatagcctgccaccgcaccgatcgcgataataaccacaatcaggatgggtacgatcctgcttttcttttgtttttccttgctgcttctttccattccctgttccccctcatgccttgtcgaaccggaacgtattcaagtattccagtttctgccccatatgctgtgtcaaaaatcccgccggcagctcagagccatatgtaaaacacctgtcttcaaggcccgggacctcccctaagacgatcgggctcgcttcgcttgcgttacacacatatcctgcaccgtccggaaaatcaaacggggcacgctgcccttccggccttatggcctggagcgcaatactgttatcgtccgatggccctgcgacaagcgtgatcccatgcgtcccgttccgggcgtcaaatcccacgatagataccttcaccgacgttccggtgtcttcgttgttgttgtatacccttaccgctggcgcggcataaatttttgccgcactcccgtaaggcgccgccacaagcgggattttaagcggtaccgtcatgtcgaggatatcgcttgacttcacttcgatatctatcacgccgtccccatccacatccacgccgcccgcatttgcgcgcccgacataaccgtagaccggcacgtcgtccgcaaggtttacggggtcgtccggcgttgccgccgtcgcttcgctctgcggcgtatccgtaaacgccggcgcggccaaacatgtgccgcccagaagcaccgccaatatacttaccagtatcatgcccaccagctttttcattcctacctctaactctgcactgtgattaccaggcctgcggctgtctgccccatctgctgcttggtatccggatcgtatgcatagatcgttgcagtcgccgagtattctcccttttcaagcacgatatccagtcggtccgtatcgatgccctggtttgggaggatacccttggtttcgtatactatttcgcccgtatcgtccagcgtgatcttcacgctcatgggatacgcgttcgtcgccggatttccgatcatcaaggcgccttcggatttcccatccgcaaaaacagggcgtgaattaatccggaacgaaaacgtgctttcatccacgctcctctgcaattgcgatagcatgttctcttgcgaaaggccgcttaattccccgtccgtagcgcggtcgtccgttataaattccgcaggggcgcggccgccgaccacgcctgtcagcaaaagtcccgccgctactgccgcagccagtatcacaattatgatcacgatcagtgctgtttttctttttttctttttctcttctgccatactcttctctctttatgtttcccttaccgcgtgtccgttcccgcgtcagccgctttgctcaaatttcagcgtcatggaaaagcctgcccgcagcgtcggcatatccgtccacggtttgctgaagatgttgtagtttggcgtatctcccgcaaacgtaaaccgcccctgcgcatttcccgtgccgccgtccgtatccgcatccatcaccccaagcaggacaggcgtgaacgttccttccatgtttggtaccagcgcgcttctttccatgcccgcaaacgctccggcattgctgcccgcttccttcacatacaacaccagctcatccattgctagcacgccgcccggctctgccaaattgaattcattcctgtcgccgccatagcgcgtcgtgtccgcaaagcctgtaatgatcgcttttgttttcataaactcgctgttgttttgcaccgtataatccggcgatatgaacccgccgccaaacgtattcggcagcaccgcaaacatcagcttcactggcaccgatacgttaagcacgttgctttcgtcgagcgctcgcttctcgctttcgttgcctgcgccgtcctcagcacggaccatatgtactgccgcattcgggtcgtacggtgtttcaaacgaatattttccgtttccttccggcgttgcactatgcgtatacggctcatttcctgctttccactgcaccgtcgcatccacaacgccgcttccgttatctgttacgcggaacgtaaccttcgtttttccatcacctacatccgtaaatgccacattatcaatgagcggcgcaaccgtatcgatattggttaccgctatacctgcgctcaccgcatgctttccgccgtaactttgcgcgtgtacgtaatacgtaccttcctcaatactgctttccgtttcgtatacatgccccgccgcgtccgcaagcttcatttccaccacattttgcttaccggcttcgtccgtcgagcaccatacgcgccgcattgccggccattcgtccgttacccgggcgcgcaccgtcctcgactgtgcccacaatgtatccgcttgcgacggatactgtccttccgcagcgatcaccggcggcgtttccgttgcgcgttcctccggattcagcgtgacctgcggataatccgcagccggcgtggtgatcgccgtatacgcatttgcatcgagcccgaaaagtacgcccagcatatctgccgtttccttcttttccgcgcctgtatctgttcccgcagcgtttcctgtccccgctccaaagcccgtgttgctcacgccactatcccaatagttgtttacaagcgtcgcattccctttgtttcctgcgattgcgcctgtgtaatttccatctgccgcagcctgcatcattcctgcattgtatgtattagaaaccgtggccgcaccgtttccggcgttacccacaataccgcccaaatattgtgccgcatttgcttttgtcgtccttacgctgcccttgttgtagctgctgcgaatggtcgccgccacattcgcgatactgcctgcaataccgcccgccgacgccgatgcttgtaccaccgctcggctgtagcagccttcgatcaccgttcccacgcctgttaccgttcccgcaatcccacctgcgtttgtgcctgttgccgtgatactccccgtaacgtcgctgttacggatgacggctgcacctcccacattacctgcgataccgccgatgttgcttgcgcccacgatgttcacgttgcgaatattcacgttttcgatagctgcgccggatacatagccaaacaatcccctgttgcttcccgcgctgatcgtcatatttccaatcatatacccgcttccgtcgtatacgccgctaaacgggatttcgctcgttcccaccggcacccacggcgtatcctccagtacaatatccatcgtctggatatgcagcgcatacggatggttcgccatatccgccagtcccgctgcgtccgaaatgtaatatacctgctgcctgtccacattttggatgatatccggataaccgtttccgcttgcttcatatatgctttccggcaaaccgaacaggccgccgcgcatctcatgggatgtcagttgcctgacctgtgcaaccgtttcgccggatgcgctgccaatcccttttatcgcattgcttgcgtcactgctccaataattgttcgtaacctgtgcgccgcttgccatgccgccgagtacgccgccgaacgtgcctgaactggtcctgacaagcgtaccgacgttgtaacagttcgtgaccgccgtattgttgcccgcatatccgcaaacgccgcccgatgttgcgttgttgatggacgtgcttgtacgtaccgcgcccttgttccagcagccgttgagcgtcagccgcgacgcagcgcttacgccgccgtccagccgtccgaccacgccgccgacatacggtgtggaagtcgcgcccgacgcatctaccgcagccttgttgtagcaaccttcgatcacgctcgcgctcgtatccgctgacccaatcagcccgcctatgcgcgcataggtcgcgtttgccgcactgaccgtgccggattccacgctgcagttggtaatgcctgtcgcgccggtcgccgcgtcgatccgtccgaccagcgcgcccacatggctcgttcccgctacgttcacttccgcaaggtgtatgtctttaagcgttgccccgctcacgcaaccgaacatgccctgatacgtcgttcccgtgaccgtaaggccgctgatcaggtatcctccaccgtcatagctccccgtaaacggcgttgccgcactgcccacaggcgtccatgtcccgctcagcgtaatgttgttgagctgcacatgcgccgcatacggatggtttaccatatcccttaaatcttcttccgtacggatgtaatacacgtcgcccgcatgcctgtccggattcgcgcttaccatcgggtaccccgcgcttacaaccgtatatccggcatcccctgtcggtaggccgaatgtttttcccagcatatcgctgtgtgtcagtttggttgtctttcccgcttcgtccgttccgttaccgtccgccgcgccaatgccgtatacaacattgctgcccgtcacgttccagtaactgtttgttacagcgccgcccgaaagaccgcccgttaccccgccggtatatacgttcgcgtttgttgtcacaggcccgcttgcatagacatccgaaacagaagtgttttccgtcttgcctgctacgccgccaatatattctcccgtgccgcttacgctgcccttgctgtagctcactttgacggccgaaggatcacttgcgctgctgcccgtgatgctgcccgcaagaccgcctgcattgcttgctcccgtcacatttgttttgctgtagcttcccgtgatgtgcgcaacgcatccgtcgccggcaatgaccgcgcccacaagaccgcctacattgctgttgcccgtgacgctgcccgtcccgctgtcgcaattttctattactatgttgcccttcgccaaaccaaccagcgcgcccgcgttatctccgccttttacttccacgttttcaagacccatatttttcagtgtcgcgtcttttgcaacgccaaacaatccggtgttttccatgccttccgcgcgcaggccgtaaatcaggtatccgccgccgtcatagctgcctgtaaacggtgtgtcaatgccgcccacgggcgtccatccgcttgtcagcgtgatatcgtttttctgtatatgcatcccgtccggatggtttgcgatatccagtaaatcctcttccgtataaatcaggtatacgccgcttgtttgcagcttcgtcacgttgcccgctccatccgttgcggtcagccagtatgccccgccatccgttggtaccgttccttcaaacacgccgcttccttcggatgtttcgcgcatctgcgtccccgcgccgctttctgtcctgctccatgtcaccttcgctacgccgctcccaccggtgtctgtgaccgccacgctcaatgtgcccgtgctgtccagtgtgtagcccagtatctccggcgcgatcgcgtcgatcttttcaagtacgatcggcgtacctgtcttgtttacattccccgctttgtcgatcccgtatacataatatgttccctgatctgtgattgctgcgccctcccagcgtcccagcgacgcattccatatcatatccgtccctgaggtcgcattttgtgcaagctccgaatagaacagtttgagcactcctgtttccgcatccagcgccgttgcaccgatcttgcgcgattgttcccatgcatcgttatccggtatctggaaagcgctttttatgaccggcggctccctgtctgatttcagtccttccgtcgtcccgtcgaacatcacgatgtcacttgtcgttcttgcttgctcgttttcgttccacacatacagcgcgtagttttcaggatgatccgctacgtccgccggaagtatgatattgatcgttccatatccgctcgcgtccgttgccgcgagacgcgcaggatatttctccttggtattcttatttacaagcagtcccgcgatatatgtctgtcctgcttcatagctcgcgcttgaatagcggatcgtaccttccgtatgtcccttgaggtgtgagatttgggctgtcagtacgccgttgccgccgcgctcaaacacgcggaacgactgattgtcactaccataatctaccgtattgcttgccgccgctgttcctaccgctttggttataatacttgtcgtaaccggcggtgctgcgcccaaatttccggaggcagtgaacaccactttggacggatcgagattgactgccggacgtacgccgaatggggtattggctacacctctcgcctcaacaactccacttgaagatacagaatatacatcataattacttgtggatagggatgtacctgtccaccatctgccatactgtccggtgacctctaaagtgtttccgctccatgtgccggcaggcactcttgtggccgcgctatatggcgcaagattcagtcccttatattttgtgttggtcacatcttccatgcttggtgaaaatacttgatcgtaaacttccagaccgattccttttgcagttgtctgtgcaggcaaataattataggtcaaaagcttcttttcccctgcatcaaatgtgctttcgccatctgctcccctgtttaggaaccctccccacaatgtctctgcacccgagccaaaggtcttatttgcctctcgaccctgcatactgtttaaccacgctcgcaagtttccgttgccatcgttatctgcataaagattgttattgtttccgtcctgatatgtacctgctgctaaaatacgttcggacaccaaatatacatttcccgtcgtgctctcgagcgtcctccaaatgattgggctttcatcgtttaacaaagctgtctgcggataatgtccaaaccataccatcgcgcggctatccgtcgcgctgccgcctacgatcccgtcataatatgtgctcacatccgtcggcaaaaccgtcgataccttgtccacatacacaggcgcgcttgcacggtttccgcccgcatcgatcgcgatcacgtaccatgtgccgtttttacctacgcccgtttccgatacgtatgtgcttcccgtagaaagaggcatattgatacctgtcgttgcgttcgggtctgacgcgacgaatacccgcgcgccgtccgccgccttaaacgccacatccgcctgaaccttgcgtgtattcgctaccgtattatccacctgcttcgcgttcgtgatcacaggtacgtttgggttgttgatattatccaccaccaccgcgccggatacgctgcggttgcccgctgcatcgtacgcgatgatgtaataggttccctcataatagatgttctggctttcccatccgttgccgctgcccacaggcgtcatcgacgtacctacgagcgcgtttttatccatggaaacaaacgcgttcgtcacgcctacgttgtccgtgatatccgccgctactttcttcacctgcgccgcgtccgtcggctgctgtacttcatttgtaatgaccggcggctgcgtgtcttcgggcaccgtgcccacgtttatactgaatttcaccggttcagacgctttctgcgctgtttcgtcctcgttccatatgaacgccgcgtagctgccatctggcacgtccgcagggatcacgaattccgcgtacccattcgccgtcgtaatcggcgcgatccgcccctgccattttgccttgctcgtcttgtccacgagaagcatattgaaataattatgatcgcttgctgtcgccccgtagtaatccacgcgcaccgtatcgcctgcatttgcgtctaccgtacgggaattcgtcgcgcccagcgtgatgttcatatcccgctcgaatacccgcatggactgcgaatctgccgcataggtcgtgctgtatgatgtcggcgctacacccgtcacttttatcagactgcctactgtagtcggcgtaccgccactgctacttgccgccgtcaggacaattttgaaagaatcgaggtttgttgcggggcgcgcttctatgtaataattgtcaatattccctgtccccgttattgccccatttgaatttacaatatatgcaaatccctcatatgtgctcgttccatttccatataccggtgtcctggtccaccaataacattctgccccgttcgcttctgtagccgtgtgccttgttttacggtctgcgtcatcagcaaaatatttcccattgcccgcttccgccaatgacagagcaaaaaatttgtcattcgtcggcatacctatatagatggctccttgttcggccgcttgcgcagtatttaaaacatatgctttttgagtcgtcgagaatgcatttgtaaagccgttattcgtgtaatcttcggtgcggccctgcagagagttcatccacgccctgatttggcttgtgccaaaaccgctcagccaaaattgatttagaggcacgcccaaatcaaatgcgaccttctttactccgtattccgttaacagcattgtcttgcccgtgccgctttcaagagtacgccaaaggatcggatcagcgccgttcgttgtattattatcctgttccattgagccaaaccagaccatagcgcggttattaacatcgagcgtgccccccgcgttggaaatcccgtcataatattgcgagatatccccgatcgacgggtcttctgtccccgtgaccgtgattttgaatggctccgcgctgacgttgcctacgttatccaccgcgtagatgtaccatgtacccgcagggatatacgccgtgtaaagattcgtgtccgccgtacgcgtgaacgggatgccatccaccgcgttttcatataactggctcgcgaacacacgatccggattcacgccgctctggctgtccaccacctgcgcagatacctgctgcgcgttgcccgcctcgctgcctaccatcacattagaaatattcggcgaatatttatccacgtacagcgtgaacttgaacgcactacgcatccctgtcacatcgtatacgatcaggtatttctgcccgccgttcaaccagtcgtcttttgtgatctcgtaagtattgtcaacgcctgcttttttgctcaggtatacgttgtttgctgcagacggttccgcgtcgatgctgtccgcaatatagatcttgctgtcatccacgtcggtaccccgcgccttgacgaccgcttccaccgtcttttcgccgtttgtccagtcttcgttcacagcgctttgataaaggttcgtaacactcacgatctccggacccatctggtccagcgcatacatcataggctcgctcgtgttcctatccgtttcgctctcgttccacacgtatagacgatagccctccgcgcccacattgaccggaagcttgatcgtcacgctgcctgcttccgccgtgaccttcgccacgcggcctgtccatttatctttcgtttccgtgttgacgagcattgcggcaatatagttttcgcgcccaaacgtcgcgcccgtataatcaaacgtcatcgtatccgcaccgccaaagcctacgcctgctgtcagtgcgatctcctgaccgccgcgtgcaaatacgcggaaggactgactgtccgttccgtatgtggaagcgaacgaagaaggtgcgtctcccgccgctttgacaagcgccgtatcctcgcccaatatcgcaggcgcgccgccgctgttcgaggacgcggtaaagatcacggtcgacggatcgagcgtcagtgcggggcgcgtcgccctgcttcggtttgaatcataactgcctaccacgccatccggcccaaccgtctttaagccgttggatttagccgtatccggcgtactcagccagtatgcagaatacccgttcgtcaccactgccgccgtgcccgcgttggttccccatatattggaatagtttccgcttgttccgccattatttgccatcggcgttgagatcgcttttctttcgctatccccgcccgcaaaatatgccgtatcctgcgcgtcggccgccgaaagcgcataaaccttgtcaagcgccgaatattccgccccgttgttgccgtaagagccgccccatgcggatgcattgcccgtttccgtcgtgatctttgtcggcaggatcatatccttttccgttgtactaaacgcattcgcgtaaaatgccggatacgccgtatcattggtgatatagcggctgtagctgccatccgtcaccatacccgcgccgccgttcatccacgcgcgcaggtcggagcttactttgttcgcgttgttgtaccagaactggttgtaattccccgtatccttatcaaaatatgacgtgtaaggcgcgtactccgataacagcgtgatgccgcccgcgttagattccagcgtgcgccacagcatcggttcgtttgccgtcgcgctcgcgcttgactgcggccacccgccgaaccagaccatcgcgcgcgcgtttgtacctgtattactgataatcccgtcgtaataggtgctgatgtcgtttttggataccagctcgatcttatccacaagcacacgtacttccgcgcggttgccgtcaacatcgtacgccaccacataatagatgccgttctttttcagcgcggataccgtccggtaagcgtcccccgtccctgccttttgcatctgcacatcgcccgtttccattccggtcgagttgtcgcgctccgtcacatatacttgggctaaatctgcgctgccgcgcactacgtccgcagtaatattcttttccgctttcagctcgtccgtttcctgttttgcgttcgtgaccaccggcgggttcccgtcgctcatcccgatgtccgatacagggatcgcgcccgatacgctgcggttgccgaaaatatcataagcgatcacatagtatgtatcgttcgtatacagcgtttggctctcgtagatattgctgccgtttgccgtcatggaaattccgcccatggcacttggatttgtcgccacaaaaatattgctgatcccgcttgcgtcgctcgccgtaaccgtgatgttcttggtcggcgcttttgtacccgccgcaggggtctgtacgccgttactgagagccggcgccaccgtttcttccgtctgcccaacattcaccgtaaactttgccggtgcggaggcctgttgtttctgttcattttccgcccatacgaacattgcgtagctgccattcgcaagtctcgcgggcagcgctacgcgcagcgtcccgttttcacttgtgattttctcaaggcgcgcctggtatttttcgtgcgtcaccttattgacgagcagtacgcccgcataaatatccgcgccaatgactgatttggtcgcaccttcgtaagcgatatcgagcgtatcccccgccgaagccgtgcgaatattcccgttgaccttgccgatcttaaggctgtcgtccgttatgcgttcaaacacgcggaatgtttggctgtcgctgccgtataccgtatcaaaagaggacggcgcggcgcctgatgtcttggtcaatgttccgtttgtccgcggctgtgtaccgtcgtttcccgccgccaccagcatcaccttagagctgtcgaggtttgacgcggggcgactcgcgacatttttagcagctccggaaaatcctgttgccagggttcctgtattgctcacaccatacaaggtatcataatagcttccataatcgggcaacggcgtgcgcgtcggccacgaattgaccattcctgaatcttttcccgaccaattatataagccgcttgttacagatggtacagcatacatcactcttgcagcgtcgtttccaaaatatttcaaatttccagcctccgcgtacgaaagcgggaataccttgtctatgacagttacagccgtcgcccccctgcctgtttccgcagggataatggtatccagtatgaagtcacgctgcgccgcgctgaacactcctgtatatacggaagggatttcgctgccgtcagtgttagtataaccgccactgctaaaatcaacgtcattcccattcagcccgttcatccatgccctgttgtttgcgcccgtcgtagtccccgtcgcatatacattctgggttccatccgctttagcgggcgctccgccgccaatcccgtactctgaaagcaggaacagttccttgttgcccgattcgagggtgcgccaaagcacaggcgattccttttcgcccgtttggttgtagcttccgaaccataccatcgcgcggttgttttctatgagcggcgctgcgcccgcctgtgcgccgaggccgtcccaatactgcgagatatccccgatcgacatatccgacaggttcttcaccgtaaacggtaccggctccgcgctcacgtttccgacgttatccaccgcgtacaaataccaattgcccgccgcgaggtcttttacaaaatatgtgatcaggctcttgtccgtttcctgctcgttcgtcagctcgagcgctatgccgtccgccgcgccaagttcacgcgacgcgtagacacgcgcaacgccgctctgcgaatcgcgcacctttgccgtcacatcctgcgcctcgccgatattttccgtgactgtaatattttctaccgcaggcgaatacgcatccacgcgcgattcaaattccgtccatgtgggcgctccgccgctgttggaatcttttgcaaccacgtacagcttgccgcccagcttaagatcgttttccgccgtcgtaaatgtatccgtccccgcgatacgcgacatgggcaccgcgttggctacagcaagcgggtcgtccgaaatatatacgtttgtctcgtcgatcacgcttgtaccattcgccttgatcgtcgctgtgaccgtcttgccttgcgccggactcgtccaatagcccgggtattgctggatatcgctgatctcgataccgtcagagatcagacggatcatggagtcggtgaacccaccgactgtccctgatgatgttcccaccttgtttgtataaccaagggaggatgtaaatgtatttcccaaaaccctagtcggtgttgtggtcgcagaaaaccaacctataaacccacccgcataagtggctgccggttttgttccggtcagtaaagcgtccgcataacaattattgatggagcttgctcctgccggtgattcatcactccccataaagccgcccatcctgactgttgtcgcgccattttgctgcaaagttgttccttccaccctgcaattggtcagattactatatgtcgggcctaagaccccccccattttaatgctggcaccgcctttgacagtcacactaccgcctttgaccatacaattgatcaaagaagatcttacacttgcggaagtagcgctgctccctgatgcaaatccaccagctaagccttcgtaggcactacacgtagctgatactgttacattttcgacaagacaatcactgatatacgcattatcctgtatcattccgacaaaaccgcccgctctcgcataggttgttccagtacgcgtgttcgtaaggtttacggatgaatccgaaacactgcaattccttacgtccgctcctgcgttaaggcacgcgaatagccctgcggcgtaaagatccggaacactattgcccgaatatacaatgtcaagatcagtcacatggatgttgcgagccgtacccttgaattcaccaaacagtccgatcccataacaattaccgtttcttatcgtgacaaattcatacgtcatattctgcccaccaacaatggcatggtttccaccgtcgtacattcctgtaaagggcgcggcgtaagtgccaaccggcgtatgtgccgtgttgtccggtatcttccagtcgcgcgactggtaatatgcgcgcgaaagcgtattgcctaccgtgttgcctgtcgcattgccaatatttttgaatacgtcataacttgaaacatcgatcatgccgacgatattcaccgtatttgtatacgtcgccgcaccgtatttggaatattccacggtgagcgtcgcgctctcattaccgttttcgagcggcacaacctggcacacattgacgctgtcgccgactacattcgaaagctggaacttcgggttatcgatgctccagtgcgccgtataacccaacgcgtccgctgcgccctgcaccgtgtagtccttgtccatctcctgtacgttgatggatgtaacggagggttggggaacagagaggactttaatttgatcatccgtaaaagatgatacgcctccagccgctcccgcttttccaaaaccattgtctatgcatacattacctgtaaaattcgcagcagtaaggaaacttcttccaacaaaaccacctttatgcgaatcactgctcgagactgtgattctgccgtatcccccgcagttgataagctttaggccgccgctatataccgttgaggaattaattgccccaacaaacgctccaactgtgtttgttacagaatttgtccctgcttcagccgtaatggaacctgttgcatagcaattttccgtcgatccgtacactgttgttgttgaatttgccgtggaatacagcctccccacaaaacctccgacaaatgaaccggacttgtccatattcgttccgtgagatattacggcggcagagctgtttgaatctttacaataagcatccaggatcgagcctacaaaaccggcaatataattgtcatagcccatttgactttcaaccgtgccgccgctgacaatactatttgttatgcttgcgctgtttatagcagagcccgccattcctccaagcgctgaattaccgctgctttgcgagttgattttcaaattctcgacattgcctcgatcaatcatcccctccgcccccgaaagaaggcctgttaatcctcctattgtcaactggtttgttgatttgttcacagtaatcgacgaactcttgatcgaaacattatgcacctttcctctaacttctgccgcaaagacaccgatgttcattttttcggttatgctggaatatagaattacaacattatcgacagctagattttgcacctcaccatcgaactcgccaaacagtcctgtccccttccaattaccatcattcgtcccaaatatcgacacgctgttccacatcatgttcctgccgccggtgatcgtacagttattcccattgtaagtccccataaacggcgcagaggcgtcgcccaccggcgtatgcgttgtaccgtccggaatcttaaagtcattcatctgtatatatttgccgtcaagcggatagagcgcgtctacgccgatcttcgcgaaatccgcataggaatagatcgggatccagtcgcttgccttgacttctaccttgaccggcgtatcgctgtagtttcctaccttatcgatcgcgtaaatataccatgtgccctcggaaagcgcgcccgaccaactgtcacccgctgcaacgcgcccaaaggccgttgaacccgtatcctccggctttgcatttgttgcgttttggctggcgtacactttcgccacgcccgattgcgaatcgacaactgttgcgctcacattaagaccgtcctgcgtcgtctgtgtctgcggatcactgatacgcggcgaataaatatcgcgcaggatcgtaaacggcgcggaggagtgcaccgtattatctgcgttctttgcaatcacatactgcgtcccgctttccataagccctgccgcctgcgcaagctcgtaaacgccgtcgtctgaggtgacgcgcatattcgtcccactggtcgccgccggatcggacgaaataaacacgctgaccgcgtctgtcatgcccgcgcccttagcgacgtttgctttcacgccgactttctggcttccgttgacccaaatggtatccgccgccggatcgagcgtgatatttgaaatcgtgatattattgtcgccgatgaggcggatcatatcgtcggtgatgttcgcgtcaagcgtcgttgacaaagtaccaaccttatttgtgtatccaacagatgaaccaaatgtattatccgcaaacgccgcctgcgcgtttgctgttgtcataatatggtatccaataaatccaccactacgcccgaccgtaccatttacgctcgactgggctgtagtactgcaattcttaatcgtctgccctgccgaatcgctgtcgatactgcctataaatccaccgaggtttgcggtggctgcaagtttccctgcaagagaaatgatcgttccgtcaacatgacaattatttatgacaaacttactgttactttctccaactaagcctccaattgattcaatagcgatagcactgccattgatcgatacatttcctccactaacggaagaatcgtaaatctgcgcgccatattggttacaaccaaccaatcctcccgcaaacgcgctgtagctggcattattgaaatcgactttgacatcgctgttctttgccgtacaatttctgatgatggaattgacgtcatgcgaaatacctaccaacgttccggcttgaccattgtttgtactggtgtatatttcaactttggagtcgctgaccgtaacgttttccacagttccgtttatcaggtcgccaatgacaactccgccccaatttgtttccttcgacgtgttgacgatacttacatttttgacattccagtttttcagcgtacctgtgaaatgcccaaacagccccattgtataaacagcagtagaattgcctgttgtcggaacggcgctcatgccagagccgcctgttatcgtatggtttccgccgtcataaattcctttgaacggtgcatcatagttccccaccggcgtatgtaccgtgttcgcgggaatcgtgaaatcctgcgtctgatagtagcttcggtcattggtataaccgtttgccgtatccgcgccgatctttttgaaggtatcgtaatccggcacggcgatcacgccgcatactttgactgtttttgcgatgtcgttatagcccgttttggaataggtcgccttgagcgtcacttccgcgggcgcagggcatgcctttatctggatgacctgcacactctgaccttccgccgccgagagtttgaagtaatcctttacggaatcgggatactcaaattcccatttcacgccgtaataaccgaaatcgtcgccaatggaatccactgtgacaggggtattcagcgaggttatgttcacgggcgacggcgttggcgccgcgtcggtgatccttgtgataccgctgattacgttggcatccgtgttatccacttctccgttgtttccgacccgctcagggaacacatcccctatatagagattgccctcgtacgattcgttgttcatatatacatgacccgcgaacccaccacaataataacttccgctgtccgtaaggcctgtcggaatatccatgcggtcggtcgtaacgcaattaataaacttgtaagtcttatgaaccgccgctgcaaaaccacccaaccggatttctgttgacggtattgaacgtactgtcagcgttccgctgcttaaacaatcctttataaccgttcctgtgttttgagaatttccaccgaccgtaaaacctgctacatttccgttatttcctgcttcccagataacgtgattattaatggtagcgcaatgttctatattgcttgttccttcgacgatcccgccgaaccctgtcacgcttgcgatcgcatcaattgcgcttgcgcgggtctccccaccggatacatcaacataccgcaagaccgaagcgccccctacagccgcaaataccggagcagtcatcggtattttcccactgatcgtgcattcggagcggacataacaatcggtcacctttgaattttcaagccgcgaatcgcaaataaatgctccaagcgccgctacgttgctattttccccaatacgtgcttcgatttttgaatcttcaatcaatatatttgaaagctgtgcatgctccgctgctgcaaacaaaaccgccgcaagggatgcatctgttgtaaatatatcaaacccggttaatgatatatcgtgaatcgtaccggttaccattccaaagagtccggtaccgcgcccatttccagggtacaataccgtttccgttatctcgacagcttgcacggtgttccacttcatgttctttccgccggtgatggtgtgggagcctccgtcgtagataccggagaagggttttacattatcgccgacgggcgtgtgcgtcgtcctgtcagggatcacgaaatccgccatctggatataatttccatccagcggatatgcggcatctacgccgatcttcttgaaatcgtcgtatgtccatatctcgatgcgcccggcaacactgtcgtccaccgcaagcggctgcgcgctcatgttgcccgccttgtctaccgcataaatataccatttctcccctgccgcgggcgcgcctaagctgcccgaccacgtgtttgtggtgtcggacacttttgtgagcttcaccctgccgctttcggcaggtgtgcttgcgtctttggacgcgaacacataacccatgcccgactgggaatctgtcacgtcgagcgaaacggtatagccgccgttttccgctttgtttgccacaagattttccatgcgcggcgaatacatatcgcgcaatacattgaattcctgcacggcgcgatttgtcgtcggatttgcgctgtcctgcgcgaccaggtacatggtgcccgaaccagtgaggccgcctgtgccgcccgcgagtttatacgaattgggcataaagatattcgttgacttcggaaccgcgatcccgtttgcaggatttgtttcgttcgcatttgttgcgacaaacacttctaccgtgcccgtgacggcggatgtcgttttcacgtcggcctgcacgcccgttccccatgttgcatttgcccatgcgccctccggcgggttgagcatgaggtttgagattgtgacaggggcagaaatcagcttaatcatatcgtcggtgatagctgccggggcaatcgaggaatatgcagatacttttttgtatctgccgtccgtataagtgttccctgaaagaacgttggaatgcgtatagccggcaaacccgccgatccattgtccatttgaatccgcaacgggtgttgtaataactgctctggtactattatcgataaagctttcgtttgccgatgcactggtcttttcaatatatccaataaatccgccaaccgccgaattgcctgttgttttctgaagatactgtatttcgccggagctgctgcaattagaaataacgctgtcataagcagtaaccttgtccgatctgttccagcctgtaaagccgccgagataatatcctccgcttaggtttgaaccacttgtgaccgtgacattttccgccgtacaatccagtatctttacgttaacggcattatgcaccacatcgcccacaaagccaccgcaagggctttgacccgtggctgccgccgcatagtttccaacaatcgttgcgttcttcacatggcaatcccgggtcgttgatgccaccgctattccctgcattccgcctaaatgggtcgccactggcgatgaggatgtaactttcacattttccgccatacagccggatgcagtaccgtctcgataaaccgaaccggtgataccaccgatatatgtttgctggataccggttgtcgaaacatccagatctacatcttttacggatacattttcgatattaccgccattttctacgagcgcgactacagctcctgccgtgacctgcgttgttcctgtcgctttgatcgtaaattgctccgcccgtaggtttctgatcgtaccattcagttctccaaacaatccgccgcccgcaacgatgttccctgtcgcttggatccaaaccatattccacgacatgttggttccgccggtaatggtgtgcctgccgccatcgtaggtaccggtaaacggcgtggcgtaggtaccgatcggggtatgaaccgcacctgccggaatggcgaaattctgtgtctggtaatacccgcgatctaggccgtaatttcctgtgccgatcgatttgaaggtatcgtaatcgggcacgccgatcacgccttttaatgcaacggtcgcggtgcttgaagtcgtccccttttgataggtgatggtgatattcgccgtctcatccggcgaagaaagcggctctatttgccgcacagaaacgctgtcgcccgccgtagcgctaagctcgaacttcggattatccacgctccactttgcggtatatccaaatgcgtccgccgcggaggaaatgttataatctttattgagctcctgcattgtaagggtggatatatttggctgcggagcagaaatccttttgatcgttgtatcgttgatgtaggccgaagcgttggattcattggttgcggaactaatgcctacacgctgataggccgaatttacacagatattattttcatatacgccggatatataagacgtccctaacatattccagcctgtaaacgctcctaaataacctgtataacttcctgcatcttttactatgattggggactgcgtaacacaattcttgattttcagcgtgttttgtatggcagtacttccaagaaatccgccaaccgcaaattgtgtactggttccccttgtcgcatttacagcccccgttgcgctacaattttcaaaaacaatggaaactgccgtactgttcagataagcagcaaatccgcctgttcgcgaagagccactgctgccattattggttactgatgcgcttgtaaaacaattgcgaatcgtcacatttggaagcaaaatccctacaaaccccgcaacatacaattcctgcccggaagccgctgtgtttgttccgctatatacatcgcaattttgaattgtcgtcttttccggagcaccgacaaaacctaccgcaatgggactgcaatcacttgccgtacttacactttccacagaacaattatatgttttacagtttgcaatgtccgcatctaatgtcatgcccgcaaaaccggccacaaattgggcggccattgcattatttgtaacttttgccgtgctgtcatatatatcaacgttttctattgtgccgccggcataagccgcaaggatgcctgtcgtataaactgtctgcgacgccatctctattgtaaatgccttcaaattcaaatttgcaatccagctattttgtgttcgtccaaataaccccgttcccgttactgtaaatgcgtacccatcccctgagtatacatctgccactttccacgtcatgttcctgccgccggtaatggtcttgttgttgccgttataagttcccgtaaagggcgtgtccacattgccgatcggcgtatgcgttgtgccgtcgggtatcttgaagtccgccatctggatgtattttccatccaagggataacccttgtctacaccgatcttagaaaaatcaacataatcgtagatcggtatccagtcgctctccgcagtctccaccttttcgggcgtcgcgcttatattgcccgcgttatccttggcaaagagataccatgtgccgcccgggagcgtcgcgctccattttttcgtcgtgtcgttataggcaagcgcaacctgccctgccgtataattcgtctctgatgcagacgcaaacacccccgctacgccggactggctgtccgcagccgaaagggacagttctattgtcccgtcctgcatggtctgcgcgtcgatatccgacatgcgcggtgaataaggatcgcgcaggatcgtgattgcctgcgaagtccgcgcggtctgtgtgccgcttgtattcttcgtctgcgcgcacaggtagagcgtgccgctgccgctgatgctttgcagcgcgccctgtgggatcgtccccgtatagctgtctcccgaacccgtgagcatcgcaagcgccgccgcgctgtctgcgtccgcgctgtttgcaacaaacacatatttcgcgtcggtaagactgctcgtcacgtccgctgaaacatccacctgccccgccgcgttcagccactgcgttgaggtgggcatggtgatgacattctggatattgagcgttgaaggagtgggaacgcccacttttgtgattccgttattgatccatgtatttccgtctttgatgccctgcgaataagccgaaacgcgattgctgtattttgtgcccgtataggtgttgccaacaaagctttccgccgttgcaacggatgccagcatcccctgataaccgacaaaaccgcccaaataccgtccgccgtttgtccatcccaggtcggaagcgttgcacgtgatttcagatgttgtggaacaggattttatgatctgattttttgtcagattactgtttgccgttcctccatatcccatcgaaccaataaatccgcctacaccaaaataactataaccgttgctgctggtcggcactgtccccgtcaccgttacaggaccagacgcgctgcaattcgaaatcacgtttgcgcccatgtagatcgctcctgcgaaactgccaatatgttgcagcataagattgtttcgtgcttctaaacgcactgtattggaggtgtgaatagtatcataggttccgccagtaagtcttccaatcgctcctccgacgcttgtttcctcatttgcggcaccggctatattgcttgcgccataaatagtcccccccgacagatcgacattcttaacgaccggattggaatcgtttgctatatgtccggccaacccccccacaagattatactttgcgcctctggtatatatatttacgctgctcacatcaatgtttcgataggtaccgccagatagctgccccgacattccacccatcgagatattgtaatctcccgtgtaggtataattaaggctactgtttttaagagaaatattttcgatcagcgtattgctcttggcaacgcctgttacaatgccaatggcaatatgttttccagcttcgctaactatgcattcgattccggatatcgtaatattcttaatcgttccatccagcaccccaaagatgccttccgcatatgttgaagcctccgcctgaacgctggaaaatctaaaatttgtcccgccggtgatcgtgtggctcccgccgtcgtacgttccaataaacggagttgtataattaccgatcggcgtatgcgttgtaccgtcggaaatcgtaaaatcctgtgtctgtaaataattggaatccagcttataccctgccgcgataccgtccgttgtgcctatttttgcaaacgtttcatagtccggcacagcgattaccgcttctgtaacagggatttcctttataataggcgctgcgccgacgcggttatacgtcaccacaactgtcggcaactcgtttggcgcggcggccttgatttgcgtcaattgcgacgtatcgccgcttgtcgcagaaagcgcaaacgcgctttgcgggtcggtgccgtccttaatggaataggaaacatccgtataaccgaagatattccccatggaataaatgttcgtgggcgtatcgagcgcagtaaagttcaactccgttggaagaggactgacttcggctgtagtatcgagtttactaatacccgcatcgataaattcatttccatcaatataggaacccagttttccggtacggttttgaagattaccgccgccgttattgaaataataatttcctttgaacgtagatgctgtgggagcgaccgaaagtcgtccgacaaaaccacctatattgcccccgtccgcgaccccgcttcccgtgaaagtatgttcaatagaattgactgccaaattattttcaagctgcatgcctgctgtgtttgaattggcggacgccaaaaagcccccgagatataatctgacgggcggctttgctatattataggaaatctttgacatagaaatacaatttgtaatgtgcgaatttcctgcaagcgccgaaaaaaagccgcctaacgaaacatcgcttgatgtgtctgcgtatatatccgccgatgtgaaacaatccgagtagattcctcccgttgacccgctaaatcctgctaccaatatacttccgctttcggcatttagcgcttcgacatgtccgccgttcacatggcaattattcaccgtccatgcagtcccacttccgccaattccaaacataccgcccagatattgcgtggctccagcgcctcctgtatgcgatacgaaagtattattgacggtacagtctttgatcgttccggtagcataacccgcaaagcctccggtagcaagtcgtactgaatccgaagcaacactgacgccgcaattttgcacatggatattttctatgacaggttcatcgcgattcgcccccatgacaatacctgtatagccaacatcattgcctgatatatcctgttgtgtatatgatacggcgaattcaacattggaaaccgtaaaattgcatagccttgcatttttctgcaccgatccaaacaaaccaactgcataaccataatcgttatgatatacaacgttcatttttaaattttgtccgccggtaatggtatgatttccaccatcgtaggcgcctgtaaacggcgtgttcccatcgccgatgggcgtatgcgccgtgccgtcgggtatcttgaaatctgccgtctggatataattaccatccagggggtacgacggatcaacgccgatccgcttcagtttctcataagaatcgatctcgatgcgcccttgcgcatccgctaccgccgctgcgtccgccaatgatactacattcaggttactgatctgcgccttgggcagttgcttcggcacgccgctctcccacgcgtttgtgccgcttgcgttatcctcgctttttgcaggctccaattcctgtgtttccgatatttgggtcggcagttctgccgccatcgccgttggaacgatactgaaaacgagggcgaacgccaacaagaacgcggtcacacttctcccccgcccttgcgcattactattcttttttgtgacttttgaacctttcgagtttctcaagtccttcatcatttctgccttactaccccaaacaatccgttgtatttcgctcccgtatcgatctgcgggttcgcgcttacgtcgatcttgtatgtttttccgtcaaacgtccctgtaaacgggttttcttccgttccgatcgggctgaattcgctttggtccgctgtgatatccgcccccagtatataatctgcatccattgtataacttgcgtcatattccgtatttccgatattcctgaactgctcccatgtcgtgatttccaccgttttgtcttcgatctccgtcggcaggatcgaatccagttttttcacttcttcaatctgtgtcggaaacaccggatcaaccggctcgagcttcacaggctcgttgatgtcttttgatacgatcaccggcgttgcgaactggatttcatccttagtattgtccgcatacgtcttttcatataccgcgataagctgtcctgcgccaatatccgctttaggctccacctgtacgctttcattagttatacctgaaatatccagtatagaatcatcctctaaaaaaaaacgctgaaaggtcaggccatattgtccggcttgatccgcattggccgtgactgcctctcccgcatccccaatcatgagcgcaagataagtcggatttgtctcgatcttcgcgattccatccgcgccgttcacggagctatccagccccaaagcgctatcctgcccatacatagacgaccaaatgcaacctttgaatacttccgtctgtgcgctattttccccaacaaacgcgcccgtcagtttactttgctgcggaatatttacaaaggccgctacattttcgatccgctttgcatttttgatctttcctgctacgccgcccgcaataccgatctccgtttcctgcggcaggataacttcacctgttataaacacgtccgagatatccgcttcgccggaaactacgctgcacagggttccaacactgccggctgccttgactttaatattttgtaggtttaaactgaagagtgttccactaaaattcacgaacatccccgaattttcatcatttgtatcgattatcaaatttgatattttgaatccgtttccattaaatacgcctgtaaacggttcctctatagagccgaccggcctgaaaggaaggtcctgtccatcgatatcattcattagttcatattgtccgtccaaaggatatccatcatccctgcctattttttctatttcttctattgttgtaaggtgaatagaattgtttgtatctaatgcgggacttgttggagtaatagaattcatacctgatttattcggtattatttcttcctgaaaaaaagaatcctgctgtatttctgtggccgagggctgcggtgtttctacagcgaatgcaaaggatgcagaatacaacacaaaacatacgcacagcatgcccgctgctgcccgcatctttttgttcgccttatcgccgcgcttattcaagattattcgccccccaccaaatacatttttatgtacttgcttccgtgtatataaatacacggaataaattccaattggaagcgaacttaaaaatgtgcaaatcctgtaccactaaaccttattcggcttttcttttctataacctttaaaaatccgaatacctatcggctttttaagaaaggatgaaaagacgaatgtatatttatgcgcatttttgcatgattgaaaataaacaaattacaaatcaaactctttattttggccttgttatgagaatccggactgaaatgaaagatttttgtaacaatttattgacaaagagaatattacgtgatatggtgaaattaattaaaattgtgataagtatcgataaacgttccgtgtatttatatacacggaacgtttatctttgcggaaagaacagcaatctggacatttgctgttttttcataaattcttttatatggtaaccgttgtatacgataaaatcaacaatataagtacaaaatttacggatcgtttacacattttttagcgactatacaaactctgtgtccattattattatgtgttttatacaatgcaacaggaggtaaacatgaatcaaaatacaattgaatatttgaaacagagtaaagagcagtacagggtctatctgtttgaacaggaaaaagcgccgtctaccatacgtttatatatgaaatacgtgaacgacctcgcccgtttccttgaatataagctcaaggtcaccgagttcgacaaatctcatatcgttctttttaaacaggatatggaacaaagatatgtccccgggacgatcaataccgctatttcagcgctcaacagcttctttaaatacaaccactgggagcatctgcggctcaggaagctgaaactgcagcatgtcagcagcgtagaaaacggccttacgataacagaatacaataaacttctccactctgccaagcagagaaacgaaaaaatgtattatatcatacgcacgatcgcaggctccggtatccgcgtcggtgaactgaaatatattacaatggaagccataagtacaggaacagcccgcgtgatcaacaaagggaaaataagaaacgttctcctgaaaagcagcctatgcaaaatgcttatgcattactgcagcaggcatggaatcacccacgggacgattttccttggttctttaggcaataaaagcattagccgtgaatatatttgccgtgctttaaaaaacatcggcgcacctgccggaatacaccagtcaaagctatttacccataatctgcggcatctgttcgcgcaaaggtttatcgataagcataatgacatcaccgccttggcagatatactgggacattcaaacatcgaaaccacgcgcatatatacccgcacttcaaatgcggaaaaacgtgcgaagatcgaagatgtggacctgtaagcaggcatacaaaaaagcatccgtaaacggatgcttttttgcttggtcttgttttggtagtgtgatcatgactatgaaaagtttaattgtatatcctatgtattatggaagcaatttatgcgcgcccgccttgatcggccacgttttacacagcgagaatacttcgacatattccacacccggcgtgccgcaggcgtttgcccaatacttatccgttctttccttaccctccagataatccacaccgaatgcgtctttgcaccagtcgcccatttgcgatgcatggcaattgcacattgcgtgcttcatctccgcagtatccgtgatatctacgaaatattccggatggaattcgggattgatgccgtgcggctgcgtataaaaaagcggcggcacaccggctgtttcctcatattctgttttgatcagtttcacggttgcgatcacccgcgcaacaaacgcaaggtaccccgtcatatcgtgatcctggttgtaatccttaaagtacggcggtgcgaacacaacgtccggccgcgcgatgcggtatgcatctacaaatttcaggcgcgttttttcgttatcgaacaggaactcgtccggctcgtccagccaaatgagatgtgcgccgatcaggtcgcaggaagcctgcgcttctttgtggcgtaccgcccgtatttcgtcctttcccatctggaaagaaccaatattgccgtttgtggcaatacacataaaaatttcgtctccccttgccgccatcttggcaagcgttcccccgcaccggaattcgatatcgtccggatgtgctccaaatgccaatactctcattgcttattctcctttaatatactttccgaatggttatggcagcatcttatgaggctccgccacgccgatcggccatgttttacataatttgaatccttccgcatatttgatccccgcccctgtctggtacgcaaagtgttcgcatgtacgtatcataccttttaatacgtccacgccgaaaatatcaccgcaccattcttcgttctgggatttatgctttttccacatcgttatctttgtttccatctcatctgaaatatccacataataatccggtatgaattccatctgccctgtcggcgggcaaaagaacatcaccggaatcttttccgttgcttcgtgcttggttttgatcagcttgatggcggcgttgatcctcgcgataaacgccatatacccattgatatcatgatccggattatagtcgctcattttccatgtcgtaaagataacgtccggccgcgcctcgcgtacggcgtcgataaatgcatcccttacctcactcgaatcaatcaggtattcgtcctcaaagcccatccaaatcaattttgctccgattacagagcatgcgtcaagcgcctcctgatatcttatctgtgcgacttcttctttggtttcggcggtcatcgaaccgatgttgccgttcgtggagatcgcaatagaaacttcgtgtcccatttttgcatactttgcaagcgttccggcgcagtaatactcgcaatcgtccggatgtgcacccatgaaaagaaccctcataacacgtgccctgcctttctgccggacaagcaggcggtgcacatgcaccgcccacatgccgacagttttttgttacttgttcatgtattctactacttttgtgatctgctctgcaaacgttccgtcgaatttgttctcaaagaacgcgccgccgatcgtaaacgcccacgcgcccgttgccttgacttcgtcaagacgctggtagctttgcacactgcctgcaaggcaaaccggaacatcgaggctctttacgaattcgctgttcagcttgaccgcatcgcccacatagcggtaaccgagaaggtcaaagcctttgatgcctttctccttcaccaatccctgcgcttccccgatgatctcttcaatcgttccgtcgagcacgctcgggcggccggagagtttccctacgaacggcaggtattccacgccgttttccttaagaaggtcgcgtaccgagtcaaaatacaacgttcccatcaatacgtcaaacccacaatccacaccgatctgtgctccggcgagacagccctcctctgtgtaatccacaacttccaggaaagttttcttgcctgcatccttcattttttgcacaagaagcttcatatcggggattggaagtcctacttccttgaatccccaatactttgcgggtgcatccttcgctccttcgaatacttcgatcgcgtcctctaccgtcctgtcgttgtgcgtaagcattacgattaactcaggtgccttattcattttttcaatacctcatttcaaatttgctttgttagtttcctttactctgttttaccggacatgtactcttccagcgtgaccgtgctttccggatagtaatgattgaacatctcgtcaacattgcttgcgtccacgaatttgttttcatagaagatagccgcaggaatatcttcaacgccgtttaagatgttgatcatctgcatcatgcaggctttcgcgcctgtaatgctggagtacgatgcactgccgagaatcgtgccttctttgattccggccaaaatcgccttgtcattgtcgatagacgtcagcagtacgtcgctgttcgccgccttcttggcattgttcatgccgatcgtagcagcactgtaaagtccccatgcgccgatcatgtccggatttgctagcaatgcgccttcaaatgcggtataatgttcttctggggatgttcctgtgagctcgatgaattccacatcgggataatctgcgaacgtttccttaaaacctagtgtgcgggtggcggcattcggatggacaaagggaagcgattggtatacgattttccctttgatatctttgccctctgccttgagtgcatcgataagagcctgggccgccatctgtccttcttcaacacagtcgatcataacgatactatccacattgcctgcaagcggcggattcagggtaacaaccggaatattcgctttttccagcgcgtccagtgaagcttttacccccgtgaagtcgcacggagcaagaatcacgccgtccacgccctgctgtacccactgttcgattgcctggttctgtaggttctggtcatagttggcgtcattcacaagcaattccacgccagccttctccgcttcctgcttcatggtatcgagcatcatcgcgcccacttcatccactgtgtaatacactgaaaatccgatcgtgaatttttctttggctttgggaacttcagtggtcatttcgtctttgacccttgcaacgccgccgttttccttgatggtaacgttacattccacacccagcggattgtagtacgagttgatgtcgaatacgccgtccttgacgtaatctgcttccacgtactcgaagtccgccgcgttcggattgtccgacgctccggcggcagccgatgcatcctggcttggctctgcgcttgcacttgcttcttcgcttgcagccgcgctttgcgagggttcgctcgaagcgggggcagacgattcagccggcgtcggtgcgcatgctgcaaagagcatcaacaccaccagcaccagtgcgatcaatgacatttttttcatttttctttcctccgttcacttttttatttgatggctcatttcgagtcaaatcaatctcatttatcctccggctacgccattcggattcgtgcgaacggggcgttttctcacctcagttcgcgctcatatatccttccagcgtgttatccgggtaataatgcgggaacatttcttccacattatcttttgtgaccaatttattttcctgatagacgatgcctgggatctcaacgccgtttaataggttgatcatctggcacaaggcgatccgcgatccatccaccgcgctgtagcatgcgcttcccagcacttctcctttggaaatacccgccagaatcggccggtcgttatctaccgatgtcagcaggatatcgtcccgcttggctgccagctttgcgttgttcatgccaatggttgcggagctgtacagcccccatgcgcccagcatgtccgggttcgcctggatcgcgccttcaaacgccgtataatgttcttcaggcgattcccctgtcaattcgatcagttcgatatccggatatttctcgaatacaccttcaaagcccaagatacgggtgactgcgtttggatggacgaaaggcagcgtgttgtaaatgatcttccccttcatatccgatccactgtcaacaagcgcctgttcgagcagttcaccggctaatcttccctgttcgatgcagtcatatgtgacgatggaatccacattgcctgcctgcggcggcgcgtccagcgaaatcacagggattccggctttttcaagcgcgtccagcgacgcttttacgcccgtaaaatcgcagggagtcaatatcacgccgtccacgtcctgcaatatccactgctcgatcgcctggtcctgggaattctggtcataatttgcgtcgttgatcagcagttcgatccccgcttcctgcgcggcctccttcattgcctccaagtacatggatcctacttcgtcaaccgtataatatacggaaaatccgattttatacttctcgtccggcttgggcatttccgcgattgcgccgtctttgattttaacgtcgccgcctgtgcagcggatatccacgctgcaatcgattccgagatcgttataatacttattaatatcggattttgtccctgcctcgtttacatattcgaatgcatccgcattcgtatgtgttttcgccgctccggcttcgggcgcttccgcgctttctgcggcgccctcgcttgcggcaacactttccgaagcactcggggcgtcgcttgcgctcggcgtcgttcctccaccacccgtacatgctgcaaacagcatgatacagatcaaaagcaatgctatcaacggtgttctcttcatcttctttttctcctttttctatcacttatttttgacattgcgtcaaattgtaaa

SEQ ID NO: 4 - DNA, 215246 bp, Christensenella sp.
attatatataataatgtagaaaaactttcagtattaggtaggttcagcttatgacaatccgggaaatagcacgtcttgcgcacgtttctcccgctaccatttctcttgtattaaacaataaaccgggtgtgggggacgaaacaagaaaacgtatccaaaacatattaaaagaatatgactataagcttccacccaaaaacaaagttccgatgaagaacatccgttttttgaagtacaaggatcacagcatgatcgttgacggaaatgccggatttatttcaaccatcattgacgctgtagaggccgaatgccgtgaaatgggctacaacttgatcatcacaaccgtcaaaggcagctttaagcaggcgcttaaaatcctacaggaggatacgtccgatgggatcatccttttgggaacggaaatcccgcccgaggattatccatttcttaaaagcgtcaccacgcctatggtcatcgtagataatatcatgtcgcacgagccttatgagtgcgttgtgatgaacaatcaggaaaccacttatttggcattgaagtatcttgcaaatctcggccataagagagtcgcttattttaagagcgcgactgagatttccaatttccgcgaacgcagccttgcattttatgactgctgcgaggggttgggactcacatgcacccataccttactgatgacgccgactttagatggcgcgtatgattccatgaaagaatacctgaaacagaatatcacgttgccgacagccgcctttgcggacaatgataccattgcccttggcgctatgaaagccttacaggaaaccggatttaaaatccctgacgatatttccatcatgggctttgacgatattccttattgcacgatctccgatcccccgcttacaacgatgcgcgtcccgcggcgcaggatcggccggcgtgctgtgcgcagattatgcgagcggatgcaggaagacccgatcaacagcaatgtcaaaatgcttttgggatcacgccttgttaagcggcagagcacctgtccaccaaagaaaaaataatcttcttttctttcctataagcgtaccgccaaatggcggtacgctttttatgttagtccccgccagtcttgtgcactctacagatatagcttaccgcagtctttgatggatatttgcattccgagtctgcgcgctacgcttgcaaagacatcgaaagcaaacaccgcatcacgcctgtggattgaatacactcccagcaaagaggaaaggcagacatttctgtccgcctttcccatttactatttcagtttagaaatgttcccttacgctacagcatttgcaaagccttccatcagtaacttcgcaactgccgcgcccggatccaaaagttcgcgggatgcttcgccgcgcgttgccgcacgtccatgcaccgcaagcattccctttgtcgccgcaaacccatcctcggcagccttctttgcatttccggccattgttttaaggtctgcgcctgttgccgcatccttctttaaggactcgaccgccggatacagtccgtcgaggaacgttttgtccccgatcttcgcgctgccacggttcataacgccatccaaatatgcttggaacagcgtaaccacgtcctgtgtatccaattcttccttacccttcagcactttgcctgcattcataagccctgaagccatgagcgtacccatagtagacggaaccgcagtcgacatggccttgccgccaaaatacagcatttttccaaggtccttttcctgccctgatgccaccgcatcatatgcggctgcaaacccgtcgctcatcgtaagtcccaagtctccgtctccgaccacgccgtcgatctcaatcaggtaatcgcggttatccgccatgatctttttccagcttgcaagtacatcaagcaaatctttttgattcatttccctatcgcctcccatcgggttaccggaagcggcggcgatatgtctgctgccgcttcccgcccggtcgtaatttatacttgtttgaagaaaggtgtattagccggtttatcaagtaagtttttcagctcgtcatccagctttaagagtgaaatagacatacccgccatctcaagggatgttgcatattcgccgacataaactttatacggtttgatcccttttgccttgagtatttcgtcaaccttgcggtatacgacatactgctcttccaaaggcgtaccgccaaggccgtttatgagcaccgctacttcgtctcccgaaacataaggaatatctgcaatgataggctccatcatctcttctacgatctcgtccgcaggaaggattttaccgcggcggattcccggttccccgtggatccccatgccgatctccatttcgtcctccgcgatttcgaagctcggcttacctacgcggggcacgatacacggcgttaatgcaacgcccattgtacgtacgtttgcgcacgctttttctgcgatacgttttacttcttcaagcgacatcatctcgtctgccgccgcgcccgcgcatttgtaaacgaagaaaataccggcaacgccgcggcgcgtattcttcgcacccggctccgccggacctgccgacgctacatcctcgcctgcgacaacgctctcgactttgatatccgcttcgaaatccgccatttcagcagccatgtcgaagttgaagatatcgccgttgtagttgccatagatgtacagtacgcctgcgccggagtcgatttctttcgttacttcgaacatctgctctgcgctgggggactggaatacatcgccgatcgaacagccgtcaagcataccctcgcccacatagccgaggaacaacggaaggtgcccgcttccgccgcctgtcgcgataccgaccttgcccgcttttttatgcttgctgacaaggcagtggaggtcttcccctgcatagccgaccatatcgccatgcgcaaggtaaataccttccagcatttccttgataaaatcttccgatttattgattattttcttcatgacgttttcctcacttttaattttttagggcgtccgccgtacacttccgcgccatactgcaccatcataacgccgatcatgacaagcccgtatacgaacgttttcaaataggagtcaaaacgcaggatattaaacgcgctggaaatgatctgcaggaccaggatagagagcacaacacccgccagctttcctttgccgcccgacggagaaatacccccgagtataacgatcaaaagcgtaagcagctggtaagaagtaccatagtctgcttttgccgagccatagtgtgaagcaacaatgatacctgcgaccgccgccataatgcccgacgccatatatgtcttcatagttaccccaaagttgttgattcctgagtattgggaagccgtcgggtttgcgcccatcaggtaaagctgctgcccatataccgtgaaccgcagtatcagaaacaatacgacaactacggctatgaaaataaacaatgggatcgggatcgaattgaaaaccaatccgtttgcaatcgacgtgaagctttccggaaggccgctgatggcaggcccctttgtgatcgcaatgccaaggcccatgaaaatctgctgcgaagaaagcgtaaccagcatggcagggatacgcaggtttccgatcatgaaaccgttgaacgcacctgcgcctgcaccgaccgcaacagctgctacgagggacgtcacgatgatgccgccgtttatgtcttcgcctgcggactgcatgatgactgccgcaacgatgcccgccagattggaaatacctacgacggaaaggtcgatcccgccggcgatcatacagagcatcattccaagggacatgataccgaattccggaaactggtaagccatggactggaatgtcgcgcctttccagaaattactgggagcggctacggtcatccatacgacaaggccgatgatgatcagcgccagccacaggatatttttatcaatggatttcaatacattaactttcgtcttttccataagtgacaccccctcaaatcttcgggctgagcgcaatgcgcttcgccttgatggacgtaattgagcagcccacaatgatcaggacgccaatgacgaaggtctgccaataggtgggaacccccagcatgatcaggttgttttgcacaatactgatcagcgccacgccgagtatcgtcccaagcacgcttccgtgcccgcctgtgatcctcgcgccgcccagtacgacagccgcgatgaccatcatttcactgcccatcaggttcatggggttggagttgcgggccaggagcgtataggtcattcctgtgatgcccacaatcacacctacaaaaatataaatgaaatactgtgtttttactacgttgaaaccagccctgcgtgccgaattctggtctccgccaatggcgtaaatggaacgccccagcattgtatatcgaagcaggaaccataccacaacgcacagcacgatgggcagaataataaacaccgacatcgaagataccttgtccgtcgatcccacctggaacaggaaggattttgaggcggcatcgagctgtgacggcaaattggaaatttcgttcgtccctacaaacgccagcagcgcgccgttgatcaggctgctcgtccccaaggtcgcgatcagcgtcgggattttgaacgtaccaaccagaaaagcattgatgagccccagccccgcgccgatacccgccgcaatcaggaacgccggcaaaacgccgtcccatccgttgtcaatcatcatcttggtggtcaggtacatcgcaaacgatgcaaacgccggaaacgatacgtcgatcccgccggaaataatgacgatcatttcacacatggcgaacatcagcatggtcagcatcgcacgcgctgtatcgactgcggtatttgcgctgaagaatgcgttgtttgcgaggccgatcatcaggcataggccgataatgatatagataacgatcgcctggttcgaagtaaaaacattattttttacaaatttatttgatttatccataacgatacccccttcctatgcctgctcactcaaaagagcggccagcttcgtttcgtcaagatcttccgcgtccatactggcagccagcttgccgccgcgcatgatcacgatcttgttgcagttctggatgagctccggcaggtcgtctgaaataataatgacgcccacgccgtcctctacgaggctgtgcagtatcttatggatatccgatttggaaccgatgtccacgcccacggtggggccgtttaaaatcaacagcttcgggctggtgttcagccactttgccaatacgaccttctgctggttcccgcccgacagcgtcttgatgggtggttccggcgaaggagcggcaatggacagctttttgatccattcccacatggattccttcatgcccttgtaatcgatcctgccgcccttcaggtaattcttgatcgaagcggccactgtattggtgccaatcgggatctcaaggaacaagccttccgtaaggcgatcctccggaacatagccaatgttatttttcatcgcatcggcaacgcttctgatcttgatttccttgccatcaaggaaaatcttgccgctggtcggcggcgccatgccaaagagcgcttctccaatctctccgcggccggagcccaaaagaccggtgatacccagaacatccccttcgcacagcgtaaagctgacgtcggaaaattccccggtgcgctccagatcctgcacctccaggatttttctttccttctgcttcgggcgatagaaaacgtcttcgatctccctgcctgtcatcgctttgacaaagcgtgcacggtcgaactcattgatggggccgtccgctacgttttcgccgttgcgcaggatcgtaagcgtctgggcgatgtcgtatacctcgtccagtttatggttaacgatgagtaccgcaatcccctgggactgcagcattttgatgatttcgaataatttcgcaacttcttttgcagtgagagccgtagtcggctcatccatgatgaccagctttgcgtcatttaaaagcgcgcggcagatggcgaccatctgtctgtttgctacggacaagcgttccaccaaaacatcaagcgggatcttcgcgccaattttttccattgcctgcttagcaatgcggcgcacgtccttccaattgacaacttttttaccggaattgagttcgctgttgagagcgatattttcagcgacggtcatgttcggaaagaccgagaagtcctggtagatgacctggatacccattttaatcgcttccatgggtgtcaatgatttaaatgtttttccgtcgatataaatttcaccttcgtcggcatcatgagcgccggagatgactttgatcagcgtggatttaccacagccgttttctccggccaggcagcgaacctcacctttattgatcgtcaggtcaacgccctttaaagcctttacaccgccaaaggattttttgattcctgttaccttcaagaatacctctgacatgatcttgtccacctttcccctgttaccatatgcaaggctccccttttcgggggagcccagcatactatttattaaagatttgttgtgtattagaagttgtacagcggatcatccacattggatttgtcgacatcgatccaagcctgtgcaagaagcgtcttgtcgtttgcactgtcaagcgccagcttttcataaccctgtactgtaagcgctgtgccggctccgatttcttcgccgttcaggatacgcagagccagttcgttcattgcataaccagcagcagccggatcccagaaggagatcatgtcgatcacgccgtcacgtacatatttaccggaaaccgatacgagggacgtaccaacgatatgtaccttacctgtcatgcccatttcgtcaaccgctcttgcgataccggccggatcagccatggaagaaccctggaagcccgtgatgttcgcgttcgccgtcagagcttctttcgtcttgttgtaagcctgttcctgatcttctgcggactcgatcttgtccatagccagcttcatttcaggatagtttgcttcctgataagcgatagaagaatcaacccatgtattgtgggaagcggatgtcagatagccaaccatcatcgcatactcgcccttttcgcccatgagttcagccagcttcatcatgaagtgctcgccataagcaacattatcaaacgcttcgatgtcccagtcaacattcgtcatgccggccgcctcgtgcgagataaccacgataccggcatcttttgctctcttcaaaacttcttcgagggatgtcgggtcattcggaactacgcagatagcgtctacgccggcagcgatcgcttcttccacatactgcgcctgctgcgctgcatcagcttcagccgggccgttctggtaagcgtctacgcctgtgtcagcagcaaactgctttacgccttcgtccattctctggaaccaagcaaggccagtcgctttcgggatcgttacgatcgtgtaatctgtcttcagctctttgagcgatgcatggtctccgggtacgatctggtcgctggccggagcagcagattcgcttgcgcttgcagcagccgattcgctcggagccgcggattcgcttgcagcagccgattcgctcggagctgcggattcgcttgcagcaggagtctcggccgtacatgcgaacagtgagaacaccattaccacagcaagaactgcgatgacaatttttttcatttttgtttcctcctaagtttttatacatttcgttttcacgaaaaacttattttaaatttttaaaattcaattttgtaaaatgagtatggtctccgtactacagataaaactttagtttagtaaacattcgtctgtttttaataaaattaccacttatgtttagcattgtcaagtcgtttcaatcgataaactactaaacaaatcgtttaagacaacataaaaacactttgtgaacaaaatactactaatttttatttttatcttcatatttatgtaaagtctgcataacttctatgcatagccttattatatatacccttttttattccggatattcattttttcttataaaatgtctcctgcatatctgttttttccgttttcttccctattatatacacatggcaaagcaagcaggtatttcttaattttcaaaaagtcacccgataactattgacagtcatatgaccgcatactataatgagggtatcttaaggcagagggattatgatataataaatcccgtcacgtaaaagaagcaacgcttcgcctttatggcgcggcaaacaggaatacgcgttcttaagagaaaggagctcaagcgtgttaacaatcaaacattttaccaaaagctacaaaggcggcaaaaaggcggtcgacgacctgtctctcactgtagaggacggcgacatttacggttttatcggccacaacggcgccggtaaaacaactaccatcaaggctgtagtcggtattctggactttgacggcggccaaatcgaaattgacggcatgtccatcaaggaaaaacctgtggaatgcaagcggatcacggcttacattccggacaatccggatctttacgacagcctgacaggaatccagtacctgaattttatcggcgatatttttgcgatcccgaaagaaccgcgcgaaaagctcattaaacaatatgccgacctgtttgagatcacggccaacttaggcgacctgatttcgtcctattcccacggcatgaaacaaaagctggcgctcatttccgccctgatccataaaccgaagctgctcgttttagacgagccgttcgtgggccttgaccccaaggcggcgcatacggtcaagcagatcatgcatgagatgtgcgaaaacggcagcgcgatcttcttctccacgcacgtgctggaggtggcggaaaagctttgcaacaagatcgccatcatcaaaaacggcaagctcctgcgcgccggaaccattgaagaagtcaagggcgacgaaagcctggaagatgtatttttggagttaatcgatgaataatcttggtttattattaaaaacatacatgcgcacttcgttcggcttcaacaaggcgaaatatacgcatgacaaaaaggcaaaatcaaagggcatgaccgtgctgcttgcattctgctacatcatgatcgtttttgccgtgttcggtatgtgcatcggtatgatggacagcctgtctgcgatccatgcggaatacattgtccttaacatcattatgatggctgcttccattatgacgctgttcacgacgatctacaaagtaaacggcacgctgttcggctttggcgattacgatatgcagatggccctgcccatcaaaacgagtacgctcatcaccagccgtatcctgatactttacgggctcaacttcctgtttgtattgggtgtgatggttccggcggcggtggcctatgcgattatcgcgcagcccgccgcggcgttttacccgctctatatcgtcatgatgctggcaacgccgatgcttcctattattatcgcgacggtgatcggtacgctgatcgcggcggcggcctcccgcttcaagcgcaaaaacggcatgaacgttatcctgacggtagccgcgttcatggtgtttatgatcgtatggttagggttctggacaaattccggcgacatcatcatcaactttgctgatatcggcggcacgataaatggggtgctgatgagtatctatcccctgatcgggctttttggaaacgcagtcgcgcagtttgacatgctttccttcctgctcttcctgctgatttcgttcggtgcgttcgcggtattcgtcgctatcattgccaagctgttccaaaggatcaatacttcgatcaccacgacccgcgcggcggcaaattacaagatgacgcagcttaagaccgcgtcgcccaaaaaggcgctttacaaacgggaaatgaagagatatctttcttcttcccgctacgtgctcaatacggcggtcggcccgcttcttttgatcgtgtttgccattatcctgatggtttcgggtacggagggcttcggcgtctattcggacataccgcagtttgccacgctcattgcgatcgccgccccgatgggtatcgcgtttttcctggtcattgcgacgccgtcggcgtccgccatttcgctcgaagggaagaacctctggatcgtgcggtcgctgcctgtggatacgcggcttgtcttaaaggcaaagatcaatgtaacgatgacgctttactatccctccgtcattatttgcgggacgcttttcaatatcgcgatcaagccggagccgcttgtcgccatcggtatgtacctgatcccgcttgcatacagctactttgccgcgcttttcggcctgaaatgcaacctcgattcgccgaactttgactggaccaacgaggttacggtggtcaagcagagcaagcccgtgctgatcacgatgctagtcggtatggtcctgacgatcgctcctgctctcctggcgcttgttacgggccccgtcatcatggcggtcatgttcgcgctcgtcaccgtactggacattatcctttaccgcagcctgatgtcaaaaggcgtgcggcaatttgaaagtttctaaaacggtaatgcgatacaaaaagcgcctccgctgctgtgggtggcgctttttcttgtgtattttttaaaaaaggattaaaatgataccaatcttagtgatatatttcatcataatttttcatatcgacatttccaggaaagaggacttcgccatgttaaaagaactcgacctctctaaaagcgtatccaaagaagaataccgcgcacagatggaagaattaagaccgcgccttaccatgctccagcagcagattatccgcgaaaagatacctgtgatcatcattttcgagggattgggcgctgccggaaagggtgcgaccgtcaattcgctcattttaaatttcgacgcgcgcggcgcgaccgtatacaataccaatccgcccgagccgtcagacctgcgcgacccatggcttaagcggtttgcaggcaagatgcccgcctacgggcgcatggctattttcgaccaagcatggtattccggcgtgttccagcttttgggaccggacgccaatgtcaagaactacaaagcctattttgacgagatcaatacttttgaacgccagctcgcagacgacggctatgtaatcctgaaatatttcctgtatattgataaaaaggaacaaaaaaagcgccttaaaaaacttgaaaaacaaaaaagcaccaaatggcgcgtgacagatcaggacctgcggaacctgaaacaccacgacgcgatcaccggcttttacgacggcatgattgggttgacggataaaccgtatgccgcgtggcatggaatcgccgcgacggacaaacgctatgtgcgccagacgatattttcttccatcgccgaggaacttgaaaacgcgcttgcacgcaagcgggccctaagcgaacaaaacacggacgcccccttcgatccgtgggtaagctcgtatttttccgtcctgccgcatgaaaagatcgaagacctggcccttaatcaaacgctttccgaagcagagtaccgtgagaaattgcctgccctgcaaaagaagctttttaagctgcaaaatgccctttatgtcaagaagatacccatgatcctttgctatgaaggaaacgacgcggcggggaaaggcggcaatataaagcgcgtcgcgcagtctttggatgcgcgcggctattgcgtcacgcccatcgccgctcctacgccggacgaactcagccggcaatatttgtggcgtttctggaaaagcttgccgcgcaccggacacatccgcattttcgaccgtacctggtatggccgcatccttgtggaacgcgtagaaggtttcacaccgatacgccgtatcaaccaagcttataacgaaatcaatgaatttgagtatatgctccaccagtggggcgcgattatattgaaattctggcttgcgatcgatagagatgaacaattgaaacgctttgaggaccgccggaacacaccggacaagcagtggaagatcacggaggaggattggcggaaccgcgaaaaatgggatatttacacgaacgctgttaacgacatgttccattatacgaacacagatttcgcgccctggcatgcggttgaatccaacaataaatattacgcccgtatcaaggcgatcgaaacgatgattgaggccattgaaaacaggttataaattggaaatgaaatatttttcctgcaaacggaacgtttgttcactttaagaaacggtgttttccatttgtgtgaaacgtatttactattttatgtgaaacgtttacgcttaggataggtctggcatattcatttcgcagccaagtttttaacgaacgagggcaatctctatggcgacgaaaaaacttcgattgtttgacgctatcctcgcggcggtgtgcatcgtgctcacgattgacgcagttgcgccggcggccgcgatcggaaattcccaatacttttggtggatccttcttttgctgggcttttttattccctacggccttgtcaatgcggagctcggtacggcctatgaggacgaaggcggcttgtgcgactgggtaaagcgtgcctttggcatccgcacgggttcacgcgccgcattttattactggatcaacttccccatctgggtcacttccacgctcgtcatgttcacgcaggttttcactgcggcgacgggtattccgatccctcctttagccgcgctcttcatccagcttggcctagtctggctggtcgtctttttatccaattaccgcatcagcgaaagcaaatggctcgtcaatatcggcgcgctcatcaaaacagggctgatccttttgctgggcggccttggggtgtatgcggcgctcacccacggggtcgccaatccggccgactctccgctcgacttccttcccagcgcgtcgggcctttcgtatatttccattatcatcttcaatttcatcggctttgaagtcgtgacgacttacgcaagcgatatgcagaacgccaaaaaggaaatcccgcgcaccatcattttgagcggtatcctgatcaccgccttttatttgtttgcttcctttgggatcggcgtcgccatccccacggcggagttgtccaaagcgagcgggtttatcgacagcctgcgcatccttttggggtctacgggcggcgtcatcctcatcacctgcggcgcgcttttcatgttcacgctcgttaccaatatgatgacatggtcgcttggcgtcaattatgtgacgcagcatgccgcacaatacggaacgcttccaaaattcctttccggtaaaagcaaaaagcagcaaatgccccttggcgcaaacatctcaaacggcgtgatcatcacaatcatgctggtgattgccgccatactggaaatatccggcagcggaacggacgtattctggatgttttttgcgctcaacgtcgacctgctgcttgcatgctacctgtttttattcccgtcattctggaaacttcggaagatcgatcccgaccgtccgcgcccatactgcgtaaaaggcggaaaggtccgcattttccttgtggcgcttgttccctttgtccttctttgcatgacgctgttcttcacctttttcgatcaggctgcggacggatcgctttccctgaacctgccgcttgtcctgggcgttgcggcagccgtgggcgtgggagaaatcgtcgcctggcacagtatctccaaatacagaaaaaaacaggccgcggaacatccgcagcctgccgaataatttttacatccttttttgcctgagccttgtttagactttgccgaaaatcttttgatcgatctgtccaatcgtgatctgtgcaagccgttccctgcataggtggtcgaggtccccataaatttcatccatcacatccgccattcccgacgcgatcaaacacgcaaggtcgctgcttccggaacgccatgtcgcggagacgagctttacttccaatgcttcgcaaacgcggcgcagcgtcacgctgtacgcctccagttcaaatgaatagcccccgtcgatgccttcttttgtgtttaccagccccgcttttttcaggctgcccatcaccttgcgtatcctcgccggatgcgtgcaaacgttctttgcgatctcttcgctgctcttgctttcttttttatggttgagaaataccaacgcatgcactgcaatggcaaattcgctcgtcatatcccttttctcccactgcttcttttactgtaatcataattgtttcgtttcaaaaacacaaggcctattccacaggcgcaaacaggtcgttaaacgcttcgctcatcgtcggatgcgtaaatacctgcttatgcaaaacctccgttttgagccccgtatcgatcgccagcttgagcgtattgatcatctcatgcgattccgcgcaaatgagtgccgcgccgaggatttcctccgtgtccgcgtcgatcaccgcctttaaaaacccctccgtttcccgcagcacctgcgccttggggactgctaccgccggaagaaaagcaattcggatgtttcgccctgccgcgcgcgcttctttttccttcatgccaaccgtggaaaaaggcgggtcgataaatacgctgttcggcacatttttcctgtcagccgtcgtatacagcggcccttttccgatctgcgaccagacgatgcgggaatcgtcgagcgatacataagtgaactgcaaacctcccgccacatctcccatcgcccagacgttcattgctgtcgtacataaaaacctgtccgttttgaccgcaccgcgcggcgtagtctctattcctgccgcctcgagcgccagcccctgcgtattaggccttcggcctgttgccacaagcaccgcgtccgccgcgagcacatgttccgttccctgccacgtcatgtgcaactccgcctcctgcgcggtctgcgccacagaatggatttgcgcgcccagccggaatacaacgccttttttctccaatattttccttacttcctgcgctacgtccccatcctcacgcgggagataggcttcgccatcctgtaataccgtcacctgggaaccgaatcccgcgtacatggatgcaaattccgacccgatatagcccccgccgatgatcgccagccggcgcggcagcgtatctaattccatcatcccttcgctggtatatacgtacggattgccgtcaagccctttaatgggcgggatcaccggtacggaccccgtattgataaatatctttgcgccctcaagcgcctgcttttcaccatctatgtcgacttccacctgcgtgggcgaaataaaccttgcttgccctgtcagcaccgttatattgggtgcatcgttcaatttatcgaaattctttttgcgcagcaaggcggtaagctcgcgtttctccgcaaccgcccgcctgtaccactgcgccttttcctcgaaggtgctccctttgctgagcgctgcgaaacgcgcgtttttgatcagcgattttgacgggatacagccgacgttgatgcacgtcccgccatacatccggtccgatctctcgatcagcgcgaccgtatcccccctggctgcaagctgcgcggccagtgtctttccgccttttccaaatccaatgatgattgcgtcaaactttttcatttgtaatcccctttcctttccatgtccgctccctgtgcgcaggacgagccttgctgctcagccgctgcatccgctcgttacctccgtaaccgcgtttacaatccactcgctccattcgttcaggctactgcccgctggaagcggcttgccgacaacgctgccccacggggagatcgcaagcacaagcggctcgtcgcccaagttgtactccgccagttcttgtgtgggcttgagctgcggaaaatccgcccccgctacttgcgcagtctggctgatttccgtttccttgccgtccgcgttcatcacaaatccgatgccattgatcgccgtactgccttttaaaaactgctgcatcttctgcatagcttcttcattgccttcccacgccggatcccatacgagcgccaaagtgagttgcgttccttcgttgagcacctcgtccgtatatgttttgccatccatattcgtcgtttcgaactgatagaagatcggcgtgctgatcacgctctttccgatgtcggtttgactgcttacgcttgccgcctcctgcgcgggatccgcaggcgcgtcggacgcttccggcacagaagaaagcagcatgtcgatgatcgcctgccattttgccttggagcgcgcgccaacataagattcgcctacctggttaccgttttcgtcgacaaatacggtttccggaacgcctgttacatctttcagctttgcttcgatcagttcgtttgacggaagcatgtgcgtgtaatctgcgcctgtcttttccgcgatctcattgacaaggtcgacctgtccctgtgcaatgctgccgtcctggttcatcacatcaatgggaatccccacgacctgaaaacccttttccttgtattctttattcaattcgccaagctcgggcatttcctgcaggcatggcccgcaataggtcgcccagatattcaccatggtgagtttgtgtcccgcaaagatatcctgcgtcacttcgtttccgctggaatcctccgtggcaaaatcgccgaatagttccgtcacctgcaccgccgcggacgcatctccttcgttcggggccgtttggctgcctgccgtgactccgctatctttcgacacgtttgatgttggctgcgcacacgctgcaaaagccattgccgcggccagcaaaagtgctgctaaaattaactgtttctgtttcttcatgctttcctccgttttatcactttcctgttacggtctcgtagggccaatcggcgataccgcccatatcgtaaatattttgataccccatttcgacaagtttatccgacgcttgtttactgcgcacgcccgtcctgcaatataccagtatctccgcatcctgatcgggcagttgctccggctgccggtccgctatcgtttcattcgggatattgatcgctccttcaaggtgtttttcagcgtattcctccggtgtgcggacgtccacaatgatcacgtctttattttcgtctattttttgttttgcctcttccgccgatattttgcggtacgcttccgtactttgggcttccttttccggctcggacgactgcgcgaccggcgcgcaagccgtaagcattgcggctatgagaacgccggctatggctaccagcaaaaatttgtgtttcatttcagaatctccaaactgtaatttttgttatttcattttactgtaattatatttatatcagttagcaatgtcaagtatttcctgattatgataaccccaaaacaaaaaaatcacacattgcgtgtgattcaaaaggcaatcatttgatattttcgccataaaggtcttaccgtcccttgcgcaccgcatattcaaaccgcacatcggcacgcgcgtatttgctgcccggatcgagcggcgtacgctgaaaaccaaacttctcataaaggtgctgtgcgggtttcaaaacatgattggtttccaggaaaattttttctgcgccgccgttggctgcaaaatccatacacgcccgaagaacagcgcttcccgcgccgcggccctgatatttttcatctgctccgagttttgtgatctcccataccgtttccgtgtgcgggtaggtcataccggtcgcgaggacctttccgttttcgacggcaaaaaagatcattccccctttttccaaatattcttccgcatgatagagggtatcgcggtcagcctgttccatgacaaaatacttctttacccatgcaacgttgatgtcgataaaatcctgtttgtatttcttttggtattcaatgatttccatatacgccttatattatactacttctgatcctttcgctctttctcctgccgcttttgctcttttttgattttgatctgctgcttcatgcgaaaaataaaatcgatcaacgcctgattggcaaacattcccataaccggcacctctttattggggagtaaattcatcccccgcttatatcgttttcgtttataaaaaagcgtacggcgtctgtcgtacgcttttgcagctcctcttacttttggggcaggacttccagccaataaccgtccggatcctcgatgaaataaatacccatcgcttcgttttcaaaacagatgcagcccatttccgcatgcagcttatgcgcggcttggtaatcatccgtttcaaacgccagatggatctcgttgtctcccagatcgtacggcgtatccttttctttaagccacgtaagctctaactggtgcggagcctgctcattcgccaggtatacaattataaaactgccgtcgcccgcttccttgcggcgtacttctcttaaccccaacgccctttcataaaaatccagggacttttggaggtcgaatacgtttaaattattgtggatcattttgaatttcatgtcagctattctcccctattttacgcccatatgcttttttgccttcctctaccgcttcgtcgatacacagatcgtccggcagtacggaagtacaatgcgggcagcgcgtcgcgtcgtccgcaatctcgcctttacaatacgggcataaacgcggcgccttttccggcgcgggattgggttttctgctcaagctgttgagccctttgatcagcaggaaaataaccagcgcaatcagcaggaaattgatgacggcattgataaacgccccaatttggatgctcgctccggcgggatccgcgctgagcggaatcttaaggctggaaaaatccatcataccccctgtcaccaggccaatgatcggattgaggatattttcaaccaatgcgttgacgattgccgtaaacgcgctgccgatgatcacgccgaccgcgaggtccatgacgctgccgcgcgaaataaattccttaaattcctgtaataacccttttccctttttcttttccatcctttacctctcctctcggttatgattcatcatcgttaaacggatgttatgcatcccagccaaactgcttcatgtccacatatccgtcttcctttacaaaaactccttcggcagcaagcatctctttctgcgcgtccatcccgccaaatgcaaaggcgggcgcaagccggccttccctgtttaccaccctgtggcaggggatgacgcctggctgcggattcacgtggagcgcatacccaacggcgcgcgacgcgcgcggattgcccgcaagacgcgcgatctgtccgtaagatgcgacgctgccgcacggtatctgttttacgatttcatagactctgccgtaaaaattcatctttttggttctccatacctaaattgtatcaaaacccgtttggtttattaaaaaacaggttaaaaatattatatcacaatcgagaggaaaagaaagatggcaaaacatgtaaaaatgatgatgctggatacatgcccgcattgcaagcgcgcattcgagttgatagacgaactgaaaaacgaacatcccgaatataaccaggtggacatcgagaccatcgaggaacggcgggagcctgaaaaaacaaaagggtatgattattggtatgtcccgaccttttttgtagacgatgtaaaggtccatgagggagttccctcgaaggaaaagatcgagaaggtctttatcgatgctttaaaaccgtaatattcatcattcttcactatagatctgtttctcacaacaaaagagggagcatatgcgccctcttttgcattatttctaggtttttgaaaaaatcagaggtcccatatctcccgcgcatattcgcctattgtgcggtcgcttgagaaaaaggcgctgcgcgcgatattatagaggcattttctgccaaaagccatacggtccttcgtatcatagatcgcgcgcagcttttggtttacataatcctcaaaatccagcagcagcctgtatttatccgcctgttggcaatatgttccattgaggagcatatcgtaaatcgcgcggaacatgcccgtatctccgtccgaaaacgttccgtcgacaagcgtatccacaacgcggcgaagcctttcattgttgtcgtaaatatcctttgggttatacgtgccctctatttttgccaggtcctctacacgcgcaccaaaaatatagttgttctcaaagcccgcttcgcgtacgatctccacgttcgcgccgtcgtatgtccccagcgtcactgcgccgttcatcatgaatttcatgttgcctgtaccggacgcttccgttcccgccgttgaaatctgttcggaaatgtccgccgccgtcaccagcttctccgcataagaaacgtcgtaattggagacaaaaacaacttgcaggagttcgtttaccgcgctatccccgctgatcacgcgtccgatttcaccaatatattttataatccccttggcgatataatatcccggcgccgccttggacccgaagatgaaggtcgtgcgcggaaaatccgtaagctcgccgctctttaaccggaaatagatatctacgatcgaaaaagcgttcagcaattgccgcttgtattcatgcaaccgtttgatctggatgtcgaataccgaatccgagcgcacggcgatcttgtcgcgcttatagatatactgcgccagcttgtccttgcgaatctgcttcgcccggttgaagctatgcacaaaggcgtcgtcccggataaacggctcgatcttacggatctgttcaaaatccttgatccagccccagccgattttgctcgagatcagctcagaaagctccggatcgcacagtgcaagccatctgcgctgcgtcacgccgttcgttttattaaggaaacgctccggaaaccattcgtaccagctatgcaggactttttcctttaaaagttccgtatggatcgccgctacgccgttaaccctgtgggacgcatagacggcaagccgcgccatatgaaccgccccgtcatgcaggatttccagttcggaaagctctttgtttcccgcctcggcaagcaacttatcgtttatgagcacaataatctcatacagttcgggcagcaaaccgcggaacagatcgatgttccatgtttccagcgcttccgccatgatcgtatggttggtataagaaaatacatcccgcgcaatcaggaatgcatcttcaaattccataccttcttccccgagcaatcggatcagttccggaatcgcgatcaccggatgcgtgtcgttgagttggatcgtattgtattttgcaaagtcacgaatatcgcactcatagtccctccgatacctgtgcaaaaggtccttaagcgacgcgcttgtaaaaaagtattcctgttttaagcgcaaccgccttccttcttccgtattatcattggggtataggacgcgggtaatcatctccgcatggttcttttccgccaccgcgccgtcgtaatcaccgttgttgaatttttggaaatcgaactcgcacagtgcttctgcctgccacagacgaagcgtattgacctgtccgccttcgtagcctattaccggcatatcataaggaaccgctttcacttcttgtccgttaaaggcgacggtcacactttcatcttcacggcgtaaaaaccacgggtctatatcgcttttccagtcgtctgcgacctcgacctggaatccgttttctattttctggcgaaaaagtccatttttatatttgatgccgtagccaatcagcggcaggcccattgtagctgcagaatcaaggaagcaggcagccaggcgccccaagccgccgttaccggttgccgcgtcttcaatatcttccagtttcttgatatctacgcccctttcaaggagctctgccttaagttccttcagccagccaagcgcatacaaattattgaataccatccttccaatgaggtattccgccgaaaaataataagccttgcgcttctttgaatcacgttccctgttccacgccggcgccacttcttctatgaccgcctttgcgagcgcggcatgcagttctgttatgctcacgtcgcacaattgtttttgcatatcgtcatgtacgatatgttctattctatctaaagctttcatcgtttctccttgcgctgctaagcactcttttttcaataaaaatatgcgaattatactagcatttataaaccattttgtcaaattggaaaagtcgtatttatcacaaaaactattgtcacgcacgatgaaatgtgaccggttgtgtgaccggatcgttatagaataaggttgtaaagaaaaaacggatatgccagtaagccaaggaggcatgacaatgaaccaggtaaaacaaaacgaacaggaagaaaaaaagcggaaatggatacttcccctcataataataagcgccgccatcgtattcggattggtattttttatgctccaggccaatcagccggccgcagctactaacatcgaggatccgcaggttcctctcgccgcaggagcggaacaatcttccggggatggaacctcccagcaggcgccggaatccggtacagatgcaaatgcgtttgcagccgcttcgaccctgacgcaggaaaccggtaatacgaaccctgttgcgaatgaaaatacggtcctcgtagccggtacggcaaacacgacgccggatacacctgtaacacctgatgtgcccgtaactcctgatgtacctgtcgaccctgatgtacttgtcgaccctgatgtacctgtcgaccctgacgtgcctgtcgatcctgacacacctgtcgatcctgatatgcctgtcgatcctgatgtgcccgtcgaccctgacgtacctgtcgatcctgacgtgcctgtcgaccccgatgtgcctgtcgaccctgacgtgcccgtcgaccctgatgtgcccgtcgaccccgatgtgccgatcacgccggaacagatttcaaacaacgggatcgcatggctggttgcacagctcaatgatccggaatctacgatatataaatatttcgcggagcgcggctcaaagtcaacgttagactccacaggccccaattacgcgccggagatcaacgaacaaatccgcaagaatgtggaaggaatcgacgatacttccgaattcagttggagattgtggaaagaaacgaacgagcaatacaatatcttttgggtcaatacggatatcgcccaactggaaaaagacgataccatcgacgatgtgtcaaaatacaatgtcgataaggcaaaccctgaaaacgaagaaatgctgcacggcagcgcaaccatcaccgaaaaagacgtgatagcggcatccgatggaaaggcacacccgatcaacacgatcgtgggcggttcttttgaagaatatccgccggaggaacaatccgtgaatactttaagcgagacgcagcctgaaggcgaaagcgttgaaacggatgtccaaagccagggggacgagggcagcggcgctgaaggacaggaagaagctccgtcggatgaagtggcatgaccctggtaaactaaaaatcaaaaaccggtatggaaaaatccataccgattttttatacacaaaatacaaatttataaaaaggataaattaaatctttttttgatacacaacccaatggtgttgtgctataataacaaaagtgactgaccagccagtcacttttgttgagtattacatattcagccgcctgcgcgcggtttaatgcggaggaaattacatctatgtcaaagttcagcgtaaaaaaacctatgaccatctttgtggcggtcgtcctcgtgtgcatactcggtttcatttcatttaccagcatgcggacggacctcctgccaaagatggaccttccttatgttatggtactgacgacctatcccggggccagccccgaaaagatcgaacagaccgtaacaaaacccctcgaacagacgctttccacaacgagcggcgtaaaaaacgtaacgagtacgtccaatgaaaacagcagtatggtgctgctggaattcacgcagggtacgaatatggacagcgtcatgatcgagatgagcggtaagatcgatatggtcaaggggagcctggacgacgcaacaggcacgcctacccttttgaagatcaacccggacatcatgcctgtcatgatcgcaagcgtggacatcgacggacaggatatcacgcagacctcaaaggtcgtggaagattccatcctgcctgaattcgagcgtatcgacggcgtagcctccgtcagcgcgaccggacttgtggaagattccgtaaaagtgacgctcgatcaagataaaatcgacgacctcaaccgccgcgttctcgcatccgtggacgaaaagctggcagaggcgcaggaaaagatcgacgaggcaaaggatcaaatcgagagcggcaagagcgagctcagcagcatgagccagtccaaggcgcaacagcttgtagatgcggggctgcagctttccgccgggcgcgagcagcttcaaagcgcgatcgcaagcctgccgcaaatgcaaaaagacttggaagcacagcttgcggatctgcaaacgcagcgcaacgatctggcagcacagcttgcggacgcaacctccgcgcgcgatgcgctttccacgcagatcgccgcgcttattgccgcaggccagagcgttccgcagcagcttacagaccaattgaatacgcttgaatcgggcatcgcccaaatgaacgatggccttacgcagcttgatgacgggatcacgcagcttacggacgggatcgcgcaaatccctgcgcaaaaagcgcagttggaagcaaaattaagcgaactggacgaaggcgaaaagcagatcgagtctggtaaaatggctcttaccacagggatcgcccaggcctccggccagcttgcgggaggcgaggcacagctatccgcgcaggaacaggaatttgaacagcaaaaggatgcggcctataaacaggccggccttgacggcaagatcacacaggatacggtcagccagatcctttccgccgaaaacttttccatgcccgcggggtacatcaaggatgggcaggaacgttttcttgtaaaggtaggcgatcaattccagggcatcgatgaaatcagcgatttggtggttttcaatatccccacaggcgatatcggccaggtcaaattatcggatatcgcgaccatcgaaatgacgaacaacaaagacgacctttatgccaagatcaacggcaacgacggtattttgatgaccttccaaaaacagagtacggcctccacaacgcaggtttcggaacgcatcaatgagacgatcaaaacgctggaagcgcaaaattccgatctgcatattacggcgctcaacgaccagggcgtatacatcaatatcgtgctggattccgtactgaacaacctgctgctcgggggcatcctcgcggttttgatattgttcctgttcttaaaggacatcaaacccacgctcattgtggcgatcagtatcccgttcagcctgctcgccgccctgaccctcatgtatttctgcggcgtcacgctgaacgtcatttcccttgcaggccttgcgctgggcgtcggcatgcttgtggataacagcattgtcgtgatcgagaatatctaccgcctgcgtgcgctgggcgtttcgcccgccaaagcggcggtcaaaggcgcatcgcaggtcgcaggggccattgccgcctcgacgctgaccacggtttgcgtattccttcccatcgtatttacggaaggattgacgcgtcagcttttcgcggatatgggccttaccattgcgttctcgctgcttgccagcctcatcatcgcgcttacgctcgttccggcgctgggctctaccatgatgaagaataccaaggagaaacagcacaaatggttcgataaatttacggctggttatgaaaaactcctggccggcgcgttaaagcgtaaatggatcgtcgtgatacttgtcatcggacttttcgtattcagtatcgccagcgtatttggtatgggcacatcgttgatgccgaaaatggacagcagcgagatcatgatcaccatgagtatgcccaaagacagcaccacccaggaaacgcgcgatatgagcgacgaaatccttgcgcgcctgacggaagttcccgacgttaagaccattggcgccatggagggcgggacgatgtccatcctcggcggaagcggttcttcgggcggcaacaacacctctatgatgatgtacgccgttttagaggatgacaagacgcatacaagcagcgaggtcgcgcagatgatgcgcgataaagtcgccgatctccccgccacggtggaaataagcgattctacgatggatatgtccgcgctctcgggttccggccttgaagtcgttttgaagggcgacgacctcgataccttaaagacgatcgcgcaggatatgacaggtcttatggagcaaacggagggccttacaaatattgacaatggcttaaacgcatcctcgcaggaaacgcgtatcgtggtggataaaaacaaagccatggattacggcctgacggtcgcgcaggtctaccagcagatcgccgccgagctttcggacggcaaaaccgctacgaccgtgacctttgaaacacaggattatcctgttatcgttgaaaacagcccgcaggacacgattgacttagatcaactgaacggcttcatgctcaaaggcagcgaagacggcgaagaagtggaaatcaagctttcggatattgcgcagatttcgcaggagcagagcctcacagctatccagcacgatggacaggtacggaccctgtccatcacggctgaagtagacgcagaccacaacatcggccttgtgagccgcgatttctcacagaaattaagcggctatgatattccggaaggatacagcgtgcaggttgcgggcgaaaaccagacgataacggatacctttacaaacctgatctacatgttccttttagcggtagttctcatttacctgatcatggtcgcgcagttccaatcgctgaaatcaccgtttatcatcctgtttactatcccgcttgctttcacgggcggcctgatcgccctgcttttgacgggtatggagctcagcatgatcgcgctgctcgggttcctcatcctcgcgggcatcgtcgtcaacaacggcatcgtattcgtggattatgtcaaccagctccggctttccggcatcgaaaagaacgaggccctgctgcgggcgggcaaggcgcgtatccgcccgatcctgatgacagcgctcacgaccgtgcttggccttgtaccgcttgcgctcggcatgggccagggcgcggaaatgcttcagccgatggctgttacgacgatcggcggcctcatatacgctactttcatgacgctgttctttgtacctgtcatgtatgacggcatgaacaaaaagccattgaagccggttcttttggaggagggccttgacgatgatatccccgaaatataaggaaaaagaactgcagatcatgcgcgcgcttttaagcctgatcagcagcggcgcagggatcggcgagatcaagacatcggatatcgccgatgcggcaggccttggcaaagggacactttacaattatttcgaatcaaaagaagatatctttgcaaaaacgatcatctacagcatccagacgcagctttttacaatttttgaacagatgcggcaggcaagcgggttcaaagacaaatgttataccgtactgcgtgttataaatgagatcattatgaacaaaaactcggatttccaccttgttttgttcaatgtcggcggacgggatatggaacaattttttaatggcgacctgtctttcgtgcgcgagtacctgtccatcatcaacgagcaggtattgctgctcgcgcagctcggccgcgcggaaggcgtcatcctgcctcctgaagacgacgaatatacttacagtgcattcgccggcgcgctgatgggttttatccatacgcgctgccgctgggaaacagcggacgaacagacggtgcgtcacgcaatggataacgcttataaaatactcttaaaagccctcagctagaatgacacgaaaaaggactgcacagccgcagtcctttttttaatccaatatattgagcaactccggaaactcatgtatcacgtgcgtggggccaaaccgctcgatcacatcctgcgggtccgccgcccagccgatctcccctaccgcgaggcaggaatcccatccggccgtgtttgcgatctcgatatcccttccggcgtcccctaccagcatgattctgccttttttgcaatgattatcccgcacatgtccgcagcgtttttccttatccgactcctgctgcgtcgcgccttccactgcctcgaagcagtccttaaggccatgcacggtgagtatcctatcggcgaccggctgcagcgagttcgtcaccacgctcatccggtaaccacggtttttcaattccctgaaaacctcttttgcaccgatggcgagcgggatctcacggatgagatcatccacatcgtctgcatagaaacgccaaagtttttcgtatacttcatcgatacgctcgtccggcacgccgatattatggaaaaaatcctcgatcgtaaaccccaatccaagaatcgtatcccccagcttcacgtcgatcttatgcttttcaaaaaagcggtggtaggcactgatgtggaaatgcgcggaatcgataaacgttccatccatatcaaacatcagcaaatcatatttcggcatctcaaactccttgttacgatttccgcatgacgcgtccatgcgcaagcataccatagccgctccccgttcgtcaaccttctgtgaccgccgatacaaaatcttctgcaaactcatcccagtttttggggtaatcgttgaggccgtgtttttcaatcgtcccgtccatactttctatgcgcaccgtccaatactccccgtcgtagatttcgtcgttcctgtattcgtccttccagttctggatccggtatttttccggtagttctttgacctgctcccacttttcgtccgaccaggaaagctctttttcccaatacgtttcgttttcatccgaaagcccgccgtattctgttgtttccagcgtgatccggcggttttcaccatctaccgtataacgctgctacggaccgatcgcgcccagccgttcaaacgtcacggtatagaccgtatcaaaactttgcgaacatgcgctcgctgccagcacgataattgcaaaaacgacccacaaatattttttcatcgtttccactcccaaggtatatttttgtgctatgatatactatatttatattcataaacgatttaccggaggcgctgtgatgcaatatcaagatatcgattcccttccacgggaaaaactgctcgaattatgtaaaatttatgccaaaaactggatcgcgcacgacggatgctggttcttgtccatcgaacaaaagcgcggcatggaggaagcgatggagcacgatgcaaacgcatggcggcagtttaccgttgtggaagcaaagcgcctaaagcaattcctgggcctgccggaatacgcgggcgtcgaaggcctcacgcaggctctgcgattccgtttgcaggcaacgctcaccgatcctgagattatctcaaatggcaacaccgttacctaccgcgcgcgagcttgccgcgtgcaggatgcccgcatgcgtaagggctttgattactttccctgcgcgtccgtcgggcttgaggaatatacctggtttgcaaaaaccatcgacccccgctttgaaacggaggtcctgagctgtccaccggatatcacggatgagaccgcgcggtgcgtctggaaattcaccttaaaggaagaccccgcctaaaccgtcttttggagcgcctcgtcgtaggcgctttttgttttatcgtcaaaacagactatgcaggccttttcaatttccggatacgccgcaagcatttcctcaatcgtttcaattgcgattcctgccgcgcgcttcagcgggaaatggtaaacgcccgtgctgatggacggaaaagcgatggttttgatcccgtatgcatgcgccagctccatacagctttggtagcagcttttgagaagcgcttcctcatggtgtccgcctccgcgccaaatcggtcccggcgtgtggatcacgtattttgcgggcagtcggtatcccttggtgatctttgcctttccggtctcacatccgtgaagcgtcctgcattctgcgagcagctccggtcctgccgcgcggtggatcgcgccgtctaccccgcccccgccgagcagcgacgtattggccgcgttcacgatcacgttcgcattcactttcgtgatgtctccttttacgatctcgatgttcatagctcttccctttccggatagcggtcgatcgccgtcgccggacatgtttccgcgcacagcccgcaatgcaggcaattttcctgccggatcctatacggcgttcctgcatcgatacagccctgcgggcatacctgtgcgcacgcgccgcacccgatgcagccttgcgtgatatgaaatccctttttttgctcccttggctttccgacgaaaaatgtttcgcggaaaataggcgtttgggacaggttaaaatattccccctgcccttcatacaggcagaacacctccagtatgttgcggctttcgcccggataaacgtcattcatggatggattcgcttcaaatataggtttcaaatactcctgcgaaacctgcttgaccctgccgcgcaacgaaagcatctcccagtttttcgtcaggcccgtcatcgcgataaactcctgattgagcacttgctggtaaaaatttttcccgcgcgccgtcaggaaatacaggcgattctcctccaccatcatcacgtcaatgatacgcacatccggcctgccgttctcatctaccgttgcaatcgcgaaatcctttatttccctcatcattttaagatattcttttgtttccatcgcagagcccccttttcttccattataatggatatatacgcttttcgctaaaatatttcttgctgaaaaatccgccgtactgtggtaaaataaacgcgtatcttaattttgaaacaaaggagctttgaagcatgatagtacagccaaaggtaagaggatttatctgcacgaccgcgcatcccgaaggatgccgcgaaaacgtcaggcagcagatcgattatatcaaaggcaaaccaaaaatatcgggtgcaaagaatgtccttgtgatcggcagctcgaccggctacggccttgcatcgcgcatttccgccgcctatttgagcggagcggctaccatcggcgtgatgtttgagcgtggcgcaaacggcaagcgcaccgcttcttccggctggtataacaccgccgctttcgaggagttcgcgcatgcggacggcctgtacgcaaagacgatcaacggcgacgctttttccagggaggtcaagcaacagaccatcgacttgatcaaaaaagacctcgggcaggtggacatggtagtatacagcctcgcctccccgcgccgcacggctgacggcgtaacctattcttccgtgctgaaaacgacggatacggattatacgaataaatccatcgaccttaccacccgcaaggtatctgaagtaacggtaacgccggctacagatcaggagatcgcggatactgtaaaagtcatgggcggtgaagactggaaggattggatctcggacctgaaatcggcaggcgtgctcgcagaccatgccgttaccgtcgcctattcctacattggtccggaaatcacctatcctatgtatacgaatggttccatcggacgggcgaaggagcatctattcaacacgtcacgcgagatcaccaaagagtttccgggcattacagcctatatctccgtcaataaggggcttgtgacacaatcctcggcggcgatcccgatcgttccgctctatatctccatcctttacaaggtgatgaaggaaaaggggctgcatgagggatgcatcgagcagatgcaccgcctgctgagcgaccgtttgttcaaggacaaggtgccgaccgacgaacacggcatgatccgtcttgatgactgggaaatgcgcagcgatgtgcaggacgcagtcaaggacgcatgggacaaaatcaatgacggtaatttggagcagcttgcggatgtagccggttattgggaagatttctaccggatgttcggcttcgggatcccgggcgtcgactacgatgcggatgtggataccgaagtagatgtaccgagcatcgagcagtgataaggagcgtatgatatgtttgtattgatcgacaatgccaatattgatgaaatacggaagctatatgacagcttcccttacgacggcgttaccaccaacccgtctattctgctcaaagagcaccagaatatttttcacgttttaaaaaatatccgttcgtttatccccaaggaatccatgctgcacgcacagcttatctcggatacggcggaaaaaatggtggacgaagcgcattttatgctgcgcgaactgggcgacgaccttttcgtgaaagttcccgtaacgcccgagggtctgcgcgctatccgtcttctgaaaaaggaaggcatcaacatcacggcgaccgtcgtctataatgccatgcaggcttttatggcggccaaggcgggcgcgcgtttcgccgctccctatatcaaccggctcgataatatgggcgcagacggtatccaggtcgcaaaggatatccacgatatcttccgcatccacaacatggacgcgcaggtcatcgccgcgagcttccgtaattcgcaccaggttttgagcctatgtaaatatggcgtaggcgccattaccgcagggccggacgtcctgcgcgcgcttacctaccacgacgctaccatgtgcgcggatgaaaacttcggtcaggactttttggccctgatcaacgaagtggaaggaacgcatttgaaataaaggagtaattaaaaaacggtacatatatgcaccgttttttttatgcgaccgcttggttgatcacatattctatatggttataaggttgctcctgctctttcagttcctccggcagttcaaacaaaagctgcgcgctcccgcctgcttcaatggcttcctcgttctgcttcatttgtgcatatacgatttccgtatcgtttgcaaacttcactgtaatactcagcagcctgcactccctgtccgcattgttctgtatattcagcgccgcgccttcctctgtctgctcgatctccacattgatccggtccgtaatatcgctgtattcgttcgccgtcataaaaacactgacctccgtatccacggccggcggtaattcattcggttttttttctatggggatcacgatattgcgccccgcgcttacctggtaaaataccaattcgtacttttgagccgtatccgggccgcacagcgacaccaccacttttggaatggcgatatcattggcatttttcacctggacgatcatattatttcccgtaatgattgtagaagtacacttgatctgttccctgtatttttcaatagagtcctgcaccttacgctcgtcatatacctcgcctccgtcactttctgttgccgcgtcctccgggataattccttcctgtatcagttcgttgatttcatcatccgttagcggctgtgtgctgctttccgaaggctccggcgcagaactcggtgcgctttcggaaggctgcgcagacgcaataatctgaaccttgcccgggtcgggcagggcgcatgcgctcagggtatatacaatcatcagcatgctcattgacatgatcaatatctttttcatacgccggtctcttcatgatccttatcttcttttgaatactgccattatagcagacgaataaaaaaggtggggaaaatccgcaaaatattaacagattgtttacggttccgccatatctggggaaaatcacccaaaatattcctgccgcgcgggccggttgacgcggccgttgtttgctgataaaatgaatcttgtcccgtttttcgggccgggaatgaggttctcccgcgggaaaccaaaactgctttttaagctgatgacttctgcaagccatgcagaaattgtcggcttttttattgagggaaaggaattatatctatgattgaatttttattggttggagcgggcggttttatcggctgctgcctgcatttttttatcaccaagctgatgctgcccatgccggtgcagatgcccctcgcaacgcttttttcaaacatcatcgccggttttttggtcggttttcttacagggatggaaaaggaaacctccttcatcacgccgcgcgcgaagctctttttgacgacgggtatgctcggcggcctttccacgttttccacgttcagtatggaaaccataaacctgtttttggcgtctgattatatccgtgctttcggcaatattattttcaaccttattttcagctttttgggagttctcctcggaatgttcacggccaaaatgttatttaaaaacaccgccgcctgactttatttccacaaaaaggatcggcccgcatagcgggccggtccttccgtcgttcgatggtttgtttcaaatttgagccagttttttatattcctctttcaggcaaccgtacaggtcgttatatatctcgtaatatttgggatattccttccggttttccggaatcggtgcacacacttgatccgttttgatcgccgccgcgcatgcggacggaacgtcctcatagatccccgcgcctactgcggccaaaatcgcgacgcccagcgcggggccttcctgcgacactgttgttttcacgtcgcagccgtaaagatcggcgagcatctgccgccataccggactcgcgctgccgccgccgcaggccatcatctcgtcgatctcgacccccatttcaaacaggatgtccgcacaatttttgagcgaataggaaacgccctccatcaccgcgcggatcatatcctttttcgtgtggatggccgataagccgaagaacacgcccctgcagtcgggatccaggtgcggcgtgcgttcccccatcaggtaaggcagatagatcagcttattgctccccaccggcacctgcattgcgtcacgattcatcaggtcgtaggttgggacgccctgtttctttgcctgctcgatataatcctggcaaaactggtcgcggaaccacttaagcgaaagccccgcgccctgtgtcacgcccatcacatgccagcagcccgggaccgcgcagcaaaaggtgtgcacgcgtcctttggggtcgatggttacttttgagctgtgcgcatataccacgccgctcgttccgatcgtcgtaaaggcgcggccgtcctgcacgatgcccgtacccacggcggcagccgcgttgtctcccgcgccgccgaccactaccgtttgctcggaaagtccggtttcgcgggcgatctccggcaatatcgtgcctgtcacctcaggcgattcatacacctcggcaagcatggatttatcgatatccagcttctcaagcacctcgtccgaccaccggcgtttcggaatatccaaaagctgcatgccgctcgcgtccgacacctccgtcgcatacttccccgtcaggataaaacggatataatccttgggcagcaaaatatgcctgcatcttgcatagttttccggctcgttattgcgtacccacaaaattttagacgccgtaaagcccgtcagcgcaggattggccgtgatctcaatcagcctttccgcccccaccttgcccgtgatctcttcgcattcctttgcggtgcgctggtcgcaccaaatgatcgaaggccgaatgacctcattcaattcatcgagcatcactagtccgtgcatctgccccgaaagcccgatccccgcgatatcgcctgcgggcacgccggaggttttcaccacgtccttgatcgtctttaataccgcgtcgcgccagtcctccgcccgttgctccgcccatccgttttgcggctggtagaggggatattcctgcgatgaagacgcgatcacgccaaaatcctcgtcaaaaagcactgttttggtcgccgatgttccaatgtcgatcccgattaaatatttcatattgttcctcccaccgttacaggttctctaaaattttgatctcgttctttacgataaagctgtctttctttggtttcattccactcacaacgtagtcaaatgcgatgtgcacggatttattgccctgtgtgaacggctgctggcagatggtcgccttgatcagcccctttttcatcatttcaaccgtggacgggatcgcgtcaaagcatacgattgtgatttcgcccgttttcccgagcgcctcgaccgcgcggcagacgccatacgttcccgccgcggcgacgaacagcgccgtgatttccggatgtgaagccagcatgcctttggcagcctcgaacgcgaccacatcgtcgtcgtttgtttccgccatatccacgacctttatctgcggataccgctcccttgctattgcaagaaagccctccacacggcggttgtgccccaatatctttttagaacccagcaatatgcccgttttagccttgcctccggtcaaaagccccatcataccgcatgcagtctgcccgccgcgctcataatcagaccccacatagcaaagccttttacaattttcgatatcgttgttcattgcgaccacgccggtcccgttttcctgcatggcgcttagaagtcctgcgatcctggggtcgttgattggattcaaaatcagcgcgctgacctccccgccgatttcttcgatcagctccgcctgccgcgaaacgtcgtagcctttcatttgcctgagcagcacgcgtacgccgtaatccttcagttcttcttcgccgcgccttatcccgcgcaatacttcgtcaaaaaacggattctcttcggatgaaacgattacgccgatgaccggcgcctttttgcgcaccgcaagcgccttgcccgccagattgggctgatacccaagctgctgcgcgatccgccgcaccgtttcttccgttttcggtttcacttttcccctgttattgagcacacggtccaccgtgcccctcgaaacaccggataattccgcgatctgcttgatcgtcgccgacatctgtccaccttcttatggctttcgtcatttttgtgctcatgcacacttctttgttttcatcataccgttatccctgtttttcgtcaatccatttttcttttttccgtttgtcacatgtgcaaaaaacgcctctgatccattgttttatagcatttttccattgcgtatatttttcttgcttttttatgcataaatcatttgacaaagtatgcaaacggtgttatgtttaatttgtaaatgtgctcgagcacatttatgcaaaacgcaccttacacttgcctgcgccacgcagtttcgcggacgcatgaaaccagattttacaggagtgaaaataatatggatatccagtcaatttcttcgccgtcttttgaaaagtacggcagacttttaagcatcggagcatatccgcagcttatgaaagcaatggaagaaacgcccctgcctgacgctgttgtctatgaaccggacattgcggctttcggcacgctcagtgaagcacggcagcttagggattctgtttttggcggcatgccgatacagatcggttattgcaacggcaaaaacgatacgctgaatgccgtcgaataccaccgcagcagcgagatcaacattgcctgcaccgaccttgtgcttttgctgggtctggaacaagatatcgaccgctcaggcaatacgtacgacaccgccgggatggaagcgttcttactgccgcagggcagcgcggtcgaactgtatgctacgacgcttcactacgctccgtgcgcgtcggacggaaataaattccgttgcatcgtggtgcttcccgcaggcaccaacctgccccttgcaactaccttggagcaggatggggaagacgcacttttatttgcacaaaacaaatggctgatcgcccaccctcagagcggtcttgaaaaagacggcgcttttatcgggcttatcggcgataatcttacgatttaaaaaagatggaggactttgttatgaataatatccctgaagtaaaacttggcctgatcgccgtaagccgcgattgtttcgtggtttcgctttccgaacgccgccgcgtggcggtaaagcaggcatgcgaagcgaaaggcatgcagatctatgaagcgcaaacgaccgtggaaaatgaaaacgacatgctaaaagcggtcgcagaagtaaaggacgcaggctgcaacgccctcgtcgtatttttaggaaacttcggccccgaaacgcctgaaaccttgatcgcgcagcacttcgacggccccgtcatgtatgccgccgccgcagaagaaacggcaaaagacctgattaacggacgcggcgacgcttattgcggcatgctcaattgttcctataacctcgcgcttcgtaagattcctgcagtcatcccgtcttatcccgtcggtacggcggaagaagtcgcgcagatgatcgcggattttgtccctgttgcgcgtacgctcatcggcctttcccatttgaagatcatcaccttcggtccccgtccgcaggactttttcgcatgcaacgcccccatcaagcccttatatgacgtcggcgtggaaatacaggaaaattccgagctcgacttgctcgtttcttaccgtgcgcataaaggcgacccgcgtattgcggatgtcgccgcagatatggcgggcgagcttggcatgggcaacacctaccccgacctgctgccccgcatggcgcagtatgaattgaccctcaaagactgggcggagcaaaacaaaggcgcgagggattatgtcgtgtttgccaataaatgctggcccgcgtttccggaagaatttggctttgaaccgtgttacgtcaacagccgccttgcttcgcagggatatcccgtggcatgcgaggtcgatatttacggcgcgctcagcgaatacatcggcgtttgcatcacgcaggatgcggtaacgctcctcgatatcaataacagcgtcccttccgacctgtacgacgcggagatcaagggaaaatacgattataccctgcgcgacacattcatgggcttccattgcggcaatacgccgttctgtaaactttctcagggcgcagtcaaataccagctcattcagaaccgccttttggaagacggcggcgagccggatttcacgcgcggcacgctggaaggcgatatcgcccctgggaaaatcacctttttccgcctgcaaagcacggcagacgccaaacttacctcttatatcgcacagggcgagatcctgcccgcagcgacgcacagcttcggcggcatcggtattttcgccattccccagatgggacgtttttaccgccacgtgctgatcgaaaagcactatcctcatcacggcgcagtcgcctttgcccactgtggcagggcgttgcacacgattttcagataccttggcgttgaagacatcgcgtttaaccagccaaaaggtatgctctaccccactgaaaatcccttcgactgattttatttccttccttatcataataaggaatagcctaacgcaaaagccactccttaaaggagtggcttttgttattcatttcaatatcttactgcatatttttagggcgaaacccctcaaaaataacggaatcagtatattcctttgcgctgtcgtactgctccctgttacgcaccgtccatgcaaagatgggcgcgccctgtctgcgcaggcggcggatcagccgcgaattgaccttgtgcagttcatagctgataaaattgggcttacagataaaattcacacccagcttctgtatgataagcagcaggttcgcgatcaggaaccgcttgatcttgccggctgcaaattcgttgcatttccagaaattgcatgcgagctggccacggtagatatgcggcgcgttccgcttaaaccaccgtacggagaaaggtgaaaacgactggatcgcatattttccttcgtactcgagcaacgcttggtaaagctgccgctccagcctgcccgccataccgcggtttttgatctctatcaaaagcggtacttttccgcctacgaccccgagcgcttcctccagcgtaggtatctggaaatccgtttccttaagccgcaagttcctcagttcacggtatgtgcggtcacggagccgccccgttacccctgtcatccgctccaggtccctgtcatgaaacaccataatcctgccgtcctttgaaagctgtacgtcaagctcgatggcaaattctgcgtctaccgcattttgaaaagcctgcagtgaattttccggaaccgcttcatcgtgcaggcccctgtgtgcatattggaattctgtcagccaggtcttttcctgcggcggggatacgaccgtcatgatccggttgaggatcaggacagctacagcccccagcccaaggacgataaaacaagctgctatgtctgaaatcattctgttctctctttcttttgttaccatgcctattataatcgaaaagaaagaaataggaaatagaaatttcagtaaaaatttcttaagaataaatgaattctgttcttttgaaatagtgtataccaattatagaatccacatgcatgtatcctcctgcttcctgccacatcctcatatttttcattttgtacgtttatgattgtaaaatcactttatcaatatagtatctcaactaatatgaaagaaggtgtgtattgatgctaacaacattcaaagctaccgcaaaaaaacttcccggcggacttcaggtggagacggattcccgtggtttcaagattttattggacgaaccgccggaacttggcggaaccgacaagggccttaaccccgtggaagctgttttgtgtgctctcggcgcttgccagaccatctgtgcggctgccttcgcgcaaaaatgcggcgtggacctcgaagatttccacgtggaaatggaaggcgaccttgaccctgacggctttttagaccttgcggacgtgcgcaatggtttccaggagatccgctttacaatgcatttcaaaacaaaatcaggacaggctgcggcggaaaaacttgcggactatatcgaaagccattgtccggtaggcgattgccttgaaaacggcgtaaaactcgttcgggcgggcgtagtcgtcgaatgacccaaatataaaattttacaaaccggataaaggcggatcattggtccgcctttattgtgccggcgtgcttgacagttatccgcatgacgcgtatcataaaatatacgaaaggcgatagcaacatgaaattttgtatcctaaaaagctctgtgcaaatggacaggatgagacattgcatggagcctaattcggctgcgaccagccgtttcatcggcagatggtattgacgcgcgcataaagggcgcttttgttgtgatactgtctttccggtgattttgatgatatggccacgggcaatgtcccgcggtttttttgtgccgcgaaatggtttttacggctcgaaaaggaatatcatcatgaataaaacaatacaaaattttatgacgggaaatttaaggcgccaaatgcttcgtttcgcatggcccttgtttctcgcaaaccttctccaatccctctacagcattgtggatatggtcgtcgtcgggcaatttgtaggcagcgaaggccttgccgccttaagcagcgcatccatgatcgtttttgtgatcacctcgctgtgcatgggcatcgcgacaggcggcgccgtgctcgtggcgcagtatgaaggcgcacgcgaaagccgactgcgcgcgcggacgatagggacgctctttacgctctccatgctcctttccgccctgatcacggttgtcagcctgcttacataccgcccccttcttgaatggatgcagcttccgcagaaggccatgcccttcgcgggcgattatatggatatcatctgcatgggcactgtctttgcgttcggttacaatgcggtgtgcgcagtgctgcgcggcatgggggattctacgcgccctttctattttgtcctcgtggcgacgatcgtcaatatagtcctcgacctgctgctggtgggcgtgcttcgtatgggtacgcggggcgccgccattgcgaccgtgatttcgcagggaatctcttttctggtggctgctgtctgtttgaagcgttcgggcatcgctgccggggcatacgcagtcggtttactgataccaaaaacggcaaagctgatccttaagatcggcctgccttctgccggacagatgacggtactcaacctttcctacctgattgcaacgggtatgctgaacgtcttcggcgtggcggtggccgcagcgtcgggaatcggcctcaagctcaatacctttgcggccatgcccatctgggcgatcgggcaggccgttaccacaatcgccggacagacgatgggcgcgggcgatactgcgcgcgcggaggctacaggcaaaatgggcgtaaggcttgtctatcctcgcttccgtgatcacgatcattttgttccaggtattcgccggcccccttgtcatgcttttcaatgcggatgcggccgtgatccgcgaagggatcctttacctgcgcatatgctgttccttcaactgtatcgcctatgccgcgatgtatacttacaatgcattcgcgacaggtgtcggggacgctatgttctcgtttttgaattccatgctcgattgcgtggtcatccgtattttcggcagtttgtttttgggcttcgcgcttggctatgggtttgcaggcatctatatcgcggaatccttcgcccctgtgcttcctgcaatcgtctccggcgtctattttgtgcggcggaagtggaaaaccagccggctggtcgccccataataaaacggcatagcttactatgccgttttatttgttttattttgccgtacaaaagcctcacggctttacatatgcatagccatcctcctgcttatcaacgatctcagcgatccctgccggtacgacttcgacaaaaggaatcaggctgcttgccataatggaattcgctttcagcgcattcctgcatgctgcaaatacgactgcctgtatcgcaaggtcctccatatcgccgaagagtccttctttctctgctttcgccgctgccagttccctgaccgcctcgctgtttgcaaggatctccacaatatattcttttcccgtttcttcaccgtatttcagcaggttctttgcatttcccagcgcaagtttccattttgcggattcatctacatgtatcagtactttcatttatttctcctttccggcttttgccgtaagctttttctccaggtattcctcaagcacggcgacgtcgctgtattgcgcatccttcgccgcatataccaaggtaacatctccctcttttaacttctcttccaccgtccctgcaaaactttctgttgaaggatttttattcagttcactgatatattgttttttaaatgccggaaatttctccggctcgtggtggaatgcctttcgcgttttcgtttggggcgcgatatcctttgcccacaggtcgatcgccgccttttccttggaaatcccccgtggccacagcctgtcgatcaggatgcgatatccgtcgtccgactgcgcagcctcatatgccctctttattttcagcataagttttctcacctctatcgcatgttcttacgcttacttataagcataatataacaccgcaaacaaaagattaacgaaacaaaatcttaagagtatcctaactttttttgttttagctgccctacaaccgtttattaccatactgctcacatctatactgcataatctgccctgttgcagagttgagatcctatatgcacgtgtttatgtgaaggctctttcagtaagatatgaacgccgtaccaaaaaaggcttggaagtctccaaagtcacgtttggtatggagcctaaggattacgaggtctatgggtatttcctttcaaaccggcaccggcttcgtttcagcccgccagttcctgtcaaagatgaaaaaaggacggatcattctccgtccttttgtttttcttccttcagtataaccgtttgcgtctggtaagggatcgcgatcccctttgcgtcaaattgctttttgatctcatagcgcaggtccgataagacctggttccccgttataaggtctttggtccatatgaacgcgcgcagcatgatggcggacggcgcaaaatcaacgatacgaatcagtacctccggcacgccgtttttcttatcttcttcggtgcgcatatcgatatggtctttgtttttcagcacggcgtccgcgatgatcttttttgcaaggtcgatgtcgctgtcgtacgatatccctatgttgagctggttgttcaccgactggtccggcagtccgtgcgaggtaagcaccatttccttgtccagcacgccgttggggatgaccacatgcttattgtccagcgtacggatgatggtgtgccgcaatccgatatcgtgcaccacgcccgacacattctgccctatgatctccacataatcccccagctcgaacggtttactcacgccgatggatatcccgctgaacagattgcccagcgtcgtctgcgccgcaaggccgatcaccacgcccgcgatgcccgagctcgcgaggatgaccgaggcaaattgctttaacggctctatggtcatgagcaccgagaatactgcgatcacgatgatgatcacgtaaatcagccggtaaaagatacgcatattgcccgtgagcttcttttttaggaacttagacaatatcttcaggataacaaaagtgatcaggccgacaatcgccgcaaaaatcagcgtgttccaaaaccccagcgtgaacattttttcaaagccttcaataaagtctttggttttatccacaatctgtgtggtatcgttgttcatgtatctacctcgtccgtttccttgttaatcttatgatacccgcttgtatcttctgcaaaacgcgccatgttttctcttcccttttttacggttatatattatagtatacaaaaacgttccggagggcaaccaatttgatttcttacgaggaaatgggacaaatgctggacgaacttgcagaagagcttccgcaggaattttttacagagctaaacggcgggatcattctgctcccgcaagcggaaatgcatccgaaaagcaaaaacaatgacctttacgtcatgggacgttattataacagcagcgatatggggcgccatatcgagatatattacggttcctttgcccggctttacggaaactcctcaccggacaggctgcggcaggaattgcgcaaaacgctgcggcacgaattccggcaccatctggaaggtctttccggcgagcgcggtctcgaggtagaggacgaagtatatatcgccgaatacctgcgctcccatgcggatgtttaaaatatgggccgtcaatttttcacttgagtttttgatacccctgcgcctatactggtaatatgaatgcatggaatccgtggcacggctgccataaactcagcgccggctgccaaaactgttatatgtaccggcgggatctatccgtcggaaaagaccccagcgtcgtcgccaaaacggcttcctttgatttgcccgtcaagcgcaaacgcgacggaagctacaagctggaaggaaaacgcgaggtgttcacatgcggcacgtctgattttttcctggaagaagcggacgaatggcgggagggcgcttggcgttttatccgtgagcggcaggatatctccttcctgatcatcaccaagcgcatccaccgtcttcccattggcctgccggacgactgggggcagggttaccccaacgtacgcatcggctgcaccgtagaaaaccaggaaatggcggatcagcgccttcccgtattcatggacatgcccgcaatgcaccgcatcgtcatatgcgagcctattttggagcgcatagacgtttcttcctatcttgccacgggaaagttcgaacacgtggtcgcgggcggcgaatccggcatgcaggcgcgcccgtgcgactacaggtggatcctttccctgcacgagcagtgccgtaagcactgcgtcagcttctggttcaagcaaacggggcgcaacttcttaaaagacggcaagcggtataccattttaaaacgctaccagcactcccaggcgcgcaaggccggactgaacttcactgtaaaataaaaaatgcttctacaggaaacggtattccgtcgcaaacctgtattcctgccctgggcgcaggatacacggcggaaactccggatggttcatgctgtccggatagaattgcgtctcaaagcaatacgcgctccgcgctgtgtaaagtgcattgttttttccacgaatgggcggcatgttgttcgccgtataaaactgcatccccggcttgtccgtatacacctccatgatgcgcccgctttgcgggtcttctacgcgcgcagcgcgccgaaaaccgtttccccgcactgcgaaattgtgatcatagccgccgcaccgcttcatttgtatatcgtctgcgtcgatacgctctccgatcgcgtggggagatgtgaaatcgagcggcgttcctgcgacgggcgcgatctcgccggtcgggatcagattcttatcgacaggcgtgtaataatccgcatcgatttgtacgacgtgctccccaacctgtccgccgccccgaatattaaaatacgaatggttcgtcaggttgaggacggtcgcttcatccgtatgcgctgcatacgcaaggcgcatcgtattgtcgtctgtcagcgtgatttccatacgcacctccacatgcccggggaacccgtcttccccatccggactgtcgtaaaagagggccagcgtgtttttgtctgtttcccccgtccatataccgcggtcaaaactgtggctgccgccgtgcagcaggttcacaccgttttcgttgcacgggatctccaccgttttcccatccagcacaaaacggcctccggcgatacggttcgcgtatcttcccaccgtcgcccccaaaaacggatgatcgccaaaatattcctgcggggtggaaaatccaagaaccatgtcctcgcgattcccctgcgcatccggtatttcaagcgacatcacgctcgcgccgtaatttgtcgccttaagccgcgctccccgcgcattttcaatcgtaaaaacaaaaatatcccgtccgcctttttcacacactttctctttccgtgccacgttgtattcctcctgcgtctttcttcttattatacttgaaaagcaacccatccaccacttgtgatttattggaaaatgatgtatatttaaagttaattctaaagcatgcaaagagggtaataatatgacagaaaacagggcacaattgcacggcagtttttcgaattttccggtcaatccgggcgatgaggagcttatcaattttgacgtggtagtaaaaatcggttcgatggctctgatacgcaaggaagacaacgacatcgactacaatattttttcgcggctggcctccggcctcaagcccggatatatcctcgtttcttccggcgcgaccgagatcggccgcatcgattatatgaaacgcaacggcgggcgggagctaaaaggaaacctcgccgctatcaaaacggcgtattctgcccagggacagccgatcctcatggaaatgtaccgccagtttatcaatccgaaatattccgtgcgccaggtgcttgtagagcatagtcattttaatgacgagcgcaaggtaaaccatatccgcaacgtgctgttttcggcggcgaaccagaatgcgatcccgattgtgaactacaacgatgcggtctccgatacggaaaatatgcgtatggagctgcgggatttgaagggaaaagctgcaaatgtggtggaatgtgtggacaatgacgaaacggccgctgtgatcgcgcagcttgtaaacgcaaaaatactcgttttattgacgagcgtcgaagggatctatgcggacgcaggcgacccgtccacgctcattgaagaggtgaccggctctacttatgaggaagtggaagccaggatcgacgatatgatgcagcactgcaacggcgcgtcccgccagggcgcgaacggtgcaaaagccaaattgcagtacgcaaaggagccgctcaaaaacggcaccaccgttatcatagcgcatgcgcggcacaagctgtccgatattatcaagggcaatgtccgccgtacgctgctcagcgttcaataatgcttaagaaggacatgaatatggatcatgaagcgttataccagtcaatttttcatagaaaatccgtgcggaaatatgatactgccccgcttacgcaggagtcgcttgatgcgctcaagggttttattgcggagctgaagccgctcattccggacatcaaaacggaaatcaagctgctgccgcaaagcgtggtcaaagcaaatgcgccccagagcctgtgcttctattcggaaaagaaggacggatggcgtatgaacgccggattcctgatggagcagattgacttgtatctttccgcgaataacatcggcgcatgctggctcggtacgaccaagcctgcaaaaggcggcgttgctgtaccagaaggcatggcgtttgtgatcacgctgtgctttgggacgcctgcgcaggaaatgcatcgcgaaaacgtcgcggaattcaagcgggattccttaaacgatatttcgcccgtttcagatttgtaccacattttagaacctgtccggcttgcgccctctgctatcaacaagcagccgtggtatttttccggcagtgcggaccgcatcatcgtcagccgtaaaaaatccttgctgcttgacaaactgaaccagatcgatatcggcattgcgctttgttgcctgtggctttctttaaagcaccaaggtaaggacgcagcctttgatttcacgccgtcgcctgttccggataagcatatctttatggccaatgtaaacgttatttgatccttaaaatgcaaacggcgggttccccgccgtttttttgtgcagtgctccgtctgcaccagctatatattatcatgaagaaacaaaataaaatcagtcctttttctttctggaaatattggaaagtgcgactgccaatatgatgatgacgcccctgatgatcgtctgctggcttacgctcaggcccgccaggatcagtccgttattgatcatgcccatcagcatagaaccaacgaacgcgccaattacggagccggtgccgcccgccatgctcgtaccgcctaaaataacggcagcgataacggacatttcgtcgccgtcgccaaacgtataacgtcccgcctgcatccttccggaataaaggatacctgcaaaggcagcaaacgcaccgctcatgacgaaggtcagcagctttgtcttgttgactttgatgcccgtgaatttggctgcaacttcgttgccgcctgttgccaggacctttttaccaaaagacgtcttgttaagaagcaatgcaccaaatactacaaatacgatagtccataacagcagtaccggaaacccgccgatatcgccgatcccgaacgcaaaacagaaatcctggttcgtgattggaacggcggccgtatccgtcatccacatcgcgctgccacgtacgatattcatcatacctaacgtcacgaggaacgcgggaatcctgaattttgttaccagccagccactggctgcgccaatgccgatcccaagtgcaatcggccctacaagcgccagaaatatattgtttgtggactgtaaaataagcgcgcacgtcaatgacgaaattgcggtaatcgcccctacggaaaggtcgatctgcgcagcagcgattacaaacgtcatggctaccgccataatggagatcatcgcggtctgacgcgtgatattcaggatattattgacggacacaaaccccttatcattcaaccagatcgaaaaaaagatgaacatggcagcaaatgcaaaatatacgatgtatttgctccagtcgattttatgctttgttaacgctttatccttggattgcatgttggattacctcctcattcttcatatcttccctacccagttctccgacgatcttcccgtcgaacagcacaatgatcctgtcgcacatcgccatcagttccgcgatttctgaagagacaacgacaacgctgtttcccttatccgcatagtcgacaacaatcttgataatctctccctttgcaccgatatcgatccccgccgtcggttcatcaagcagcaatacctttggatttatattaagccatttcgcgataacgattttttgctggtttccgcccgataagagacttgcgatcttgttgatcccatccgtcttgatgtccaggtctttaatattctgctgcgtataggcgttgatttttgacgtatcgatcagcaatcccttttgcgtctgtttgaagatcggcaactgtatattgtccttgatgctgtgttcgaggatcaatccctgtcgcctccggtcttcgggcacgagtgcaaagccagcgtcaatcgcatcctgcacgcatttgattttcacttgcctgccgtctactgtaacgctgccgttttgtattttcctgatgccgaaaagcgcttccagtatttctgtcctgccgcttcccatcaaccccgcaagcccgaccacttcccctgctttcacctcaaaagacgcatggtccaccaggccttccacgcttaagtcttttacttttagcatgcacttttgctcatccatatgggcgcgctgttggtattcgaacgcccgtccgcgtttttctcccagcatatattctatgatggaatccacggtcaggtccgtcgctttgcgtgttgtcacatatttcccgtcgcgcaggactgtcacttcatccgcgatctccaaaatctcgttcatcctgtgggaaatgtagacaatggatacgcctttttcctttaaaatgtgtacgatattgaacagcagctttacctcgctgtccgaaagcgaagcagtaggctcgtccatgatgaggatctttgcttccttggaaagcgctttggcgatttccaccaattgacacagcccgacgcttaagtcggataccttagccttaggggagatgtcgattccaaattggtccaaaagtgcctttgcatccctctgcatacgtttgtcatccagcaacatcccctttttttcttcttcgttcagataaatattttccgtaacggtcagtgtcggaatgatgctcagttcctgaaagatcatacggatgcccaccttatttgcatccgcatagcttaagaaatggacatcttgcccgtccaccgttaccgttcccccgtcctttgtataaataccggtcaggattttcatcagtgtggattttccggcgccattgcctcccaccaacgcatgtacatggcctctttcgaggttaagctgcacatcatccagtacctttacgccattgaacgatttatccacatttttcatttgcaatatatattcgttcatttttcaccccgccaaaaagcgtcgccctttccgtcttaaaacggaaaggacgatatttttttattcttcgatttcgccaaccttttcccattgctcggattgcgcggaacgaagtaccgcgtcggaaataagttcgatctgatacccatccttaaaactcggatcagcttgcttgctttccgcaatcgctttgataaaatcgtacatctcaacgatttttgtctccgtatacccgataccaagcgcgggaatcggccataagccttcaccatacggatgggcaggacccgtatacacggtacggaatccacggcggtcgtctttatcgtctgcaaagcaaacctggagttcgtcgcgcctttcatagttaaacgcaaccgatccttttgtcccatgtatctcgaaggtgatgaagttatttcttccccatgcgttgcgcgtcgcttcaatcgacccgaacacgccgttttccgctttgaccataaagaaacattggtcgtcaacgtccacctttcctttgggaacatcgctgccgccttttacgttgcccaggctgtcaacagcacctgtctgcacagggcgctgttcgatataggttgccgtatgcgcgttgatctccttaaattccccgaccaaaaaacgtatcatgtcgacgacgtgcgttgcgatatctccaagcgcgccgctgccgcatacttttttctggaatctccaggaaagcggcgaattcgggtccgccgaccaatcctgcaaataagtagcgcggaaatcgaggatatctccaagcgcgccttcctcgatatattttttggcaagctggacagccggcgtccttctgtaattgaaagcgagcatattgacaacgcctgcttttttaacggcgtggtacatttcttttgcttcttccaccgttctggaaatgggtttttcgcacaggatatgtttccctgcctgtgccgccgcaatcgcgatctccgcatgcgcgtcgttgggagtgcagatatcaacgatatcgatctcagggtcattgataatgtctttccagtttgccgttcctttttcaaacccgaaagaagccgccgcatcgtccgcacgctcttgcgtcaaatccgcaatcgtcttttttaccgtcaggccgggcgcaggccagaagaacatgggcatccccgcataagcgatggaatgcgctttcgccatgaatcctgcgccgatcaaaccaactttgtatgttttcattttatcgtatctcctttgtttccattacaaactgatggtgtttcttttgttggggaccttttcagcggggaaggggaacgtcccccgcccccgccaaaccgcttaccctgcttatttgctgtacgcatcctgtatttcctgcggtgcatccgtgtgatataccgtcgtatatgcatccaggacattgtcgtgcgtgaccttgagcgccggaaccgctacatacggcggcgcgtccttgccaagaagcgcatatccgacaagcgttgcttccgctaccccctggtcgtaaggaagctgtgcgcccagccctgctacgatatctttccccgcgatcatttttgcaatattgtttccaagatcgatcgacgttaccacaaggtcattcctgcctaccgcttttgccgcagacacaacgccctctgccggaatatcccaggaagcatagattccgttcaagtcaggatatttggtcagcagcgcgtctgctacctccgcgcctttgttctcatcgtcaaagccggatttttccacgatttcgatatccggatatttttccctgatcgttttttcaaacgcttcgtccctctggtttgttacaaagaagttcgcgtcataatataccattgcgatcttgcctttgccgcctaacgcttcccccatgatctctgcggattttacgccgttgccatagttatctgccgaaacgacggatgtataatccttgcctgcctcaagcccgtcaggacagttatccataaaaacgagcttgacgccttcgtcggccgcctttttaaacgcggatgccgaggatactacgtcaaccggaattgctacgatcgcatccggttttaaggatagcgcgttttcaatatcagagatctgctgctccggcttgaagttcgcgtctgttacggacagtacttcgatgcccattttttcgaactggtcgcggaggcctgcctgctgggctgtggaccagtcgtttcctgcatagtggaaagaaatcgccaccttgtaatttccttctttgagttttgccagttcctcatccgtcagtgaaagttccgttgcggcaaaagcgctctcaccgtgcggtcctttactcatcacttcgctgtctgaagccgcgctctgcgatgccgcgggggtctctgcactttcggatgcttctgcgctttcaggggccgcagattccggcgcagatgcggaagcgctctgcgatgccgcgggcgtttgggatgtgcatccggcaaataccgctgccgaaagcacaagacacaaaacaattgccaatacttttttcatttctttttcctcctggatatatccttatttttataaaaggtcctttaaatagtttgccgtgatcttcgcgccctgacttgcgtcgccgttccagccgtcgcattcgaccgcccagaggatctccccgccgcgttttttcagcgtatcgatgattggaacaaaatcgatcgttccttccccaagcggacagaacatcccatcctccgtaatatccttcaaatggaaataaaggatccggtccgcatatttttttgttaccgtgagcgggtcgcccccgcctaattttacatgtccgcaatccgggcatagcttgatacgcgtttttgccatgaccttatcgagctgctccggcgattccaccagggatcccatatgcggatggaaactcgccgtcatgttaaggctttccgctatctcacaggcgcggtcaaggcctgccgcgagttttgcataatcgctttccttgataccatcgtagcgcgtcgcaccgccccccaatgcgatctgtgttgcgccgaaacggctggcgaattccgccgcttttttgaggcgatacatttcttccggcaatatctcgtcataaataaagcagcatgccgagtaaatcgcgcgaagccttacgttatactttttaagaagcgcgctcaagtcgtcctccctgccttcatacgcaagcaggtttccgtcgaacatctcgatggaatcatatcctgccgccgcaatccccgcgattgcttcttcgtcgctgcctgggcacatgtaatatgccccgtttacattgttgggcgccgcacagcttgccatgaccggcgaccatgcatttgtggaatacgtaaccttcatttctgaccctcctagtcgtttttttaaatgtgtgtacacaaattcttgagcaaaagtttgttagataaattctttgataaattagaattcaggatattactgcattggatttttattccaaatttgattgcaaagcatctcaatccattaatttacgcaaactttagcacctatcccaaagagggtcaagcaaatttggccggagtgaatttttttctttttttatcggttttttcgtatgattttacgtaaattttcccgctaccgcttcaaaaaatccggcacgggcatgtgcaggatatcgcgccatgaacgcgccaattcgtttggaagaacgacgaccggctgcacgccaatgaatttgtagcgcttttttccaagcagcgcctgaatcacggcgagcgccgccgcttctccttgctcatatggacgctgtgcggagactccccgcaccatttcacctttttgcatatattcagcgatctgtttatcaaggtccaccgtcacaacggaaacatccgccctgccaatgtcttttaaggcgcggatcgcgtccagggccggacgttcccaggatacgtaaagcccgtggatctcagggtgcgcttccatcatttccctgcacgcactataggcgtttggtattttataaaaacttcgctggtctacaatatcgatatccggataattttcgatcaatacttgttccgccgccgcatcacgctgctttgtcatatggaagggcaagccatggttgagcattcccacctttacattccccttgcccttcagatactcgcccagtatctttccggcgttttgcccgttttccctttcattgacggatacacagctataataatcgtccgcattgagtccctgcggcacattaccaatgagcacgagttttgtgttcttcgaaaggtccttaaacttacctgcggtaatattttcgtccgccggtacgccaatgatcgcgtcaggcctctgcatgcggatcgcctctagctgcgttacctgcagcgccggatcgaagttggcatccatgaccgagattacctgtacgccatattttccgagcgtatcgcggatcgccagttcgtgcagccgcgtccattccgtccccgtatagtggaaggaaatggcgaccttatagtttcccgcttcaatctgctccgcttcctgctggctcagcatgatatcttccggcggaactgcgatctcgccaaacggaccgcgattgataacgcgcgtcgatttacgtactgtaatattgaccggcacccgcttaaccggttcctccacaggctgcccatttatcttgcctatcatggtcctgaccgcacaacgcgccatttctcgcgtatcctgcgtaagcgtggtgagcgccggattggttacgctgctccattcgtcgtcgccgaaaccaaccaccgaaacatccttcgggcattccagcccgatctcgtcgatatcctgcaataattttaaagtcagcgtattcccgcctgcaataaaagcagaggggatatcgttacatttctggtcctggaagatattccccctgtctggcgcatataggtcaatgcctttggtaagcgtcttatcataaggaatgtcgtattcgcgcagtgccctctggtagccggcaagccgttccctgcttgtggaaagtccatgttcttccaacagtatgccgatcttctcatggccgcttcggataaggtgccgcgtcccacgataggttgcttccgcattttccgccaaaatactgtccatatcgacccccggcgccatgcgttccaaacaaagcagggggattcccgaccgcaggagtttttcgtaaatttttgccttatcgctggttggcgtcaaaaagatgcccgccgtacatttgcttgacatgaggcaggtcaggatatgtttttcccaggccggatcatccttggtaatataagcggacaagacatatccttcttcacgcaaatactccgccagcgccatattgagttgcgcataaacgacgctgctgatattgggtacgacaaaagcaatttcagactttttaccgatcctgaaattactgtttttaccctttacctttattttttccacataccccgtctcaagcatcacacgctgcacccgtgatgccaaatccggacttacatagcgcgttttattgatcacatgcgaaacggtcgcaatggatacgcctgctttctccgcgatttgtttgatcgtcaccttgctttcccccagtgtctttaagttgcgtaaattgtagcaaggcctttttttacagtcaatgaaaaacctttgtttttccgtaaaaaagcacgtttgctgtatatttacgtaaatttatccattttctgtatttttctttcgttcacttttctggtggtaagcggtattttgatattaacgttgtaaaattccatctgttgctttatgattagaggtactgaggccaggaggaatcgacatgaaaaaaattattttggttatttgcctgctcgtagtccctgtcttgctctgttcttgcatggccccgttctatgcaatgcggcaagccgccgaaaatgcacgtttccagcctgaatacagcggcagttcctacaacggttattttgatgctgattattatgatgatacttacgctagctatgatgacggttataacgatgggtacaatgacggctatgatgatggctacagcgacggatacggttcttatgatccggacagtatcggcaatggcagtaacgctgcaagcccgcgcagtgtgacttgcacgatgcccacagttcccgtaaccttttccgtgccggataacctggccgttttttatgatgaggcctaccaaacggaaagcggctggcagggcgacagctacgctatgacggatcccgataccggcgctgttttttcgtttaccaccaataaaaccagccggacggaagcgatcggcgatttcgacaccgccggcggccaaaaggtttgggaatttatcacgcaggatatacaggacatgcaaagcatagtggaagacaattgcgtgatctccgattatgggatcgcaaaaatgcaggacacgacctacggttatcttcatttcacctgtgatgatccggaccttggccagttgtatgtcgatcaatactatactgtaaaaaacggcgtgtgggctgttttcgaactttatacctttgatgaagagccaagccctgctttggagcaagttttacgcgggattattgaatctgcatattatctataggccgaactttccctgtttttttctcagatcgcttttgcttcttcctcgttcttttcacgctgcagcctgatgtgcagcttgcgctctaggtccttgattttcccatgctcgcgcggcgtgatcagcgtatacgccttaccgtcttttcccgcgcgccctgtccggccgatgcggtgcacataataatccggcttgtccggcacgtcgtagttgatcacaaggtcgatcttgtcgatatcgatgcctcgcgcagcaacgtctgttgcaatcagtaccttcgtttttcccttgcggaaggtattcatgatggtgtcgcgctccttttggcgcatgtcgccgtgcaggcacgcggaagcaaggccgcgtccgcgaagctctttttgcaattcctttaccttccgcttggtattgcagaatacaagcgacagcctcggttcgcattttttgatcaatccgcataccgcatttgattttcgtttcgtttgcatgtaagcctgcgcaaccgtctcgaccggcttgttttgcgcgccgatttccacgcggacaggatcggtttggaactgcctggcgatcgccgttacttccttgttcatggtcgctgaaaacagcatggtttgacgcttttccggcacacacgacaggatttccttcatgtcgtcccgaaagccgaaatccagcatttcatccgcttcatccatcacgaccgtacgcacatttttgagcttcagcgcattcctgcttatgaggtcttttaaacgtccgggcgttcccacaacgatctgcgcgcctgcgcgcaacgcttttagctgtatgccgacggactgtccgccgtatacgctgacggtacgcacgcccctcatatgtccggaaagctccgcggcgacctttgccgtctgcatggcaagctcgcgcgtcgggcataaaatcagcgcctgcacctttttgttcggcgggaaaatatgctctaagatcggaatcataaaggcagccgtttttcccgttcccgtctgcgcaaggccaatcaggtcttttttctccaaaaggggtagcagcgtttgttcctgtatgggcgtaggtttcctgtagccgattttatgcagcgtaccgttcatctcttttgataattgttgcgaaaaactcaagtagttacctctttccaaaaaaataagacttcgctatctcaaagcaaagtcttttccttaatctactttgtaataccgaaagagtataccacgttatgtgtcaaatgtaaacaaaaaccgtgtattccggcggcatgcctgccccttagccattgcccgcgctgcagtttgccgcatcgatcgccaatacgaccatgagcgcatacaatgcatttccaggattctgcacttctatttcataggtatccgagaggttccatatcttcttttgcgcgctcatgatcagttcttttttgtaatacgcccgataattccattgcataaaatcgccctctattgcccacccgttgaaatcaatattatacctcggcttgaacaaggtgaattctttgctgatcgtaccaatacggcgctcgccttcaaacaattcaaactttggcaggaatgtaaagagccgttccttgatctgtccgattttttgtccggaaggcgtgtaaatattgagcagatgcccccaagctatttggccttttaccgtaaacgccgtttccccgttttcatagaaaatatcatacgaatcaaaccacgaaaatatcctttgcttaaatagtaatcgcatcctgccgccctccgctttcatcaacagtatatcataaaacgaacgtatcaaaaaaagtcctcccaataatgggaggactttttgttcgacttatttctcttctgcaaggctcttgtagtactcgtaccgttcctttgcttcttcctcggactttgcaaacaactcgtctgcatgctccgggaaaatcttcttcaaggatttgtaacgcgtctcgctcatgatgaaatcctggaagctcgcggacggttctttggaatccagcgtgaacggattcttgccctcttccttaagaagcggattgtacctgtaaagctgccagtaaccggcttccaccgcacgcttttcttcgcgctgcgtcttgcccatgttgatcccgtggttgatacacggcgcataagcaatgatgagcgacgggcccggatacgcttccgcttcctgtatcgcctttaagagctgtccctggtttgcgcccattgcaacgcttgcgacatagacgtagccatacgtcatagcgatcgcgccgaggtcttttttcttgaccttcttgccggaagccgcaaatttcgcgatcgaaccggtaggcgtcgctttactggcctggccgcctgtattggaataaacttccgtatccacgacaaggacattcacatcttcgcccgaagcaagtacatggtcgagtccgccgtagccgatgtcgtatgcccagccgtcgccgccgaatacccatacggatttcttgataaacagatccttctggtctaagatcgctttgcatgtatcgcactgatcggcaaccttttcaagcgcagcctcgaggtttgcagccgcaatcttggactcatcgcccttatcggcaacttccagccatgctttcatcgcttctacgactgccggatccttctggccgtctgcgtcgattgctgagcgcacttggtctttcaaagcgctgcgacgggctgtgaacgcaagattcatgccataaccgaattccgcgttatcctcaaacagcgagttcgcccaagccgggcccttgcctgcgtcgtttgtcgtatacggacatgtgggcgcgctcccgccgtaaatggaggagcagcctgtcgcgttcgcgatggtcatcctgtctccaaagagctgtgtcacgagttttacatacggcgtttcgccgcagcccgcgcatgcgccggagaactcgaacagcggttttaagaactggctttccggaacgaggtttttcttaatctcgatcttcggttccggcagggatgcagcaaattcccaatttgcagcctgcagcttttcctgctcctgctggggcttcatcacgagagccttttccttcgccgggcagatgtccgcgcagtttccgcagcccgtacaatcgagcggggaaacctggatgcggtagctgtagccctctttgccgcgcgccggtttcgtttcgtagccggccggagcatttttcattgcttcttcgtctgcgaggaacgggcggatcgccgcgtgcggacaaacgtaagagcactggttacacatgatacaattatcgatctgccattccggcacgttcacggcaataccgcgtttttcgaacttcgtcgtgccaaccggtacgaaaccacgcggatcgaatgcggaaaccggaagctcgtcgcctttctggatcaggatcggatgtatcacatcgcggaaatactgatcgtccggaaccgctaccggagcagcgccttgcgttgtcgtcgcccaactgtcaggatatttgacttcctgcaccgccatgcctgcgtcgaccgctttatagttcatgttaacgatctcatcgccttttttgccgtaggttttcttgatcgcctttttcatataatcgatggcgtccgcttccggaatgatgtttgcgatcttgaagaacgcagactgcatgaccatattcgtcctgccgccgaggccgatctcacccgcgatcttgatcgcgtcgatgttgtagaatttcagtttcttttgagcgatcacattcttcatggctgccggaagctctgtttccatttccgcatcgctccacggcgaattgaggaggaatatgccgccttccttgatcccttcgagcatgtcgtaacggatcacataggaaggattgtggcaagctaccatattcggctgcgtaatgaggtaagccgactggatgggggatttaccaaaacgcagatgagaaatcgtaataccgccggatttcttggaatcgtaggagaaatacccctgcgcgtacatatccgtgtggtcgccgatgatcttgatggagttcttattcgcgcctaccgtaccgtcgctgccaaggccgtagaatttcgcgctgaacaggccgtgcggcgaagaatcgatctcgtctttgatttccagtgaagtattcgtcacgtcgtctgtgatgccaaccgtaaagtggttcttcggcgccgctgccttcatgttgtcgaataccgctttgaccatggaaggcgtatattctttggaaccgagaccatagcgtcctgcgagcacctttacagacctgcctgcttcaaagagcgccgttacaacgtcttcgtaaagcggttcgccaaggctgcccggttctttcgtcctgtcgaggacggttactgtttccgctgatgccggaatcgcgtcaacaaacgcgcttgcgtcgaacggacggtaaaggcgtaccttgatcaggccgtatttttcgccctgcgcgttcaggtaattgacagcttcttccgttacatcgcagccggaccccattgctacgacaacgtgttttgcgtccggagcgccgacataatcgaacagatgatactgacggccgaacatttttgcaaacgcgttcatcgtttcctgaacgattgccggagtcgcctggtaatatttatttgcagcttccctgttctggaaatagatgtcgggattctgcgccgtaccctgctggtgcggatggtctggattcatgccccttgcacggaaatcttcgaccgccttccaatcgaccatttccgcaagtttatcatagtctaacagttcgattttggatacttcgtgggaagtcctgaacccgtcgaagaagtgtacgaacggaacctttgctttgagcgtggaaaggtgcgcgaccgcagccatatccattgtttcctgtacggaagcagccgccagcatcgcaaagcccgtctgtctcgcagccatcacgtcagcatggtcgccgaagatagacagcgcgtgcgcggcaagcgccctcgccgatacatggaataccgccggcaggagttcgccggagattttatacatattcgggatcatcagcaaaaggccctgcgacgccgtaaaggtagacgtcaaagcacccgccgctaaagaaccgtgaaccgcacctgccgcacccgcctcagattgcagttcagagattttcattgtctgaccaaagatgttttttcttcccatagccgcccattcatcacaggactctgccattggcgaagaaggagtgatcgggtaaatcgcgccgacatctgaaaacgcatatgcgacatgcgcggcggcggtattaccgtcaattgtttgttttgccatgaatcgtgacctcctagttttatatatattattcaaatgttcacaacattataattatagtattttcggcagtgaaaagtcaaggaacaatgcgtgtttacgcggttttgcgcccgcttaggtcttttccgtcccctgtggatgttccgccggcgtgctttccgcatgttcccgcttcgtttcgcggatatcttttcccgtgcgcaccctcttcatcggcgctttcttatacatccgcttgaacggttttctttcttcctgcggaacgatcgctttgccgtggaacgaaacattgtaaaattcgctttgcaattgcgtcatatccactttatcttcaaaatatgcctgcacaaggttaatgcggcgcacgctccacgcgaccgcctggtctaaaagcccgaaatagaaatcgtaatcataaagtccctcatattccccgatgggatgatagagcatggttttcaatttcaactgggaaatgatattcaaaagttttagcttaaaaaggtctttttttgtcggctgggagacaagtccattataatattcataatatttacttgccttcgtatacggctgatcgtccaccttgagtccggggaacaggtaagacatgcgtttatagaattcatcgatctcgcccgtatccacaaaaatatcatgtgcgaatttctgtttgtcaaaggcgtaagcatccacgccgtttttacgcgcatataaaatatccagcgcacactctaaggtattgtgcgtggacatcggtttggtctccttgttgatccatggatgcagcagcatgtccagacaataatgcgtgatgtatccgtaaaaataacttttcagcgtatcgctgccatgctccttgatatactttgcgctttcacaaaaaaaacgctgcgggcgtgtatagtgcagcgcccatcccagcattttttgtttcgcgccgcacaggaaaaaataaaatttgtataacaaaaagatatccccgccctgcgagccggaataaaaagcgggcatctcacgagcgatcagttcccccgcgccggtatgctccaattccttaaaaatgttgtccgccgcgatcttatgcgtcagcgttgtaggcatactttatttcacctgtcgtttcttatttcatatcatttggccggacggcgtataaaggtaacaagccggctcgtgcgcttcgatgatacccacgctctgcataaaggactcgcagatcgtgtaacccacgaaaacaaaaccatactgtttcaatgcttttaaaagctgctccggtctttttaggccgtatacgaaacggaaaaaattaccgtgctctttgctcaacctctctaccgcgcgcgcgttttcacgcacggcaaaaatcttgcggcggttgcggataattgcttcgtcctgcataagcgattccaaatattcatccgtgagacaggcgcattttccgatatcaaagcctaagaacaccctccgcaaagcgtcccttttgaccaagaccgttctccacgaaagccccgcctggaaactttccagacacagcttttcgaagagcgcgttgctatcggatttgattttgccgtactcgttgtcgtggtaatcgatcaatatatcgtccgtcgcccaactgcagcgttttttatctgtttttatgtccatagaccttatcttaacacattttgcacaatttatctcgattttgtgatagaatttatagagatttcataattttaacgagcgaggaacaacgccatgaatacgctttggagcgataaagcaaaaagtttaaagccatatacggcgggtgaacagcccaaagaaaaattgatcaagctgaataccaatgaaaatgcatatccgcccagtccaagggttttggaagcagtgacgcacgctgcggccgacctgcggctttatccttcgcccgattccgacgcgctgcgcgaagagatcgcaaaataccacggcgtgaagcccgaacaggtattttgttccaatggttcagacgaagcgcttgcgctttgcttcgcggcttttttccagaacctccatactgtgggagaggaaaacgccaactggtttcccaacgtatcgcttccgtttcgtttgcggaccttagacgtcacatacagcttctatcccgtatgggcggaccttttcgatattcctcttgacatcgtgcccctcaaagacgatttttcagtggacgtacctcggatgcatggcgcgcgcggcgtggtgctcgccaaccccaatgctccaaccggcgttgcgcttcccttaagcgatatcgaaagcatcgcgcaaaagacggagggcgtgttcgttgtggacgaagcatacggcgcgttcggggcgcaaagcgcgatccccctcgtctccaagtaccgcaacgtggcggttgtgcgtacgctttccaagtcgcatgctcttgccggcctgcgcgttggatacgttattgccgacaaagacctgatcggggctttaaataccgtaaaggacagcttcaattcctatcccttagaccggcttgcgcaggcaggcgcgatcgccgcgatacgggatacggaatattatgacaaaacgatccatgacattatcagcacccgtatcgacacgatcggcgcgctttatacgatgggcatcaagtgcctgccctcgcacgcaaactttttatttgtggaatttgatacctttcccgcaagggaagtctttcaaaagctgcgggaaaaaggcgtgctcgtccgctattttgacggcaaacgcaccaaaaaccatttacgcgtgaccatcggtacgccggaggaaatgcaagcgtttttacatgcgctgaaggagatcatatgaaaataggcgtagtcggtctcggtctgatgggcggttctttggcccgtgccctgaaaaaacacacctcccataccgtttgcggtgtggataccgaccccaaaacgctcgaaaacgcatacgcggcgggggcgatcgaccgcgacggcagcgtatctgcgtgcgatatcgtattcgtgtgccttttcccgcaggacagcatcgattatatgctgcatacggaatttaaggcaggcgcgatcgtcgccgatatttgcggcgtaaaacgcgcggtcgaacagcaggtcgccgagccgcttttcaggcgcggtctgcgttatgtcggcacgcatcccatggcaggcaaggaaacaggcggttttaaaaacagcgacgccgacctgtaccaaggcgcaagctttatcatcacgcttgcagagcatacggaccacgaggcgcgcgcagagcttgcaaagctggcaaaagagatcggtttcacgcgtatcacggaatgttccgcgcgcaaacacgacgaggtcatcggctatacgtcccagcttgcgcatgtcatttccaacgcatatgtcaaaagtaaggccgcgcaggatttcaaaggcttttccgccggcagctttatggacctgacgcgtgtcgcgaagctggatcccgagatgtgggcggagcttttcctgctgaacggcgacatcttagcggatgagatcgacgaagtaattggtaacatcgccgcgcttcgcgatgcgatccgcatgggtgacaagcaaacgttacgcgcacttttgaaggacggcagcgacaggaaagagcgcctgaacgaggaaaacaaatgaaaaaatttggattttttgctttgctggccgccatcctgttttgctttgccggttgtgcgcccaaaatcgaaatcaccgaccagatgcttctggaactgacacaaaaaagcgacgcttatacgcagagtatggtaagcggcgattttgaagccgttgccgcaggcgtcgccccctctgtttccgcgcaattgagcgccgaaaagctggaacaggcatggacggataccaccgcttccgccggcagctttgaggatatctcccaaacaggcgccggtgtccaaaacagtttgcctgtggtgaccgtaaaatgcaatttcactgcaaaaggcctcgagatcaaatatacctatgacgcaaacggccagatcgccggtatgtggatgacatatgccgcaaaatcgcttactgcggaaagcaatgacgattatgtggaactgcttgtgtccgttggaacggtcaagccccttgagggaatcctgaccttgcccagggacgttgaaaaacctcctgtggtattgatgatacagggcagcggcgcgcaagacgccaacgaaacgataggcgcttcggccaataagccgtttgcggatatcgcgcacggtcttgcggcgcagggcattgcatcgctgcgctacaacaaacgcactgcacagtatccaaacgaaccttcaaacccgctcgacctgaccatcgggtacgaggtcctggacgacgccgcgcaggccgtagacctgctcaaggattcacaatgggtcgatccacagcgcatttatgtcttaggccatagtctgggcggaatgcttgcccccacgatcgcgcaggataacggcctgaaaggcctgatctcccttgccggttctccccgcagcctgttagatatcatgctcgaccaaaacgaagctgcggcggcagccggacaaatcacgtcgcaggaactcacgcagggcaaagcgctcatcgagacggccaggaacgcaaagcagggagacgctacccccatgcttggcggcacgggaaattattggtatactttaaaccagatcgatacgcccgctaccgcagcggcgcttacgatccccatgcttttcctgcagggcgatgcggatttccaggtttctgcgcaaaaagacttcaaggcatgggaagacctgctttccgatcatgccaatgcccagttcaagctgtattccggcctcacccacctgtttactcccgcgccgcaaaacgcttcgaataccatagcggattatgacgcgccgcagcatgtggatttgcaggttataacagatatcgcaacatggatcaaagcgaactgaaaagtaattgcaaaatcaaattttacggattggggggagcataatgcctttaaggaccgttccgaaaaaaacaagcatcatttttttcgttatcatttttgtgtgcctggtgctttccctcgtctacaatggaatggcgcctgtgcccgtttcagatgccgtttctcccctgcaggagggctggagcttaacggcagaggggaagaccaaaagcaatagatcgctttccatcaattattatggccaatccggtgaggaggtcgtgttttcaaacacgatccctccgcgcgcgggacaaggcagcgcgctgtgtatccaattctatacttcgcccttttccgtttatttcaatgacgaaaagatatatgaatatggttttgccgctacgaacgccggatacctgagcgtcggcagcggataccacgtcatcgggctgcccgaaggcggggaaggcgagatccgtatcgaagcgcagctttccaaaggcgctcctgccgtaagcctgtccgacgcggcaattatgccaggtccggtcttttaccggtatcttatacaaaaccacttatttacgctcgtcgcttttatcgtactgatcgccgtttttgtccatgtgctgatcaccggcaatatgcatacgtcccatcatacccagagcgtaccggtccttgccgcgcttgctttttgcgccgccatatggatatcggcgcgcagcggcttactccagctattcactgacgatctgctgcttataaacggtatcgattttatttcctttttcctgttgccgctcacggcgatccgcttcgtccagatccggctccagatccaggacaaccggcggctcaatctttgcctgcttgcggggaatatcttctttatcgcagcatgtatcctgcactttacaagacttgtcgatttcacgcagtcgcttgtcgtgttccacgcgctgctcgtgatcgatctcgtttgtatcgcaaccagcatctttaaaaaacaggaatcctattctaaggatttaaaggtattgcggatcggcgtaacgatcctcataataagcgccgccattgaaatgattttatattattttctgtcctttggttttctcaaattttccgcgctggaaatcggtctgcttggttttacgctctgtatgctttatgtgtggagcacggaaacacgcaacacaaaaaaacaactcgaacgccagtcgatattccgcaaaatggcgtataccgatgcgcttacaggccttgagaaccgtaccgcctttgacggcatgttaaaacgcctgaaccgcgataagaaggaatcgctgcatatctttatgatcgacctgaaccatttaaaacaggtaaacgacagtatgggccacagcgaaggcgaccgctacctacagcaaagcgccaacgtcctgcaaaaggaatttgcgcaaaacgcgcagttgttccgcatcggcggcgatgaatttgtcgccgtgctcgagtcctcccatgaagacgcggctcatattttaaaacgcctgcgcgcataccgcgctgccatgcaggggactccctgccacacctttgcagtcgggtgcgccgcatttgacgtaaaaaaagacaagcggctgcaggataccctgcgccgcgccgataaactcatgtattcctataaaaagaagctgcacctgagcgaaagccatcccctttaggccgtctggcaccactctacgatccgctgcctgatccggtaggaattttcttcatcgcaaagaacgattaaaatatcgcccgggcggatacgcaccgttcccttgggaatgatctcgtggctacctcttctcaccgcgacgatcaggctttgctgcggccacttaagctcgctgatttttttcatacagacaggcgccccatggtgcaccggtatttcaagcaatattttattgccctcttcctgcggagattgctgctcgccgtttgtcctcacgatccgatccaaaagctgttcatagatcggtctggccttcaaaagatcggcaacggcatacgcgatcagcgataccagcgtcagggataaaagctgcgtgaacgatccggtcatttcgcatataaggataatacctgtgataggcgcgcgtacgatcgccgcgaaaaagcccgccatcgcaagcacgataaaattctggagcagatcctgcggcaggccgaagccatcgatcatcgccatgccaagtccgccgccgagcagcgcgcccagcaccagaagcggcaggaagatgccgcccggcgcgcccgagccaaaactcaccatcgaaaaaatgaacttgatcaggaagatcgcaaacaccatcgccagcgcaaatttgccgtcgatcagcatggggatcaactggttcccgccgccaagcacggcagggaatgtaaaacccagtaagccggcgcaaaaaaacgggatcatcaaccgaaattccagcctgatttttttcatcttgccgtaaagctgctgcgattttttgatgcagaaattgtaaaacgcgccgccagcgccaagcacggcgcccaaaatcaggatgacccagtaaaggtccagcgggatgttctgcgtcaggtgaaaactgaatatgggcgacagcccaaatacattacgcgaaataaaatccgccgtgacggatgccgccatcgtagacaaaagcacttctattgaaaaattcttgtgcaactcctcaagcgagaacagcacgcccgcaaacggcgcgttgaaggccgccgcaagcccagcgctcgcaccgcaggtcatgaacagtttttcttccattttgatgcgtttcgtcatacgcgaaaagcccttacccatcattgcgcccaattggatggacggaccttcccgccccagcgacagccctgcgccgatgctgagcacgccgcccgcaaattttccaaccagtaccttccaccaaacctgactgaatataccgtgtatctcgccctccacctgcgggataccgctcccgctgatcatcggctgccagcgcacgagctttgcggtcactaccgcaaaaatcatcagcacgccgaaccatgcgatcatcaacaggatattctgccctgcggccgacaggataaaaaataaaatgtcgttcgcatgttcgatggtaagacggaacaaaaccgatacaagccccgcgagcgccccgacaatgatgccttgtatcagcaatccatatctgaaatttttaaagcggtgcaataccgtctgcgtatcgcttgcgctgttcttcatttccctgcctcttttgcgacatttccccgctactatcttagaccctttccaaaaatcatgcaacaaaaaaggacaggaagtcttttcccgcccttcttaccgctccttacagcttgtcctgccctaccgcttcgatcagcccgcctgccgcaatgatatcctggataaaaggcggaaacggctgcgcacggaattcttttcccgtcgtgaggtcgcggatctctccggtatcaaaattgacctcgacctcatccccgttcttgatttctttggaagcttcctcacattccaaaatcggaaggccgatattgatcgcattgcggtaaaagatacgcgcaaaacttgcggcgatcacacagctgataccagattccttgattgcgatgggcgcatgctcgcgcgacgagccgcacccgaaatttttgccgcctaccatgatatcgccctttgttaccttgtttacaaactccgtatcgatatcctccatgcagtgcgacgcgagttccttggaatccgacgtatttaagtaacgtgcggggatgatcacgtccgtatcgatattgtccccatattttataacagttccttttgcattcattcgttgactcctcccttatagttcagccggcgaagcgattttgcctgcaaccgcgctggctgccgccacttccgggcttgccaggtaaacttccgacttcacatgccccatccggcctacaaagttccggtttgtggtcgcaaccgcgcgttcaccttccgcgaggataccgcagtgcccgccgaggcacggcccgcatgtgggtgtggaaacagcgcagcctgcttcgatgaatattttcagcaatccttcttccattgcctgcaaatagatcgcctgcgtcgcagggaaaatgatcgtacgtacatgtttcgcgaccttcctgccaacgaggatatccgccgccgcccgcaggtcgctgatcctgccgttcgtgcacgagccgatcacgacctggtcgatcttaatgtcgcccacctcgtcgatggtcttggtgttttccggcagatgcgggaacgctaccgtggacttgatctgcgaaagatcgatatcgatcacgcgggtatagtccgcatcctcatccggcgtatatacggtaaactcacgatcggaatgactgcgcaaatattccacagtctggtcgtccacctcaaaaataccgttcttgccgcccgcttcgatcgccatattggccatgcacaggcgatcgtccatggaaagggaggaaaggccctcgccgccaaattccatagactggtaaagcgcgccgtccacaccgatcatgccgatgatatgcaggatcacgtccttgccactcacatattttttcaattccccccgcaaattgaagcggatcgcctgcggcactttgagccagactttgcctgtcgccattcctgccgccatatctgtggacccaacgccggtggaaaacgctccgagcgcaccataggtacatgtatgggaatccgcgccgatgaccgcgtcgcccgcgacgaccaatcccttttcgggaaggagcgcatgctcgatacccatcgtcccgacgtcgaagaaattgacgataccgtgcttcattgcaaattcacgtaccagcttacattgttccgccgctttgatatccttgtttggcgtaaaatggtccatcacgagcgatatcttgtttttgtcgaatacttctttacccgttttattgaattcacggatcgcgacaggcgacgtgatgtcattgcccagcaccatatccagccggatggaaaccagctgtcctgccgttacactcgggagccccgcgtgtgcggccagtattttttgcgtcattgtcatgcccatacttatttcctctttctatatcttttcaaatttatttctcactttcgtccagcgtgagcttatactcgatggaatccgtcagcgccaaaaaacttgcctcgatgatgtctgtggatacgcccaccgtgttccaacggtgtttgccatccgtcgattcgatgagaacgcgcaccttggccgccgtcgtcgcagagctttccagaacgcgcaccttatagtctatcagccgcatatcccgcagcgatggataaaagcccttgagcgcattccgcagcgccaggtcaagcgcatgcacagggccgtcgccttccgcgcccgtaatacgcgattcgcttcctaccttgaccttgataattgcagacgacggatattcctggtccttaagcggctgctcgccgatgatcttgaaatattccagttcaaaatactttttgtatttccctagtatcctgcggatcacaagctcgaaactctgctccgccgcttcaaactggtaaccctcaaactcaagctgtttcagtttatcaaccaactcccccacgacagtatctttaggctgtacggaaggatccacacgctgtatcttttttagtatcgtcgccttgccggatacctcgctcatcaaaaagcggcggttgttgcccacgctttgcggatctacgtgttcaaaactttcgcggattttttttacgccgtcaatatgcatgccgcccttgtgcgcaaacgcgctcgatcccacgtacgggcttcccgacggcagccagatgttggagatatccgcgatcgcgcgcgccgtttccgtcagttttttcaagttttcttttcccagtacggtatagccgcgcttcagctcaaggtttggaatgatcgtggaaaggttcgcattgccgcagcgttccccataaccgataaatgttccttgtacctgcgtcgctccggaatccacagccatcatggtctggctgaccgccatgcccgtgtcgttgtggcagtggatgcccacttcggcctcggggaatgtgctgaccacgcgccgcgtgatatccgcgatatccgtgggatacatcccgccgttcgtatcgcacaggcaaagcacgtccgcgccgccacggattgccgcatcaagggcgagcatcgcatattctggattcgccgtatatccgtcaaaaaagtgctccgcgtcaaagacgacgtacttgtcatgccgcttcatataggcgaccgtactttcgatcatattcaaattttcttccagcgtggtgcccagcaccttcaatacatgcaggtcccacgcctttccgaaaatcgaaaccgcaggggtctccgcttcgagcaggcttgttacgtttatatcctcgtccggcattatgtccttgcgccgtgtacttccgaacgcgcataatctggcatgctttggcctctcgcctttcaaagcgcggaagaattccaggtctttgggattggagccggggtttcccgcttcaatgaaatcgatacccaaatgatcgagcgcgcgtacgatattcagtttatcttccaccgagaaggcgatgccctctccctgcatgccgtcacgcagcgtggaatcgaacgtgactatttttttacccataattttttcctcttgccggtttgtattaccgccggtcgcggttgaaccaacgccgcgcatgtgttatctgcctacttgcccaaacaacagacgcacttcgcgccgtctaactcgcatgcggcagcgcgcaggcaagtcaagctcccaacagtttattgaccgcgttgatgtacgccagcatggaagcctcgataatatccgtcgaaagcccgcgtccggtgaccgtacggttttccgaagaaaccttgactacgacctcgcccagcgcatcctcgccgtgagaaaccgcgttgatcttgtaattgttgagcttcaacggcatctgcacgattttctcgatcgcctggtatgccgcgtcgacaggtccgtcgcccaaagcgaccttctcctgcatttccccgctcatgtcttccagcgtgacgtttgccgtcgcctggatcgtattgccgctgttcacgacaaactgctttaagcggaaatgctccacgaccttggctgccttctgcgcgaccagggcttccacgtcgtattctgtgacttcctttttcttgtcgcacaaatctttgaactgtgcaaacgcgctgtccagctcttccttgctcaggttgtatcccagctccttcaggaaatcatcgaacgcatgacggccggaatgcttgcccagcaccattttgttcgtggtcagtccgacggattcgggcgtcatgatctcgtacgtttcgcgttttgccagcacgccgtgctgatggatgccgctctcgtgcgcaaaggcgttcgcgccgacgatcgccttgttcggcgggatggaaacgccgatgatcttggacagcaaacgtgaagaacggtagatctgtttggtgttgatacgcgtatccgcgccaaacaaattcctgcgcgtatggatcgccataacgatctcttccaaggacgcattgcccgcgcgttcgccgatcccattgatcgtacactcgatctgcgttgcgcccgcgccaaccgaagccagcgaattcgccaccgccatcccgaggtcgttatggcaatgcacggccaggtcgatttcatcgatgccttccacattttgtttcatgtaagcgatcatatcatacatttcctgcggcagtgcatacccgaccgtgtccggcaggttgatcgtttttgcgcccgcatcgatcgctgttttgacgcatgttgccaaaaatgccttgtcgctcctggaagcgtcctctgcggaaaattccacatcgccaaccagcgtccgcgcataggttacggattccttgatgtgttccaaaacctgctcttcgctcattttcagcttgtattgcatatgcagcggcgaagttgccaaaaagatatggattctcggcgcgaccgcctccttcaacgcttcgtacgaagcatcgatatcctttttgacagaacggctcaaggatgcgaccgtgcaattcttgatggttttagcgacggttgcaacgctttcaaaatccccgggggacgaaacggcaaagcccgcctcgatgatgtccacgttcaattgctccagttgctttgcgacctcgatcttctccgccaggttcatgctgcatcccggggactgttccccgtcgcgcaacgttgtatcaaatattttaatttgtttcatgagtcatgctccttttcaatttatttaagtatcgcgccggtatctgcgctctgcaccattcttgcgtacctcgcgagccagcccgtcgataccttcgggggccttagctgcgagtccgtaagtcgtttcttaaattcgtcgtcgctgatttttaaattgatggagtatgcattgatatcaatttccatgatatctccttcttttatataagcaatggggccgcctgccgccgcttcgggcgaaacgtgtccgatcgccgcgccgcgcgacgcgccggaaaaccggccgtctgtaatgagcgccacatccttgtcaagccccatgccgaccaggtttgacgtcggagcaagcatttcgcgcatgcccggcccgcccttcggcccttcgtagcggatcaccactacgtcgcccttttcaatgctgccgccgaggatggccgcgtttgcgtcctcttcacagtcaaacacccgcgccctgcacgtacttttgagcatttcgggggcgaccgccgagcgttttaccacacagccgttcggcgctacgttcccatacagtactgcgatgccgcctgtcttagaatacggatcgtctatcggccggatcacatcgcctttgattttcgcatttttgatccggtccttcacggttccgtccacagttttgttatcgcggatcagcccttttttgtcgatctccgccatgaccgccggaacgccgccgcattcatccaattcctcgatgtaatggtgtcccgcaggcgccaaatggcataggttaggcgttctctcgctgatctcattgacctgatgcaaatcgatcgtgatgccgcactcatgcgcgatcgccggcaggtgcagcatgctgttcgtgctgcacccgagcgccatgtccaccgtgatcgcgtttgtaaacgcatcgcttgtcatgatatcgcgcggacagatattttgctccaccagcttcatgacctgcatgcccgcgtgcttggcaagcgccacgcgcgccgccatcaccgcagggatcgtcccgtttccgggcaaggccatgcccagaacctccgaaaggcagttcatggagtttgccgtatacatgcccgagcagcttccgcatccggggcacgctttttgctcaaacgcttccagttcttcgtccgagagcgtcccgtttgcgtgctgcccgaccgcttcgaacatactggaaaggctcgtcttttcttcgcggaattttcccgccagcattgggccgccggaacagaaaaccgacgggatattcacccgcgccgccgccatcagcatgcccggcacgatcttatcacagttggggaccattaccgcgccgtcaaaagcatgcgcgatgagcagcgtttccacgctgtcggcgatgagctcgcgcgaaggcagcgaataatgcatacccatgtgattcatcgcgatcccatcgcatacgccgatcgccggaacctcgatgggcgtaccgcccgccatgcggataccgtccttgaccgcctgcgcgatcgtatccaggtgcacgtgaccgggaatgatctcgctttgcgcgttgaccaccgcgatgatggggcggttcagttcttcttctgtcagccccagcgcataaagcagggagcggtgcggcgcacgctgcgcgcctgttttgatttgatcactattcataagatccctcttttacttattcttatgccagctcattttcccgcgcagctcttcgcctgttttttcaagctgcgactgctttccaatgtttctcatagcgataaagtgcggacgcttcacctcgttttcgagcatccagtcgcgtgcgaacgtgccgtcctggatttcggaaagtacttttttcatttcttttctcgtatcctcggtgatgatgcgcttgcccgttacataatctccatattccgccgtatccgagatagagtagcgcatacgcgaaagtccgccttcaaaaatcaaatcgacgatcagcttcatttcatggcagcactcaaaatatgccatctccggcgcataacccgcctcgaccagcgtgtcaaagccggctttgatcagttcggaaacgccgccgcataatactgcctgttcgccgaacaaatctgtttccgtctcttcacggaacgtcgtttcaaagatacccgcgcggccgccgccgatcccgcttgcgtaagcaagggccaagtcacgtgcttttcccgtagcatcctgatggatcgcgatcaggcacggaacgcctttgccttcccggaactggcttcttaccgtatggcccgggcctttgggagcgaccatccatacgtccacatcctttggcggaacgatctgtccgaaatggatgttgaaaccatgtgcgaaaacaagggatttcccttccgtcatataaggcgcgatcccttcgtaaatcttgccctgcttctcgtcgggcacaaggatcattacgatgtcagccgcctttgcagcctcttcggatgtcatgactttgagtcccgcttcctccgcagatttccaggacttactgccctcataaagacccactaccacgtctacgccgctttctttcaggttctgcgcatgcgcgtggccctggctgccatagccgatgatggcaacggtcttgccctttaaaagcgagagattacagtccctgtcgtaatacattttcatattcatttcttttgcctccaataaatttttgtaatatcttatagcgcacctgccggtgccccaggatttcatgagtcatgcaatgaattttcccctcgctccaaagcggtgatccccgtacgcgccatttcgatgatgccatattccgtaagcaggtccattagcgctttgttcttttcaggcgcgcctgtcagctcgatgatcatggtatccgtggagatatccactatcttggtgcggaagatatcgcatagttcgatgatattcgcgcgttttttggcaggcgcttttacttttacaaggatcagttctttataaaccgaagtacttgatcttagtcccttgatcgtaatcacatccaccagtttatcgagttgtttttgtatctgctccaaaacgctttcgtccccgatcatctcgatcgtgatacgcgaaaccttcgggtcgtgtgtctcgccgaccgaaagggaacggatattatatcccctgcgggagaaaagccccgtgacttttgacaggacacccgatgtgttttgtaccagtacggaaagtacatatcttcttatcatgagagttctcctttatttctgtttaccttcattatataacgtccccatccggcacgcaccattatttttcccagtccaggatgatattgtcgaacgtcttgccgcccggaaccataggcaatacgttctcatcctcgctgatgtcgcactgcacgatcaccggccccttgtgcgcgaacgcctttttgaacgcgccggccatgtccttttcgtttgtgatgttcacaccgtacgcgccaaacgcttccgccagcttcacgtagtcagtcggccgattcaatgtcgtctgcgaataccgcccgtcaaatagtattttctgccattggcgcaccatgcccaaaacgttattgttcatcaccaggatcataacgggcaactggtgcttcaccgccgtcacgatctcctgcaagttcatgtgaaagctgccgtcaccggcgatatccactacctgttttcccgtaccgattgccgcgcccattgccgcgcccataccaaagcccattgttcccaaaccgccggaagtgatgaattcgtgtggccgctcgatcttcaaaaactgtgccgaccacatttgatgctgtcccacctccgtcgtgaagatggtgccttcgggcgcagcttcctgcatggcctggatcactttcttggggacccttgcgttttttgtcgctcggtccagtggatatttggttttccacgcctgcgcctgtcccagccacgttttgtctgttttttgttttaccttcggcagcaatgcatccaagactgcttttgcatcgccgatcacttcataatctgcagtgatatttttgttgatctccgcaggatcgatgtcgatgtgcagcaccttggcttgtttggcgaatttcatacggtcggacgtcacgcgttcggaaaaacgtgcgccgatcgttatcaacaggtcgcaatgtgtcgtgcataatgccgaggcctttgtaccgtgcatcccgaccatgcccgtatattgttcgccatttgccggataagcgcccagccccatcaaagtcattgtcacaggcgcattcagcttctttgccagcttgcgcaatccctgttctgcctgcgaagcaataacgccgccgcccgccatgatgaacggttttttactttcgttgattgcgcgtgctgcagccgcgatatctgccgctttaaaacggtttggacgcacgatcactttaggtttttcaaattcatattcatacgtttccaatgtcacatccttagtaatgtctaccaaaacagggcccgggcggccgctctgcgcgatataaaacgcctcacgaatcgtcttcgccaaatcttcgattttctgcactatcacattatgctttgtgatcgggattgtcacgcctgtaatatcgatttcctgaaagctgtctttcccgaggtttttctgctcaacgttacccgtgatcgcgaccattggaacagaatccatatatgctgtcgcaatccctgtaaccaggttcgtcgccccggggccgctcgtcgcaatcaccacgccgggttttcccgtcgcgcgggcgtaaccgtccgctgcgtgcgccgcgtgctgctcatggcaggtcaggatatggttgatttcggggtaatggtaaagcgcatcataaatcgggatgacggttccgcccggaaatccgaaaaccgtatccacctgttgttcttttaaacattccatgataatctgtgcgcctgttaatttcactgtactttcctccaaatgatctgattcggcttttttgcttcgccgcgctttcctaacaaaaaaggcctgcgcttatttgcgcaggccttgaattactttctaactcagtccttactcatgcccctccggcacaaccgcaataagccttattcgctctgccaataatgacgacgctaataaggttaataaggacgaggatgaagttgtaagaaactttattattcattgttcttacttctttctttgcatttatggtacttatgataaatctatccgttcataatgtcaacatttttttaccaaatcaaacaaaataattgcaaaatgagcgcatttatattagaataaaattcgtgatgtacttatagttcagcaggatagagcgtccgcctcctaagtggtcgtacttcgaccaccgcgagtggttgataattgaataaatattacacatgttcccgtagctcagcaggatagagcgttcgcctcctaagcgaaaggccgcgcgttcgaatcgcgccgggaacgccatttcagccgtttttccagtgggaaggcggctctttttttgctcttttgcgtgcgtccatttatatacatttcatctgcataaattgtatattcttctaacgcctccaggctttgttttcaaaatccgctaacaaaaacgctgttttcgctaacatcacaaatccagatgctttttcgtattgctgagtgttagcaggatctttgcgatatcaggctggctttgcacgagctccaatactttaagcaattcggggctttgttggaaaagctccagtagctccaatacttcattttgcgacataggttcggctactttgttcccatcgctgataagcagcggcctcgacgtaggcgccacattgttcaccacaaatccggaataaaagcttttgttgaatcggtgcgcgtttaccttcctgtcctcatcaatgatctcagaatacgtcttggtgaccatatctggctctgcccaaccgccatcgccctgcacggatttgatatccccgccggattccttcagcttgtatgtcgcgctggatttccgcaatgagtgaaaaactacccgaggcagctcattctttgtgatgagcttctcgaacgcttttgtgatgatacgctcttcacagggggaaccgtcgttaagcgcgatcacaaatttgtattcgcgtccatctccaccagcataccttcggtattcgtcgcccaaaaattcctccaggcgctcctgtgactcccgccagctgatcagcataccagcaagcgtctccgggatccataccctgcgcacactactctcggtcttgggcgtcttcagcagcagccttgttacattattctttttgaacggctcgaagatataaaaaatatcctcgcttttcagcttttgtattgattccagactggcgcgctgcagctccttttcgataaacaaatgagcgtttccttgctccaggtcgtcactggagatatggatattatcccaggtgagacccaacacttctccaatccgcatagaacaggcaaaggccagattgatcgccatgaacagacgattgtccttgcataaatttagcgctcgctgtatcgtatccggtgtccacgcctccctctttttgtaagaagccctgggcgcctttatctttgcgaaaggattatccgcgatgagctccatctcagccgcaaacccaaacgcacaccgcagcagcttatgaatccctcgaatttgtgtcttcgagaggcatttgccggtcgcttctcccgtgcggtgcggtaccgctttgaccttggcgagacgctgatagtagctggtgataaacagaggcgtcacctcttgtattttcacgtctcccagcgttggattgacgtagtgccttataattccaacattggaatcataggtcgaaaatgcccaacgctccatgccatagttggatacaaacagctccatgaattccttaactgtcatgcaatttggtttgatgtattcccgttcggcacttttgaactcgatctcgcctttgcgcttcaaagcatcctggtgcttttcgtagggctcccatttctgcttgcgttttcccttgctgtctataaaagagtatacgacataatattttatgccttttttcagttttttctttacgatagctgccataatcaattctccttttctttgccatccaaccactcgtcaaatgactttttggagattcttatagccgtgccgatttttacagttttaaaatgtccttggcgcatcaggtcataagcggacgatctgccaatatctaatatttcagcaatatcctcaactctgtaggtgcgcttttggggaatatcttgtgtgccgttcatgtgcgattacacctccttaacacaaaagcggcgcatgaggtaattatatacctaatgtaccgctttttcaaaacgtcatatgcttgtgagataataatttcgatgatactattttaacttgatattatcttgctgtcatcggcaaaagtctgccatataatttgcgctccattaacaggggcttcaagaaaactcaatctttctgtatttatccatatggtataattttaataaaggagtagctaaccatgatttatattaccggggatacgcacggaaattttactgggatcacaaaattttgtgaagatatgaagccctcaatggatgatatcctcattattttaggtgacgcaggtatcaattactatggcggaaaacgcgacaacatcttgaagcagcatctatcaacgttgcccattactttattctgtgttcacgggaatcatgagcgcaggccccaagccattctttcttattctcttatcagcaagttcggaggcgaagtttttgttgaagaagaattccccaatttgctatttgcgaaggatggcgaggttttctcttttgatggaaaaaattgtatcgtcataggaggcgcttatagcgtagacaaatattaccgcttatctaaaggatggggctggtgggaagatgagcaaccggacgatgaagtaaaagcatgcgtcgagcaccgccttaacaaatgcaatcatcaagttgatgttgttctgtcccacacttgtccatataaatgtattccccgggaaatgtttatatcagccgttgaccaatccacagtcgacaattccaccgaactttggctggatacccttgaagataagttgcaatatgataaatggtattgtggtcattatcatacgtataagtcaattgataagatactgtttttgtttgatagaattattccatttgattgatttttatttttccaaatatggtaatctagtttgagtggccttttcaaagaaacagcgcacaacgctattttaacgttgcgcgctgccgaaacaatttgtttgctattgaaaatcatcaaattgcagcgtatttttaatttctggaaaaaatattatttaagacttttatggcttgttgtttcgtaccgtatgataatctacgcaattcttttcaatcatatactgagcggcaagtagtaacgcgatttgatgaatacatacttcgtcggcatactcgcattggcaatggatattttcaatttcaaaattatcgttaacctcaataccaggcataaatatttgtccatcgtcatacataaaggcttcaaattcacgtggttctgacgggtcagctaaatctatgtattttacacttttaactttatcgctgtctaagtactttttggctctaacaagtttttttgaatcaatagcatcaatataatcattaattttcatcatattatttctccttacaattaatattaatgttttgctgagattcctcgagatgtttcacatcaggttttcatccaatttattacaaaattcccccaaagtacccaagtacggctgaaagggctcccctgctaagggagtaggctgaggtaatcggcgccggggttcaaacttcagtatttagaagttcaaaccctgtcacttaatagaaaaaacagctcgaaattcccttatctcaagctgctttcagtctatctgtatattttaagctatcaatttctgctgagagatgttttgttaatccatgtcatagcattggttgctgcaatctttgcagaataatctaaatgcgcataggtatcagccgtggttttaaaggagctatgccccaaccattcctgaactaatttcagtgacactccactctccaaaagcagactcgcgcacgagtgtcgcaaatcgtgaaatcgcagtcgccgaaatccatttttctccatccatttaggaaattctgctgtcagataatctggccgtatccgattacccaatacatcagtatagatataccggctctcttttttattgtatgatttgccgcacaatttttgacagtgttcctgctctgtttttaaatcaagaagcaacgtatgaaattgggcgattaggggtaaagtacgcaaactagctcgtgtttttacggtgtcgtttgcaatcacagttttcttgccgtcaatttgtgcaaccgttactgtgtgatctatagtaatagtatttctttcgaagtcgatagattcccatcgcaaaccagcaatttcgcaccgccgcaggccatagtacgcagccaagagtacgcctagttctaagcgatgacctcgtattttttcgaatagggcaattgcttcactctgtttcaaaaattttgcgacatatctttccgcgcgtggccgctttaccttttccataggagagtggtttatccagcctttttcgacggcatatttcaaggatcgagaaagaatattatggtatttatgaatggtggtagctttcaccgtttccaaccgttttttataaaacgcaaagatatcttcgctggttagttcccgcagaaggagctttcgtttatcaaaaaatgggctgatgatatttttaattatggcttggtggtttccgaaggttgttggtcttaattcatttttaattgcttcaagccagcctctaagaaaagtggaaaataatacttcgcaactcttaaaattgctcaggttcaactgttctaatagttccgttttcttttcatggagcatatctgatgcgcgttttttgtttcctttcatatgtaatccggttgatatacttttgcgttgccgtttcccctccatttgccaactgaatatcatttgataaatatcacgcttattctccaaatgcccgcttactctaattttactatctgtcatttatattactcctattcgtttttgtgttaaaatttaggctatacttttatggtttggtgtcggaatcaattattcttaaatattgtaataagtaatatttagggacacggtagaccctgcccattttgatagatgacaatgagccatctttaagaattttgtacactgtttttttacatatatccaatatactacaaacctgtccaacatctagaacatcaggataatctttaaaaatggcatcatacacgttttgtatatttgcatccatgcaactcacctccctcctatgcatcttagatgatgatagcatgaaaaatgcaaactacacgaaaaaatgttgattcagaatctgacaccttcgctaaaaataattatattttttgttttatgatgaattgcattataaagatcatggcacttgtttgtttacttgataaaatacgatgctgtacaattcgttttataaggcgcatggtcgttgaggttgtatactttttgggttatatccataaaatctatggcaaatcaataaatatttatggttataaccataaaaacttaaacaaatgtgagcaatcaaaaaatacaatcactgaatgatagacatgcgatatatatcacaaatccgattctagagttggtttgtggtattctataatattgtacacaactgtaatgggcatcatgtaatcctttcgtctatccacttaatgtatagctatgaggatttgggcacttgtaaggtgtgaagttgacaggtgacaacttgatataggtaactatcaagatatccccatacaatagtatactggaacataccgctgatttttcaaatatcggctcataaagcggattttagtaaaaaacgacaattgcgcaaaataggttgtatttatcctatatattgcttataatatattagaggtgaattactatgatcatcaatagtgatgctatggcatccttaaccgaagccaatcagaatttttccaaaattgcccgcactgtagacgagaagggtaaagttattatactcaaaaataacaacccgcgctacgttgtcttggatatcgagcgatacgaacaaatggagaaagccgaattcgcacagctagaccgtgttgccaatcacatccttgacgaaaatatggaagctatgaaagaattggcaaaatgattactcttgatgttgaacaagtaatctatcttcatgaaaagcttattaagcgaactggcggcaaagacggtttgcgcgacaaggggattctggaatccgcgctttttcatgcctatgctacatttgatggagaagatctctatcccacgattgaggagaaagctgcccgccagatgtttgccctgacctccaaccatccatttatggatggcaataagcggataggggtgtttatcatgcttattttcctcgagatgaatcaaataaagctcaaatatactcaagaggaattgattaaactggcgctcgatactgcatccggcaaaatcgacgctaatcatatattagcttggataaaaagccacaaaacccaatagactcatttctacattatcgacatttttgcgactaaaatttttacaaaagctgcaatgtaattcatattataaacgtacttgtaaaaaacaagtcgaacagtacatctctcatattaaaatcgccaacaaatctaactgaaaaaatcagcaaaaaacattctacgtagtatttagagcagctaaatattctatttagactataaaattatttgattagcaaggggattgagatgcactacagactctatttttctttaagtcttttggctctttgactttaacaatcgactagattaagttgctgcctcaaattctttcaatgttttaccatcagaaagtttccattcagtaagcccattggagtttttaccaataacaaatgaagatgccgctgatggggatttaaacaaaacatcttgctgtagaactccgttatcatcaattaacttggaatatttttcgcgcaagcttcgatatccactgggcagataatctgctgtttccgcgcatatctgactaccgactagtacaacaaatccatcactggtaattcttccttgcgcttcaatattttgcttttgtctgcgacaataaaaaagaggttcattatcggatgaattgggtgtcctattctccgtgtcattctctacacttattttgtagttcaaactttcaaaaactttatgccctaaagtacccataacaattttagaatactctgcaaattcctcaagctcactttgcttctcttctgtaatgttcccaggagaaggatcgtttccattttttaccacatatctttttgcctccagcgcaaggccgcaaaaatagttttcgagccagcttatctctgttgggccaaaagagttatttgcagttgtaaaaacaactgcttctgtccaataatctttctccgaatttcgcttatgctcttgtagccgaaatagaatgccttcgccgttttttcgcgttcctgcttgcccaatataaacaacatcttctccggtatcttcagagaccccaaacaaaaaataaacaccgctttgctttaaatcttcccgctctttgcagtcttctattttagtacgagggattttataagctacgcccgtccaatttgcaagtgtacatttaatacgtccattaccaacaccgtccatcaaaaacaagttaatactttttcctcttgcagccatcttgcgacctccaatatttctaaaattcactgcaactccggcaatccaagctcttttaaaaattgattatgcttagtttttgcctctataatcgttttctcgatttcatccagattttttttcacttctgcaagatcaacaatttcttcttctaccgctgtgcttacataccgtgatatgtttagattgtatccattcttttcaatctcctccatcaaaacacgacgagagtactttttgtcatcttctttacggtattgatatgtatcaataattttatcgatgtgttctggcgaaagaacgttttgtcgttttcctttgtcaaaatactcactcgcattgatgaataatacatcatcaaattttttgtattttttgagtacaagaatacaaaccggaatacccgtggagaaaaacaggttggctggtaagcctattatagtatcaatatttcggtctttaagtagctttgttctaattctttcttctacaccgccacggaacaaaacaccatgtggcaaaataattgccattgtacccccatcgctcaaaaaatgaaaaccatgcagcaaaaaggcaaaatctgctgctgattttggcgcaagtccatagcttttgaaacggaaatcttctgccaacatgtcatttggttcccagcgataactaaaaggtggattagcaactaccgcatcacattccaactttttggccggattcatctcatttaaaatatcccaatcgtttaacagagaatcgccgtgaaatatttgaaactccgaatctttaagtccatgaagaagcatattcatacgagccaagttgtaagttgtaatatttttctcctgcccgtatatttgcccgatgctatttggaccaagttgctttctaacattgataagaagcgaaccagagccgcacgcaaaatctagtacattttttagatgtttctttttacctgtactaggatcttgactatctaaagtaacaatgcgggaaagtattgttgatatctgctggggggtataaaactctccagcctttttgcctgaacctgctgcaaactcacctattaagtattcataggcatcgcccagcatatccctttcattgggaaactcggaaagtccatcggcaattgcagttatgatggaacacaacattgtattgcgcaacatgtaagttttacccaatttctccgagtctaaattcacctcagaaaataacccgcgaaatgtgctttcaaaggattcattttctataaatctaaatccatcttgcaaggttcttaatagtattttgctttgtctacgagctaattcatagatattgctccaaaggtagtgtggcttgataacaaaatgaactttacggcgcatctgttcttcgaacaacgcaacatcatttttattttttgcataccaaatggccagcggcgtcagcttataagtttcatcagattcgctgtccacttcatttaatagcattttttttgcttgttcatttatactagcaatactgaaaaactcattaatatactcaaaaatatccccttctctagcttgattttggctgcgagattcaaaaattctttcagcttctttttcacattgcgtataatcactgccaagttctttttttgccgcttcttcatagttgtccgaaagataacgcaagaatagaaaggataacatatagtctcggaaatcatctgcattcattgcaccgcgcagtttatcagcaattccccacagagttgcccctaattgtttttgttgtacgcctgtcattattgctaacctctatctttcttcaaataattcagaattaaatttataactttccataaaaccatttagtatttttctaaagatttctttgttatcatcaaccatctcaaccggttcaaacaaggaataattgccatggcttaatagatttgtcattctcgtgtggatggtaccatctaggtcatcgctctcttgtttgatgcactttgaaaactgatcaaatccatgaaaagaagcggtcttttcaagaatatttctcaaaatattaaaatgataggtataaagttttccggaatccgctgcctttcttaattcttttaacaaggcaatatgatggaagaaaggtgtgtcaccagtgttacgcgttatatacttgccagtttcttgattgaagctcaagaagcggctttctgtttcacttctttttaattcattatacataatattaaaaaacagtgtatggtgtgtagaaatagctgttttcacattactgtccctaagcagcttcgaaagttgacaagctacagctacaacattattgtcgtccagtgaggaaattgggtcatcgatatagatgtatttcacccaactataagagagatcaccatcagccaccaattgaaggatggaaaggaaaaaacaccaaataaagatgttttcttcaccgcgagaaatttttattccactgatttcctctgtttcatccctgtttctgatttctctagaaaaacgaatatacgcttgatcataatcaattataaaatcaaaatctgcatgtattcttaaaaactcgcggatacgggtatccatctcaagctctctcaagccatcaaaaaagcgtgaatttttattaaagcgcaattttctatctgcatcgccttctatatcattatcccagaagaaaagatcctcggtaaaagcattgtaatatagtgtgtctcgtgtttttgcttcgcctccgtggattattgattttttgcctaaatctctaaattcgccggatagcctagtttttcccgttccgttatacgcaaaaagcaaaaaatatttctttgtatcggttgaaccgggcgcacccaatgtatcgcgcatattccgagcaaatcttttcaaggttgaataagtcttagttctcatttactaacctcctcaacagaaggaaacagcccttgcagcagaccttttttgtgtagtttcagcgcttcgattttatctgtttgcgcagatattaaactgtctacacttgagaggcaatcggcgattttttgttgctcttgcattgatggcaaattaattgttagcgactttattatttgtagattaagcccaccgcgcccaccatcaccagtggatatagttcttaattcagaatatcggctatctaaattataataaacgaactcacatacaaattctgtatcatcaggaaatatcgcggcaatagattgattgatacaaaggtcaaccatattaattgcagcagttcctcgtgtttttccttgcccagctagacctattaatacacatttctctggaattaattttgtgcttgattttttcaatccttcttcgcttattcttccattaacttcatatacttttttcagatttaattctccagagctcatccaccgaatattaccattccaataattagggtttaaagtacttggagtacctccagctacaatatttggtgatattttacctattttttttatctcccactccccactatccttaaactccggaaatctccattcaggtaccgttctgccttccgcagggaacagcttttgcatcaagccttttttgtgtgctttgagagcctccagctttttatcttcggcggtaataaggtcatccagcgaagatagacaatcagcaattttttgttgttctttgagctgaggtaaagcaacgggcatatcccataaatgcttaatattaacacttaaagaaccatgtgcacgagctccaacttcgatatattttcgcaaccatgaaccatggtagttattgcgaaaaagatgatcgaaaaatttaggttcacattctttatcaacaatgcgaaaacaggtaaaaatactgtttggtaaagcaacttcttcgtggtcgctaagtatcgagatataaccttctggaaattgctttgttgcacttttgttataagcaaaatcattttttttgattacgtaatagtttttgtaagagttccccgctatctctctaccaaatttttcgatttgcggcactaaccctacaccagatgtcacactcatgagggtatatttcttttttcctgcacgttcttctacaggaatagtaattctcccaaatttagtaacaacccattctggataatctttaaattgacgtagccgcaatcgcggaaggactctcttctccattttactcatacgctttcagccccgcaatcacacgtccgcccgcaagctttttcagcagcggcaacagatctgccatcaattccagttctttcttggtcttgtctctccacgcaagctccagcggctctaacaaatctgtcagcttttcaccgtcaaaaatcatacgtctcataatttcatcgataaaggctttcaatgcttccgatccaatgtcgtgcttgtttgcgattctttcaatttcttgagcggttttttctttcttaaacgtctgatatccttccttaatcgcttgttcatctagcccttttccagattccaaagtgtagatatacgcaataatatcctcacgctcttccatcatattagaattggaacatagcaattcaatcagctggtcgcagctcattttttctttttggtgctcatctgattgcgtatatttagaaatcagcgacatgatataatcgtagtcaatgacggcagaggaaaatagaacaaactcaaaatcgagttgctcaacctccagagctttatctttgtaatctttgccttgttgtgctcttaacttttgcgccaattcaatataaacaccacggaacgcgcgcaacgtatcttgcggcagcaactcttcaataatttcttcttgttcctcttcaatgtctgtatattgttcaagttgtgtttttaggcgctgcacttccttaaatttgttaataaattcgcatcttgcagtatcgccctttaaattgctaacttgttctggtctacattccaatccttgcgacttcataaatcgctcaagatcggcaactgctttatctaacttctttactacaacaggagctggatcaaccaaccaaatctcttttgctttagcactattcttttctccagagaacaaggtaatggctgcatccacttcttttttttgccctctaaaatcaaggatattaccataaggcttcgtatcattcaaaacgcggttggttcttgagaatgcctggatcaaactgtgctgctttaagtttttatcgacatacaaagtattcagatactgagaatcaaacccggttagaagcatatccaccacaattgtcacatcaattttgttcttgtgcggataatcagaattcggatatttttgatcttttatacgtttctgtacatcttgataatacaaatcaaattcatttaagctatgatttgtcccatacttttgattgtagtcatcaataatattagtaagcgccgccttcttcttttccggctcttttgcattgtcagctttttcttgctgtaagtcttcctgcaactgcttgacatctctgttgccctctgccgggggagaaaacacacacgcaatgtttattgggttgaaatctttaccctcattggtttggctttccctctgcgctgatttgaagagctcaaaatattctatggcatcattaatagaagctgtcgcaaaaattgcgttgtatcgcctaccatttgtagcagcatcgtgttttgagagtatagactctacgattgctcttttcctagcagtttcggtggacttttcagcctttttatcatcatctggctggaaataatcgatatggaaacgcagcacatttccatcatcaatagcatttgttatggtataagcatgtagctcttttccaaaaatgtcttttgttgttgtcaatgttttgatttcaccatcaacttgtttatatattgcgttttcttcgaatattggggttccagtaaaaccaaaaagctgcgcccttggaaaaaagtttttaatcgctttatggttatcgccaaactgagagcggtggcattcatcaaaaataatagccatacgcttgtcactaagctttgataatcgttctttataggtaggcaacccttttttctttttatcttgattcatctttccgccctcatcaagagcaagaccaagtttttgaatcgttgtaacaatgactttatctctatagtcatcggaggtaaggcgcgctactagtttttctgtatttgtattttcctcgacacaaccatcttgaaatctattaaattctatacgtgtctgtctatcaagatcctttctatcgacaacaaataggcatttttcgatttcaggattatcttttagaagtgtggatgctttaaatgatgttagcgtttttccacttccggttgtatgccaaatgtatccattaccacgattttgagcaatgcaatccatgattgccttaacagcataaatctgataaggacgcattatcatcagtttttgttcacttacaacaagaaccatatattggctgataagcttaccaagagtacatttctgaagaaaatgatcagaaaagtcatgtaggtgagtaatcttgtgatttttttcatccgctaactgataaattggcaagaaccgctcatccgcatcaaaacaaaagtgttccttttgattattagcaaaataatatgtattgctttcattgctcacaataaacagttgcataaaacaaagcagtgagtttgtatacccattaccaggatcatttttataatctactatttgctccattgctgtttttggcgtaatgttgagagatttcaactcaatttggacaacaggaataccattgattagaataatgacatcgtaacgatgattactgttttctgtatttattcgtaattgattgattacctcaaactcatttttacaccaatctgttatattaacaagagtatattgcagaggagtgtcatcgtcccgcataaaagtattgatctcgcgcaaagtttttgaagcagtgaatacatcatccgttatcacactatctctgagacgcgcaaactctgacggactcaaattcactccatgcaaccgctcaaaatgctttttaaaattagcctccagtgttgttttatcacgaatgtcatcgcggtatgtgtattttaaatccttaagcttattgataaaagattcttcaatttgcttttccgttctcattcacattcacctttcaataacaaacccctgtttttccaaatatgtaaatccaatataatttacaaaaatgtacttaattatatgtattaataatatcacataaaacaatagtcatctacatcaaaatagttctaaactgagatttggttgcttcacactttactaaatcgaccgtttcccctgtattaacaaaataacgcttcaaaaatctcccaaaacccatcttagcaaagcggaaaataccatgtcaaagcctgcatcctgaatggcgccagtttgccgctgtatttttccgctaatattctgctaataagccatcaagataaggaacaaaatcagccaataccatataacacgacccagtatctaattcataacaaaacccgctaccagagcgggttttgcggcattctgcaacatagtgcatcactgtaaaataatcgtcaaggctctctcctaagggctaattatcagttcggttctggtcgggggtaccaccagagccactttttcaagaagagtggttcttttattttttcttctggatgattccccatcatgcatatccaatgcatatctgctaattggaatcgaactatttttgtgatcttgctaagcaaaatcgcctgtttgctaagcgcaggattttttaggtcggtgcattctgcgccccgataagctgcgcgagtgccttagcaagttcgggcgattgttgtaactactcaatcagtccgttcaaatcaagcgcgggcttttcaggttcgggcggttttgcatcatgcagggcaggctgtgaataaaacgccgcttcaaacttctgtgcattgatctttcggtcatcatccaatatatgggcgtacaccttcgtaatcatatcgatctccgcatggcctgtatcgccctgtgtagcctttagatcgccgtggttgagctttagcttgtaggttgtactggaatgccgcagcgagtggaaaaccacgttcggcagccctgccttttcccgtaatgccttgaataatttcagcagtacgcgcccttcgcatggcctaccgtttgtcaaagccacaacgagattgtaatcctcgtattcatcacccaaaaattcttttagctcgtcctgtgccgcttgccactttctaagaatataagcgaccgttttaggaagccacaccttgcgaatgctagaatcggtcttaggctttttcaataccacacgagtcgttgtgtttggcatcaacggcttaaatattctgataatatcctttttatccaatacttctatcgcccttttggaacaacgcatcaattctttatcaagatagacaaatgcgttatctgcggcaatatcatcatcagtaatatggacgttatcccaagtcagccccaaaatttcgccctctcgcagcgaacaggcaaacgccagattcattgcgatatatagcttgctatcctcgcatgcgtcaagggctttgcggatgttttcagccgtccagatgtcacggtgcgtatatttgacttttttcacggtcacaagctcaaacgggtttttcttaatcatatcccaacgcacagcctgtttgaacgcgcatttcaacaacttatgaatgcgttcaatgttgatgtcggtgacgtattcattctttggcttgcgcccacggctgatcactgattttgtctttttcagcttcttatagaacgcgtccaccactttaggagtgatctcctgtaccaacatatgcccgattgccggattgatgtaattcccgatcaaccccacattggaatcataggtggaaacgccccaattctgttcgccgtacagtgaaacaaaatcataaagaaagccttccactgtctgatcgctgggcgcaatgaatgtgccatccagcagatcgttttccacttgtgctttgcgctttagggcttccttatgcgtgttccacgtctcccatttttgcttcttctcgccgttttcgtctataaagttataaacaaccgcatacttgctttttcttttgataattgttgccattctaataatctcctttgttaagcgtcttggtctaaccacgggtcaaacgactttttggagatttgaatagctttgccaatttttacggttctaaaacaacccttttttatcagattatacgcagatgatttcccgatgcctaatatttcggctactttaggtacgtctatcctgtatgctattcatccatccgacgccgttcctttgaccaaagtaccgctatatgcagatatatcctgataaacattgtataaaaaaacggctgtttattcaccggatacggtatccccgcagcgtttatgtccatcagctcgtcatcttccagcttacagaaaaaatcttttttgatgctcctaagcaggctttgcctgatgctgctgtcgagggaaaaatccgcctcttccggaatttccgcgccttttttcttcccgcccgcaagcgaaaacttttgcatcttttttttcactccatccttctcccgaaacaaccagtcccaaacacaccggagttagggaccgttgtatttttcgtacgcataattaatgaagggatttttcttggttttcaaaaacaaacgacaatggaaactccttttgctgctgacaatcatttttatcgcgattaccattccctttaagatcatgagaaccttatcccccaatttacgaaggtgcgccccgtcaacgccctgaacttgctattcggccttgtgggcgcgtgggcgtgcgcattcggtcgccttgtttcggctggtgtttttcaacacgctggtcttttcctgcagccccgcggccccagttgtcattatcctgacggagatatatggcgcggactgtattgttccagtaaaacacagccagatggagccataaaaaaggcatgcgcatgaagtagtaaactcaaaggagaaaagaaaaaatgaaagtgtcttatgggctgagcctcctggctatatggctggatgagcaggttttgtgggtcagctccctgacagggtatcccctcttcggacgcatctctgtgcgtaaggtactgaaacaaataccggtgcatgactaatatccggcgagcaatataccatcatagcggaagacgcgctttcttgcgctgtatccggcaattatacactctgttttttaccggcatttgctctggcgcatgggcttcccaaggtcacgtatatgctttttcccaatattttggcggagatgtttttacacaatcggaaaagataattccgtccggtacaattcatccgtttcccagcaggaaaaaacgccgccatgatcgcgcataattttttcgcaggtcttaaggccaatgccgctgccctgggcaacatcataatccctgcccggagcattttcaaaccggatgacgagcatattgccctgcctataatattccacagtgacgggcctgtctttccgcgcatatttcagcagattggaaaatatgttaccaaacaccctgcgtaccaggtttacgtcgatgcggagctcgccggcgatctcctgtgtaagcctgtcgatccggaatccgttgctttcgagatcaaacaggctttcttccacaaactgcgccaagaactcggctatcctgacattctggagctccagcttttcttctttttggctgtagaccaggaaatactcgaagagtttatccgacatttcttttatctgatagcctttatcccgtgcggcctgcacatattgatgctgatcctttccaatgtcatgatccatgaacaaaatatccaggtatcccaacaacgcggtgagcggcgtacgcaaatcatgcgacatggctgttaccagcttgtggtttgcgtcgagcgccgccgtttcggtttcctgccggtcgaggatggcccttcgcatcgcgtcaatttcccgcgcgaggtctgccagctcatctgttccccgtaccgtaacagaatgtgccaaaacaccgcctttcagtacctttaaatcgttctcaagcactgaaatatatgcaatttttccacgcaggaaccggaagagcagcaacaggaaaattacgaaagccgccgccatgcagataacgtcaaggatattgtagagataaaacggataaaaagaaacaacggccgcctgcaatgtgccgtccgaaaaccgaatatcatataccgaaggtacatcgtactccatgccgtatgcgtccacggaagcatatacctgcggactgctgctgtataccgtctgcgatccgtcgtagagtgtgtagatcagatcggatggcgttttcagccctgaaagggaaccaacgtccttttttgaaatatcatgcgtgtccgcataatcctgcagttcctgcgcaaaagatttctctctttgctccagcttaccaggatccatatatatccggtcgatgatcatgccgccacaccagctcagcacggcaaatgccaaaaaaccgattgccagcgccagcagcgtcgcgattgccagttgccccagcagcctgctcttaaaatttttcaatccgatacccctttccccatacatttacaatatactttggattggcaggatcgtcctccagcttccggcgcaggttccggatgtgaaccattaccgtattggtggaaacatggtaaaagaactcgtcccaaacgctttcataaatgttttgtattgtaaaaattttcccgcggttttcagccagcagaagcaggatacggtactcaaggtcagttaactggacttcctcgccattttttgtaacatcattgaacattttatcgatcatcaaatctcccaggacaatgctgccattcttttcactggccggttccttgccctggtatacatggtagcgccggatcatcgctttcacgcgtgcaatgagctccgaatacgaaaatggcttgaccaggtaatcgtcaccgcccgctcccagtcccatggttttgtccgagtcctggctttttgcggtcagaaacagtatgggaactgtcagggatttgcgtatttcgatgcacgccgacacgccgtcacgcacaggcatcataacgtccagtatgatgaggtcgaagctgctgtcagccaatgcgacagcttcgtttccatttttggcttcgaccacctcgaaaccttcattttccagcaaaattcggactacattccgtatctccggttcgtcctcggcaaacaatattttttccctgttcactggctgcgcccccttctggtttttcttatctgggttctaaactccatttgctcatgattccaatatgtatatattctaccaattacggcaactccaaccggccttttgttttttgctcaaaactgtatccaaaattcaatagtttttcatcctctcctttgcgtgttacaaaagtaacgccaaccggagcttttcccgaattggtcccgaaaggcacagtgagttcaggataccctgccgtggcgggaatatccacagccgcatcattcaagaagacgatcccatcgagcgaatggctgtcaaatactcctgtcataatggagtctgccttgtcgatcgtttccttcaccatcgttttgtccatttgttctacctttacgtcctcttccagcgtgtcctgcccatatttgattcttctttgaggatcttcgttattaaacgcaatcagatcctccagctttttgatcgggtagccgtaccgttgcgtaaattcttcaaagtcatgcttaaaagactggctcaatacctcaccgagatacaccccatcctcatttatttctatttctttcacagtaacgcccagttctttcagttgttttttcagggcgtccaccgaggcattatcgtccatctcattgataaccaggcccaaggttttaccctgaagcgcggcagccgcaaatggtttggatgataacgccgtcccggtgatcgcgttgtagcataatgccacgtcttttaccgtttttgccattgggcccgccgtgtcaattgtttttgccaatgggaaaacgccttcggtcgacacgctgtccttgctcggcttaaagccgacaaccgaattcgcacaggccggtgagatgatagagccgatggtttccgtccctatggaaagaggcgtcaggtttgctgccaccgatacggcgctgccgctgctggaacccgaaggggaaagaacaagcggtccgtaaggatttacggtctggccctttttgccgctgtagccacttggcatgttggaagaaagataattcgcaagctccgcgaggttgttcttaccaattacaactgcgccactttccttcagcttcgtaacgagcgccgcgtcctctttgggaataaaatcggcaaatgccactgtacccgcgctggtaggcatatccaaagtattgatgttctctttgagcatgaccggtatgccaaacaacagtccagacccttggccttctttcctgctcctgtctttttccctcgcctgctcgatggcgcctggattgatttctgagaccgaattatatcccttgtctttttgatccaactttttgatgcggctcagataaatcgccgtgatttcctcataactgactttgccgtctgcaactgcctgctgcatgtcctcgatgctcttttcgattacatattgtgatttttccttttcgattttctcgatatcgatgccttccaactgtcggtcgatcgattggatcagtttttcattgccatacgaaatccactcttcgcctgtctgcggctgggattgcggctgtggcacggcgcacgccgctatgcttacggacatcagcgccgatataaagcacatgataactgttttggctttccgtctcataataactccattccaatccggtaagttttctgcatatctatattttcatgttaacaaaaaaatcaaggaatacaatgcatttgtcagtttattcagtattcttcatatctcttaagaatttcgtgcaggtttcgagagccggtcattgattcttttccggctgctcttggcctgcttaccttaatgttcgctcttattaaataggtacgtgtttatttatatataacagtatatcatgatgcgaatgcaattaaaattgatttaaagcgtatttatgttggttgcaaaacctagaatccattttaaaaataggtacgtatttatttaatatcttgacaaatcctgcctgcttctctaccattgagattaaagggcgtcgataaggaaaggactatcgtgttcgtatatagttggcggatggagtcgagaaacatatacggctttgaacaatcggcaggtacgtttgttttgggtagggtttgcgtgaaatgtcatcgttggcacaactttcatgggaatattatcccaaggttacacccattacacgttccatttggctacattcctaatagagattctcattatgctgcttcatgccatttgggttacgattgcatatgtccgaatatgcttcgcgagttccacgaacacagtatcatgatttggctgatatgattcattctatttttttcggatgtgtttgcagggttaaacgacgcgctttggcaagtataaaaaattaaaggagaaatgtaagaaatgaaaaaatatctgaatctggcgcttgtttacgcgattatcgcaatggcttttggtgtgttttatcgggaatatacaaagttgaatggatttgcaggccaaacaagcctcgcgtatatgcacacacattattttgttctcggagtgatcatattcctgatcttcgcgctgctggagaaatctctggaattttccgcactcaagccggttcgaccagcacttatcacgtataatatcggtttgaacattacttgtttcgggttcctgctacgcggccttaaccaggtatggaatacaaacctgtcggcgggcatggatggcgttactgctggtatcgcgggtattggccatgcattattaggaatcagtctgctggtaatactggtacaggtaaaaaaagcataccggtaaaatcaacgctgtttttcataacagctgacgtaaacctgttttttttcagtagtccacctttatcttccatatactgacttcgtataaacatctgtgttggaatgcttatcccctgtatgatgcgggatatagactcacttcttccacacatgttttagaatagccaatagcaatcaggaggtaaagaagatgaaagaacaatattcgaaacaatgcgtacgcttgttgttatgctgtttttggtacaaagcatacgaaaaagcaccttacatcatgccggactgaaaagagtcctgataactattattccaacagggacttaacaaagaaaagccttaaaaaaatattgatacaaagcaatgggtatgtattcatgcccattgtttctcttactgtgaaaatcgtgtttttttgttggttttcactgtcgagagaattttttatgcaaatatattttccaaaggaggtgatattagtcgcctttttttattgtggcttttacatcgcgaaaatctaaataaaagcgtgccatcctggcatgtcatcgttctcgatggcacggtcaggaggcaaaatgagtaaatacgaaggagaattcaccgcttatatgaaacgtgttgtccctaatgcaaaagtggactacatacgcagaaatgcaaaacgaaaaaaagaaatcctgcttccccaggtccaagaagatatagacatatttatgatggaagatatctattttgaatcgactggcgaaatacaatttgaagaggaacagttggaaagggctttttctgggctgtcgccgctgaaaaggcggatactggcttatacctatgtcgatggcctcactgccgaagagattgcgaatgttctgggatgttcagtggacaacgtctatgcgatgcgttcacgggcaatcaagaagatccgttctgttatcgagaaggaggggagaaatcatgaaatcaacagacttcgataaacaattaaaaaaagcaatcgagggcgttgacggggcgcaccttcgtaaattgggggataaggttctcatgatcttaaagggaacggcaatcgcgataaaaatgattgtcagcagcaaaaggagccttcttgaaagaggaagtgcgggacaccgaggttatccggtgctgtgtgaaggacgtgctgcgagagccggataagaaaagaagctggacgcacgaaacggagctatagagcgaatgagtaaagaacccaagaataccatgttcaatatcattccttcggtgctttctcatatttttcacttggtgtaactattgactagttggctaagaatttcttttttgtgctgcaaattgcttcatattggcaagtgatgctcgaaaagacctatcaaagctttcatcattttttgattcatttaaagcaaaaagtaagatattgtctaagatgctggcttgggaagacaacgttcatctggaaattttctatgtgtattttatatttccggcatcctttataccaaaggctatagtttagaaggaacaaaagttacgtacaaagaagaatcgctacggagttgcagttccgcagcgatcaataaatatctcgatcagttatttaaaaacgctacaaaaagcattttttattttacacagtcttcatatatcatatttctctttttctacccaggaaaaatataacaacaccagaaatgacatgactgatcacaatcaaaacaaacgccgaagcaaagccggtgttttctgccatcaagcccataatataagggaacactaaggatgcaataccaatcgataaaggaatgatagaagacatcgatgcggtacgggttggaaacagcgaactgccaatcaaaataatcatggtagcctgcaccccttgcatgaaaccggagattgtaaccagtaccatcatggcggctgtattattgacaaataatgcggcggccatcgtagcacaagaaaccagcatacagatcacatacaaattttttgtacgtattctttttaaaaatatggggctgacgaaacgcatcaccaatgatcctgcccagaaaagagtaaccatttgtcctgaaagctggtaggacatacccagttcattgctacagaaggtgggcagccaagcgccaacgccaacctgaaatgcaaagtatgtaattcctgctacaattagtatccacgcttccttagtacggaagatttcagcaggattcgcgactgcacgttttttgataacggacatatccgcatataccgtgcttgcagtaacccttttaccagtaaacaaatatatcaggaaaacaatcgcagtagcaatgccgattattaagaagggaacgctaaacgtagaaacaatttcgggatttacgactgcggtcaccaaaaccggtgcgatcatggctccaatcccatgaaacccatgcacaataggcaccagcgttgatttgtttttaaaattctctgtcagagtaccatttaccataatatctataaacgtaaacccagcccctgcaattaacaccagaaccagtaatgtattgtaggtgataccaccgcctaaaggggaagacagaccaatcaccatgcacccaagcgtcaatagcaataggccaaaggtgataccatacaatttgttgaagcgttcaccaaataatccaaggaaaaccgtagctcctaaaatgccgatagattggatggcagtgatgaagccctgctgcgattccgttatatggaaaaatcccatcatcacagttgcatttgaacctagcacattatagaacattgcatacacgacatatgcggcacaacaaagcaccactaataatttcaggtttaccgatatttttttttgtccatttgattttagttctgtcattttatatccactcctcaagttaaattacgtctgattatattctttcgtttgaactgtgcgtagcgttcagatttgcgatacccctttggttttgcatatggaaaaccaagtaatcacccttgcacactcgtactatagtttgattcaggtgtttacagaccgatatcacattcttttctatccatctaataagacatgaacgccattattttcaaagagttgtatagtgcgttccacggataagtcgaccaagcagggtgggatagtatccataagatattgctgatccatgaacgaatatttggattcaccaaaactatggtaaggcaatacattgatgctggaaaggcctgcttctctaacgatctttactgtctccattacatttttattatcatcgttgaaaccggggatcagcggcatacggaggaccagactgtttgttgcccgagacagcttaataatattttccaaaatcagttcgttggaaacgcccgtatactcctcatgccgcttgacatccatacttttgatgtccacaagataataatccgtgtaaggcaaagagttttcgatagcttcccattggcaatatgctgaggtttcaatggcggtactgataccaattttttttagagcagccagacacttaattaaaaattcgcgctgaacgaaaggctcgcctcctgagaaggttactcctccgccactggtttgaaaaacgacacgatctttttcaacttcggtgataaccgcctcaaccgtcatatagtttcctttctgggaaagcgcttccgttggacacttcttcgcacattcaccacagccaatacaaaattctttattcacccgattcccgtggtaattttcgcgaataatagccccctgtttacatgctgcaaagcaggaatcacaatgtatgcaaagattcggattaaagagaatatccttctttattgattgtgattccggattactgcaccaaagacaccgaagaggacagccctttaaaaaaacgattgtccgtatacccgggccgtcatgcagagaaaaacgttggatattaaataccattccttgtctgcctgaatccatattgctacctacccttggttaaatcgtcgccgcattgcgcgcgataacggattcctgtgctacatcggatagttcaatgaaaatggcgctgtaacctgctacacgaacaacgaggtcacggtattcatgcggatttttttgtgcggcacgcatggtatcggtagaaacaatattgaattgccaatgaaaaccgcccagttcaacaaagcttctgaaaagttgagcaagcttcttccggtttttttcgttcgcaaatacagaactcgtaaaacgctggttcacaattacgccgcccggcgcatgcgaaagatcaattttggagaaggacttcaaggaggccgtagggccattacgatcctgcccatacattggagtcagaccatccgcaagggtttcgcgagccaaacggccgtctgcgcctgcaccggtgagctgtcccattcctacctgagaggtcacggaatacaatgccatccaaaactcgccgttgtgataggtcttatacttatccagttcatcaaagaaatggtttgttacctgaaccgccaaatcatccacgtcatccacatcgtttccgaactttgggagtttatttgtaatcatttggcgaaggggctcctggtcttcatagttattcttaagaatttccctgaattcctgaagcgtcatggtttttttgtcatataccaattcttttacgctgtacagcccatctacacagtttgcagttccaagacccacaatatttgtgctgttaagatatgcaccgccatcggtgacatctttgcctttctgcagacaaccatcaacaaacgtactgacaagggggataggagccagctgtttatgcgcgtaatccaccagattggtttcagaacaatgcatttttacaaaatagtccatctgcgcataaaaacaatccataaaaccggcaaatgttttaaccgaatccacgtcctgtactaaacctacttttttgccaaacagtagatctgtgccgccgccaatggtgacttccaatattttggcaaaattgatatatccgccattacatctgccccaatgacctttcactgtgatttcatcacagccaagggcccaataatcgcgggcggtttccagtggaatccctttttggagcagggagtcgataatcagctcgtcatttaataattcaggcataccgtttccagcggcgatactgtctatgactttgtcaatatacaggtcgggcatggatttgtggacacgtgcggcaaagttaggttggtttaatccgatgtgtttgttggcggtcaaacaaatatacgataaatcattggtagcgtcttttccttcctgatccacgccgcccacgcataacaattcgccgacaggatatcctgcgatttcttctgccgctgcattggaagatacatggatgacttcacacgttcgcaggaagaaatcgtcaaccagctcctgtgcctgaacttctgttaaaatgcctctttcaatatcctttttataaaagggatacatatactggtcgaatctgcagggtgacatggaataattatggttttccatgccgctgatgaattgcaataggttgagcgtctgcattgcttcccaaaacgtatccgctttatgcaacggaactttccgggaaatgcgcgccatttccaaaagttcggctttacgcttttcatccatggaacgggttgctgtgctctcggccaattcagcaagccgattcgcataaattaccaacccattcaacatatttctggaggcttcataaaaacacttgcgttcaaaataatcaggttggttttcatccagtctggattggtgttttgatacttcctctaatattccctctacgcccatgttaatcaacttgtcatattccataacgacatgtccaagcccgccgtcaaagctaactgcacgctttacgccaacttcatttgcaagggcggcctctcggggttgcagagcgaaaaataaatttggaacgcctttgcctttccagtatgggaagatgtcccggatgcgttttttggtatcctccgttaccttcagcctgttgcaggtacgtgtttcaaaggtatcgatttcatcaatccagttttcgaaaaagagttcaggataaatttccgcactccttggcttgctggcatgatggcccagcagcagttcaccatcttcgatgaacaaattaattttttttgtgcattctaaaaatgcaagggaacgcttgaggatgacagggagactctcgtttttctgataaacctcagtcacaatttccccccgttggctgcataattgcggtacatgctgaaggaagctctctttcatctttctaattcgatcagtaggttttgcaatcagttcaaaatccattatttaacatctcctttcagtccgttttatatcaatgaaaatacatcctatgtattgttttcgcttgaattatttttgttttataaccttttggcattccacagaagcaatcttatactgccattccgatcttgatatattatgaggtatatctgttaatatttatggtcgcagccctaaacttaacagtgggctgcgaccatattatattttttcatttcaggatatagccacgttattttacaccgaagagatccaggatattctgtcccattacattggccaaaccttcatcactgatgccatccagaacttcctcgtaagccttgatacattcaccctggtcaaaaaagggagcgtccgtgccaaagcacatccgcttgcttccaatggtatccactgctttacggacgtaagaataatcttccagcacactgcctatgaaataaatgtttttattggcaacagccgcgtcgatcgcgtcctggctgccctggggtgagttacccatatggattagcaggattgtgatttccggaaatttttccgcgatagcccttacttttttcggagttgttcgctcatctgctcccgaatggaatgcaaccatcatacccgctttcccgagttcttcaacaacggaaaaggatttgacaggatccaaaaggtcaaaatagttttcacatccgtttaacttcgcggccttaaatccaaattcttctttttgggtctgtatattttttttgcattcttccagcgaccacaaacgagggttgatccagcccaaaggaataaatctgtcggggtatttctgcgattgttggtatacatatcgattgagtccttcataatcgcacggctcatccatttcaataccacattgcaaggtaattaatgatttttcaatcccgtacttatccatcaattccaaaatttcctcgcctgtggcggctttatctttcggttccgttgagatatgcacgtcaccatcgattatctttatatcttttctcataatacaatcctttcatggcgcgagagattattcgtaaatgtcctcttccagcgtcttgatttttttctgtgcatccaataggaaatcatgaaagtcgtccattccgtccgtaatctgggtagccagaaaagcttccgtcatcttgattcccgtatttggggcaacaaggaatccccccatagataaaatgtttgaatcattgattgcccggcaaagctgcgccgaatatagactttcgcataccgcagcacggatacctttaaagctgtttgcgatctgcgccatacccatgccggtaccgcagaacaatatggctttatcatatttgccgtcttgaattttccgggctataaccggagcgatatcgtaataatcgacggggttgtcacttctcagcgttccgaaatcctggtattctatccctttttcatctaaatatgtgcgaattgcttcctttagatcaaaacctgaaatatctgcacctattgctaatttcataatcaattatcctttctttcaaatcacctgttgctttcagcgttttatattatttcatcgcgggagcctaaatgaaaacatttaggctctgcccgctaattcgatataaggtcgcttatgctggagcggtatatccggtaatgtactgctggattgcttttacaccttcctcggtatccatgttgtctttggtcagaatgaaactgccggtatcatttgacttttcaaccgtaccaccttccaagatcgtcaagattgcttcaacgctcatgtatccttcattgtatggcatttgcagggcaagacaatctacagtaccgtccctgaggccttccaacaactctgcattacagtccacgctgcacaggaaaatttcatctcccatatccaacgccttgatggcattcattgcgccaaggcccatgaagtcactggcacagaaaagcatatcaacatcaccgccggcaatcaggttctgcgttacgttcattgcattatctacagttgttcccggggtctggaaacctccgtctgtccaattgggagccttttctttcatcgtatccacgaaaccggcgtacctgtcctgcatttgcttcatatccatgttcgggagaatctgatagtacgtaccggattccggtatcactttatcaatcatgtaggtcgccatatcagcgttcatcgcaatcgaatccgtaccgaaaaatgcggggacagtttccatatcgtctaggatgttatcgaaacaaacggttacaacgccactatttgccgcattgttcatacagtctgtcagggcttcgctgctcaagggagctaccagtatgccatctacccctgatgccaccgtgttgttaacgatgttgatctgctgttcaatatttgaatcaggagccccctcagtcagtatctcaatgccgccccattcttccgcatgagcggcggccgcttcttcagcgcccagacgggaagcatcccaataaggtgtttccacacccatagggatatgtttgataactaagccttcaccttttttggggagcgttgcatctggcgaagagcttccctcagaagccgcagattcagaagccgcagattcagaagttgtgggtgttgaagtgcagccggcaataaacaacattgcactcaacgttagacaaacaacaaacatcactttcttcattacttttcttcctcctttagttttcatggttataccattatttggaaaattggtttttttttaatttctttattgttctttatggcgccttaccatatccacgtatacggcagtgataaggatcgctcccataatcaactgctgtatataggaagagatgcctgccacctgtaaaccatttgtaagtacaatcataatgcctgcgccaatcatggaaccactgatcgaaccaaggccaccgtcaagactgccgcccccaatcaccgcgccggcaatcgcgttcatctcataacctgtaccagcctttgcaataccaccgttaactttgcagagcataataaaacctgcgactccaactgtaagatcgctgatcaaataagttgtaaaacgggtacgttcagttttaatgccagaaaactttgcagagttggcgttgctgcctgtcgcatagatggcacggccgtaagtggttcgggataataccagatgtcctaccacggcaaatataattgtgaaaataaccattacgggaaatacaccgccaatagatgtggttgcaaaagcagagagctcaggcgggaggttatgaatattggaaccgccagtagatagtaatgccaaggcctgcgtaatctgcatcatacccaatgtggcaataaaagcgggcagttttatataggatgccaggaacccgttgataacgctgatgccgatagaaatcccgatgcaggaaaagattgccacccaccatgggagtcccagatggtcgccggataccaataaagccgaccaaaccgttgtcaggccaagtaccgatgcctgtgaaaggtcgatgcatccgcttacaataacgaatgtctgtccaacggttacgatgccaatcattgtaatctgctgcaacaagttgttaagattcatcgaagaaaagaatccctttactgaaaatgaaaacaagataagcagaaagactaaaataatcccaacaactgcgagcctgttatcaaagaaccttttttgtgtttttatgccttccatttttaatttccccctcttaattgtttggtttataccgacaaaataatatcatgttccgttactccgactccgaagctggctgtcattttgcctttcgacatgacctcgatcctgtcacatgtcccaatcaattcatctgtataagatgaaataacgataacggccgcgccttccttcgccaattcacgaatcaattcataaagtcttgttttcgttacaacatcgatacctttagtaggctcgtcaaaaatatatatctttggttgggataccatccattttgctacggaaactttctgctgatttccaccgctcaaggatgaaaccttttgggtcagcgagttgcaacggatgtccaaaagatccttcatgcgtttggccatttgcttctcaacatttgttttgataaaagatgattttgtcacaatttcaggacgctttcccacgatgcttggcaaagcaatgttaaatgcaatggacatcgtaaggttcaatccgtttatccttcggtcttcactgatgtaagcaatcccttttttaaaagcatctgcgggatgagtaatgttggcttcttcgccatcaacaaaaatttgacctctctctttttttgtcgccccgatcaacatatgaaccagttctgtacggcctgcgccaatcaaccctgccagtcccacaacctctccataattgattttgaaatcgcagggagacacgataccgccccccaaatttttgatttccagagcaactttttcctgtttatatggttcgatttctggataataattctctatacgttttccgatcatatagctgacaatcttaggctcggtcattccttccatcgaaccaaagtaagccactttaccgtcacgcataacgacgcacttgtcacagatatcgattgcctcgtcaagataatgcgttatcaatataatggttaagccgtcttctcgcatttttcgcattacagtaaataacttttctctttcggtaatcgtcaaagcggtggtcggttcgtcaaacaccacaactgcgggattgcggtatgcaatctttgcaatctcgaccaattgctgtgtggaagccggaaatttatagagatgctttttaatatcaagatcaactcccaaccggtcaaaaacactcctgacaactttatcctgtttcttaaaatccaatagaccgcctttggtacggatatctttgccaactaccacattgtccgagaccgataggtccggcatattgctaagctcctggtatacaacgccgatacctgctttctccgattcagaagcatccttgaaatgctgttcttttccattgactaaaatctgcccgctatccggctgatgcacgccggatagaatcttcataagcgtgctcttgcctgcgccattttggccaagtaaagctaaaatttcgccagattccgctttcagattaacatcagtcaacacttgatttcccaaaaatgatttgttgatattcctgaattctatcaattgacgtcactcctttgctattatatatttggaacaagggtacgacggaagccgtgcctttacaccacctcttatcaattttcaaaaaaggttaactacccaacggctaattttattagaccttagttttttatacacgattttgaattttacgagaaacgtacagatcagacgtttggaacatttgtaccagaaaacaacttacatttgttacaacaaacatatcatgcgttacatttcttgtcaacatatttttatttaaaatgacgaattttatcgatttcctaatcctgaaatgaaacactatcgttttgatactgtgctttatacccttttaaaatcgtttttttgtatttcattaaataaattcatgaaggttggcatacttggttgacggactggttcattgtagtatatgatacatatgtaacaaatgtactaacaaaatgatatgaagaacaatatataaggagtgtccaatctatggaagggaagaattattttgacacagactatttgattcatattgcacaacaatactattatgaaaataaaacacaatctgaaatagcgaaagaaaacggtatttcccgcccgcaggttagtaaactcttgtcacatgcgcggcaagatggaatcgtaacgattactgtccaatctccagctaacagcctacgtgacctgcaaaacgtgatgatacagcgatttgggcttactgactgtctggttgtgccttccgttccagattcttttgacggaatgcagttgattgccaagaaagcagctgaatacatcgatcgcataacctcacgcgcttctttggtagggctgggctggggtgaacttttgaataccattacattatctgaagatttgatcccacaaccgcataaaagcgagggagtggtgatgcctttgattggcagtatcaccgcttccaacaatggctataataccaatgaactggtgcgcatgttcgcatccaaatttgcgtttgtgccctatgatctgtattctcctgcatttccatcatctatatcggaatacaaccaattttgccaaacagaaaattatcgagaaatcagtcaaaagtgggatcaaatggacgttgcgatttttagggtgtttaattaccccagcgcaccggatcatgcgaccaaaagccgttttggagatgaattaatccgccggcatgcagtcggagccctgctttcttatttttatgatgtggctgggcatttcattgaaggagagaacgattattgtatcagcgcttcgatcgaccaaattaagcgggcgccaatcagcttggggatatgctcgacttcaacgacccctctaagcctgttgggggccttgcgctcagggcttctgacgcatttaattgcagatgagagcttgttaaagcaggctctaaccattgcgtttcccaacagtaaataaatctaataattaaaaaccttataatctatattgtccgctatttaagcttgcatataaaaatatatgcaagcttttttcgtaattatttgttgacaaacatttttttagatgataatatcatatgtatcagacaatcgtaacatttgttccaaattgcacttcatttgttataagtacataaataacaacaacatatagagaattccttgtaccgtttatacaagggcagatattaagtggtatcggtttgtaaacaagaagctctcaagagtatcatttgttttgccaaaaccaatgagcgtttcaatataatctacaaccgtacgccatacgacaatgtcgacatatctaaaaaatatatgtacgcttaaatggaggagtcatgaagattactttagaacaatggaagcagatgctaaaaaaatcggctgagctgttacaacaaaattcatcagcgctttgtcgcatcgatggtgaaatcggcgatggtgaccatggtatcaccattgcacgaattgcggatctcatttcaaaaaaaattcaggaaaactatgatagcccttctgcgttttttgatgaccttggtttttccgttatgaacattcaaggcggaagtgcgggtgcgctatggggcgttttctttacggggataggtaaggtgcttgccaataagccggatgcagggattgcagacgtatttgatggagccctgaaggaattgcagacaatcagtaatgcaaaagaaggggataagaccatgatggatgcgatcattccggcggtaaaggctatgaaggaagcggcggacgatcgtgtcgcacttcggaaaggagctgatgcagcccagcaaggcgctgaaaacacgatcaattttgttgctaaatttggcagagcaaaaaattatggcgaacgaagtctcggagtaaaagatgcaggcgcttgttctatcgcattattgtttcaaggaatgcaaatcggatttaatggacaataaacgaaaatattattttaagggggtcgtacacatgagtatgaagaaattcatcaacaaaccagaaaatctcaggcaggaattactcgaggggcttgctttggccaatccggatactgtagagatgacagaagacggattaatcgtaaataaaaagcttgccgacgcagaccgcgtaacagtggtttctttaggcggcacaggccacgaacctgctttaagtgggtttgtaggggaaggtattctagatatttctgtgcctggcgatatttttgccgcacccggtccgcagctttgctttgatgcgttgaaaatggcggacaagggcaaaggcacattatttgtgatcctgaatcacgcaggagatatgctgaccggcagtatgacattaaaaatggcgcaaaaagcaggtctgcaaattaaaaaaattattacgcaggaagatatttccaatgcctcgcgagaacatagcgacgatagaagaggccttgtaggatgcatgccggtatataaaatagcgggcgcagctgcggccaaaaagatgtctttggatgaagtggccgaggttgcaggacggtttgcaaacaacatggcgaccttagccgtggcggcgcgcggcgctacgcatccggcaacaggcgaagccatttctattctgggcgaatctgaaatggagatcggtatgggtcagcatggcgaaggcggcggtggccgttcgaaaatgaaaacggctgatgaaacggctgaaataatggcaaacgcattgattgacgatcttcaattaaaatcgggcgaaaaagtgatggttatgatcaatggatcgggatccacaacctatatggaaatgtttatcgtattccgtaaagtatatcatttgctcaaggaaagaggtattgaagtagtcgccagtgaagtgggcgaaattcttacagttcaggagactgcgggtttccaactgtttatggcgcgcatggacgacgagttgcttgagctttggaatatgccctgccgttcaccctatctcacaaaataacatcaattataaactcgtaacgagttgcagaaatttaaaaggataaatatatactattaaggaggagtttattatggcagatcaagaaggtaataagaacgcgagggattacaatctcgacattcctcagaaaacagaaggattttttgtgaagggggcgggtcaatacgactggggaatgaaaactaggctttccaacatttttcaaaaagatggacgttcaattatgctcgcatttgaccacggctacattatggggccgacatcgggtttggaacgtttggatttggcaattccgcccttggttgaacacattgattgtttgatgggaacgagaggcgctttccgttcctgtctgtcaccttcctacaaaaaaggaatcgctttgcgcgcaagcgccggctccagtgttttgaaggatgatatgagcttggaagagtgtggtgtcaacatggaagatgctgtgcgtttgaatgcggattgcgtggctattcagacatttattggttcagataatgaatgttctagtatcaacaacctgaccaatgcgattgacgccggatatagatatggagtgcctgtaatgggtgttgtagcggtcggaaaacaaatggagcgaacttcaagattctttctgcttgcaacaagaatgcttgctgaattcggtgcgcaaattgtgaaatcctattactgcgaagatttcgagaaagtagctgcagcctgccctgtacccattgtaatggcgggaggcaaaaaactgccggaagaagatgcgctgcaaatgacatacaatgcaatttcgcagggcgctgctggtgtggatatgggcaggaatgtttttcaggcagaaaacccagtcgcaatgctaaaggctgtaaatgcaatcgtacatgaaaattcaacttcgaaacaggcgtatgaactgtatctggatgaaaaatagatcggaaggagcctgcaaatgtataagcttgcacatgttggaattccaacgacgtttgaacagaaaaatgaaatatattcggaagaactgcacgtacacctgacagatccatctgagaaccaataccaaatcgaatatttacggtttgtttccggtactcctttgcccgatatcctgaccaagcagaatcatgttgcttattatgtagatgatttggaaacggcaatgaaggacggtgaagtaatcgtgatgcctatggcggtaagccctgtacgtaggatcgcttttatcatgttgaatggattacctgtagaattgattgaagataaatgatcccctcgctgaaaaacaccctttgcttttttgtgcagagggtgttttttcatgtgcaaactgttatcgatatagtttggccctaaagttggaagatgagtcgcttcgtccatacctatcaggttgcgcaaatccggaagacaccgcccggagaacattcaagctacaatcagcaaattttagggaagttttatgcccgcggcttctacaatgccaaagcccacaaacgcctcctgcatgacatggaacatataccggtaaatatcctgcagcatttcagcaaaagcttctttatccttactcctgatatactcgatggcaattttcgattttgttttgatcctctgcagatgcgcctcattacaacgcgcaaacgcgaaatagtacccccagcgcatcaactgccccaactgcccatatatatttctcaaggattcgagcggctgaacctctaccagctttgccaatatataattgggcattatggttctcttaggattgtccaattcccgctccaattcatccgctatgccttcggaaagatagtcaaaccctgcgtttacaagaccatcgcatacaagcgccgtcatatgcagggcactcaaaatcgttatcagatcgtttctgggcgcgctgctctccacaacgagctctttgtccctggcttcggccagcgtcaccaaataccggccgcgctggctcattttttggacgagtccggaatcctccagcacttttaccgccctcctgatggtattgggcgcagtgccataatattcctgcagcttaatgttagtgggaaggtatgtaccatccggatatatgccctccccgattttttcaataatgtcacgcgcaatagctgtatattggtgaactctgcctttttccgcgctccaataataatccgttttttctgacgccaaacttggatatgcctgatgcagtgcgctaaaatatgtggacaaggtttgcaaagcacggccatacatatcaccgatcatctttcggattccggagctgtcctgaaaatcgagcatgtcaaacagggcgttcaggtttttatcagcctctgttgaatttttttcaaacgggttgtcaaatccctcgatggccggcacctgggcgaataattccatgtcgatatacatatcactgatcaaggaattcccgaatatggcaagtatccgccggtgggccacagaagatatacgccacttatccttcgctgtcatttgaccaatgcctttgatatcttcgcggcatgcccggatcaggtcgtcatccgcaagttttgaggcctttatatacatgctcggcaatatatacgacatcgacgtgaccaaatcgagaaccgattccctttttgaaaggatgtcttttacctgcgatatgtttcccgcgctgttatcttcctgatatgctacctcaagccgcagcccggaggagttgggcttgatatatccgtcggcggaaagctttttgaccacatcgcgcacggtgcggatcccgacgttatataatttgcacaaagagacataggaaggaatatattcaccataagcaaacttgccggttttgatctgttttaccaattcgtcatacaggtatttggataaagtaatcttttgttgcatgccggatatagcctcgattcttcctcagtaataatcactttaatatatagctatgtacatgatcatattatactgtgagaatgcgtgatatgcaaatattggtttgcttgcaataggcatatattcggtatattaacgcctttggcggtggatgtcatgcagcacatactgcgggctattccagcattcgctcgaaatcaggaataggtacgggcttggaaacggttatcatatccagttttttcgccatcgagaccaccgactcgatattgtgcgttcgcggggattatccgcatcaggatcggcaaagaaagctttatccagcttgagcgtatcgacctttatatcctttaacgtattgagagaggagtagccgctgccaaaatcgtcgagggaacattggaagcctgccccgtggagatgatcgatgacccgcatgaccgcctccaaatttttgaacacaagcgtttcggtcagtgctatctcaatcagttccggtgggacgtcatatttcttctgtatatcggcaagattccccggaaatgccgcatcattcaggtgaacgcggctcaggctgaccgagatcggcaccgctttttctttcgtgtcgtcatcatcaagccatttccgaagaagaatacatacctgttcaaacacatacaggtccagattgatgataaaaccgtttcgttcgaagaacggtacgaattcatttggcggaatgaccccttgtccttgtcgtgctccagttcggcctttggctgtaggtaaacatgaaattcgcatttgtgtttttctgattgagaacgctggaaaccgtggaaatggatacgcccgctttctgcacgatttctttaagggtcatcgtattttatgttgtaattccctaatttatccaagaagggaagcaactttcctcctcgttacatattgataccgtatattggaaatacgcaaggtgatccttatttagcattctccggaattccggaagctgcgttcaaccttatttcaggacctattttacgatcattgcctgcgttgcggtagcctgagccggcaagctctgcgcaaccatgtcgaaccatgcgagaagcgtatcgcctttcgcaatatccccgctcgctactttatccccctccttgccaaacacgccgatttcaatgtcggcaggaattgtgaccaaaagatcttggttttcgttcagcgtggtgatactgccgtcatcgttctgcgtcacttcttctgccacaagatatgtcggtataccaagatggttttcagggatattcgtaacgatcgcaaaggcgttggcaataggcggcaatgatttcgtcatcgcgctgctcacatacacctgtactttatctcccgcctgaagcttatccgccgcaacaggcgcgccggtcacagcatttacaatcaccgtatcgtctgtaatggttgcaataatgtcgtttgccggattcgcttcctcttcacctgttacatggatttgaagggtatcgtcctcgttgataacttcctgaatttcccccaatacattctgtgaaacctgtactgtctcttccggtgcggcgacaggatcgtcttccggtgccggcgctgtttcgtcggcggtatcgtccggcgtaggttgtgtctcggatattgtaggcggcgttgtttccgctgctgtatcttccttagggggagcacaggccgcaaggacaaaaacggccattgcaaggatggccgccattgtaattaagagcttctttttcattttgtttcctcctgttgcatatcaatgattttttgtttccgtcaataagacgatatatacgtccgtatagtttcttgttaaatttaaacaaatcatgaacatatttaacaggaaacatgctcatgaatcgctgaacatacgctttatttacatattaattttaaatgctcctagccgcattccctgaaacagattttttattatctgcgtaatgcacatattatcctttagcttcagggcaagtacatcccctttgattgccgacctctgcaagcatagattcctgccggtttataatatccgcaaacgatatacctcccagatgcgaatcaacaccgctttgtatctccttaaaaatatcatgcaccgcgcagtggtcaatcgcattccggctgcaaaatccgtcccgctccaagcaacggttgatgcgtatgtcatcgttcatcatgtggatgatatcgatcaaaaacaaatttttgggatcatatgtcatcgcaaatccgcctgagttcccgcgttttacatccacaacgcccgccttcttaagtttgtttaatatctgtgccgcgtatttacacgggatagacatcctttcggatatttcattcgtgctcacgtatcccttggaatttgcaaggtaaatcaggcatcgaatggcgtaatctgtgctaatattcaaaatgtgcattgctttactcctatcatagctgagagcggttatgaccgctatagtttcagtataccttttctaaatactgcgcatatccaccaccgaagcagggacttccgtatcttcggcctcctccgtccacttgaaaaccgaggaaaccgtatcaaaattacgcaggatcaccaagttgtagtttttctgattgttaaagaggtcaatttttttatacggtttttcaatcgtttgcacgatcggtcgaagctggttgccatgtccaattactaccgcctttgtcccgtcgctcaactcaacgaatgacccaattgggtaaaattccactttattcagaaacacgccgacaatctctgtatcaaaatcggcgccgcatcttgccatcatatactctaccacgtcgtgttgtatcatgggttttcggtacgacctgcttgacgtgagagcatcatatacatcggccacagcgataattttactgaaaaaggggatctggttttcctgcaagcgggagggataacctgtgccgtccagcttttcgtgatggcatttcacgctttcaaggattaattcgtcatttacaccatacccggcgagatatttcacactattttcaggatgctggcgaacaatttcaaattcttcgtctgtcagctcccccggcttgttgatgatatctgccggcacagacattttaccaatatcatgcatgattgcgctgaatcccagtttgtataactcttgattggatagcttcatggccgaaccgatggcaatagccagcacagccacacccagggaatgatgataggtgtactcgtcatgtgcttttaggtcagatatatgaatcagcttggatttatccttttgtatcaggccgatcaaccccatgaccgtctcgtcgatatgcttcatatatgagaacgaccgatgttccagcggttgctccggctggcgaaaaatccattctaagtttttgagcgacttatatttggtattctcatccatcagaggaatgctcggcatgagctcgccggtgatttcatcccgcacatatataccggttactccaaaccgcttcattctgcagattgtcttttccgtcaaaactgtccctttgactaacaaaaggacgtttgaacggccaaacgccaacacatcttcaggcagctttttccctgcctttatttcagaaataggtataaataacatcgttttttcccttgtatttaataggttcgcttcattgcataatggcgaagcaggttgcgcgttccttcaaagaacgtttccaccctgtcctggtattgatcgatgaaatcatacaaaaactcgttcgcgcagcccatgcaggcaagcatgttttggaggcagttttgccgactgaacttctttttctgttcaaacagcatggaggagagcaggctataaaattgcaccttgtccacgccgcatgcttcgtcgtagcgcaggtaggtcttaaccaaccggatacgggcctttccgagctcggtgaactctcgctgggatattgtaagcccttcgagcgaaaagatttgcggtagtatagactttataatgcgggcttctatctccgcagaatatggtccgccttttttcatgcggaaaaaaaacaaatccttcccgacagttgcagcgtacacatgcatcaccgcctgaaccatatcgaggcattcacggctcctgtccgagcggataagaatttcgtcccccaggacttcacgtgttacaaaatagatcacaacatcctggatcatctttaatcctttctctttcgcggttaatacacatacagtgtatggtatttatctcaccgagatcgcgcctcgtaaatccgtcagccactgcgtcaaatgtcggatcgagaagtgtccagccatccgtcttcgtgtaaacgctagtccatgcgtgatatatggtttcgtcagatactgtggcatagccgacttccaagcgggcagggatacgctgcgaacgcagcatggcagtcattaacgcggcgtagtccaaacagatgcctttgcccgcggcaagcgttgcgtcaatatccggcatatattcctgaatatctgcgcctacagcttctgttgctttttcagtgtcgtaacgtatgtttttagagatatattcatatacggcatcaattatctctgtttcgcaaccggatttgtttacgatttcggcacattttcccaccgccttgctgtcggtactaaaatcaacatattgattgggatacagaaaggggagaaattcgttttccagttccacgtcaacgctttcaccaagtacgagcacatactgggaatccacaacattttcatatatattgaccgtatagttgccatctccctgtgtgagtggaagcacctcccatttttcggaacggatatcatatgtatatgggccggcgctgtccttgtcaatctgtgcttttacccttttgccgccatcgcattttaccatcaggtatccctgcgacacgtttgacgcatcgacagtaacgttggattcagcatatactgttttgcctgatgcgctcggttccagtacggtgggctcacgtacaacatccgccgttgttcccgcgcatccggacaaagccaacagcgtggcaatgatcacgaggatgatacatcgctttttcaggggaggtatgcacctttttccagatgtggttgcgtctttcaatctattgcagcctttctcataaactttcaatcagcaggataaccctgccctttatgcggttcatcgagtaagtgccatgtgtgcggctgtctacggattcggcgcggttgtcgcccatcacaaagactcttccgggttctatgtccacgtcaaggccgtcgtttgttggaaggcccgcatatttggcatatggctcgttaagcggtaaaccgttcagcgtacatcttccgctactatcaacattaattttatccccacttacgccgatgacgcgcttgattaccacgctatcgtctgtatcatggagcacagccacatcgccgtaatttaagtcggtccgctttatgtacaataccaccgcaccatcttttaaccccggcagcatagaactgccacgtatgatcgcaacgccgcatacaaactggaacaatatgattgctgccaccatcgctgtgagaatcgatattaccgcgcgccggacttcctttttatgctgaaggtcggcctgggcgcactgcgcccggaattcatgtaacctcataaaatccgcatggacggctgcccgttgtcgtctcgttccggcttatgtggctcggaggccatatctatctgcattttttttaactgtatcagcatttgtttgagcatgagctgtacatgctgcttgtgccggtcgatctcctgcgcagccaactttgcttcctctgctgattcttcggcataactgcgaacatcatgccgtatgtcttctatattttgtgtcaattcaaccaccagccgatcatagattgaggattccaaagtctcgatcttttctttgaaacagcgcaacgattcttccagacctgcgtttccaaccagccacgaaaaaaggaatgttaactgtccggcctgcatgttagccagtgccagcaggcgttccgtaattcgttcgcgttcgattgccatgtcgtccagcttggcagttagccttttgtttgagtcacacagatgtgccgtttgcttttttgcggcgcttaactcatcatcgtttccttttaagatcgacgatatgtaccggcgtacatcctgcttgtcgtacccgccaaacacacgggtacgcacatccttcaaatccatactttgcatatctgtcatattccgcaccttatttgtgtaactggacgattcccgaaagttttttttccgccgcttggttttcgccggcaacggtggtattgggatgtccagtggaacccgggtgattctttgacgcctcgcgttcgttttcgcagtttttatccgcccaatccaacactgactttaattcctgcgccaatccctgtatatagcagcctgtttcccgtcgtatacgcgcggcttcagccttggtatcgtccagtttttttctgcatgccagctccgtctcaaccaattggtctgtggcggcccgttcatgcgctttcgcattacattttgcttgttccagcatcctgcggcactcctgttcggtctgctccaattgcttccgtatttccgccttcgcttgcgtaaggcgttccagtcttaaccggtattcctcttccgctttatccttggacgcaagaagcgcaaacagctgcgatatctggcggctttgcgccgcgatcatttccatatattttttttcctgcttaacactttgcgcagcggtttcctttgcttccgccagcaagcgggaagcgttctgctccagcttacccagtttgtctttcaggatgcttgtttcttcttcgttttcttccaggatctccgatatatactgccgtgtttcgtttttatcatatccgccgaataccctggtccgaatattttccagcttcatccgctcggcttgttgcgttagtgtttttcgtttgcttcccatttattttccgcctccgtcttttttcttcctgctgcgataaaacagaaggattacaatggcggcgccggcgattgacgccatgacaatgtatagatatatattcgctacatcacccgtcttagggcccttgcccggattttgcgccgatggcttggatgatggggaaggggacggttggcttttggacagcagtttgacatcaagcccaatattttcctgcaaacgaaatctggggcttcggtattcttcatattccggctcatttatttcgacgacataccaattgtcgtcggaggggaacatcatgactgtgatctcccccttatcatccgtcatatatctgccgtccgatcctgtgacaggtggtatctggacattgatgttggctctgctctgaactttaccggcgttttcctcgcttttttcctcgtccaaaaggatatttacgataataccgggcagatgcttttgtgttccatgttcgcgcaccttgatcgtcaagctgacgcgcggatcatccgggggcgggcttgggtactctgtatatgtttcgataccaaggatcgactccccgcgcgatgtctcatccgaaacggaggggagggcaaatcctgtatatgcggtacacaaaaccaatatagagatagtaagaatacataatatttttttcattgcctatttcacgcctcctacgaattcacggtaatcagcagatgcatgcccgtttcgcctatttctgtgagtgtttcgggatcatatcccgtgaaagtcgccacgcacgcgtattcgcccttaggcaaatctttgtccagcttgatccgttctatataatacccagggtcgagtacgcccgttttcaatatttcctcgccgttgtccatacgtgtgatcgtcactgtaaacgcgtagttgttgcccggcacgttttcgatcatcacattcccttcggattttccgtcctcaaattttgggtgcggattcattccaacattcatcattgattccgctaccttgtggttcagcctgctttcgatctcttcgtcactcatgcctgggagtatccccatctcagccgccagttcgcgctcaagcgtatcttcttccaatacggaactgaatgaattgattatcagcagtgttgcaagcgccgctatgacaaccagaaggattacgatgataaccggcttttttgtttttttattttcagtatcattttttcttgtgccagccatggtttcggattactctacctttcccgccagtgttgcctgtgtcagtccaatttcttccagcgtttcgggatgcagcgcatgaaagaccgcataaccgttatactctcccggcgccagctttatgtccgtcgaggcctcctctatgaagtatccctgcttgatgatgccggaagaatatatctttcgggggccttcattcgttgaaaaaaacacgtccacctgcataaagtaattatttgccggcacattttctatcatgatattaatcttgccgtccaccaccacgggcgtcggattgatcgcaacattaaaacgtcctttgtctataatgcggttcaattcgtcctcgatctcctgttgggaacgtccgggcagaaagccctccaacgcttcgcggtccagctcgaattggctttttgtccgcggccagaaaagccataatgcaaatacgccgccaacagccagtaatacgataaggattacggcaacggctttccggctgccttttttctttcgattcctgtcaggcgcaacgatgacgtttcctggtctatgctggtttttattatcgcctgttctgccgttatcggtgtgttcctgacgatcgaggcttttcctatattccgtcctgcccatatgcttctccttattattgaggtctgtttccgttaagtcggctttaccgggcgccctgttttaagacgcccgccaaagccggctaaaagccggttttggatgcaaggtaaactacggaaccgttgtttcccccacaggttctcctgccgcgttcagcagcgccaacgtgtatttgaccttgaattggggcgtggccgtggctgaatcgctaatgttgtatgcctccggcacagtccccgcgattggaagctcctggcctctccctgttatgtccacgggcctgtattttccaacagacatgtcgtaaaatacggaactcgcggtatggatgttagcaggtacagaggcagtatcgcttgcgcttacgggcggcagcgaaacgccgccgatcgacaggctcatattcctttgtgtggaggcattgttcactgattcaacaatactccaaagcccgccgcttcccacgccgcttatcgacattcctgtgacacagacgggcgctaagctcccatcggacgaataggtgttgttccgtattctgtatccgtgttttggaagcgtgagccctgtttttccagggcctgcgccgtcctttgtcacagccatcgttacgtatagcggcacttccaccgagaggacgcgggggttggctttggaaacggcgactccaacgtcagtctgatgaggcgtatccgccccgatatcgatctgcgggtcgtccgttgccgacgggtccagtattggggacgccgccaccggcaatgcaagcgcaaaagtaagcagcgccaatatccatccggccgttatgacacgcgccatatttttactgttccgtttcacgttactttcccccttcttctctcccggtttcatacgatcagcttactttcttacggtgtgaatccgccggtaccggaatcccatgtgccgaatccggccaggttgctgtcgttaccaacgtacggatctgccactgtcgggtcaccgcctgtgttgaccgccgctaccgtatacttcacccggaactgcgggacagccgaggcctccgccgagacggcggttgccgaaatctctccctcaagcgggacgttgagcgtagcgcccgggagaatgacggcagccttgtctgcatttgcaaagacgcttccggtcaaagtcatcgattgcaggctgccgaggcccgcgccgagacccggtatttcaatattgcctatcgtaagcttcacttgcttaccggtaggcgttccggtgtgagctaccgtagaccagttaccgccggccacagtgccgaattctacgccggtgacgccgagattcgtggctgcactgttgttcttaatgccgtagtttgtggggacgcgcaccgcggtttcgccctgtactgccgccatcgttacatacaggggcacctcaaacgatataagagcggggtcgaccgttgtctcgtaaataccgatggttgtgtggccgttggccgcctgttcttcagcagacggcaccgcgagcgcgggtgctgcgaaagtcaggacaagcattgccaccaggactgccgcaaagagttttttgtgttttttcatagctaaaaatctcctttctttatttaaaagctagctattttgttcatatatatatcagcaaccccaaggggttgttgcttcctttatccgcctattttgagcgtaacggacgcttgcacaacgccggatatttcttctgtctccgggtctaccgctgttgccgtgaccgtggcagggtattctcccgctgccagcgttttatttagcttcaccttcagctcctggccgcccggataaagcatgccgctttcgtaaagcgtttcgcccgtttcatcaagcgtcagcaccgctttcatattaagtttattgtccggaggattttccaaaaacagcgtcccttcgccgccgcccgtttcaaagtacggctccgcgttaactttcaaccgaaaaagcgcgttgtcagtttcattttgcagccgtgcggcaatctgccccgggtctgccacggcgccctcctttgcgtctttgtcgaaggggaccgccgccagccaccagaccagcagcacggaggcggatacggcagccagtaccgcgacggcggcaatgatccaccgtcttcgccttttcccgcgccgtggccgcactactaatttaataccggagttgtccataggcatatctcctctttatggtcccacctgactgaaacggtagccaagggcgcatgtgctccagtctgaggtatctgttatattgatatggtcgtacagcgcgtcgaatgtgaacccaatacgctgttttgcttctcctactggtggggccagtacgcccaggtgtactctgtccgcttggctgatgcctaccaccggccgcggcgtccacaccgttgcgcctgccggcttcacacgaagattgatctcatcgttggcaaaaccgctggtcttgtcgaccagcttaagcggccccgtgcccgccgtataagaaaccatttctatcgacagtgtaatcgacgagttattggtgatatagcaggtcggcgcaaccagcctgtttgtcattccatcgtataggtgccctttgagggccaccgtacttaccttgagcggcactgtaacgtcgatgaccctgtccgccattggtatgctcagccgtttggcgttgccgagcgagtcctgtacgtacacatacagcacatccgtgctcgtaaagctgccggccgccagcgatattttggcagtatatgacgcatagttgtccacgcccgtcacgtctgttacgcccaacaggggaacaggagccgttttcatgtccggcagtatacccgccgcgtcgttttccgtaaagctccagccgatctgcctgacgccgtggccctggtagttgatgctgaacggcacgcccgcgggcctgctgggaggacggaaatcgctgactttgatgttgacgaccgtggaaccgtccggctcgcgtgataccgatatatccgaatccggcgtatgtaccggcccgtgaagatccaatatgtccgtctttactcttccgtccgcgttgcgtacatggatgaaataatactgtgggtctacaagggcaggcggaacaatatccatcgtcgcggttcccgtccatgtatgttcttccgcgcccgagcctgcggtgagcgtcatttccgtatcgcccacagggacagttccgccgccagaccaggcaacgtcgggcgcccaatctgtggaaatatatgcggaaacaatgtccgcgcccggcgtcccgccgtctacgcgcgcgtcgaacagcagcgtgatctccttgttgacgcccacagggctgcccggcgtttccgccgcgcttgtgttgcgtacgcttatctgctccatgttcaaatcacccgtgcggcccagcgcgatcgcgttgccatccttgacgtatacctcaaatccggaataatccgacgcgtactgcgcgggctgtgcgttcgcgggtgtgtggaacacgagtatttcatcgcccgaagcggggggcgcttccgcaatcagccccagcacaagctggatcaggtttccgccgtctgcgccgctgctattgaggttgtcaaccgtcatcggctgcgaccccgccgccgtcttcctcacgtggaagtggctgcggtctccgcccgctatgccgtccgtcgcaatattgcccacattgcgcgcgtccgccgcgccgttgttaaggtcgaataccgagttgtttgtgatgcgcagcgtacctgtgcgcgttccggaagtcgcgcccggatcgctgtcgaggtttcctgttacagtcaaattcgtaatgccctcgctgccgacatgcagcaggtcgaagtatatgatatcctgcgcgttcggctgcacgccgccctggttggacttgaagtatatattttttgtcccgatgacgcatgtgcccgcattcggctcgcccggcctgccgcctgcgcttaccgtcttgtagcggttgaaggcattcatgttgatatccacgttgccgcccacgctgccggttccatatacgccgtacacgttcagcttaacgctgccgcccagcggtccggacgccgcttcactcaggctcatattcagcgttgcgttgccgatcaccgttccgttgtccgcgccggcaatgctcacgtcgcctgctacgctgcttcctgccaccacagtaacgaccgcattgcctacgctgcctgtttcgccgccgccgactactttgccgcccgttgccgcgcggtatttaccgccgaatacattgacgacggccgtacctgtaacatctgccgcccggccgccgccgtatccgccgtcaagctcggtatccatgccgatcaccgttaccgtcgtgctgccggtaacagttgctccggcttcatcgccgccgccgtataccatgccgtactgccccgcgtaaaacgtcaggctgggatttgccgtgagaggcgtgcttttgctgccgccaaatataacaggagagttggctttgtccttcagcacgatccccttgctgcccggctccgccgtgccaaacgacaccggatgcccattggcatagaccttgccgcccggcgctgcgtaatccatctggatgttgtcgaacacatattctgtggtcgaagaagctgggaacaattccaggtcgccgcccaccttcacccatttgcttccgctggtgaatgtgatccgcgctgcgttgccgccctgcgtggccaccgccaggccgtccgcgggagtcaccacgtaattgtccagtaccacggtcacgcggtattcgccgccgcccgtaccgatcgcggtcattgcgtccgctatgctgccgtacgagaccggcgcgccccacacgtctcccgtttttgtttccaccgtcgccgcataccccaggtgcaggtaggaaaccgccttgttcgttccggccacggcctccactgcgttctgcttgagtacgggaatcgacagcgcggaaccgtcgtatttttccggatccgccagcactgccgcgtttgcgcccgtataccgcaccaggcggtcgccgctcgccggtgttacgcccgaagggtattccagccgcagcacgccgtcgccgccgttggcaaggctgcccgagatatccagcggcgcacccgtgccgtcaccccattggggaagtaccagcttgttgcccgtaccgttcaccacgagcctgcccgcgacgtttgtctccgctcccgtatccagctccagcgcagcgttgccggcaaacgttacaacacccgtaggctgcgtccttgccgcggggttgtcgcccggcccctgcagcgcgcccgacaccgacaatgtgctgcccgccgcgatattcagagcgtcgaagttcatgacgtttgccgtcataacgtcggtgttgatattcactgttacaggggagagaaaagcagggtcggcgtagccgctcacagtcagcaccatgccgccgttgatgttcaggtcggcggcgccgaggcttccgcgcgcaaaagtaccgctcagcacgtagacaattccgccgtccacgttcaccgtggtacgggatgcgccgtcgtcgccctcgagcgaaccgcccacgaccgcgccccaactgctgtctttgattgtgatcgtattttcaaaagccgttccgtcgttcaccttcatgcctccgtatatggagtgcgggaacggcgggggataatcgtatgaaacgcccgtccctgccgtgagcggcgtgccctgcgcgatgatgtctttgtacgtggcctgaccggcaggcaggctccaaacgatatccgcgatctcaaattccgtttttgccgcgacaagcctttggtcgggcaggcgcatatctatggtggataaaaacttgaacgtacgcgccagtgcgtccggcttaccggtgatctttatccgcgtcacgttgagaccggccgtgcccgtcagactgcttagcacagcgtcgtcgtccggtgtgtaggtgtaatcctttaagagcgcggttttatactcgccgggctggttatccgcctggataaagataaatgcgttcgccagactgttatgaatcgtctttgcgccgcccggtgcggtcacctcgatctgctcttcgcccagcctgatatatccgttatccttatatagcatccagttcgcgtcaaacccactgatataatccgaaaccttcgcgttgtcggcagtgtggaactccaacaggggatcgccgttcttcagcacggcgcccgcctggtgatagtatacgagcagcttgccgccgccgctgatgggctgcgtaccctttacgacaaacggcgttttgagcgtcggatagatgcccgtcggctgtgcgacgcccaggcggttgccgttaccgtgcacctccagcctgttggtggacgcaaagcaattttggttcagcagcagggtggcgttcccgccggctgtgccatcctcccttaacccgaacgtgaccgcgttgtcgaccattccccgttcgatgccccagtcggtcaggagcgttctcacggtcaaagtctggttctcatagatattcagcgcactaaagccttctacagtgccgacgctgaccgattcctttatgttgatgaccgcagaactgttaataaaggaaagggcatctgcagaagcgacatcaaggccgcgcaaggagttcattccgtctccgccggatacattgatctctattcgcgcgccgtcggtgttttctccgctgtttgcagacacaattcctacggtaccgccgttgacgtcgagcgttacggcgctgcgcaatataacagacgtactagtaccgcacaccctggttacggaccccccgttgattacggccttaaaatgcgaatctgccgctgtggaaagatcagacgtaccgttgttggctgatcctgccgttatatcgccgatgtttccgccgttgactgttacgtccgtttcatacgcggtccccggttccgtcggaaacccgccgaaaatattgaaccgcgacgtggggttaaaccccgcaccgaatacgacaggggtagcctgcgcgtaaagctcgttggcctgcataataatatcgtcaaacaaaattcccgtcttgcttgcctggggcagtgcgcgctggtcgggcaagcgcatttgtatgctgctgttcagacgatacacagggccgtcggcgtccggcttaccggtaatctttatccgtgtcacgttgagaccagccgtgcccgtcagatcggctagcccggaattgtccgacccagtaaaggtgtaattcgccaggagcgcggctgtatactcgccgggctggttatcctctttgataaaacgggtcacatcccacacgctgctgcggaatgacttcgtgccgtccggcgccgttacctcgaagttctttggcatcagtttgatatcattatgggatgaagccagtacaaactccgcgccaaaaccgttgatgaaatcacttatcttcacatcttccgatctactgtatctcacaacatagtcgcctaccgcgggcgtacccgtggaatattccagcgtcagcttacccgtgccgtctaccggcgcatcattaaacagataaatatatcttcccttatgtaactgcagcgcattgcctgttccgtccaccgtaagcgaaccaacaaacagagtatttgttgatgtatgccgcagtgtactgttgccgttgaacctgatcttgccttcgacagtcgttcttagtttcctgtaatccaccgcatcggccactgtcagaccgacatccgcagcgatattcagttcgtcaaacgcataaaccctcgacacagtaacgtttgccattacattgatttcactcctgcccaggttgcccacgacagcttccccttgcagcgtttggatggagccgccgtttatattgacaacgctcgtgctggcctcagtggtccttatctgttgtccgccggctgtcaccatgttaaacgtccccgcgttgatcgtaacgctgcaatgcatcgtctttgccccataaaggttttgatatccgccatacacgttgttttggtcggagtttgtcgtatatgcgaaaccggcgtcaaacaccattggcgtgccttgtccgtagaaggttctaggttccgtttggatgtttcggaacacaaattccgttttgccgcttgtacggtcgatctggtcgggcaggcacatggcaaccgcgcccgtcagcgtgtggtcggcaagcgtgatccgcgtcacgttgagcggagcttcgcccgctgcgccggccatggctttaagcgtattgttgtcttgttccgtataggcgtaatccttcattaatttgaccgtgtattcgcccgcctggttgtccgttttgataaagctgagcgcatccgccattgtttcatatagcgtctctacgttgcccggcgcggttacctcgatgttccttggcaccaaccggatggatccgtccactgcggacagtataaagccctgtcctctgaagccgttgatatagtccgaaattttcgcgtttgcggccgtattgaaggacagcactctgtcgtcggtcgcaggcgtggctcccgagtattccagccgcagcttgcccgtgccgctcaccggtgctgtactgttcaggatcatagtggcgcccctgtgcaactgcagggcgttgttttcgccgtccgctataaatgtgcctgcaaccgggctgttcgcccctgtaaacctgagcgtactgccgccgttgaatttgaccacgcccgccgcgccggttttacccgacgtggagtttataacagcgctcatcgacaactgcctgcccgcggcgatgttcagctcgtcgaacgaatggatatttgccgccgttgcccaatctgtgtttatgttgatcacgccccggcccgcgctttggttcgcaccgcgcaaatcatgcgtgacagagccgccgtttatcgtaacggtcgcggtgctggccgccccgtccgtgcccgcggcgctgccgccgtatacatcataaaatacgcccgcattgatggtgacgctgccgttcatcgtcgagccggagccgttgttgctgtatccgccgtacacgtacaggtcgcccacggtccgcacaaatccggcgtcgaacaccacaggcgtaccctgcgcagagatgcgcctgccctccattttcaggtttgtaaacacgaactgcgttttgtccgcctgcggccgcgcgctctggttgggcagggctatgcctaccgtgcctgtcagcgcgtagacgccgccggccggatccggcttgccggtgaagctgacagtcgatgcgttcaggtcgctcctgacgcccaggagcgcgttcgcgtcgtcgctcgtgagggcatagtctttgagcagggcgatctcataggcgcccggcttattttccacagaaatatgggcggcggctttcgccatagtgaggaatttcttttccgtctttccccccgcgggcgccgtgtgcgtcacgcgtaccctcggcccgcgcaggtacagtatcctgccgctatcctccaggctggggagtaagttggcgtcgaaattaacgatgaactgttccgcactgatggcggtaccgccggcgcttcgcaatattatgtcgccgtcgctccccgtgccgccgttggagtatggccctatcgtgagcttgttgccgtctgttgagatagggctggtgtcttcgatcttgacgggcgaatttttcgcgcaccgcagcctgttgcccgcgcccctgatttccatactcgtgaccaaaagcccgctttccgcgcccgagggcttggaaaccgtgctcataagcatgctgttgccgttgaagcgaagcttggcgtacgtcgcgcccgcgcctcccttgccatcgatgccgcccgtcaccgtcagcgttcggcccgccgcgatattcaggaggtcaaagcgcttgatcgtgccggccgatacgttgccggtgatgttgacattgagcgccctattatggagcgtcccgcccggatagttccccaatacggataccgcgccgaccgtcccgcccgaaaggttgatgtttgtagcaacggaataggtcgacaaatccgtgtttcttgttccctgcaaagtggttacgttaccgcccgatatatccaccgttacatcgccgagcgcctttccgactcttgtcccaccgccatagagcgtatcgacagagccgccctccaccttcacatacagcggcgagttcgcggtcgtatcgtatatggccgcttcaggacaactgccgcttacaattgcgtagttacccgacttgatggtgacgtttgtgctgagctgcctgttaaaagcgccgcctttcgtgctgccgtaaacactgcacttgcctgacgtcaccgttacgccggcgcccatcacgatcggcgaattgttcgcgtaaaatgtccgcgggtctgtttggatgttttggaaagtatattttgttgcgccggagggccagttttccggcaggttgatctccaccgtgcctttgagggcatacctggaatagctggtgaccacgacttcagacgcggcgagcgcgcccacgcccttgaatacggcgtcgtccgcagccgtataagtataatctttcagcagctcgaccgcgtatgtgccggctttattatctgttttaatgtagctgaaggcatccgccatcgtagcgtagttgccctgcacggctccgttcaggctcacacggaccgcggtgccggagcgcgcggatctcatcatcatggcggaatcctgctccgcaatgcgcggcagccgccgtacaaaattgaagcccgcaccctgcgcaggcgatatgaccacattgttggcggacgacgattcgtgcgccgccatcactgttccgtccgcggctttccccacaaccactcctacatggttggtatccgttccatttggcgcatggaaaaaaacgaggtcgccggggagcgcatcctcccacgcaatctcatatgtattgttccattgatcggccgttgaccagccgacgccggttataaaagcgtcgtcatttgacccgaacgcgtttatcatggtccacagcgtaaacccgctgcaatccaggccgtaagcgcgcgtagttcccgtctggtcactgccggggctgcccacaatggcgtcgtttttccaacgcgcgtcccagcctatggctgtggatttgccgccccaaaagtacggcacttttcctgcgagggaatatgctttttccacaacggcgcgccgaatattcgtcgtgccgtcctctcctatgtattgtccaatttcatttgcctgtgcttcggtcagtaccagatccgcgtcgctgcccatggccatgatctcaccaagaaaaacagccggctggtcatacacagtcggcgttggttcgggggaaatctcgggcgagggcgttgcgctggccgagggggaaggcgagggctctgcacccgtagacgccgaaggtgatggggaaacgcttcctgttggcgagggctccacacccgtggatgccgaaggtaatggggaaacgccttccgtcggtaagggcgagctgggcgaactccctgttgtagtgggggcgggcatcggcgattctgccggttcaggctgcggcgtttcttcgggcgcgggttccgccggggcatccggaagatcgccggtaaccggcgcttcttccgcagggggggcaatggcgccctccggggagacacctccttccgtatttgccaatacgcttcccatactgattaccgtaatcaatagaaacactacgatcacgacaggccatatacgtgttcttttccgtttcatacgctcattccttttatatccgaatttgtgtaacatcctggaatgttaacttgagtgttgtaatagcaattcaatgcagggttatccgtcctgaaaatctttccatccccctgatttatactgtttcgcgctatatttatggtatcttgaagctgtgtgctttttttcgtacaaaacgggataatcccgcccacggctttcgcagtatatcccatactgagctatctattcagttttcgcgcagccatgcgggtttcagcgcccatggctgaccatttttgacggcttatgcgacttggctgtcctcctcccacatctgcaaccgcccgatgcattcccgtttatgcgccagtgtacagtgcgcgtaaaatcggtaagtcacctccggcgaactgtgcccgagcaactcgctcaacacctcgcatccaatttgctgttcaaggcagcgggtagcgaacgtatgcctcagcgtgtgcatgtgcgcgcctttgatacccagtctggcggccatgcatgaaaactgctgctgcatggtgcgcggatccatatgcccacgctttccggcgaacacgaatacgctttccgacctttcaaaatgcgcaagcagcagccgcatcacaaaaacagggacggggatatcccgaaccgaacattcacttttgggcgggctgagtaaaacaaccgttttgttacccggctgcctgcggtaaacccggcttaatgtatggcgcacatatatgatgttgtgctcaaaatcaacatcctcccatttaagcgcgcaaagctcgcccagccgtaagcccgtatacaaagccacgatatattcaattttcccagtgcgcatacaatcgtgctcgatgcgtttctgctcgcccggcaacaggaagcgcggttttttcctttgccgcgcgaggcatttcatgtcctcgaacggggattccgcgatcagtttctttttgcgcgctgctgcaaacgccgcttttagtatgcggcacacgctttgtgccgtgccctgcgcaacacgctgctccagcttttccatgaatctcacgatatcttcctttgtgatgccgtatatggaatattctcccaacaagggaaggatatgcgtgttgattttctgcaaatagctgtcgtaggtcgtgttcctgatatcaggccggatcatttcattcagccaatagtccagccagtcggcaagcgtaccgcgccggtacgccagcacaggctgcggattttcggaaagctgcgccttgattaccaccagccggcgcttgacctcgcggtatttcgttccgtaaatcgatccgaacagcgctttgccattttcttttctccctttgatataccggccctcccaccggccgtctttacgtaagtatatattttctcctcgtttcgccataagtcgccctccaagcgtatattgttattctatgcctgcccctgtcgcgcagaatatgacggcttgtttgacggcttattccgaaacccttttgtttcgccgttttttacaagccttctgttctgtgcttttttcgcgcttataacgccgccggtcagaaagtctctgaacatgtctattgacaggcttttcgtacagtgttatcattaaaaaaacaatacgaatagatacgtacttgatgataatataagttttctcagtatgggatatactgcgaagatttttttcaatttattcacgtaatattcaatttcaagacatttattaaagttcatgccgaaaattcgaaatgacaaacgcagaaggcgcctggacgttgtttgagatgcctgtatttatcttattgataatgtatattaaatggaaaagaagtgatttgtgtgcaaacccaaacagaaccgcgggccccgcgtattgaaaaacatttcctgttactgattgccggaatcgtgtggtgcttcgcgggaagcatgattttatccattggactgccagcatacgcaaaaagccggcctttcccctggtacggaccggtgttgtcggccgtcatattcggcctgttctttttcctgatctttgtccgtatgttccgccgtcacagggcgcgtatattgggatataaaaaagaacgcgtatgtgtattcgcgttctttgacgttaaaagctggatcatcatggcctgcatgatcactgtcggtattctgctgcgttcctccggcctgctgaacccattttggctggggacggtctacaccggtatcggcagcgcgcttgcaggcgcgggaatctgttttctggtttcctttttctcaacgcttccgttgaaatgagacaggcgcatggcgtcagcttgcgctgcggatcgcttcaagcgggctcatctttgtcgctttgcgcgcgggatagagcccggacagtatgcctacgccgccggatatgccggccgctcccagcgccagccaccacgggatgaccagcttcatgccgttctggaaatacatcccgaggaagttcatctccccgcctccaaagtttgtgaaagcgctgaggatatagctgatgccgaggccgatcatcccgcctatgagaccgatcatggcggattccaccaggaacatcaggttgattttgctgatgccgagaccaattaccttcatgacgccgatctcgcggctgcgttctaaaatactggccagcatggtattggcgattccaatggccgataccagcagggaaatcaatccgattgccacgagctgggactgctgcctctcctgttcctgctgcatctgcttgatccattcggtcgggctgtaggcctgcaggcccaattgcttgacttcttttagtaccgattccacagaatccacatcaacggcgttgacatacccctgtgagtattcgccttcctttacgccctggttcgccatcatctggcggttttcgcgtatcagcttttgcgcggcctgaaggctcatatatatattgtagctttgttcgctgtccgctttttccaacacgcctgaaattgtaccgcggtattcctttggctttggttcatcaggctttgcagggtcggtattttcgatcgagcttgcgttacccggataatattttacgatggagcccgtccatttgatatccggcccctgcatttcctgctcgccctcgacgccggccatcatgcctcccatacccatatcatacatatcaccgcccgcgccggcgctgctttgctttcgtggatcgataaaactctgccgggcgttcgcgccgaccacaagctctatttcagggctttcggagaaaaccttgccttccataaatttaaagcccatggccgacggatccaccgcgattacagaggtatccgctttataacggtcgagcaaaatataggagggaatattgattacgccggttgcgttttttacgccggggagggcgcggagctgcgcgaggcgggaatccgtcagcttagcctgctcgcccgaccccctgggggatatcgtgatctgtgtcagattgttgctctgcatgatgctttccttgaactgctccaggtttccaagacccagcgccaccatgagcacgatgcacgacgtgccgatgataacccccagtacggtcaggaatgttcgcattttacgccgccacaggttggacgcggcgagcgccacaatatcaattaatgtcatcgtccataccctccgacaattccgcggcgcgtcgtgatttttttcttacccgaatagtaacggccgctatgatggcggcagcgccgcccgcaacagcgatccatacccatggcggcagcgtttggggcgcttcgggttcttcctccatcggcatttcctgattattagcgggggcggagaccagctctgtctgggcagggaccttcatttcatactgctttccatactcgtcctcatatgtgacgaccaggttccccttgaccggccccggtttcgctgttcccgccgctgacacgggtgttgctgccggtgttggcgcaggcgccgcttccgcttcgccgctctcgccgggcatgctttcttccggaaaacctcctgtcggagcgttcgcgtccgccgcgacagacacgtaaatatccgctgtttttgccgcacccgaatccatattccctatatatgcgcttgtgtcgggtttgagcccgggaatgtccagcgcgacagatacgttatacaacataccctttcctttattgatcaggctcaggctgacggtgcccgtatcgcccatattcatctgtgcggggattttgggcggctcatgctccagccggatctgctggtgtatatctacgctgatctcgtcggccgctgtaagctgtgttgctttgttgtcctcaaacgcgatggcgagatcgattttctgcgggcctgcctttgcgtccggacgcgcggtcattttgaagctgaaatccgccgtcttctccggcccgattttgtcaacaaacgcggaatttgtgttgccggaagacatcaggtcggtcgtctggcttttgaaggtcaccatgatatttttcatcgtcttggatttgctggtgtttttcagcgtagcgttgacggtgaactcatcgcctgcattgacggtctgcggcgagatggaataatggctgatcatgatcttgggctgtgagcttggtttttcgaccggtatcggcgtgggcgtgggttcaggcgtgggcgcaggaacatcgctgatcgtcacatacacggtaaaatcctgcgttgcggccgtaccgtccgccagcgtataattcgtacggatcacgacagggtatgttccgttctgcctgcttggattcagcctgaacgaatattcaacaaggtaggcgtccatggcgccgcctgccacattatgtttttgcagggaaaccgttttatcgaagttttccacgacaaacggggatgcggaagtatcgccgggggtgatcgtggcacggatcgtgcttccctgtatattgaaaccgggcagcggaacaagcggcagaacaacgcttaatcctccgttggccacggcaggcaggtagccgtcgttgtacgacttatccattttgggcgtgccgtctgggttcaggtactggtgtgtgttgtcgatctgcagcgccgtgatactactttctcccggcgtgctgcttggagccggttctgcgggcgccgcgcttgcagttcccgctccctcctgcgccgcaaggacgggcgcgccgatacagctaaacgcaacaatcaggatacacgcgagaatcaaatatctttttttcatgtcaattttctccttgtactttttcggtttcatcaattccaggcctgttcgtttcccgtttcgctactttgccgtcgatgacgtggatgacctggtcggcatactccgctttggatggatcgtgcgttacaaaaagcagcgtcgcgccgcgttttcgcgcagtgtcgcatatcaggtccatgatctgcacggatgtcgcggagtccaggttgccggtgggttcgtccgcgaaaatgatttcaggctgcacaacgattgcgcgggcaatggatacccgctgctgctgcccgcccgagagctgtttaggaaggtttttcagatgctgcttcagccccatttggacgagcaggtcttttgcaaccttcatgcgcttgccgcgcggcacgccgcggaacatcagcggaagggccacattttccacggcgctcataatgggcatcaggttgaacgactggaatacaaaaccgatatgccgcagccgaaagtcaaccaactccttttcgttcattttgtaggtgggctggtttttgataaatatctttccggatgtagggtgctccaaccccgcaagcagggacagcagcgttgatttcccgctgcccgatgtgccgagtatcgcgcagacctcgccgggcatcacgtcgatatccacgccgtccaacgcgtggatcttcgtatcgcccatctggtaatattttttcaggttgcgtgccgcgataattggtttcatggtttcctcccgtttcttttgcataatgcttgttttatttccacagcatagcaatcaaacagtgaagaaatgccatatatatttcttaagaaatatgaagaagtctatggatcagacaaaagctgttattcatataccgttgcattgagatgttattatatgagatggatgaggcaggaaaaagtttattgtgcctatttgccagtatataggtagcgatggcttgatcttggagccggaaaggaggatatattgcacatgcagtgaatagcataaccgcgactatcaccatcgcaatcagtttcagtaccgtttttttaatcctatctgtctcctttccagtttccgccgccctttggcagcataggtactatggttaggataacaaaccctatgtccgattcttgttagttttatagcggtcataggagctcttcataatctatatcggcatttcatttcagagcaggatatcaatatattgcttctcaatcctcattatgattctgtccatgcttatcccccctggataagcctttgctgacaaaaagcttaaaatatattacaatggagaatagtttttgaaagaaagaggctgccatgtacacaattactgaagtcggcgggatgcccggcggcgaggctttcctgcttgtaacggaatacaaaaccgcgctgatcgattccggattttcgttccatgcgccacaaatggtccgccgtatcaaacaaatcctaggcggaaggcccctcgattatgtactgctgacgcattcccactatgaccatgcttccggaagcgcttacttgcgcgatgaatggagcgatattgtcatcaccggaagcgcccatgcaaggcaaatactggaaaaaccctctgcacgctcgttcatacgcgagatgaacaacaatgccgcgctatgctgtggcataaaagaatatcctgataaaacggatagcttacatatcgaccgtatagtgagcgagggtagcgtcatcgatcttggctccataacgctgcgcgtgatcgaaacgcccgggcataccaaatgttcggtatcgttttacagtaaagaagcaggtctccttattgcaagtgaaacgctggggatccctgttgcagggcgcgtgatgccctgttatatggtaggatatcagatgacgatggactccatcagaagatccgccgcacttgctccgcaaaaaatactgatcccgcatattgggatcatcggcgatgaaacatgtgcgcacttttttgaaagcagtctttattggcacgaagaaatgatgcggcgtatcgtaggcgggcacatagacggcaaaaccacagagcaactctcgcaggaatttacagacctcttttatgttgacaacgtggtcaggatacagcccgaaaaagcatttttactgaatttaagctatacagttcccatgctgatcaatgagatggcaaaacaaaaaaccggcgcgccgtccgaaatactataatgacagctttctcagctttccatattgtttgtcaatatcccgatggccggtcacatgctcaaactcgatttcatagcttttatccgtttcgcggataacggtcccgtttccaaaaacagggtgcgtcacgcgatctccggccttaagcgccatttccggagtatatagcctgcgctcaaggttgcctatataagttttcgcctgggcaaggaattccccgtcgggtattccgtcgacctcgagtttggcaaaatccacattgaaaataaagcgcgaaggataacggtagctgctgtcgttgttgcgcccctcggcgtccacgataaaaagactgtccttcgcacgcgtaaacgccacatagcacagcctgcgttcctcttccatttcctgcctgctgcggacacggccggacggaaatatcccttcattgaggctcgccacaaagacataagggtattccagcccctttgcggtatgcacggtcatcagcttaacgctttcccgtttttcgacgatatccagatttgtaaacaacgaaatcttaccaaggtaatcccccagcgatactttttcccctgctgtggattcatattgctggatcgcgtttttcagttcgctcacattgtcgatgcggttttgatccgcgttcttcatcagcatttcttcgtatccggattcccgcaggatcccgtccgcaaaatccgaaacgctcatcgtatctaaaagctgtgcatatttctcaatgacctctacataacgccgggccttcgtatttttgatcttctcatgttccagattgtcttttagcgcgtcatatagcttcatgttattattttccgcatattccgtgaggaaattgagacgcgtccgcccgatttcacgccgcggcgtattgatcgtgcgcagaaaagcaatatcatcgaacgccagtggcatacgcaaatagcaaagaacgtccttgatttccttcctgttgtaaaattccacaccgttgaacagcgaatacgggatatcttcttttacgaacgcttcctcgaggcttctggacacataatgcgcgcggtacaaaaccgcaatatggtacggctttaccccgctttccatgaggaatttgatcgttcgcgcgacataggccgcttcttccacggtggatttcgtatgcttataatagaccttcgcgccgtcttccttaacggcggacagcacgttttgcaggcgctgcgtatttttagagatcaggtcgttgctcacacccaaaatctggggcgtggaacggtagttcgtactcaaataaatcgtcttcgcctgcggaaacacgcggtcaaaatcaaggatgatatggacgtcggcgccgcgccaggagtagatcgtctgatccggatctcccaccacgaacaggttgccgtaccccttcgaaagcatatacaccaactgcgcctgtttcccgtccacatcctggaattcgtccacctgtatatactgcagccgttgctgccacttttgcaggacgtcctcataatgcgtgaacaggtacagcgtatagtttatgatgtcgtcaaaatcgagcatgaaattgcggcgctgcttcttaacatacttccccaatatccggtccttgtcgtcccgtgtaaagctcctgaaatatgcaatcgccttttgttcgtccggctccgtcacctgcccgacatactcaaagggcgccttgaaaccgtcgatcaccttgagcatgtcgcggaacgtataatcgcgcaggtttaatccaagctcatggtatatctcttccagcaggcttttctggtccgtttcgtccatgatcgaaaaagactgcggataattcagcctgtggatatcttccttgagcacctggaggcagaacccgtgaaaggtactgatgaaccccgtgtctacgtccccgagcatcctgcggatacggcttttcatttcgcccgccgctttgttggtaaaggtgaccgacatgatctttcccggcgacacgcccagctcttccaccaaatatacgtaacgcgaagtaagcgtccttgttttaccgcttccggctcccgcaatgacgcgcacatacccctcggtcgcctgcacggcttccctttgatggtcgtttaattgttcaagtattcccgacacaataaaaactctcgatcgttttctttttattatatcatcgatacaagccaaaatgtgttaagagttggcaactttccaaaatgtgcgcttattttatgatgactccccttgcttttgttccgctttcaagtcgaccaccggcgctatttttaactttttgggcatgacagtatatactccggcaacgatcaccaaaaaactgaagaacagttttttgacctgccatttttccatttccctgaacttcatatctcccccaccttttggcataaaaataaccgattcgtattcattggttacttttattttcaaaaaataatataatacaaggtttatttggtatacattggtattactgttatatagtttattcatgaaacagccaaaagtcaacaatctttccgttatcgcggctttcctttcaatccatttgcaaaataaccttttcctgtttataatggataccattatggaaatgaaaacagtacaaaaaaacggcgtggagatcgccgtcataaaaagtgaagatgtcctggtctttgatactccctctgcgcttgacttaatcgctgccgtcaagtacgagacaggctgcgaacgcatcgcccttgcaaagcccctgctgcacgaggattttttccgcttaagtaacggcctcgcaggggatatcctccagaaatttatcaattaccatgtcaaattttctgtatatggggatttctccgcttacacaagcaaaccgcttcaggactttatgtatgagagcaacaacggaaaggatattttcttcgctaaagacgaaggcgacgccatcgatcgtttgagccgtaccggctgctaaaagaaaggggtaccttatggctgttgtatcgattattataagtatatttgcactgatcgcgagttttgtccttggcttccctctaagcctgattatcgggccgtatgtagggatcgggatcggcgttgtcggccttgtattcgcccttctttcacgaaggaagcaaaaatccaatgtgataaatgccgccctcataatcagcatcatcgtgcttgcgatttgtgctgtccgcatcatttcctttgtctcactcgcgggaaatgtggcgggatggatcgccggtgcctttcaataatttatccctgcaataaaaacagtaagtttttttagcctgtcaaaatagttttacccgccggaaaaatgcatcgttactaaattttaccaacctcacctgcataaaaatcagccaattggccgcccaagttttctaaaggcatatacgaatctataaaatgtgtattgagccttatctatccaattgcaaaattgatgaggcgtactcgacaaattgaaagtggaaagaagcggtatatggcaaccagaacaaaaatataaatttcagatgatgttgggcttcgtaaaatattagacgatgaatatgagaaatcttctcaaataaagttatgtaaatatactctttcgttggcaacgcatatcttaacaacaatcggatacgattgttgttgaatgatattaatgcggttagacaggaaagattatggcaaatagcacagctaaaaagtatagaagataccgttgtccagacttcctgtttattgggatgatttggtacgctttagacgagcataaaaacgcctcatccacagggtccatctgcctcttgcggtttcggggaaggcggggtataaccaagcaggccgtacagggccttttggactgccctatttcctattttagcaataaaaaatccccgccttatctgcggggaagttttatcgtttcatcagcgatcatatccgtatttgaaaactttgttgtcttttaccatcacagctttttggacatttttgctggctatcagccgattaaactccttgtctgtgatgaccttcgagacttttttttctttcatgttcatcacactcctttactttttacctattttaaaataaaccattttttaccattttaaacagcctgcggttgagaaaacaagatccggtttatattataacgaccccaaaggagaagaatattatgatcacagccaaagcattgaaggaaaaaggcggtattttaaaccggccgtatgcccttacccgctaaagacgcacggcagcaagcacctttccgccgatatactctgtttcctgcagcgaatacctttgatcacaaggtatggcaagcatatgtcctgcaatatcttcgcatacgccgcatacgccccgcgcttcgtcctgcaaaggccatatgaccggacaataaatgttgctgcgcgcaaggtattgctgtgcggctttttggtttttagccatcaccggaaaaaacaaaggcccttcccgcacttccggcagcaacgagtggccgtgcaatatgcggaataaaacctctgcattttgctttctttgcgcttccacttcggtaaaatcaatggttttcagtaaccgtgcggacggttcgctcatttctatcatgcggttctttttactgagcgcctgctccgcttcttccaacaggcgaacaaatctttcttttgtttccggccttgcatcctttaaataagcgctttttaaatccatcgcctgttttttcatctcatagtaccctctgtcgtatgcgtcatatgcaaaggggatcggcttttgggggatcaacagtccgccatcaggaagcgaagcccatttgcgtacgctgaacaacatataatcggccgaaaaacgcgcgcccatcgcgcgcctcaagctatgcgtccggtcatcgagcgtaagaagccccggcttctccttctttttgcctgcaaaatacgttcttcgttcctgccgtgttttttcagtcgaaatcccaaaataatccatataaagaatgatatcgccatcctgtaggtgggcgtctaaaaaatcatagttgatcgtaaaatcttcggttagcggataataaacgactttgatcccattctgcaaaaacggggccgtcatggaagcacagctaagtgcaggaataaagacccttgtatgcgcgggataaagcttttttgccagcatgcgcagcgcatcgcgtcccgatcgaaacaaacaggcttcttcccagaactggttttcgcctgtttttttgattacacttttattcgcttgcgtatcgatgtcgcttccgaattctatatgcaaaatatactccccaggatcagcaatcttttttttcatccgtctcatcgataatgaatgccggacggcggcgcgccgcgtcaaacgtacgccacaaatattctcccaatattcccatggcgatcatcacgattcccaggacaagcaccagcaggaatgcaagcacgatatacggctgcaccgttatgcccgcaagcgcgaggatgagcaatacgatcccccaggcagcggcggctaagaagcttaccgcacccacggcaaggatgcaccggatgggaaaataagaaaaccccaacagggaatccatcgtcattttaatctttttggaaagcgtccagcccgattttccgatctcccgcttttggcgcacataatatacgtttgccgttttaaatccgctccacaaaataagttccgtgatgggagcattgttctcgttcatattcacaatcaggtcaatgatctgacggtcgatcaaaaacgaatccaacccgcctttgggcatatttttgagcgcaaacctgcgcaccgtatttgtataaagggaagaaagcgctttttgccctgccggatcttcacggtcggtgcggaccgccaggacgaccttgttgccctcctcatacttttcgaacatttccaggatcatttccgatggttcctgcaaatcagcagctttcctgaccgcgcagtcgccgccgcaaaccgaaagccctgccaaaagcgccgcatgctccccaaaattccgtgaaagcctgaccgtccttattttatcgtcaagccgctttaattcctgcatcacccgaaaggaaccgtcccctgagccatcgtccacaaaaataatttcataatcgcatggaagcttgaagagcgccttttccttcaggtcttcatagagcggccggagattctgttcattgtaataaaccggtatgataattgataactttttcataaaggacacattttcccctttttcagatacactactgatatcccgttgcttttcattgtatcacagccaaaattcattttaaagatatcgtcctgttaacattaaatgaacattccccatgttataataggacaaaggcaacgattggagaaaaacacatgaaaatattgaaacctgaatttctggaatccctgcatgagggcgaagtatccgaggactacttagatgaagcccgccttcaggaacgggacattgaaaacaaacgaatccacggcatttctttccaggagatcgatctttcgcggctgtgttttcgtaatacgatatttgaaaactgcaaattcatcgactgtgatttccgcaaaacggaatttatcgacgtacgcttttcgttgtgtgatttttccaacagcaatttggaaaacgtttatttcaaccgttgcgaaatgctttcctccaaaggggtaggcatgaactgcttccgcgcttttttcaaaaacttctccaccgcggactgcaatttcggctataccaatttttcatccgcaaagcttcaaaacagcggcttttccaaaagtgatttttccaatgccgagttcggcgaatgtatgttcaaagagctcatgtttgacgcctgcgttttcctgcgggcaacctttttcaagaccgccctgaaaaaaatcgacatgacaacatgcgatatctccggcatcagcgtaacgcccgaagaccttttcggtatggtcgtgacgagcgcgcaggcggcggaacttgccaaactcatggggcttgtcgtcgtatagcttgcgctactttttcagcaccttttgcaaccttttcagcgcgtcttccaatacgcttttggggcacgcgaggtttaaccgctcaaacccttcgcccgctttgccaaaaatatatccctcgtcaaagaacaactgtgcctcttgtgtcatcatgcgttccatctcaaggtgcgggatatggtattgccgcaggtcgagccactgcaaataggtgccttccagccgcgccgtcctgatttttggcaggttctcctgcaaaaacgcctccacagcgcggcggttttcgtcgattacaccgatcagctcgtcaagccatgcaccgcactgcgtatacgcgatgcggcacgcttcgtagccaagggcattgagttcgaatatccctgccgccagtttagtcttttcaaacttttctcgcatttcctggtttttgatgatgatattggacgtctgcattcctgccagattgaacgtcttgctgggcgcggtacagatcaccgaaaagtcggcaaaggattcttttacctttgaaaacaccgtgtggaaatagcccggcataatgaggtcgtgatggatttcgtccgctactaccagcacatcgtacttttcacataactcccccacgcgcaaaagttctttttccgtccacacgcgcccgaccggattgtgggggctgcacaagatgagcattttgttatttggatcggccagtttcttttccaaatccgtaaagtcgatttcatatcccgcatccgtttctctgagcacattttcctgtaggctgcgtccggtatactttactaccatataaaacggataatagacgggcgtcatgatgaccacgccgtctcccggctgcgtgagcgcgcttaccgcgatccccagcgaagcaaccacgcccggcgcaggaacgatccactctttttccacatcccacctgtgcctctttttcatccagagcatgaccgcgtcgaaataagcgtccgtggcctttgtatagccgagcgcttctctgccgacatattcctgaagcccgctgacgatctccggcgcagtcacaaactccatgtccgcgaccgatagcggcacgatccctttttgcacgtccggatttttttgtctcatctcttcccatttcacggaatgtccgttgtcccgcaaaacgcatgtcgtaaaatcgtacttcatttcaatctcctgtctgttctatgctgttcttcatccacgctgcgatcttgtccgcagcctctttttgctgtccggcagggctgatcatcgcctgcccgtcaccgtcctgatgaccatagctgccaaagcccgagtggttgccgccctcgatccggtaaaaagtagtatccgccggaaacttagcctccgccgccatatatttgtcccagtcgagcacctggtcgttgcctgccgtaatgctcagcgcccgcttgccgcttagcgcaaggtcggaattgggataagcggccaaaaacacgatatcctgaatccggtcgtcctctttcgcatattccgccgccatcacgccgcccagcgaatgaccaccgatcgtccagtttttgatgtccggataagcgtctatgacgttttttgcgccattgacgttaaacaccgcaaggttaaacggcatcctgacgatcacgcaaagcacgccctgctctgccatgtcgcgggcaaacacggcatacgcctccgcatccaccttgccgcccggataaaaaacaaagccgttttgcggctgtgcgtccggcatgaacgtaatcgttttcgcattttccgttacggtaacgccgtttcccgtctgcatggcctgtatgtcttcgtcctccgcggcataatttccggtacacaaataaataagcatcgtgcatatgattgctgcgaccacgatcagtataataatttttgtccgtttctttttcatcgctttcccctgtttttcatattttatattgtaatataccgccatcgtcccgtaaatatgacaataccatttttcggtttttttaaaacatttctgtgctaattttcaaaaaaaggatgtttcacgattgtatttttgttattatatttataatgtagaatattttttatggaaggagaagcctatgataccactgttgatacttgctgcaaccgttctccttttgtgcgttttttcgagcaagttgctataccgtttcggtattcccgccttgcttatttttttggtattgggtatgcttttcggctcggacggcatcgccggaatccagttcgacaattattcgtttgttgagaccgtaagttcattttgtcttatttttatcatgttttacggtgggttcggtaccagttggaaagcggcgaggccggtcgtcgcgccgtccatctggctcgccacggcaggcgtcgtcataacggctgtgctcgtcggctggtttagctggatcgtactgaaaacgacactgctcgagggtatgctcgtcggcgcggtcgttgcttccacggacgcagcttccgttttctcgatcctgcgttcgcgcaaactgaacttaaaaggcggccttgcttccatgcttgaggtagagagcggctctaacgaccccatcgcctatatgctcactatcgctgtcctgacgatgatttcttcgggcggcgaaaccaacatcgcttccatggtcgtcatgcagcttgtttttggcgtgggcatcggttttgctctggcgttcctctctatctttattctaaaacgcattcattttgagatcgaaggcctttatacgatttatgtcgtggcgatcgtcgtacttgggtatgcgttgtgccagcagatcggcggcaacggatatttatgcgtatatatcataggtatcatgctcggcaataccaaaatcaaatacaaaaggacgctggttcatttcttcgacggcctttcatggatcatgcagatggtcctgttctttatgctcggcctgttgtcctttccgtcgcagattccggcgatcatcgtaccggctgtgctcatttcgttgttcctgatctttgtagcccgccctgcggccgtgttcggtatcttaagctggtttaagtttcccaccaaggaaaaattgtttgtttcatgggtaggcatgcgcggcgcggcctctatcgtgtttgcgatctttgcccttacctccggcgtggggatcaaaaacgatattttccatatcgtcttctttgtcgcgctcttctccgtggccgtacagggaacgttaacgccgcttatcgccaaaaaacttaagctggtggaaaaggacaattcggtattcaaaacgtttaccgactaccaggacgaagcggaaatgcacctgatcgaagtaactctggatacgcgcaacccgtggaacggacgcacgctcaatgaagcgaatattccggaaggaatccttgtggtaatgatcaagcgcggcaggaaaaatattatccccaatggttcgacccttcttaagacaaacgatgtggtcgtattaagcggcgagaattttgacgggatcccgctgtagatttttctgtatatatagtatattattaaagatgtatggaaatttatttttaggagatatcattctatgtttaaggtcaaccagaattttgcgcggcttcagggaagttatttgttctctgaaattgcgcaccgtgtagccaaatataccaaagagcatccggatgcccagattatccgcctagggatcggtgatgtgacgcgtccactggctcccgcagtgcttcaagcaatcgatgcggcaacccgcgagatggcagatgcgaaaacgtttatgggttacggtccggagcagggctacgagttcctgcgcgcggcgatccgtcaaggcgattatgccgcccggggcatcgacatcgatttggacgaaatctttgtttcggatggcagcaaatgcgacaccggcaatttccaggagcttttgtcccccgatgcccgcgtaggcgttacggatcctgtctatccggtttatgtggataccaacgtcatggccggacgctcgggcgagtttgatcctgccgcttctaaattcagcaatatcacctacatcccaacgaccgcagacaatcactttgtacctgcgctgcctgagggtaaggtagacgttatgtatctctgttccccaaacaacccgaccggtacggccctcacaaaagaccagctcaaagtatgggtggactgggcaaatgaaacgggcgcgctcctcctctttgacggcgcatatgagcgtttcatcactgataaggacgtaccgcacagcatctacgaaatcgaaggcgcaaaaacgtgcgccgtggagttccgcagtttttccaaaactgcaggctttaccggtacgcgctgcgcgtataccattgtccccaaagagctttacggtgaagacggaaccggcaataaggtcagccttaacgcaatgtggctgcgccggcacacgactaagttcaacggtgtttcttacatcgtacagcgcggcgcggcggcaatttataccgcagacggcaaaagccaggtggaggatacgatcaaaggataccttgaaaacgcggctatcatcaagcatggtcttgccgaaatcggtattacttcatatggcggcgtaaattcgccgtacgtatggctcaaaacgccggacggcatgaccagttgggaatttttcgacaagctcttgtttgaggctaacgtcgtaggtacgccgggcagcggctttggcagcgccggcgaggggtatttccgcctgacagccttcaacacgaaagaaaatacggaaaaagcgatcttaagactcgcaaatttaaaataattttggaatgaggtaaaaaccatgaaaattgcatttttggcggcggcggattccccgcatacaatcaaatgggcaaacgctcttgccggagatcacgaggttaccgttatttccctgcccgaggataaggatgccttcggggaattgggtgaaaaggtgaccgttacctatctcgacgtttccgcttcgcagggcggccttaagaaaaatgcgtcgcaggtaaaatcgattttatcttccggaggctttggcgtggtaaacgcattcggcgcgacgacatacggcgtacttgcggcgaaagcaaaggcgccgaataccgtacttactgtcctgggaccggatatctatgcgggcgtagacctcggaaagaaggggcttgtggccaaaagtttcaagcacgcggacgctgtcattgctgccgcccccaacatggtcacgcgccttgaacagttgtttaaaaaagaaaaaaattattttgtcgttccgttcggcgttgacctcgccgcttttaccaaaaaagacggcggcaagaaagaagacgcgctttgctttggctccttaaaggcgctcgaatatggaaacggcgtggatatggtcatcgaagcttttgcaaaattcctgcaaaagtccgcgggacaggcaacgcttaaaatcgtcggtaccggcaccatggaaaacagcttgaagcaacaggcgcaaaacgcagggatcgcggataaaatcgaatttgtgggatatgtccccaatgcgaagatgccggaaatgcttaatagcatggatgtgacgatccagatgagcgcaagcgaagcgttcggcgtaacagggattgaatccatggcgtgctgcgtccctgtcgtggcttcggatacggtaggcgcgagcgaatatatcttgaacggcgtgacaggttatctcgttaaagtaaacaacaccgaccgttgctgcgaatgcatgcttgagctgcgcgacaaggcggcacgcgagcatatgggcgagttggcgagaggcgatatagaagaatccttcgaccttgcaaaatgcaaggaaaaatatgaagatgctttgaagtctgtttccccgcgcgtcatgtaaagattaaattttctgatgaagccgtggtcttaaaagccacggctttgtttttttcatgaatggtgctataataaaatgaattattttgaagcatacaggggtaaacggtatggaaaattatccattgaatcatgttaaacatatcagggactttcgcgaactgttgcaccatgcaaaggaagtttacaacggcggagacatttttcgcctgcgcacacccgacggcggcatcgaaggaatcggctacaaccgtttgatgcgcgatttaaacgcgcttgggaacgcgcttgtttcccttgaccttacagggaaacatattgcagtgatcggcccgaccagctatgagtggctgctctcctactataccgttttgtgcggccttggcgtggtagtccccatcgataaggaactgcccgacgacgagatcgcaaacatccttttagacagcggcgcttcgtgcctcatttactcgcacgaatacgcggacacggtcgcaaatatacgcggcagtatcgggaacgtccggtattatatcgatatgaacggcgatacggggacgcatgatttgcaggaattgctgaaaaacacgcaggaccgcggatatgcggggcttcccatcgatccctttgtcatgtccgcccttttgtatacgtcgggaaccaccgggaagagcaaaggcgttatgctctcgcaaaacaatatcctgcgcgcttccgagggtggtcttagtctgctcgatattggcaaggtctgcatgtctgtacttcctgtgcatcactcttttgaaagtacgcacgggattacgatgatgatcgagaacggaacgacaatctgtttaaacgacagcctgcggcacttccttgagaacctgcggcttttcaagccggatacgattttccttgttccgctctttgtggaaatgatgtatggaaaaatttgggcaaacgcacgcgcaacggggcaggaagaggcactttccgcgctgatcgaaaaaagcaatgcggagctcgcgcagggcatcgataaccgcgacgtatattttaagaatatccatgcaacgttcggcgggaacttaaaactgcttacctgcggcggcgcgccgctcgccaagcatttgccgcgcgctttccgcgagcttggcatccttcttttggaggggtatgggatcactgagtgttccccgcttgtatccgtcaaccggaacaggtattatgaagatggttccgtcggcctgccaatctcatgctgcgaggtgcaagtgcgcaatgaagatgaggacggggacggcgaaatctgggtcaagggtgaaaacgtcatgctcggctattataaaaacgacgagggtacgcgccaggtcatgcaggatggctggttcaataccggcgacatcggtcatgtcgacaagggcggtttcctgtccattacggggcgcaagaaaaacctgatcgtactcaagaacggcaaaaatgtctatccggaagagatcgaaggatatctgatgcgcatcccatatatcaaagaggtcgttgtgttcgcgcctcttgtcggcgccagcgaggtcgcgctccatgcggaaatttttgtaaacgaagattataccgcagagcatacgcctgaggaaatccgccaaaatctggaaagggatattgcaggagtaaacaaaaccttgcctgtctataaacatgtggagaatttccacgtacgtgataaggagtttgagaagacaacgaaaaagtcgatcaagcggttcaccgttcagtagaagggagcggcagcgaccgatgggactcaagcggagcaaagtattcttcacttggtgttttcagtcgtcaggaataaatcggtttttcgagcggggacgcaaagaaaaacaacataaagcaaaaggggcacgcgggggaagtgcaacgtccgcccgcgaagggagcggcagcgaccgctctgagaaaggaggtgtaatggaatggctaacgtagaacttgctgtcgtgcaacagcttttggcgatggcgtctcctgtggatcctgaagaaattactcccgaaaagcaccttatgagggatcttgagatggattcattcggaatgatggacgcagtattgtcctttgagcgggaattcaatattgaaattccggaccgggatctgcgcctgttcgatacggtgcaggacgtactcatttatcttgctgaaaaaacgggttcggctattgctcaaaccagtacgatttagcaatcatacttttacattgtgacaagcagggaaaatttcctgcttgtcttttttgttacgtacaactttttgttgttatatatgtttctgatattgcggcaggaatgcctaaggtatatgatagataaggtttatagtatggcttttgggagtattgtatgaagcggaatttatttttgatcaactttgccgccgcttttttgtggatggcgatgtattcctatgtccccacactgcctgcttttgcaacatcgcttggcgcaacggcggtgatgctgggcatcattggcggcgcatacggcatcatgcagattttattgcgcattcctttgggtattatctctgataaaagcggaaaagataaattactgcttattatcggctttgttatcctgacggtgtccgccattttatttatttttgccagcacggtcgaaacggtggtcttcgcgcgcggcgtcgcgggcgcggctgccgcatggtgggtcatcatttccgcatcctacgccaaatataacgacgagtcaaagcaggtaaaagcacagggcgtgctcagcgcgtcctccaaccttgggaaagttttggccgccttattcggcggattgagcgctcagttcttcggtttgcgcgcgccgttttattttgcattgggcgcggcgatcatcggcctttgcgccatgttcttcctgaaaacgcccaaaaaggcagagaaacgtacgcctccgacattaagggaactgctttccctgctgaaaaataaagatttgatgatcatttctatcttatgcatttttgcacagctcatttgctttgccgttccaacctatttcacctctgttgcagcggaaaacatcggtgcggatccaggccagctcggtagcttgacgctcgtttatttcctgacagccggcgtgatctcgctttttgtgggcacgcggctttaccaaaaaatcggcgggatcaaagtcgttgtaatcgcgtttgccttaaacgctttctcctgcttgcctgttttttatcatatgaatctgcctgttatttacgtgatgcaagtcctgtccggcatcggttacggtatcctgacctccgcacttgccggcttcgtcatcaaagcggttatgccgcaccaacgctctaccgcaacgggaattttccagtccatttatgccatcggtatttttatcggaccggtgatcgccggcggcgtgatcgaagctgtttcctttgacgcggcctatcttacaatcggtatcattactgccgcggcggcaatagcaagcggcctcctgattcctaaaaaatacggtaaaatgtaaaaaaattaaattcctattgttttattcctgtcaataggggtattattattttaatgtatcctaaaaaaggaaaatacaaacggaggaaacggttatgtcagatactaccacatggaaatcaaaggagactatcaggctcgtacttagtatcgtgcttcttgtcatcggtatcatattactggctgcaccgcaggcggccatggtcggcatcgtcatattgatcggtatcgttatgcttgcatacagtgttatcacaatttttatgaatatctcaaggcgcagcaaaggagaggattccacctttgtcgttccggtcatcgtgctggtcgtcggcatcctgctcctgatcttccgcgacggtgttgcgaatgtacttttgcccattatcatcggtatctgggcgatcgtcacgggtattatgagcctttcggacgcatccaccttaaagcatgcgggttcgccttcatggcgtgtaccgaccatcacgggcatcgcggcgcttgtgctgggtatcattatcttgatcggtatcgcaaccaccaacgtagttggtatcctgctcggcgtatgcctgctgatctatggtattatcagcattgtggaatggatcgtcgtcgcaactgcgcgcaagaatatctgacaggggcccctacagggactgacgcttatattctcaaaggccggaaacaattccggcctttttacggtcaattaattcaaccataggttgaatttttaatgtcttttcactgatccggttattgtccccacacccaaggcatgatataacagtaatagaaaggaaagcaatatcaatggaatcaagcattgcgcaaaacattgcgagactcaggaagcaaaaggggcttacgcaagaggccctcgcgaaaaagttgaatatttctttccaatctatttccaaatgggaaaacgcgcaggcgcggccggacctgacattgctgccggctcttgcggatgcgctcgataccaatatcgattttttgctcggctaccacaaaaagcatttcacgatgtacgaggagtgttaccagtcggacgaatattattggggcatcgagcctgacccgatgtgctatgaagtactgaagttgtatccgcccgtaaagccgctgcggcttttggacgttggatgcggcgaagggcgggacgccgtgttctttgccaaaaacggttaccatgtgaccggctttgatatcgctgcgatgggcatcgaaaaggccaaccgactggccgatgcgcaccaggtgtatgtcgacttctttgtggcggacctcaaagattttcggttggagcaggactacgacgtgatctattccacaaacggcgtattcgactatatcgctccggatattcgctcagaggtgctgcgtaattatcaggagcatacggcaacggacggcatgcacgcgctgaacgtgtttgttcaaaaaccgtttatcgcggttgcccctgacatggaggaaacggaatttctctggaaatccggcgagcttttttcctggtacacggactggctgttccatgcgtgccgcgaaactatttatgactgcgaaagcagtggcgtaccccatcagcattgtatggatacgctgattgcacaaaaaatacactgctaagacttaaaaagccggatcccttcccagagtccggctttttaagttcattttatttaaaatattttacgccgctttcgaatatcttctggtcgtattcgcccggcacgttctttgcgatatatttgcccgcgcgttccgtatgccccatctttccaagtacacggccgtccgaactcatgatcccctcaatcgcatacatggagccattgggattgtattcgatatccatggacggcgttccttcaaagtccacatactgcgttgcgacctgcccatttttgaacagctctttgatttccttttccgtcgccacaaaacgcccttccccatgcgacacggccaccgtatggatatctcccgcatcgcaaagcgaaagccacggcgactgcgcgctcgtgatgcgcgtcctcaccatgcacgatacatgcctgccaatgttgttatatgtgagcgtgggcgaattctcctgcatatccctgatctccccatacggcaccaagcccagtttgatcagcgcctggaacccgttgcagatgccgaggatcaggccgtccctgtttttcaggagctcatgcgtcgcgtccttgatacgcggattgcggaacatggtagctataaatttaccgctcccgtccggttcgtcgccgccggagaatccgcccggcagcatgatcatctgtgcatgcgtgatctccgattccaacgcgcggatactttcatcgatatcctgcgcgcttaggttccgcatgatgaccacgcgcgggatcgcccccgccgtttcaaacgccttttccgtatcgtattcgcagttcgtccccgggaatacagggatgaccacgcgcgggatcgccgtcttatagcgactgacgacaatatttttctttttataaagaggtgtttccaccttccctttgtcttctgttttggtcgcaaatacgccttccaagggttgcgtatacgctttcaacgcttcgtcaagcggaaccagctcgcccatgagctctaagaaaggctcttcgcgtatttcccccttgatctcaaagtcctcgtcatggatacatggcgattccacaaggatcgcgccgtaacgcttggcggtcgccttatccaaatgctgcgagaacagcttgacgcccagattgttgccaaacgcacacttcgccgcgcccgcaagcaggccgccgcgcgccagcgcatatgccgaaaccacgaccttatcctggatcatcttatgcagcttttcatatttgcgtttcgcgtcctcaaaatccggcaagccgttttcgtcgcgtttgatatccatcaggtaaagtttgttgcccgcctgcttgaattccggcgtgatcacatcctttgcaagcacaggcgccacgcagaacgaacaaagcgtaggcggtacgtcgatatccttaaagctcccgctcatggaatctttgccgccgatagccgcgatcccgagttccctctgcgcccagtaagcgcccaaaagcgcgccgagcggcttgccccaacgctgcggatcttcatgcagccgttcaaaatattcctgtagcgtgagccacgcttccttcatatccccgccggcggcaaccagctttgccacgcttaaaagaaccgcatagaccgagcctgcgaacgggctcttgctcatcatataaggatccagtccgtaactcatgagcgtcgccgtcttgctgtccgcgccatccaccggtatcttcgcgcacatcgcctgtacgggcgatagctgacgcttgccgcccagcggcatcgttacgctgcccgccccgatggtggaatcaaacatttcctgcaagcccttctgcgaacaaatattgaggtcggaaagcagggacagcagggtatcttttaccgttttctccattttttcttcgaacaggtttttcgtatcgaattgttttaccatcgcgctcgcatgctgcgtcgcaccgttcgtatccaaaaatgcgcgggaaatgtccacgatatttttaccgttccagaaaagccgcatgcgccccgtatccgtcacgcgcgcgacaagcgtcgcttccaggttctcctgcgccgccagcgccagtacgcaatccagatcctgcgggcgtacaacgaccgccatacgctcctgcgattcggaaatcgcaagctccgtaccgtcaaggccttcgtatttttttggtaccgcgtcaaggtcgatatccagcccttccgccagttccccgatcgccacgcatacgccgcctgcgccgaagtcgttgcacctttttaccattttggaaaatttttcattgcggaacaatctttgcagcttacgctcggtaagcggatttcctttttgtacctcggcgccgcatttttcaatggatttttcgtcgtgcgctttggaggagcctgtcgcgccgccgcagccgtcgcgccctgtgcgcccgccgatcaggacgatcaaatcgccttcgaccggacattcgcggatcacctgctctgccggagcggcggcaatgactgcgccgatctccaaatgttttgctttatatccttcgtggtatatttcttccacaaggcctgtcgcaagcccgatctggttcccgtaggaggaatacccatgcgccgcttccctggtgatcttgcgctgcggcagcttaaattccatcgtatctttaaggctttggcgcgggtctgcgctgcccgttacgcgcatcgcctggtaaacgtacgaccgccccgaaagcggatcgcggatcgcgccgccaaggcacgtcgccgcgccgccgaacggctcgatctccgtcggatgattatgcgtttcattcttgaacataatgaggtaatcgcggtcgcccttgtccgtctcgatccgctgtttgatggaacacgcgttgatttcttcggaatcgtcgaaattacggagcattcccgcgcgctttgcctcgcgcacataagcggtcgcaagatccatcaggcacacgtccttatcccgtcccatcttcctgcgcgcatcgaggtaatcctcatacacatgctccgcttctttggaaatggggtcgcctgcaaattcgaccttgtcaagcgcagtggaaaacgtcgtatggcggcaatgatccgaccaatacgtatccaaaaccttgagctccgtgatcgtaggatcgcgtttttcggatttgaaatagtcctgcgcgcacagcatatcctccgctgtcatcgcaaaaccgttttggaccgtgaaatccgcgatttgttttttgttcatcttgatgaagccgtccatcacggcgacctgcgtgggaatatcgagatccatttcgagcgtatcgtattttttgagcgtggcctcgcacgagtccacagggttgatcacgtattttttgattgtttcgagttgttccttgtttgcgcctttgatgaaatatatttttgcaaagcgcacgttcgggcgctcccctttggtcagaagctgtatgcattgcgccgcgctgtccgcgcgctggtcgtactgcccgggcagatattccacggcaaatacggaatacccctttttatccggcatttcctcaagcgtcaccgtatccacggcaggttcgctgaatacgtttacgaccgcagccgcaaaatcctcgtcatcaaggccctgcgcgtcgtagcggtttaagatccgcacctccgtaacgggcaccccaaggttctgcttaaaatccgctttgcgcgactgtgcctctacgtcaaagccttttttcttttccacaaacaatctttttacgctcatatcgatctcctatgatttgttttacctaataaggataccatatttgtactgtattttacagatgccgcggccacaaaatttagaatagcaggacatacaggggaatcgtaataaatgacaaaagcgttgtgatcaccacgccctttgccgcaaattccgtatccgcgccgttgatctccgcaaagatcgtggcgttcaccatggcgggcaagctcgtctggatgataaaaacttcccttggaaacggcggtatggaaaaaagcaccgacgctgcaaacatgatggcgggagcgatcaaaaaacgcccaacaaggacccacgaaatatttttatcgatttttttgatacacgacagccctgtacgctgcaagatcatgcccacaaaaatcagcgcaaggggcgaggtaaggttgccgacataagtgaatacggacgacaaaaagccagggagttctacgcgcagcatgaccaggacgaaaccgataatgacggcgatcataggcggctggaacactttttttacaagctgccatcctgtaaagcacttcttatcccccgttccgccgtccgcgaggcaccggatttccatgccgtcgcgcgcgatctccacataaccgaggccgttcataaacgtcgtattggcaatataataaaaaagggcgaaaacaaccgcttcttccccaaaaatagccagtgcgacgggcaggccgataaacactgaatttgaaaatgtaaacagcacggtaaataccccgcgccgcgttttgtcgatctttgcgaatttgatgaccagcttgcaaacggcgtacgtcacgcccacagagacaaacgcagccgcaatataaatccacgaatccagcagcgtttcggcggtaaagttgcctaaaaaggccatcaccaccgtgcatgggaaggcaatattgaccaccagcttactgacgaaatccgtgacgcttttgcctgcccagcctttataggacacgaagtacccgatcgccacgatgatcagcaccatcaacactgcctgcaatgcgttaaaaaccattttttcttcccgtttttgttgccttcttgcaatgccggcaagtatttccgctgcacttcaaacacttaggctgcgctgcgcgccgttaaactcgttcgcgaaaatacttgaccgctaccgctatacaaccatatacatccagcttaaaccagcgcgttataaatcgccttgaccgctttttcaaaatcgtcgttttccacgccgacgatgatattgatctcgctggaaccctggtcgatcatgcgcacgttaacgtggttgcttgcaagcgccgcaaacagcttcgccgacacgccgatctgccggatcatgccacgcccgacggtcgcgatgatcgccatgttggaggatacctccacgctgtccggctggcattccgcatggatctcgtcgatcaactgctcgatcacgccgcgcacccgcacgtccgcgatcacgatggatatcgtgtcgatcgaagaaggcatatgctcgtaggaaagcccaaatttctcgagacagccaagtacctttcggccaaagccgatctccgtgttcatgccgtctttttctatcgtaataaccgtaaaattctttttccccgcgataccggtaatgccttcccgtgcgttatcccgtccttcgatcgccggaatgatcattgttccgctgttttcaggatcattcgtatttttcacgttgatcgggatcgccgcttcgagcacaggaaaaatgctgtcctcatggagcaccgtcgcccccatatatgcgagctcccgaagctcgcggtacgtgaccacgtcgatctttttaggatcgctcacgatgcgcgggtccgccatcatgaagcccgaaacatccgtccagttttcgtaaaggtcggcattcgccgcgcgcgccacgatggaacccgtgatatcgcttccgccgcgcgaaaacgttttgattttgccattgggcaggctgccgtaaaagcccgggatgacggcacgttcgtgcagtttcagtgcgcccggcaatatggacagcgtctttttcgcatcatagttgccgttttcgtcaaagaaaataacgtccgccgcatcgataaaatcataaccgaggaggtccgcgatcagcaggccgttcaaatattcgccgcgcgatgcgctgtaatcttcgctggcccccgttttgatatcctcgtacattttctgaagatggtcttcgattttgatggtcagattcagttcatcacggatatccgtataccggcgcacgatcttctcataaatttcctgcgtatcatccagcctcattgccgcgtcatgcagtgcatacagaagatccgttaccttgatgtcatccgaaaaccgcttccccggcgcggacggcacaacaaattttcttgcctcgtccgcatcgatgatctgcttcatcttcaggatctgctctgccgatgcaagcgaacttccgccaaatttcccaaccttaacagccatgttaaaacctctccgccttattcctcaattttttctatttccggtgtatttttaaaatcgtccgtcagcagacggccctccaaataatacctcttttgttccgcctcacccagcgagaacgtctttttgggcaacacgccgcatttgatgaccaaatcaaaaaattcgcttttttccatgggttcaaagtaaaacccaaggttatcatactccctggcaagcgataaaaacgcctcgtcgccgtggatataatcgatgcacccctgcgggttgcgggtaatgtattcctcaaaaatttcctgtacttcaccaattgcgagcggatgctcaggatcttctatgatgatcctgcccgctccgtcgtggtacaaaaacggaatctggtacgttccgtcatgctcgatctccgtgcgccaccgcccgaataccagctttgcattccttcctttttcacgcagccgttcgaccacaaactgcacgcatccggaaggattcacaccgaaaagtacgcggtgtatgggcatgaactccaccgccctgtcgcgcaggttgatgatctcgcaaagggcaaaacgcagtggatggtctttgcgctgctcctctgtgagttcctgttttacctcgtcccacacggctttggccgtcgcaagcgaatgatttccatcgcccacgcagaaaagcatgttgtcgcgcttctgaagtccttctatcgcgtctatcgcgccgtttaccagcttctgctcatcgatgagccagccctcgatcctgccgccgtccatcatcaaatcaaaatcatatattttttttaggctgctgcgctggatatgcaacggcccgatcacgctgtcctgcggatcgtccatcaaaagcatgatatgcggcagctccagctccgcgccgctcctgatcttcatacggggcgggatgcgcgaaagcaccgtttgctccgtcgcccgaatcaggggcttgttttctattttaaaatcgtactgctctaagtccatcgcaagtaaaatacccttgcgtactttatttccaaaatggcgttccgtaagcacaatgccttgcggaaggaggcccataacacccttgtttaaatattcgtgcatctcgcttttcaggtcgtcgatgcactgcgccacattatcgccttccaaatagacctcaggcaataccaggtgcagcgtagagggcgcgtttcctacaaatttttctaccttctgccagtattcaggctgtgacgtaaactggtcgcacgcaacgcatgcccatttttccatgttaacgtcctgcgccggcagcaatacctgcggaaccacaaagcccagtttttttgtatctttcattgtttcctccacttttagccgttttttcgccacccaaagatacatagtataatatatcagtaaaatgccgttttttcaagtaaaaaggcaaaacgccgcgcttttgcgcttcagataatgaacggcgtgtcctgcatcgttcgcccgagtaaattacgcaggaccgtaagccctttttccagccgcgctttcgtcggcgcagcggaaagcgatatgcgcaccgcgtcaaatgggaaatcactccctaccacaaacttttccgcacaaaatacgtttacgccttcgttttttgccgccgtttcaaattcccgcccatgcatgccttccggcaaaataagccacctgaaataatccctgtggccgccgcgcaaatcatatcccgcaaggaccttatccgccagggtattgcgcgcctgcgcctcgatgcgctttttgcggatgatctcgtccgccaaacctgtgcgcaccagataagaaacgatctccgtattaaaatgcgacgtcatcaggttgatattgcgtatccccaggtcgatgcgcgcacggaatttctctgcgactgccagaaaagcaacgcgcagtcctgccgacagcgccttggacgtgccgctgatataaacgctgtgctcctctgcatacgcggaaatcggctttagccccgtgttgttcaagaatgcgtaggtgtcgtcctccagcaggataagtccgttttcgcgaacgacctgcgcgacctctttgcgccgcgcaagcggcatggaatacgccgtcggattctggcactccgccatcaggtagatccctttgatcttgtcattgcggcatacccgcccaagttcctgtgcatccatgccgttttcatccatatccacgggcaccagccgaatgcccagcatgtacgcaaggtttttgaatccggtatacgtaaaacggtcggttatgatcttgtcccccgccgaaaaaagcgacgttaatatgatcgccagcgcgttttgcacgccggacaccacgaaaatatgctgcggcgtgaccgaaaagttcatcttttgtatccatgccgcgcccagctcacggtccgcattctttttttgcggcgcatcataggaaaggcagtcctcggcctccggacttttgaccacgtggcgcatcgcctcgataatatactggtctttatcgtgcaaaggaaaaatcataccaaggtctaaaagcccctgcgtacttgttccgtcggcggtcgtcaccgcgtcagatgcgagaacgtccgaggaaataaacgttcctttgcctactgtcgcaaaaatcagtccgcgctgctcgcatagtttaaacgcgcgcgtgatggtactcaggttaaggccgagaaaatccgccagctcacgctgcggcggcagtttgtcccccggctttagtacaccccgtttgatgtcgcgtttcagcgcgcttacaatttccatataaacgggtttgttttccctgctgatttccggctgccagctcaggtcatcataaaaaaagccaaccatgtctgctcctttaaatttgtattgcatacaattataccattgaaaccgcattacaacaatcatataatgaaatcataccgcaaataaaagcatacaatttattttttaacggtacaattatatacaggcgtttgcgccatgaaaatggcgtttaacaatacagcagcaaagtgagggaaaacatgatgcaggacaagacgaaaaaattaacgaccacggcggtcatgaccgcgctcgtttttgtggtgacattgctgatttacattccggtacctgccgtgaaaggcgcgtatttcaatattggcgacgtcattatttattgtttatcgtttattttgggcggcccctatgccgtgtttgctgcggccgtcggcagcgcgctggcggacctgacgctcggctccgtgatttacatccccgcaacgctcgtgatcaagggatgcatggcgctcatcgtgggtatgctcacgcttcggagcgtatcctttggacgttacctgattgcgtgcgtcattgcgggtctggtcatggcgtttggttattgcacgtatgagttttttatcatcggcggctgggcggcagcggcggcgacctttatccccaatatgatacaggcagtgtgcgggatcgcgatcgctgcggcgctttatcaccccatgcgttcactgcgcaaccggtttgcgctgcgccctaaattatcttgctgaactgcttctttggcggtattcctccagcttttggtcaataatcggccatgcggcctgaaactctttttgatagtccctgccacctttccagttggcggggacttttcctgtatatggtacaaacccaaattgcttatagatattgaccgctttataattccatgtggaagaactcaggtacaggatcccatcgtgatcaagctcctgataaatatccagcagatgggtaagcaatgcctttaccagccctttcccctgatactccggcgcggcggacacccaatggatgcgcagatgctcgctgccaaaatgactgcccggccaaagcgacgcagttgcagcaaccttgcctgcctcattcagtacaaaaatacattgcttttccagcagctttggcctgctcaaaaaatcccgacggaacaaagcgcgcgcctcttcaagcgtatccgtttgctcaagcgtatagaggagctccgcccactttttcgcatactccggccgatatccggaaaatcgaaaaccatccggcagcgtataccgtggatattggctaatatccggcttttccataaggatatcaaaatagggaactgttttatccagcatatttcctgccccgtttccaaaatcgttattttgattgtaccatgaaatagccgccgatgcagcgtgcatcctataaggcgctgcccgttttgggcgtaaacagccctgacaaatccacttcttccagttcaagcagttttatttttgtttggatacctccggcataccctgtcaggctgccgtttgaacctactaccctgtggcaaggaataatgatagagatcgggttatgcccgaccgcgccgccgacggcctggcccgacatgcttttcctgcccatttttgccgccatttttttcgcaatatcgccataggtaatcaccttgccataagggatttcgcataagatgctccatacatcctgacggaacccgctgccaaggggagccagcggcaattcggaaacgtccggtttttcccttgcaaagtaccggtccagccattcttttgcggcatcgaacaccggcatactgctgtcttccgtcatcacatcggatatggggcccccatgatacttctgcccttccagccacaacccgatgagccggttgccgtcagcgttgcatgcgagcgtaatgacccccacgggcgaaggacaggttgtcttataatacataatatcctcccagagagtattccataaattgaccgtcccacttgcatttgattataccatatcctcatggttttctcgccattttcggatatccttttctatgaaccggatgccgccccatgcaagtaaaacggcatagccaaaatggctatgccgtatgcggtaatcatgctttttattaagatcaattgatgagcggccgtccatccgaatccgtattgatgctgcccgtaaggatcatgatgccttccacaagaccccagatccccgaaatcgccgatgtgataccaaaggtgacgaacccgagcaaccccaagatcaactggcccaccgccttgctggtaaagccgaggtagaagttatggatccccagccaccctaagaaaataccgaggatacccgccgcgatctttgacttggactgcggcgttgcatatggattcgctcccgcctgctgctgtgttccgttcttgggcacaagccctgccccgcactttacacatacaaccgcttccggatcgcttttcgcgccgcaattccagcaatagtcatgtcctgtccccaccggcacgccgcaacccatgcatactgtttcgcccgggtttagctgcttgccacaatttctgcaatatttgtattccgccatttataattcctcctcttatgttgcacccgcaacaacgcatttcgcgttgtattttcctgcgcaactttcctttcctgtttccagtatacggggcggaaaaccgcgtgtcaacggcatttggccgtatttcgcgtttcttcataaagtcttaaggggtttgatgggtttttgttaggaagtaatatttagttccaatatttagatgttccaaatattggaaatggctattcaaatgaatataatagaaccgcctatttttttcttactatttgatttcctgctccagcccgtcaaattccggcgtactgaaaaattcgccgagggtgatatctaatccatcacaaattgtttttattgttataattttaggattcttgctttttccataaaaaatatttttcacagaggagggaggtaaagctgaaatatcagccagtttattgatcgtcaatcctctttccgcgcataattgaaggatacggttacgaattacagttattgtgttcattttcggctctcccagaactttgttttataaagcttagccgaatttgatagacattataggctatgcatgctactattaggctatacatagactattcggagcatatataaaatgaaaaaagagactacctgctgcttcacagggcaccgcccccacaagctgcccttcctgcgcgatgaagaccatccacagtacaggctgttggagcagcggctcaccaaagaaatactggaaaaagtgctgctgcacgactgtgatacctttttgtgcggtatggcgcagggcgctgatatgctgtgcgccgaacttgttttgaagctgcgcgtgctgatcggcgaacacctgcggctcatatgcgtcatcccgtaccttgcacaggcgcagcgttgggatacgtcagagcaaggacgttacaaaagcatccttgcgcaggcagaccacaaaattcttttgggcaatgaatataccggcggttgcctgcttgcccgtaaccgttttttggtagaccattccatgcacatgatcgccgtttacgacggctcctctgcgggcgggacgaggtatacgctcgaatatgcccgcaggaaaggtctctcgatatgcgtggtcgacccaaacagtcttgttccttttttcgtatgaataaagcatggtttccgccgcttcttttgctcacagataattgactttatacccaaaatagccgataataattgggtatattgaaatttgagatcgcggaggcgaaggaattgaactttacggatatcgagaagaaatggcaaaagaaatgggcggaaacagggctttataaattcgacaaaaacagcttaaagcccaagcactatgtattggaaatgttttcttacccgtcgggtgcgaacctgcacgtcgggcattggtataactacagcctttcggacacctacgcgcgctttatgcgcatgaccggacacaacgtgttccacccgatggggtttgacgcgttcgggcttccggcggaaaactatgccatcaaaaccggcatccatccaagcgattccacgcttaagaatatcgaaacaatggaaaaacagctacaggcgatcggcgcgacgttcgactgggattacgagctcgtgacctgcctgcccgaatattataaatggacgcagtggtgctttttgcagctttataagcacggacttgcctaccgcaaggcggctcccgtcaactggtgcccgtcctgccagaccgttcttgcaaatgaacaggtcatcgacggcgagtgcgaacgctgcgggacggctgtcacgcgtaagcacctgacgcagtggttttttaagatcacagagtatgcggaacagcttttggagggtttagaccgcatcgactggccggaaaagactaagctgatgcagaaaaactggatcggtaaatcacgcggcggcgaagtaaagtttgatatcgtaggcggcggggatttcaccgtgtttaccacacgtgcggatacgctttatggctgtacttacgtcgttatttcgcccgagcatccgctggtcgataagatcaccacctccgtacaggcgccggcagtcaaggaataccaggaatacgcagccaaggcgacggagatcgaccgcctgtccaccacgcgcgaaaaaacaggcgtgttcacgggcgcgtatgcgctaaaccccattaacggacggcaggtacccatctggacggcagactacgtgctggcgagctacggcacgggctgcgtgatggctgttccggcgcacgacgaacgcgactttgcgtttgcggaaaaatatgacctgcccattgagcgcgtgatctgcgcaaaggacagcgatacggatgataagcttcccttcacggaacacggtattctggtgaacagcggaaaatatgacggtctcacgaccgcagaaggtaaaaaagcgatcctgggcgacttgggcaaagagggccgcggcgggttcaagacgaactaccgcctgcgcgactggctggtttcacgccagcgttactggggcgcgcccatccccatggtatactgtgacaaatgcggcgaggtacccgttcccgaggatcagcttcccgtggaactgccgtacgatgtaaactttacgccggacggtacgtcccctcttgcgaagaaagaagattttgtcaacacgacctgccccatttgcggcgggcctgccaaacgcgatgtggatacaatggataccttcgtctgctcgtcgtggtattacctgcgctatcccgacaacaagaatagcgaggaagcgtggaacaagaagattgtcgacgagatgcttcctgtggataaatatatcggcggcgcggagcacgcggtcatgcaccttttatatgcgcggttctttaccaaggcgttccacgatatgggatatgtcggctttgacgagccattcatgtctctggtccaccagggcacgattttaggaccggacggcgagaagatgagcaagagccgcggaaacgtgatctcccccgacgacctgatcaggaaatacggttcagatacgctgcgcatgtaccttgcgttcggctttaattatgtggagggcggcccgtggaacgacgacgggatcaaggccatcaaccgttttttggaacgcgtggagcgtcttgtcggcgcggtcacagggcttgagggcggcagcggcaagacagacgcagaccttaactaccagttgcattacgccatcaagaacgtgacgcacgactaccctgtcttctcattcaatacggcggtcgcgcgcatcatggagttggtgaacgcattctataaatatatggacgcgcagcctgacggtgtttttgccaaagatgtcgccggaaaactgtgcctgctgcttgctccggtcgcgccgcattttgcggaggagatgtggggacgcttgggcggcgcatattccatcttcaaccaggatttccctgtgtgcgacgaaagcgcgcttgtccgctccaccgtcaatatggcgattcaggtaaacggcaaagtccgcgcaaagttcgatatttcctcgaacgcttccaaagaggaagtggaaagctatgtgcgcaaggaatttgcaaacctgtgggacggcaaggaaatcgtgaaattgatcgtcgtgcccgggcgcattgtgaatattgttgtgaaataacgaatatgaaaagaggctgcggaaaatccacagcctcttttttatgctttcttattttaccccgcggatgaactcgcgtccgatatacggctgcaacgcctgcggcactttgatgctgccgtctttttgctggtagttttccatgatcgccgccaccgtacgcccgaccgcaaggccgctgccgtttagggtgtgcacgaacttaagcgaaccgtcgctgtcacggaagcgtatgcccgcgcggcgtgcctggaagtcttcaaagttcgagcacgaagaaatttccacataccggccatagcttggcatccacacttcgatatcgtatgttttcgcggacgagaaaccaagatcaccgccgcatagcagcaccacgcggtacggtatctgcaaaatctgcaaaatgctctccgcgttcgccaccagcttttcaagctccagataggattcgtccggccgcgtgaatttcacaagctccaccttgttgaactggtgcaagcggataaggcctttggtatccctgcctgcgctgcctgcctccgcgcggaagcacggcgtataggcacaacggtaaagcggcaggtctgccccgtcaaggatggattcacggtacatattcgtcaccggaacctctgccgtcggaatcaggtacaggtcggtgtcttcaatgtggtacatgtcctccgcaaatttcggaagctgccccgtgccctccatggatttctggttggccacgaacggcgggatcacttctgtgtagccgttctgctcggtatgcgtattgagcataaaattcatgacggaacgctctaaacgcgcgccgagtcccttataaaatacaaaccggctgcccgcgacctttgcgcccagctccggatcgatgatgtcaaggtcgtttcccagatcccaatgcgccttcggttcaaaatcgaatttcgtaggctccatgaacttacggatctccacattgtcactgtcgtccgtgcctgccggtacgcttgcgtccggacggttggggatggtcatcatatccttttccagattagcggtcataatctgcagctccgcgtcgtaatctttgatctgcgccgcaagctctttcatctccatcatgacagaggagacatcttccccgtttttcttcatcacgggaatttccttggaaattttgttccgcttcgcctttaactcttctacctttgtcatcagcgcacggcgttcttcgtcaagcttgatgactgtatccagcctgatatccttaccgcgttttcccaatgcgtctgcaatcgttttaaaattgtcgcgcaatgtccttaaatccagcatttcttactccaacctcttctctatcgtataaacttattttatgctcacattttattgggcgctttgatccccagcagggaaagcccccgtttgagcgtgtcctttaccgcgcgcgcaagcgcgatacgcgcattggtctgctctttgttgtcgtcaatgatcctgtattcataataatatttgttgaacgcctgcgcaaggtcgatcaggtgcctcgtcacataaaacggctcgttcttttcgcttgcggcaagcagcgtctgtggaaaacccgctaaggatttcagtacggcgaacgcttcgtcattgtccagtacagatacatccatgcccgcgtcgtttgcttcatgccgtgcgatgaccgaagcgcagcgcgtatgcgtatattgcacatatgggcccgtttccccgtcaaaattaagcacgcggtcaaacgagaacatgatatccttgatgcggctctggctaagcgttgagaaaatcaccgcgccgataccgatatcgcttgccacctgttccttgttttcaaggtccggatttttttcgttgatgatggagagcgtcttttcaaccgcctttttcagtacgtcctccaaaagcacgatcttgccgtgacgcgtggaaagcgtgccgtcctcgagcgataccataccgaacgcgacatgctcgcaatcatccgcccacgcgtaacccatttttttgagcacagcgaacacctgtttaaagtgcaggttctgctggtaggcgaccacgtacaaatttttataaaaatcgtacgtctttttgcggtactcggcggccgccaaatcgcgcgtcgcgtaaagcgtcgtaccatccgatttcaaaatgatcgccggcggaagttcttcctcgtcaaggcgcacgacatacgcgccttcgcttttgaccagcagatccttttcccgcagctcatcaagcactgccggaattttatcgttgtaaaaactctcccccgcaaagctgtcgaactgcacgtccaaaagctcgtatacgcgcttggcttcccgaagcgtcagctccttgaaccagccaaagatacgcatggcttcctcgtcgccgtcttcgatctttttgaaccaggcgcgcgcctgctcgttcaaggcttcgtctttttccgcttcctcgtgaaagcgcacgtaaagtttgagcatcgcggaaacgctgtcgcgattgatctgctcgtcgtcgccccacattttataggcggcaatcagcttgccgaactgcgtgccccagtctccgaggtggttcacgcctacgacgttatatcccaaatatttgtttatcttataaagcgcgctgccgatcgccgttgaggaaagatgaccaatatggaacggcttggcgatattgacggacgaataatcgatgacgatcgtttttccgtcgcctgcattagagcgtccccagttttcaccggcctctgtcacttttttcaaaacgctttgcgcgtaatacgtcctgtcataaaaaaaattcaggtatccgcccgcaatctgcacttcggctacaaagtccggcttttcgattttttctgaaatttcctgtgcaatcatttgcggcgctttttttaatactttcgccagcttaaaacacggcaaagccgcgtcgcccatcttcggatcgggcggcgtttccagcatttccaaaacttcagggctttccatgcccgccgcgtgtgcaattttttccgccaatgcggttttcagatccattcttttccccgcctcactcgtttgatagtaaccataaatatatcataaaactgcggttttatcaatgtattttaacattcccatgtggtataatgtgacgagaataaaccaaacgaaggagattttatgaacttaggaacaaagcgcctgttgtttttgatcccatttattgttttcgcagtcgtgcttttggtgttgtcgtacaaatgaaacgtattttacccttcattcttgccataacatgtatgctcgcgctctgttcgtgcgcccctgccgtgcagcaaagcgaatcgttcgtcatgaatactactgtccggcaaacggtgtatgcagaggacaacagcgtgatccggcaaaataaccaaatactgcgcgacatcgaaaacgagatgtctaaaacgatcgcgcaaagcgacgtggcgcgtatgaacgctgcgaataccgaggacattgaaatctcggatgcaacggcgtttgtcctcaaggcttgcctcgagcaggcggcccttaccgacggcgcatttgatcccgcgctgggcggcgtaacggatgcctgggacttcggcacggaaaacgcgcatgttcccgcgcaggcagaacttgaagaattgctggcgcatacggattacagccaaatcaccgtcaatgtaaacgaggacgggaaagccgtcgcgaacgcaggcggcacagaaatagacctgagcggcgctgcaaagggatacgccctcgaccgcctcgcgcaaaatctgtccgacaaccatgtatcctcggcggttctttctgttggcggcagcatctatgcaaccggccaaaaaccggacggcagcgcatataaaatcggtatccgcgacccgaacggcggcgaaaacgactatatggcgacgcttgatctggatggaaagtttgtttccacctccggtatctatgagcgcggctttatggaaaacggaacatactatttccatattttggaccccaaaaccggttatcctgcggacaccggccttgaggccgttacggtcatctgcgataacggcctgctttccgatatttattctacggcgctgtttgtcatgggagccgaaaaaggcatcgcctttgcgcaaaagcagggtgtggacgcgcttttcctgacggatgataagcaggtcataactacggacggatttgcggaaaaatatggccttgccataacgaatagggaataccatgagtaaacgcatcaaaaaaagcgatattgtctttaccgttgtgatcgtagcagcgatccttttggtgtggttgattgcgctcccgcgcgacgcgggaagcgaagtcgttttccggcaaaacggcgaagtggtcgcaacgcttcctctttcgaaagatacggtctttgaggtgtccggacgctatcacaatacatttgagatcaagggcggcattgtgcgtatcaccgaaacggattgtcccaaccatcaatgcgaaaagacaggagaaatttcgcgcgtcgggcagtccatcgtatgcgcgcccaacagcgtaagcgcgacgatcacaggcggaaaggcggaaatcgatggcatcacaggataacagaacctcaaagtttatactggccgccgtgctgtgcgggatcgcgctcgcgctttccctgcttgacggcgcgatctccgcactgctgccccttcccggctttaaactggggcttgcgaacgtggtatccctttttgcgctttattacctcggcttttcgtgggcaacgctcatctgcatcgtacgcagcctcctgaccgccatcctgtccggcaacatgaccatgctcgtcttctcgctgacgggcgggctcgtctcccttctggtcatgttccttctcatgaaaaagctgtcgctgatcaaggtaagcgtcacaggcgggatcacgcataacctcatgcagcttgcatgcgccgcccttttgaccgccacgccgcaggtttcttactacctgcccgtgcttgccgttatgggcgcggtttgcgggttctttatggggcttttgtgcgcccttgttttctctcggctaaaaagggttcccgtgcataccatcctataatttttagcaaaccgctgatttttaccgaaagggtatagtataatagcaatatcaaatctattcattctcgtggggataaaattatgagaaaatccttttttattttagcaaccatcctggttcttttgactgtttgcctttcagcctgctccttttccctggaaacgccgccgacggcaagtgcggacgcgtctgcttccgctgcgcgcgaagcaagcgcagcgccttctgccgaggcatctaaaataccgtcggtgcttccgacctttaacgagatcataaaggatcatacgttctcccctgtttgcgtgccgcaggaattgtatccggtggacgcagaccgcaagggctatgatgtgatcctgcaaaatcctgcgatcacgcagtcgcttgaggactgtttttccgcgtggctttccgaggccgtctccgccgtgcaaaagcaatatgaagaatattatccccatgttaaaatcacggcggatataagcgggctgtcctggcagatgctttcgtccgtggcctacggatgcgcgtcgtccgaggattttacaggactgtttccgtcgcttatccgtgtcaggatcgcaaaaagcgccgaattttcgaccgacgacgcctcttttgacctcacggtgaccacagaaaagccgcagcagtttttttatgcgttgccgcgcgcggatggcgaagacccttcctccatcccttatggatttttcatgtgcacctatttaagcaccgcctatgatgaaaatatggaaatgatcgcccctgaggacgaggaactgcctgcgctttccgagcggctgaccttcccgtttgcgacgcgttacgattaccgcgacagttggtatgacgaccgcgacggcggcgcgcggcggcatatgggtacggatatcctgtgccccgaaggtacgcaggagcttgcatgcgtagacggtaccatccttgccgtcggttccggcgaaggaacgggcaattatgtggtcattggcggcagcgacggtacgcagtatcattattaccatatggtcgaggtttccgaccttgtgtccgtcggcgatgatgtgaagcgcggcgacgtcgtcgggctggcaggcaataccggcaacagtacggcgaaccacctgcacattgcgatcattcatccatccggcgtttacctgaatccatatccctacttaaacgaagcggaaatgcccggggatgcggcctgaaaaaacgccccctgtataaaaacggcacaaaaaaagagttcctgcacatacatatatatgtacgggaactctttttgatcctgttttatttttcgctttccatcccgtttatcagctcaagcgccgctgcaaggtctttttgattcacatagatatcgtccccgtaaggggaaaagcccatatatgcttccagcgcctcgcctgcctgtttgccctgcacaatggaagcgataccgtttcggtttaagacctccgcgatcatctccgtctgtacattgttttcggtagataccaaaaaaacgctcttcatatgttcctccctatacgttgaaacggaacagcacgacgtcgccgtccgcgatcacatactccttgccctcctggcgtacgaggcccttttcctttgctatttgcatatcgccgttgcattcgtctttcagcgtatcaaaagcgatcacttccgctttgataaatccgcgctcaaaatcgctgtgtatcttacctgccgcctggggagccttcgtcccttttgtgatcgtccacgcccgcacttccttttcgcccgccgtcaaatagctgatgaggcctaacagcgaataggattttttgatcagcttggaaagccccgactcgccgatccccagttcttcgataaacatctgtttttcttcttcgtccatgcctgcaaggtcttcttcgatctttgcggagatcgtcacgacctcgctgccgtgctcctgcgcatagtcaaatagcggctgcaaaacaggaaggccctctttgcctacctggtcttccgcgatattgcccacgtaaatgataggcttgtccgtcagcaggaacatggagtgcatgacctcctgcccctcctcgtcaagctccacattgcgtgcaaaattacctttttcgagttccgcaagcagtgtctttgccacctgtgcctcggtcttgaacttcttatcgcccgtcttttgcatcttgagggccttgtccagcctcttttgcacggtctccatatcggcaaatatgagctcgtaattgatggtcgtcacatcgcgcagcggatcgatactgccgtccacgtgcgtaatgttatcatcctcaaagcagcgcaccacctcgatgatcgcgtctacctcgcggatatgcgacaggaacttgtttcccagcccttctcccttgctcgcgcccttgacaagacccgcaatatccacaaactcgatctgcgcgggcgtaaatttctgcggatggtaaatctccgccaggtaatccatgcgcgcatccggtacggaaacgataccgtaattcggttcgatcgtacaaaacggataattcgcgctctgcgcgcccgcctgcgtgagcgcattaaacagcgtactttttccaacgttgggaagccccacaacacctaatttcattatattttaagaaactccttattgtaacacgccaccaatcagtataaaatacaaatatagacgtggttttctgaaaatcttgcaaccatcttattataatcggtatcgaagcgctgtgcaagcatggttgtaaaaaacggacaagtctcacataaggagtatttttatgggttttttggaatctatagtattgggtatcgtacaaggcttcacggaattcctgccggtttccagttccggccatcttacccttttgcagggccttatgggtcttaaagaagtgccgatcctctatgacgtcatgctgcatgtcggtacgcttatcgctgtgtttatcgtgttgtggccggagatcgtggccattatcacgcatcctgtgaaaaacaaactcggtatgctgattttggcaaccatacctgcggtcgtcgtgacgctggtcgcggagaaggtcgcgcccgaagtgttcgcggacgtcctcaacggcaaataccttgcaatcggtttttttgccacaacgggcgtgttggttttatgcgaagtcatcgcgcggcgcatggaacgtaagcgggatgttgagcttccgcaggcaatggcaatgggcctgatgcaggcggcggccatcctgcccgggctttcccgcagcggttccacaatcgcaggcggccttttcaccggtgtaggacgcgagcgagcggcaaaatatgcatttttgatgtccatccctgcgatcctcggcggcgttgtgttcggcgcgaaggacgcggcggaaaacggcatgggcgacgtttccataccgatcgtcttaattggcctggtagtttctgcagtatgcggtttcatagcaatcaaattcatgctgaagctgatcagcaagcataagctgtatggtttcgcggtctatacggctgtgatcggcgtggtcgtgctggttcttacaaattccaatcctacgatgtttatttcagcataaactattttgcattaatagagggagcagataaaaattacctgttcccttattttttgttcctttttttccgttgttcatcaaatccgcctgtcaaagctttacttgtgaccatttatgtgaccttccctgtttacaataaaaagaaaaaatatgcaaatgaagcatgcgcccatgggagggctcgtgaaaggaaaatattcatgaaaaaagttttgatattcatcttggcagtagtcctcatgatcggaatggtgccagttaatgcatttgcacaggagatgccgggcgggcagccccttccagctatcacggaaacttccagtgaagttggggccgttctgcccactgtttccgaagcacctgccgcatctgagtctcccgccgctgtagagtcgtcaccagtaatttctgcatctccaaagccggacgttcccccggcgcaggataagactcctatcgaaaacgaaacttatgagcctgttaccgatgctgcagacggtattgcgatactttccatggccgataatacggaagaaaatgttcccgcgaatgcaggcaccccgaaagaaccggtggaagagccgacctttggggaagggacaaacgtaaattgcacattctatatcacaatgaaagggtttggcgcggatgtcgatacgatccaacccacgccttccacctattatgtacgcgccggaagcagtcaacaggggagtatgaccgtcccgcacggcatggtcaaaacatccaggggttacggcagggcgctttctttagtggaatatgaaaacggctcggtcgtaacaagcggaaagccggttgctgcccagatagaaaatacccttaccgcattggcaaaaaaagtgtccactcccgagcaacctgtggtgtttccggaaggtactcagatttattggaatgtcattaaatatgatccgacagacggttggcatatcgacggatatgttgtcaagccaacgaccatagaatacgcgaatgtcacgtatgattatggaatcgtagacgccggaagcgtcatcggaaaacctgccaataaccctgtacaggtaaagacaggcgcagacgtacccatgccggaaatcagcgcgcacggatacgaatttttgggctgggcctacggaggcacggtcacagacgcgctcaagatgcccgctatggatattacgcttacggcgcaatggaaagaaataaaatatggggtaacgtttgcggcggcggcaggcggaagctttgcgccggacgcgcaaaccacctttggcgatatctcttacggtactgcatggagcagcgcgctcacagcgcctacccccttgccagacgaagggtactattttgccggctggagcgattcgtttcctgctaaagtgacggaaaccaaaacctatacggcaaagtttgaaaggttgatccccgttaccctcacggcgaacagcaaaaccgtgaattataatggcgaatcgcaggtcctgactggtttcacaggaacgccgaaaggaattaccgtaacaaggcttaccgcgtccggaaacggaagaaatgcgtcggaacccgcgtaccaggtcatattccaggggtcgcccgtatttacggatgcaaatggaaacgatgtaacggaccattataaggttacctataggaccggacagctcctgatcaaaaaagtccccctcaccattacggcaaacaacgcccaaagaatgtatggggagccaaacccgcagtttgatttttcggcgaacggttttcagggcgcggatactgcacaggacatcggccttaccgtaagctattcctgcgcagcggatgaaaactcgccggcaggcagcaactatcctgtcatgccttccggcaaagcggaaagcgtcaactacgtcatccggtatgaagacggcaggctcgatgtgctcaaaagtgataagctcgatgtaacggctgtgccttacgctggaacctatgacgcacaaaaccatgcgggcctttccaatgtggcggcaaatataacaggcggtaccaacattacatatagtacggatggcgtaaactataaggacgcggtcccgcagttcaaaaacgcaggaagttataccatatatgtgaaagcggaaaacgccaactacgaagacgctgtacggcagtttgaagtcgtgattgcaaaagcgccgctcaccattaccgccatggataaatccaaagcggaaggcgaggccgatcccgcgctgaccgcagccgtagccggcctgaaaggtgacggcgcgctgtcctatacgcttcaccgcgaggttggggaaacagcaggcacgtatgcgattaatgttttcgcaattgacgacccaaattatgagattacgcttataaacggtacatttaccatccaggttgttcctgttacccctgacgatccgaacaggcctgtttctccgcctgttacgccggcagaccccggtcagggaactggcggcggggatgtcccagtggttccgcctgttacgccggcagcgccgaatacgttagcgccggacaccgctcctgttgcagcagctatactacagcaacctgcaaccgcaaatacgcaggatgtgctcatccccgagcagcagacgccgcttgcagccggaacggcgcaggatgatgcacaagaagaagtgaacatcgaagatccgcaggtaccgctcgcgtccggaagcgatgcgctcggtaacgcccattgggcgcttttgaacctgatccttgcgatcgcaacggcaatcgtcatgatcgtattgctcatcggctacttcatcggtaaaaaacacaagaaagaagacgggcaggaagaggaaaaccaaataaaacggcgcggcatcgcgcggctgttgagtatcctgcccggcgttggcgcggtaatcgccttcctgctcacggaggacatgtctctgcccatgcagtttacggacgaatggacgctgctcatggcagtcatcgccatcgtacaggcggtcgtcatattctttaccttcaaaaagcacaaggatgaacagtcccaggcttccgaaacgccaacgatttaataaatacaaacaataaaaggcaatgcatgcggcattgccttttattgtttgcaccgcttcaaaatttgttataatttaattaaacaatacattgggggaaactatgatgccgcaggaaaagcttgattacaagaaagaatataaagacctgtatcttccgaaaacaaaacctgtgctgatcgacgtacccgctatgaactttattatggtggacggcaagggcgcgcccgagggggaggaatacccacaggcgatgcaggcgctctattccttaagctttaccatcaaaatgagcaagatgggcggcatgcagccggacggatactttgaatatgtcgtgcctccgcttgagggcctgtggtatggcgacaagggctcctttgaacaaaacgaccgcgacgtctggctgtggacgtccatgatccgccagccggagttcgtaacacaagaagtttttgattgggccgtcgcgcaatgccgcgcaaaaaagccggatgtagacgtttccaaagcgcgctttgaaaccttcaccgagggtttgtgcgtgcagatgatgcatatcggcccttattctgaggaacccaccaccataggagccctgcatcgtttcatggaagaaaacggccttaagaacatgacgggtaatatccgcaaacatcacgagatttatctgggcgacccgcgccgtgtttcccctgaaaagttaaggaccgtgctccgcctgcctgtggagaagaaataagccggaaaagcaaatgtcaaaaacaaggctggaggcatttacggatgcggtaatcgctatcatcatgaccatcatggtgctggattttgtcgcccctgcgctgccgacatttgccgccctgtgggagatgcgttataaattccttatctatattttgagcttcgtatccctcgccatctactggaacaaccatcaccacctgttccagatttccaaaattatcaacggtcgtattttatggcacaatatggcctttatcctttgtctttccctttttccctttgtaaccgcatgggtggacgagcaccttttcgaccgtgcgcccgagatcacctacggtatcgttatttttctcgcggacattgcctacgcatttttggcacgcgcgcttgtcaaaacaaatgggccggattcggagatcgccaaagccctgagggactcccagaagtctaagatcaccttgtgcatcatcggcgcaggcctggccgtgggcttctttgtaccgcttgcggtcatcataagcgttgccgcttccctcgttttgtggattatccctgaaaaacgaatcgaacgccgcttttcttagcccttttatttatcccctatgctttgcagccacgcggaaacctctttccgcgcttttgtgctgccatttccatagatctcaaaggcgggcagcaatgtagactgcgggcacagcgtttccacatcctgtgccacccgtgctaatccgccgcccccatgcgtacaaaaggggatcacagttttccctgccagatcacattgctttaaaaaggccgcgacagggggcgcaatggtactccaccaattcggcgaaccgacaaagactgtatcgtattgttccaatcctgcgtggtgcgtttccagctcaggaaggaaccctgcgccgatttcctgttttgcctgttttacgactgcatcgtaggctgccgggtacggcgtttggggcctgatctcccaaatgtcccctcccgtctcttcgctgattaattgtgcgatcgttccggtatttcccgaatgcgaataatacgcgatcaagatactattttccatgtgttttccttctttcgttattttatatccgggcttgtagaaacctgccgctttatcaagcataccttctggagtgcactccaagtcaaacacttttttatgcaaacaaaaaagccgccttgagcggcggctttttactgcttcttatttcatcaacgatttcatataattggcataccccgcgaacgcaatgcccggttcttccagggaaagatcccagcgtttcagccactccagcgaataatacccgccataaccgatttgctccaactgctcaatacattctttgacaggcaggtcgccgtatccaaccatcgtatatttcagtttttcatcttcatatatggaatctttaatatgcacgtggcggatgaggtctccgatctcccccaccgtatcagcaggtttttcgtggaaataacgatacggatgatggatatcccataacacgccgatattaggctcgcctgcggtatccacaagctctgccatcctttgggaatcggcaaaaaagccgttcgtctccaccaatacatcaatgtccatcggctttgcatactgcgcgaccgccttgatttggcttgcaatcgccgaaatgttgagctcgctgctctgttcgggtccaaaatcgcccagaacacggatatatttaatacccatatcgtttgctgtatccacataagccttcgcgagatacaccacgtcgtcgatatggtttaaatcattcatataacaagccgaagtaaggcaggcgattgtaagtcccttgctttccagcagctttttcgttttttcagcgtttgcaggtgaaaactccggaatgcgcgttccgtcgatcacatttccgacgccgcggatttcgatgccgtcataccctaaatcgcatgctgtggatataatatctgaaaagctccattcggggcatcccagtgtagaaaaacaaagcttcataatttgcttcctccattgctatcttatcaatattttaacataaggataggccgattgcaattctacgccttgcaatcgaccacgccgtcgcaggcttttgtgctgcccgctttgcaggcatattcgtaatattttattttctggttgatttttttcagatgcccttttagctgctccatctgctgctctaccgcctttttctgatcctcaaaaagccttaaccgcttttcgagcgtagtgtcgccctcctggtaccaatcgatataagtacggatctccttgatctgcatacccgtgctttttaagcaattgatgatggaaagcatctccaggtcatggtcgcaaaacgcacgcttgcccgactccgatcgcccgacaaagggcagcaatccttccttttcataataacgcaatgtatagacggataaacccgattgcttggccgcttgtgaaatcgaataagtcattttatttccctccataaatttatgcttgacttcgagttaactcgaggttatatgatattattatatcatatatgcacaaaggagtgacgaaaaatgcaacgattcaattattttatccctacgcgcattttgtttggagcgggaaggctcaatagcctccataaacagaagcttccgggcaaacgcgcgctcatcgtaacgacgggcggtacttccgtcgtgaaatacggttatttaggccgtcttgaagagcagcttgaaaaagcggggatcagctatgtcctgtataacaagatcctgcccaatcccatcaaggagcacgtgatggaaggcgcgcaggtatgtaaggacgaaggcatcgattttgtcatcgggcttggcggcggcagcagcatcgacgccgccaaggcgatttccgtaatggccacaaacaaaggcgattactgggactatgtcggcggtggcagcggtaaaggcctgcccgttccaaacgacccgcttcctgtcgtggccatcaccacaactgccggcacaggcacggaagccgatccatggacggtgaccactaaaacggataccaatgaaaagatcggctttggctatgacaagacgtttccgatcctggcaatcgtcgaccctgaactgatggtcagcgtcccgccgtacctgacggcctgccagggttttgacgccctgttccacagcacagaaggatacctcaataatacaagctatgtgatgagcgacctgtacgccctgaagtctatcgaattgatcggcaaaagccttgcgaaagcagtcgcagacggaaaggatatccaggcacgcgaggatgttgcccttgccaacacactggcaggcatggtggaatccacctccggatgcacttccgagcatagcttagagcatgcattgagcgccttccatccgaaccttgaacacggcgcgggactgatcgcgatcagcaaggaatattacacgttcattgcgcagaccggcaagtgcgaacagcgcatgatcgatatggcaaaagcgctcggcaaagcggatgcggcttcttccatggattttgtcgacgcgctcgtttcgttgcaggcagcgtgcggcgtcgatgacattaagctaagtgaatacggtattacgccagacgaatttgcgacatgcgtaaagaatgcacgcgaaacgatgggcggcctttttgaggttgatcccgtggaaataaatgacgaagccgcgcttgcgatctatcaaaaatctttccgctaaactacgggctacaaggggttcccttcatggggactccttttttgtaccctgccggcaagttgtttttaacgatgaaacgtgttaccataagtataaccgagtgacttttgaggtatgctttgaagaaacggctgtctatagagtgaaaacaatatgaaaaaagaattctccaatacatcgtcagtagacctggaatatagtttgctgatgaattctttcggcgccagcgtaagcaagcatttgctggacgagcattataccgttgtttgggcgaacgaccgctattacgaaatgttcggctataccaaaaaagaatatgaatcgcttttccacaaccagtgcgatttgtttttcaaacagaatccgaaggattggcaggacatggtggagtatatcaccgaggtcttttctaccggcgcgacgcggtatgaatatgtctgccggatgccccaccgcagcggcaaaaaattgtggatcaagctgatcggcaacctcacgggagagatcgtaaatggttgtcctatctcttattctgtgatgatggatatcacagaacagatgcagctccaggccgaacggaccattacctacaacaattttccggggctgatcgccaaatataaaatgacaggagacggaatcgtttttatcgacgcaaacaataaatatttccagaaactcaaccagcattcccacttttcgcttgaagacctgacgccggagagcgggtttagcgcgatcgttccgttgtggccggatatccgtcagggaaagccggtctcctttacgatctccccgccaggcattgacggaaacccgctttacatgcgcgtaacggccgaatgcgtggattgggaaaacgaggaccccgtctatcttttgatttatgacgatattacgcagctcaccgagcagcaggagctcttgcagcaaagcaatctggaattggaaaagcttgcctacgaggatcctgtgacgggcggcatgaaccgtttgcggttcgatatggtcgccggcgaagcgatccgttgcgcggacgcggattcctatgcgctcgtatggctcaacatgcagcgtttcaagctgatcaacgatatggccggaaacgaaatgggcaacgcggtgctgcgttatgtatatgataggctcagctcacatttgcacgagggggaattccttgcacggatcactgccgacaattattccctgcttttaaagaatgcagatgatatcaccctccaaagccggatagacgagatggtagcagacgccaaccgcttcaacgagcagcgtaaaaacaaatatatcctgtcctttacggcaggtatttaccgtatcttcgatccttcgctggagatcacgcagatacaggaccgggcacatgttgcgcgtaaagccattcaaacgaagggcctcgacagcttatgcagcgttcggttttacagcgaagacgaccgcaagaagctggtgatcgaaaagaacatagaaaataagatgcgtaccgcattggaaaatcgagaatttgaaatatatctccagccgaaattttcattggcggataaccggatcgcgggagcgctcgtgcgctggaacgatccgaaacggggaatgatcccgccaaacgagtttattcctgtctttgaaaaaaacggatttatcgtggagctcgaccattatgtaatggagagcgtatgcatattgctgcgttcatggatcaaaagatgccttacgcccattcctgtttcggtcaatgtttcccgcatccattttggagtgccggattttatacaagcttatgccgatctttgcaaaaaatatgatattccaacggatttgatcgagatcgaggtcacggagaccacggtattcgcggatcctgccgccttctccaaaatcgtcgaacagatccatgggcatggcttttcctgttccatggatgattttggcagcggctattcctcgctcaatgttctaaaagatatttttgtggatacgctgaagcttgaccgcgcgtttttcagttccaagcaaatggataacccgcgtgagcgcgacgttgttaccgccgcggtcaatctcgcaaaaagccttcatatcaagtccgttgccgagggcgtggaaactcctgcgcaggaagaattcctcaggaaggtcggatgcgatatgatacagggtttcgtattctcgcgcgctatccctatagctgcatttgaaaagcaggcatttggaccagcagtacaatcctgatttattttttctgcttctttttcatttttttcatacgatacatggcttgatccgcccttcgcataacatccgcgagggttgcatcgctttgcgtaccaaaaaccgcgcatccgatggacatccggacaggtacgccgcccttcgtcgtgcaatccgcagacgcttcttcaatcgactccgcgagagcgttcaggccgtcaaggtcgcttccgcgcacaaaggcggcaaattcgtccccgccgatacggtaaaggacgtccggcgggcggataaaacgctgcgcaaggctgcttcctgcgcggatatactcgtcccctgcggcgtgccccaacgaatcattgatccgctttaggccgtcaaggtccatgactatcagaccgatcccctctttattcggcaacgcttccagattatgaaacatgacgtcaaacgaattcctgttgttcagtcccgtaagcatatccgtattcgcaaggtcgcgataggccggatttgaaatccgtttgaacaggatcgccgcgatgattcctgaaatgacgcagcacagaattatgataattggcgttgccagcgcaagccaccggaaggtctggtattggtgctccgcatcgaactcgagccccaccacccctacaatgcttcctgcatcgctgccggtgcctgcatggatgggaaagtacgaaataaaaatatttccccaggaagtatctttgatttgctcgggcaacacgatttcgccgcggtatgccttctcgatatccggaatgatttcaggttcgatcaaatcgcccacgtttcggaaatcctcgctttccgaaggcaggccgtccacaaggtaaatgtattcgcctgcgtcgtttaattttgcggtataaagataccgtacgcccgtgacggatttgatattattgaacatctctttcattttgagatattcttcatcctgcatatcgcctttggtattaaggctttggaagctgtcctcatcgaggttgtcttccaggtaatcgtaaatgccccgcgcccgatcctgcaggctgtcgatcatatcattataggaaaacgtataattgatggcaaatatgaggatacaggaaagcaccaccataacggctgtcaaaataaacgcctgtatatcgactctgccgagccttttctgcttcttcatcactctttccgcctgtccggtctgtctttttcaaatacaagccttgcaaattcatccacaggaacggtcaaaactcatacaacgatccctcttttatacattaagatttttgatccggtatttatataatcccttagttgtgttgtatagtatagtataatgatttttccagccagattcaataaaacattcttaaaattagcttccctataagaaaaagggctatacccgaaaaatacgccggtatagccctgatttttttctcttgctaaagtttatcgcccttcagatcgtctgttcaaactctgtgagcgccttgtcgaactcctgcatacatacgtcgaccggtttgccgctcgcaaggtccacatgcgcgatcttcaggaggttgagcggatggtcgctgccgcccgaggacaggaagcggatgtagtcgcgcaccgcgtttttcttaccggataaaatatccgaggcgatctgcaccgcgcacgagaaacccgtcgcatatttatacacgtaaaacgcattgtaaaaatgcgggatccgcgaccattcataggaaatgatgtcgtcgcgctgcatctgcggcccgtaataaagcgcattcaggtccccatacatccggcacagcacctcatgcgtcagcgcctgaccctgttccatggcgctgtgcgtcattttctcgaactccgcaaacatcgtctggcgcactaccgtggtgcggaactgatccagataatggttgagcacatatttgcgcgcctttttatctttgatcgtatccagcaggtggtgtgtgagcagaatctcgttgaccgtgctcgcgacctccgccacgaatatctcatagccggcctttgcttcgctctggtatttgttggaatggtaggtgtgcattgcatgccccaattcatgcgcgatggtgaatacgctgtcaaggtctccgcggtggttcagcagcacgtacggatgcacgccgtaaacgccccatgaataggcgccgctcgttttgcccggcgtttcgtatacgtcgatccagcctgcgtcctgggcctcctgcaacaatgccgcataatcgtcgccgaggacggccagcccctgttttaccatctccatggactgctcgtaagaatattcgccatgcgtttcttccgcgagcggcgtatagatatcgtacatataaagctcatctagtttgagcgcccttttgcgcacgtcaacatagcggtacatggtgggcaggtttttgtggatcgtttcgatcaggttatcgtaaagcgcgacaggcacattgtccgaaaacaaagatttttcgagcgcgcttgggtatttgcgtgcgcgcgcataaaagacgtcctttttgacgcttgcagaataggccgcgctgatcgtattgatcatgccctgataggatttatagtaagttttataggtgttcttgcgcacctcgcggtccgggctttgcatcatcacgatgtatttcccgtgcgaaagcgccacccgttttccgtctgcgtccttcacgctgccgaattttaagtcggcgttatcgatcatcgtaaaaatatccttgggcgcgcctgcgatatccgcgctcatggagagcaacttttcttctttgccggaaagcacgtgctccttgctgcggatgagctcctttaacataaaatcgtaatccgcaagcttatcgttgccttttacattgttgtcgcacttcttgcaatgaccaccctttttgcacgtcttgggatcgcgtccgtgcttgcagtggtctttcgcactttcgatatatccttcgagcactcccggctttaaggcgagcaaagcggggtttacaaacgaaagcgcgctgccgaggcgtacatttatgtccatcgcgcgcgcggtcatcgcctggtaagttgtgttggcgttgttttcgtcgcggcgcatacgtgcgtacacgaagaggttgcccgcgatatgctccatcttttccattgctttcaatgccttggcaagactctttgcatccttggtcaacgtctttttgatgtccggtatccccttcatcagttcttcaagggccgcataatcttcttcccacgctccgtccgacggataaatatcctccagcacccatttatattttttttcaatttggtctcttgtcttttcactcatcctttttatctccttttcctgagataataataaacttttcctgccgcgcgtaacgcgtcaatttctctgtgcgtgcagcggcgcgggtatcctgccgccgcgttctataaactctttgggggaatttgtattatacggcatgatgggcgcacgccccaacaagccgccaaagcttacggattcgcctaccctctttttaggaacggggatcaggcgtaccgccgttgtcttggtgttgaccataccgatcgccgcttcatccgcgatgatcgccgcgatcacataatccggcgtgtcgccgggcaaagcgatcatatccagccccaccgagcacacgcacgtcatcgcttccagcttggaaagtgttagggcccccgtttccaccgcatgaatcatgcccgcgtcctcgcttacggggatgaacgcgcccgaaaggccgcccacatgggatgacgccatgatgccgccctttttgaccgcgtcattcagcagcgcgagcgcagccgtcgtgccgtgcgcgccgcatgtctcaaggcccatctcttccaaaatatacgccacgctgtcgccgatcgcgggcgttggcgccaacgacaaatcgacgatgccaaagggaacgcccagcctgcggcttgcttcgcgcgccacgagctgtcccatacgcgtaatattgaaggccgtgcgcttgatcgtgtccgcgatctcatcgaacggctgtccttttttgttttccagcgcgactttcaccacgcccggccccgaaaccccgacattaataacacagtctccttcgcccgtaccatggaacgcgcccgccatgaacggattatcttccaccgcgtttgcaaacaccacgagttttgccgccccgataccgtccttgtctgccgtcaattccgcgctttttttgataatacgccccatgtgcgctacttcatccatgttgatgcccgtgcgcgtggtgccgatgtttacggacgaacacaccaaatccgtctgcgccagcgcgtcaggaatcgtatcgataaattccttttccgcatttgtcgccgccttttgcacaaaagcggaatatccgccgataaaatctacgccgacctcttttgcggcccgatccattgcctttgcaaagaggatatactctccgcagccctgcgaaataagcgatatgggcgtaacggagatccgtttgttgacgatcgggatgccaaactcgctctcgatcgcctctcctgtgggcaccaaatattttgcctgccgcacgatcttttcgtacacgcgctgcgcgcccgtttttgcgtcatcactcacgcagtcaagcagagagatgcccattgtgatggtgcggatatcgaggttttgtttggagatcatgtctattgtttttaagatatctttttgatttatcatcatgcgcaccgcctgctatatcctgtgcatgctattgaatatctcttcgcgcatcagtcttatttccatgccgatctgctctcccgcatcgtcgagcatcgttttcaactgctcgaaggatgcgtttaaagcggataagtcgatgagcatggtcatagcgaaatactcgtcacgcaatactgtctgcgtgatatcaaggatgttcgcattcacttcaaataatgtattcgatactttggcaatgatgcccggcttgtcgtgtcctaagacgcttacgatcgctcgcataactggtactctccttttgtcgtttcaactttattccgctttttgcggatatttcttctcgtattcatattttgcgttctggtaggtatgataggtaaacgcataccagaatggcaaaatcaaagtaatcagcacgatagccgccagcgccagcaggatgacgaataccataagcggatccttgagcgcaagcatcgggtccacgaggtaaagctcgtaaagctccttgaagggcagttgggacagccaattgatgaccactccgcccagcgccacgatgagtgccgccgtcaatatgcgtgtaaaattgctccaaaaatttcccaaaaacgcataccggtacgatgtgaacaccgcacgaaaaccgctctttccctggatcgccaccgtgtacggcacaaagacaatgccaaacaccatgaaaagcacgaccagcagaatcaaaacgagcgctactgtttcgcccggcggaagggcctgcatcaacacgccgccttcaaacgcgccgatgccgatcacgcataccgcaagggcaataaccggaaccagcaaaataatgatcgcaaaatacgacttcagcatgttgccgtaccgcttctttgcatgcatagcagcctccttaaaggtaacttccctctcatggtaatcgctgtcgatcacatatacaacattggaaaccatgaacggcgacacaaataccgccacgcaaagcacgatccccagcaccgaaagcacagaggataggctgctcccgcccgtctgcgagagcgtcaacaaaagcgaacgggcgacagataccgtccccggcatcgtaaaaaacatcaagggaacaagcagcacaagctggaacagcaataacggaacaaacagcctgccgaaatttttcttataggcatatgcagatcgtttgaacatctggccaaagcccataggtaacttactcattttccacctttttaccggcaatacaccataccgtctcagagcggcgcgtcaggcgtaaaccatttgctccccattgactggtaccggtaattgttgattgcccggatcgccttttccggcgtgtccacaacctcgtaaaccgtgagcgcctcgcgttttgcgaacctttgcgccacacacttttcaaacatcgcgatcatttcgtcaaaaaagcccttcgtattcaagatcacaatcgctttttcatgccgtttcaattgctttagcgtaacgacttcgcacagttcttcaaaagtaccgaagccgcccgccgtcacaacgaatgcatcggccatttcttccattacaaatttgcgttcccgcatggatggggatatgatcaactcgtcgcattgttcaaacggaatgcccggcaggttcataaattcggggagaacgcctgttattttgccgtttcctgccttgacaccgcgcgcggcatgccccatcatgcccatgtcccccgcaccgaaaaccatttcccatccattttcagcgatcagctttcccagcttaaacgcatcgtcaaaataaggttgatccaacacggaagaggatgatccgaatacgcatatctttttcattgttacaccctttcctttcgcactaaactcttttaaaaatcgtcttttggtaccgtttcagcagaaagaagagcggcattccgaccgcgtaacatgcgacggcctgtcccgcgcctaccgaaaggacgttgatccaataaggaaatggggtctgcccctgcgccaccagcacccatgccaccaaaaatgcgtttacaataacgctcggcaggggcagcagccatttgcttttgttgcggatcgcccatgtgataagcgccgctatgagcgtcgccaggcttcccaccacgatatccatcagtccaaggcccaccgtataaaggttggcgagcaggcacccgataaataatccgggcactgccgcaggcgtaaaaaacggcagaacacaaagcgcttctgaaacgcgcacctgtatcggtccatagctaagcggcgccaataaaagcgtcagggcggcgtaaatcgccgcaatcaggcttgcctcgcacagaaaccgtacctttgatactttctgcataattcccctcaacattaaaaattaaatacagtatagtatagcacatttttcgcatgaataaaaccgctctgcaacttgaaatgactatgggcggtggtatactataatagtattgtaaaattttttgaaacggagtatctgtatgtttgactaccatgtccattcgaatgtatcgttcgatgcctacgacagtatgacggtctgcgcgcgggcggcggcggacaaaggttttaaagagatttgttttaccgaccaccacgaacttggatatccgtatgaagaagataagccggagtttgattttgacctttatttcagcgaacttaacaaggcgcgcagcgccgttccggaaatcaaaatacgcgcgggcgtagaagccgcgctaatccctgactggctcgaccgcatcgcggaagacatctcaggccgcggttttgattttgtaatcgcctcccagcatacggcgcttgggatggatccttatttcggcgaccttttccccgggcgtacgctccgccaggcgcaagaagcgtaccttaaggaaatgtgcgacgatcttcaaaacttcaaaggggattacaacgtgatcgcgcacatcggctatatcgacaaataccttgataaatgtgagcttgcccccgacgacgcacctttccagtataaggattttcccgacctgatcgatgaacttctgctcaccgccatcaacaaaggacggggcatcgaggtgaatacgagcaactattatatccacggttatcccacgccccacccgacgatcattaagcgttttttcgaacttggcggcgaggtcgttacgctcggcagcgatgcgcacagcgccgacgtgatcggtcataactttaaagaagcgcgcgaacttttaagaagctgcggcgccaaatatatatgcagtttcgaggcaatgaaaccaacctttgtgcccatcggctaagcgcggattttcgctcaatttcctcaaagcatgacgttttatgcatatgcttttgcgtttatatatagttcataaaaaaatgatataatgataacaaaaaatcagcgcctgcccgagggccggcccataacttaattgtaaaaggagaagatttatgccgttttttctatggttcgactggacctggctgatccttattccagcgtttatcattacgatctgggcgcaggcaaaggtcagctccgcatataaaaaatattcggcgatccccgcgcaaagcggcgttaccggaagggagtttgcccagacgatgctgcgccaaaacggcgtggacggtatccgtgtacaggcgatagaaggccagatgacggaccactttgatccgcggaacaatacggtgagcctttcggagggcgtttataacaaacatagtgtcgccgccgtatccatcgcggcccacgaatgcggccatgtgttgcagcgggtccaaaaatatgggcctatgcgcgttcggaacgcgatcgttcctgtcgtcaacatagcgaccagcctcgcgtttccgctcatcctgatcggccttttgttttcaacgatgaagattcttgtggatatcggtgcatgggtatactttgcggtcgttattttccagctcatcacgctccccgtggagttcaatgcttccaaaagggcgcttgccaatattgaggcctcgggcgtgcttacgttgcaggagcagggcgaggctaaaaagatgctcagcgcggctgccatgacatatgtcgcggccatgctcgcctcgtttctgtcgttcttgcgtttattcctgctttcaaggagaagatagtaaaaaaatcaaaaacgggagtcaacggctcccgtttttatgtcatacaagaccgtgcgatcaatactgttcctaccgcccagaggatacaaaagagcgggatcacgatgcaaaagctgatatgccttgtcttgtgccggaagcaaagcatccccacaagaaagccaaacgcccctccaaaggcggcgagcaaaaaaagagtgtgctcgggtattcgccggttagcccttcgcgcggcgcgtttatctatatagcatgtgataaaagcaatgatattgattgcaaacaaataaagaagataatatcccatgatgcatgtattatagcacggcaaggaggttcattgctatggattctttaaaagcatctaagccgctgccgctccagggcgcatataatgtgcgcgaccttggcggttatcccgcagggggcggcaggctcacaaaacataaggcgtttctgcgcgccgacagtcttgcaaacctgactgcagacgaccgaaaatttttgtatgattatggcgtacgcctggtaatcgacctgcgttcggagatggaaaccaaacggaatcccgacgcgctcgattcccaaatggagtattttaattttcccttgatggacaatatacagtctaccctgctcaagggtcagatgccgcatgatatgtccgcgatgtatatcagccttgtcgaaaacagcaaaaccacgctggccgcgatcttccgcaaaatagcaggggcggaaggctgcgtcctttaccactgtaccgccggaaaggaccgtacaggtattgttacgatgctgctgctaaaacttgcaggcgtcagcgatgagctcgtccttgccgattacagcgttacggagcagtatatgcagcccctgttcaaaaagcaaaagcaaatggtggaagccgccggtatcgaggttccggattttgttttccagtcaaagcccgaatttatgcaaaagcttcttgcatatctgcaacagcattacgaaactcctgaaaaatatttgctgcaggcaggccttaacgatctgacgatcgaacaattaaaagaaaagttagtataacagaggtagcggtatggacgcattatccaaactgccgaatatcggcaaggtagtggaacaacagttaagcgaggtcggtatccaaacggctgatgaactgaaagagatcggcagccgcgacgcatggctgcggatcagggcggtcgatccgtcagcttgctataacaggctatgcgcccttgagggcgccatccgcggcatacgctggcatgatcttcccgttcccgtaaaaaaggaactcaaggagttctatacatcggtcaaataatggatgtgcataagcggcgtgacggtttgcgtcatgccgtttttgatattgggaaatcatccccacaatgatacggaggaaacgcgatgcttgaggttgtattcagcgacagcgcaaaaggctctatgaagttggcccagaattatgacgaaaaaagtatgcttggcggcgcgataggctttattggggaaaggccgtcaaaaaccgaactcgaaaaaatgttccgcggccaacccctcggagggtcgtcggcggatgtcgtcaatatcggttttatgctcgatgtcggcgacatatccggcgaagtggacgggccggaaagacaggatgtttttcatacgctgtggggcatgcataactttagcagccgcgagtgcgaagcatttttccgcgatcagcgcgatgatgtcgaaaaactccttttggcggcgcaaaacgggaaccccatccgtatctggacaagtaacgcgccctattcggcttgtggattttattatacctgccacctgctccgcaacatcgagtgcgaaatgtacgtgatcaccatgcctgccttcgtttcctgccccgaagacgaaaccattacggtttcctatagcgattggggcgaggtagagccggggaaattctatcgctttctgccctttgaacaaaagctgccgtcctgtgaaaaatatgcgtatagcaatcactggtgcggcttaatacaggaaaaatctcccctgcgggctgttgtgaacggcaagctgatctcggtacccgagaccttttacgaccatattctttcgaaaagcgttccggacgatgactttgccatgtgccaactagttggtatggtcatgggggaatacgatcttggggtcagcgacagttggtacgtttcgcgtatccggcagatggtaaaggaaaataagctcaccgtcgtcggctgcgcagacaaaacgcatccgtatggagaaattttgcggaaagtcgaggaaacaaggtgaaaagaggcggggggggcggggggcgggcggggggggggagtatatttttgattgaatgagtataacgggatgggacggggcgtttttatttgtgttagggcgaaactacccacaaacgcaacaa

SEQ ID NO: 5 - DNA, 208271 bp, Christensenella sp.
cggaggccggagcggagaagacgaaagagatcgtggcgagcaaagggcgcgcgtcatacttaggcgaccggagcatcaactggccggatgccggagcagtcgccatcggcgttattttcagaagctttgtttaaaacagttttttaagaatacacaataggaatttacataagggaaagcccgtgaaattgtagcaaaaggtatgacatcactacagtgttctttctgttacacattatacggaaaaaccgaacggacaatgatgcaggaaaggaagagaaaaaatgaaaacagttacggaagcaagcagggaagtaccggttttatgcgaagctgacgttgtcgtgatcggcggcggagcagcggggatcggcgcagcactgggagcaggacgcgcaggtgcaaaaacgattttgattgaacggtttggttgcctgggcggatgccagacccttacctttaacgattcattctcgtttgtggacgatcgtatccagggcgggctgatccaggagattatcgacaaattgcatgagggcggcgcggtatataaatcgagcgtaggttcgcataaagcgcactggagcgaaaaagaaggatgcttctattttgatcctgagtattataagttcatgctcgaaaatatgatgaaggatgcaggcgtgcagcttttgtaccatgcgtttgccgcagacgggatccgcgaaggggacgaactgaagggcgttatcattgaaagctggcagggccgtcatgcgattctcgcaaaaacagtgattgactgcacgggcattgcggagcttgcatggaaggccggtgcggagtgtacgggcgaagaaggctacaaagataataaatacggcccgtacaaaggcaggcatatggcgttcggctatggatatttcgtacgcggagtggactataaaaaattccgtgcctttgcagaggcaaatccggaggaatgggacgattgggtcaagggcaggaacctctttatcgaagcgaaaaaatccggcgaactgtattcgttccgcaatagctgtatcttccaggaatatgaagacgggcgcgtatggatgctgagcccgggctatccgatcccggcgggcaaccatccatgggaagcggagcagatttcgcttgccacggtagatatccgtaaacaggcgttctccattctggaattactcaaaaaacatgttcccggctttgaaaatgcgacagtcgagcagacagcaagtaagcttttgcacagggacgggcacaggatcgtcggcgagtatacgatcacagaagacgatatgcgcggaggaaccacctttgaagatgcgatcacgtgctgcaacatgccgccggatccgttcttcccggacggaggacatcatttcaagtttgacgtgaccccatatgatatcccgtaccgcgcgcttgtttccaaggatttcggaaaccttatggcagcgggcggcgcaagctcgatggaccttattacatgggcggcccttcggtattgcacgccgagcgtatgtaccggacaggcggcaggtacggcggcggctatggctgcaaagcaagggattatgccgagcaagttaagtgttccggagcttcagaaagaactgcacagccaagggctggtgacgacaaataaagatttgccggcatccgtggtcgaggaatatgcaaggcgcgaggaagaatggggcaacggcttcggaatgtagcggaaaagcagtacgcatttcggcgatagaaaggagaagaattgacatgaaaacgatattggaagcttctaaggaagtaccggttttatatgatgttgacgtagttgtgatcggcggcggccctgcagggatcggcgcggcccttgcgtcggcacgcaatggtgcaaaaacggtattggtggaaaaatatggatgcctgggcggcaaccagacgctgacgcataacgataattatacatttgtagacgatcgcatccagggcggcatcgtgcaggagatcatcgaacgcctgaaaaaagcgggcgcgacatttaaccccagcgtagcattgatgcgcgataactggaacccgggaacgggctgcatctactttgacgaagaatattacaaactgatgctcgaggcgatgatggaggaagcgggcgtcacgctgctttaccacgcgtcggcggcaacagggattgcggacgggaagacactgcgcggcattatggtggaaacgcatgaaggccgcagggcgattcttgcaaaatccgtgatcgattgcacgggtatcgcgcatatcgcgtggcaggcgggggcgtctgtgacaggggaagaaggatatccggacgacaagttcgggcctttcaagggcatgcacatgggattcggttacggattctggatgtgcggcgttgactataaaaaattccgtgcgttcgcggagcaaaatgaggatgaatgggattattgggtcaagggcaggaaattattcgtgcaggaaaaagaagccggaaggctttacaccccgcgtaacagcacgctgatgatcgaatatgcaaacggacggtgttggtttatcggcgcatacaagccgatcgaaaagggtcgccatccgtggatggaagaagacctgagcgaggcagagatagaccagcgcaagcaggcatggtccattctcgaaacgtttaagaagaacgtcccgggattcgaaaacgccaagatcgaacagactccggtcaggttgctgctgcgcgacggccacagaatcgtgggggaatatacgattacggacgatgatatgaagagcgcgcgcagtttcgacgattccatcgcttgctgcaatatgccgcaggatccattcttccccaacgcaagccatcagtttatttacaatgtcactccttacgatattccataccgcagcatgctttccaaggattttgacaatttacttgcggctggcgggtcggcgtcgatggaccttgtaacatgggcggcgctcaggtactgcacgccgagtatttgcacaggacaggcggcggggacggctgcggcgcttgcagtgaaaaaagggatcacgcccaaggaaatcgatgtgaagcaggtgcaggattcgctgcacgagcaagggatggtaacaaccaacaggcaactgtcacccgaagtgatagaggaatataaatggcggacgaaaacatggaacagaggattaaaactttgatacagaccaaagaatccggccatgggagaagaattgcctgagactaaatgatttggaggaatgtataagatgattctccgttttgagaatgtaacaaagtactttggtggtttggccgcagtaaaagatgtttcattcaacgtagagccaaaccagatcctggggctgatcggtcccaacggatcaggaaagacaacatgctttaacctgattacgggagtccataaaccgaccagcggaagcatcgtattcaacgagaaggaaatcagcggcttaccttcccacaagatcgcgcggatgggcgttgcacgcacattccagatcagcagtgtgtttccggacctttcagcagtggaaaacgttgtgacggcgcaccattgcaggatgaaatcgaatttcgtcacgggggttttcgggatcgccggtacgctcaaggaagaaaagcgcgtcgcagagcatagcgaagagctgctggaattcgttggactcaaggaaaaaatggcggtgcgcgcaggatcgctcaccagtgcggaccagagaaggctgatgatcgccatcgctatggcgaccgatccaaaacttttgatgctggacgaaccgtgcgcaggtatgatcgaagacgagcgtgcggacctggtacatctgatccgcaaggtatgtgacgggggtattcccgtactgctggtggagcatcatatgaagatgatcatggaagtatgccaccatgtcgttgtgctgaatctgggcgaaaagattgccgaaggacggccggaagaaatacagaagaacgaagctgttattgaagcttatctgggaaggagtacaaaacatgcttaaagtcaaagaccttgtaacttgttatggaagtattgaagtattgcatggattgtccttcactgcagagacagggaaaataacggtcctgatcggaaccaatggcgcgggtaaaacgacgactatgaaaacgatcatgggcatgatgcgcgcgaaaagcggcactatcgaatggaacggaacggaattaagcaagatgaaatcgcatgaggtcaccaaaagcgggctgtccttatgtccggaaggccgacagctttttccggagatgacggtattcgaaaacctgatcatgggtgcgtatacgcgtacggataaaaatgagattgccgattccattgaagaagtattcggttggttcccaagactcaaggacaggacaaaccaacaagcagggacgctgtccggcggcgagcaggagatgctcgcgatcgcgagggcactgatggcaaagccggagatgctgatgctggacgaaccgtcctggggacttgcaccgatcctggtggaagaagtaggggaaattatcaagaatataaacagccgcggcaaatccgtgctgcttgtagaacagaatacgcaaatggcactggatctggctgattatgtttatgtgttggagacgggagatatcgtcatcgaaggtacggcggaagaattgtccaaggatcagaagatccaggaaacgtatctcggtatctgacacgtccctccggggacaaggaatacatcaatattaaaaggagggaaattatggataatgctatacttcttcagcaaatcgtgaacggcatcgttacaggaagtatttacaccttgatcggtatgggattatcgcagatttacggaatcctcgggatttcgcactttgcccacggttctgtcgttatggtagggggttatatcggatatacctttgccaggatgctaggcgtaccgtggatcctcgccgcaattcttgcaattgccggatgcgcgcttttgggaatgtttttggaaaaatattgttacagggtcatcatcaaaggacccccgatcaatatctttatcctggcgcttggactgctcttcatctttgagaacctttgccagatcatctggggaccggatccggtatctatccaggcggtcggcaacacatcgatccagatcggaccgatttcgattacgacattccgcctgtacgttatcattattaatcttgcgttgatggcggtgttggcctttatgatgaagaagaccaaacttgggcgttccatccgcgcgatggcacagaacagggaagcggctacgatggtaggcgtaaacgtaaacaaaacaagcggcgcggttttcgcgatcggcagcgcgctggcgggcttgtgcggtatctttgtaacgagcctgctgcagatgttcccgtcctatggcggcgacatcgtaatgaagggcttcgcggttatgatcttaggcggcctcggcagtattcccggcgttatcgtcggcggcctcatcatgggtattgtagaaagcttgggcgcagggtttatctctgccggatataaagacttgttcggattcatcatcattatcttggtgctgatcttcaaaccaaacggtttattcggcaaacgtggcgcggctactaaataaatgattagaacagttttctgaaaagaaaagagtaaataaaaatacaggaggattgaaaggaatgaaaaaaggaaacttaaaagtattggctatacttgtagctgtgctgatggtcgtcgcactggttggtggttgcggcgcaccggcaacacaggaaagcagcgctccggcggcaagcgatggcggagcggcgtcatccggaagtgatgcagcaggtaacagtgataacaaagttctgaagatcggcgtggatgactcccttacgggcacgagcgctccttacggactgccggcctcgcacggcgtagaactggctgcatcggaagtcaatgacgcaggcggtatcaaaatcggcgaagatatgtacaacatcgaagtcgtgacctacgacaataagagtgacgcgacagaaggcgtttccacattgcagaagctgatggacgttgaccaggtgcagtttatcctgggctggagctccagcacgcctacgctctctgccgtacagcaaatccccggcaaagaagttacgatgctggtcggtaacgcgcgttcgccgcagatcctgctgtattcgccggaaaacacgttccgcagcgcgacggcaaactgctatgatccggttgcagactgcacatacatcaaagacgaactgggcgttgacaaggttgcggtcctggcattcttcaacgacacaggctacagcgtacatgcgaacaatgtaatcaaagcgtttgaaagcattggagtagaagtggttgcacaggaaacaatgaacgcaggtgaccttgacctgctcgcacagatgacaaacattgcaaattcaggggcaaacggcttgtatatggccggcaacatcgaagaatccgcaatggctctgcgccagttgcgtgaactgggttccacgatgccgatggttacatattcgtccggtacgggcccgcagtggctggaagtttgcacgaacgagcagatggacgacagctatgcgattcgtccgcaggttgcggaagcaggcggtgaaaacggcaaacagtctgatgaatttatcgcaaaatatgaagcgaaatttggggaaaacccgagccagacggcaacgaacacatacgacaatttctggatcctgatggcggcactgcagaaggccggcacaacggaatggaaagcggtaaacgatgcactgaaagaagtaaaagtagaagacttagaccccagggtgatcgtagaatatacgccgctcgagggcggtctgctgttcgacgacattggccaggcttatcatccttacacagtttccaagtggagcatggatgaacagaactgggcatatgaaagcacgatcggcaaagatatcggaccggacttcctgcacaactatctgaaagaatattgtgcacaggaaggcctcacatatccgggcgcttaacaaaaagcccacattggcaccataatatagacctgtttcggaaggccccgcacgacggggcctccggaacaaaaaccaaaacagcatagacttgggattttataaaaaccaaaatatagatgcaaggagaaaccggacaatgaaaacgattcaagaaagcgcgcgtgaagtaccgttgctttgtgaggaaatggatgtaattgttatcggcggtggcgcggccggtattggagcagctatttcggcagcacgtaatggcgcgaagacgatcattattgaacgctttggtttttttggcggcagccagacggcggccttcgacgattcctttgcatgggtagacgaccggatccagggcggtattgtgcaggagattatggatgacatcatcgcggccggtatgaatcacaaaaacagcccgggacaggtacgtgatcactgggcgaatgaatttggaagcatcttctttgacggagaatattataaatatctggtagataacctgatggaaaaagcgggtgtgaaggttgtatttcatgcgttggcggtcgatgcgatcaccgatggggattccttgaagggcgtgatcattgaaagccttgaagggcgtcaggcggttcttggcaagacgatcatcgactgcacaggtatcgcgcatatcgcgtggaaatcaggcgccagcgtaaccggtgaaaacggctatccggacaaccggttcggtccgtatgaaggataccatatggggcttggatatggctttttcgtccgcaatatcgattaccacaaattccgtgaattcgcgcaggcgaatccggagcagtgggattattgggtgaagggaaaagaactctttacgaaagcacgcgcagaagggaagctgtattccccgcgtaattcatgccttttgacagaatatgaagacggacgcgcgtggatcatcaatccgtattacaaattggaaaaaggccagcatccgtggcaggtcgaggtcgtttcggacgcggaaaaggatatgcgcaagcaggcatggtcttgttgggaactgctgaaagaaaacgtgccgggatttgaaaactcgcgtatcgaacagacgccgtcatgtgcgctcctgcgggatgggcaccgcattgtaggcgaatacaccttaaaggaagaagatatgtatggggcaaggacctttgaggattcggtatccatctgcaacatgccgccggatcttttctttccggatggggcgcaccactttaagttcaatgtgacgccatatgatatcccataccgctgtctcctttccaaggattatgataacctgcttgctgcgggagggacatcctcgcttgattttattacatggggagcgatccgctattgtaccccgagcctgacgacaggacaggcggccggtgctgctgcggcgatcgcagtgaaggacggcgtttcgccaaaggacgtcgatgttcagaaggtacaaaagcagctcaataaacagggcatgctgacaaccaataagcaggtgtcgccggaagtggtggcggaatatgcgcgccgggcagaagaatggggcgacggctttaaaatcagcgagtagttcattacgcaaaagcccttatgattttacacgactgattcatgattaagcttaaggcggcaaccgtccgcattgtatcataaggaaggagaaattctatgttgaaaaaatcgaaaaagaggtcgctgatcaccggcctgtccgcgataatcgtattggtgatcatgttactgatgccgcagatcgttacgacgtcttattatctgcacctgatcattgtgacgttgatctggatcgtgatgacctctggcctcaacattattcagggctatgcaggttatgtatctatgtgccaggttgccttttatgggataggcgcatatgtttcgggcctgctcatgagcaagctggggctttccatgccggtcggtatgctgatggcagtcgcgatcggactggtagtcggagcagcaatcggaatcccgtccctgcggacgaagggacactatttctcaatcgttaccctggcattcacgatgctcgtattcacggtcatgaaagcatggcaacaggtaacggggggcgtacagggcttctccatcccgccgctgaaaggcgattttctgggactgccgctctcttccagagaaggatatttttatattgtgctcattgccgcagtattgacgctgctgttcgtataccgattgttcaaatcgaaaacgggacgtgcgatcgtaaccttgcgggaaaacgaagaccttgcgaaagcggtaggcatcaataccactggaacaaaattgcttgcgtttgagctaagcgcagttctgggatgtatcggcggcgtactgtacgcgcattatatgaactttgtaaacccaacgacgtttgcggcagggattggcatgaatgcgatcctggcggttatgatcggcggctgcggaacggtgatcgggccgattgtcggttcggtggtcgttacattcctgcctgaattgctgcgtgcggcggaactgtacagacagcttgtattcggtattttggttgtcgtaatcgtgtttgtactgcctaacggcgtaatgcagccgatcgtaaaaggcttcaaaaagttgttcagtaaaattacaggcaaagacaaggaaaacattgcaaatatgccggaatgacagcccgataaaaggatcaaaaccagcctccagtggtgtcggcgtgttcgtctgagtggggaacagaccacacaaggtaccaggaaaacccgcttagcaaaagataagcgggttttgtttacccgaaaagggaaagaaaggaagagatgatgcaggatatatatattttaggaagcgtccgcagcgcgattggttcgctgggcgggacgctgaaaaatacaaaagcagtagaattgggcgcgctggtcatacaaaacgcatatgagcgtgcagggatcgccgcatcgcacatagatcaggttttaatgggtaacgtgttgcaggcaggattgggacaaaatcctgcgcggcaggcggcggtctgtgcgggtatcccgcaggaagttcctgcaatgacgatcaacaaggtatgcggatcgggccttaatgcagtgaaccttgccgcggcgctgatatgcgcggggcaggcacaatgcgtcattgcgggcggtatggagaacatgtcgcgcgcgccgcacacgatggatattcgttggggacagaagatgggggatatggcggcaacggattccatgatacacgaagggctgtgggatgcatttaacgactatcacatgggaatgacggcggaaaacgttgcggcgcaatacggcattacgcggcaaatgcaggatgaatttgccctggagtcgcagcaaaaagcgctgcatgcaacgcaggtggggcgttttcaggacgagatcatacctgtgaaaattccacagaaaaaaggcgaaccggttttgtttgcacgggatgaatatatccgcgagacgtcgatagaagcgctaggagcgctgcgtccggcgtttcaaaagaacggaaccgtcacggcgggcaatgcgtccggtttaaacgacggtgcggcggcgatggtggtcgcatcgggcgattttgtaagggagcacaagctggttccgcaggcaaaatgggtaggatgcgcgtcctgcggggtcgacccaaaggtgatgggaacagggcccatccctacggtgaagcgggcgcttcataacacggggctcacgatcggcgatatggacctggtcgaagcgaacgaggcgtttgcttcgcaggcgatcgccgtgatcagggaaatcggcgcgcctaaggaacgggtcaatgtcaacggcggtgcgatcgcgctgggacatccgatcggcgcatccggtgcgcgtattgccgtaacgctactgcatgaactgatcaaaagggatggcaggtatggacttgcaacgctttgcatcggcggcggaatgggtgaagcaacaatctttgaacgggatgccctgtgcaggtgaacaatatggaaacgatcaggttggaaaagaaagacgggattgcgacaatcacgcttgaccgccctaagcagaggaatgcgatcaatgaatgtatgctgtttgagctgcggggaatatgcaggcagataaacggcaggaaagatgtgcggtgcgtagtcgttacaggcagtgaagaaggacgggcttttgcggcgggcgcggatatcgccgcaatggaaaatatgacgtatgggcaagcgaacgaatttgcacatctgggatgtgagacgtttcggatgatcgagcagatggaacagcctgtaatcgcggcggtaaacgggtacgcgttgggcggcggaatggagctcgcgctggcgtgtgatatccggatcgccgacgacaccgcggtattcgggctgccggaaacgacgctcggcgtcatgccgggctttggcggtacgctgcgccttaaggaattggtaggttatgggcgcgcggcggaattgatttttacaggaaaaaaattaggggcgagcgaagcggcggaatacggactggtgaacgcatactttggaaaagatgtgttcgcggcgcaggtgatggagctggcccgaaacctatgctcaaatgcgccgcttgggatacgcaacgccaaaaaatctatgaagcggcataaatatgaaatggaaaatatgtattttgcgcagttgtttttgacgaatgaccagaagacgggcatgcgtaatttcaatcataagaaaaaaacagactatttttcgggggaataataaatgaaaaaaatatcagtgatcggcgcgggaacgatgggcgcgtccattgcgcaggtcttcgcaatggcggactgcgaagtaacgctttgcgacagggcgatggaatatgttgagcggggacgggggatcatcgaaagttccttgcggtatatggtgaaaaaagagaagatcggaatgcggcagcaggaagaaatccttgcacgtatcgtttttacagatgaccttaagttatgtggggacagcgagcttgtcatagaggcggtctatgagagtttgcaggctaagcaggagatttttaaaaacctggaacagatcgtgcaggaggatacgatccttgccaccaacacttcatcgctgtccgtgacggagatcggaaatgttctttgccacagggaacggtttgtaggcatgcatttttttaatccggcgaatattatgcagttggtcgaggtcgtatccggcatgcataccgatccgcaggtcgcggcgcgtatcatgcaggttgcgcgcaaggttggaaaaacgccggtatgcgtgaaggagcatgcggggtttgtcgtgaaccggatactgatcccgatgatcaacgaagcgatcggcgtttatgcggacggcgcggcgagcgcgcaggacatcgacacagccatgaagctgggggcgaaccatccattggggccgcttgcgctgggggatatgatcgggctggacgtagtgcttgcaatcatggaggttttgcaagcggaaacaggggaggacaagtaccgcgcgcatccattactcaggaaaatggtgcgcggcggcctgttggggcagaaaacgggtcagggattttatatctacgaaaagtgagcgtcgcttttctgacggccttggtatatactgaggaaaaacaggaaggagcggcaaagcatggattttgtactcaggaaatgggaagggcgggacattttaagcgtcgcacgttatataaacaatatgaatgtgcaaaaatggctgcgcgacggccttccctttccttataccacgcaggatgcgtttgcgttcatcgagggaacgtgcctggcggccgatcctatgcgcgaaatcatgctggcgatcgatgtcggcggcgaagcggtcggcagcatcggtatctttaaaaaagacaacgtataccgaaaaagcgcggagttgggatattggctgggagagccttactggggacgcggaatcatgacgcgcgcagtaggtcagatatgcgcggccgcattcggcacgcttgatatcgtgcgtatttttgccgaaccgtttgccgaaaacgccggatcaaggagggtgcttgaaaaggcgggattccggcttgaaggggtcatgaggcggtcggtatacaaggaagggcgtatcatggattcatgcatatacgcgctcatcagggaataacatggaaaaagatgcggtttgggctgcatcttttttgtttctgcatatttgatttttttgcacagtactattttgcaggataaatacagccgttgtttttatcctgtttttatgctatacatataggaagacaaaaaagaacaggggcaggcatttgaagttcaaagacatttccattcgtaaaaagataacgctgacgaattttatgatgattgttattccggtgctcattgtgctgcttattatggttggggtcctggttggaatcctggcaggcaccggttcggggatcacgatatccacgctggaaaaattcagcggtaagacgacgaactaccagctacagatgatggtcgattcgttaagtgaagagcttgtggagagcgcgcacccgctggaacaggggtcggtgtttttaaagatatgcagcgatatggaaggctttggcacggcaatttttgttgcggacgaggagcgggttttgtatgcgactcagggcgtaaatgagagcgctatgcaggcgatggcggaggaaatcggcgcgccgaaaaattccagtcccatattcctgcgcaatgacaatggatttgtttacaggacgaagacgcaggaagggggacgcacctattttgtctttgcggtgaacggtgcattgccttacgacgcgggagaatattatgtgttcgaacagataaaaatacagcttaagatccttttagtcgctgtaggcggggtggcaattcttattatcgtgcttacgggcacgctattgtcgcgtaagctttcgaaaagtatcctggtgccgattgggaaattgagtcaggcgaccacatatgtacgcaacggggaccttgacaaaccggtaggcttcagggcgcgcgacgagctggggcaggtatgcgaggagtttgacgaaatgcggctgcggctcaaagaatctgtgatgctgcagcaaaaatatatgcgccagcagcaggagatgattgcggggatctcgcatgacctttcgacgcccattacttcaatcaagggctatgtgagcggtatcgtggacggcattgccgatacgcctgaaaaacgcgagcattatttgcgcacaatttacgatacggcatgcgatatggaccaactcgtggataatttgtttctgtattccaagctggggatggacaatgtgccgttccgcatagagcgtacggacctcgcggcatatctttctgattactgcgaggacttgcggtttagattacaaaaagagaatatggagctggagtttgaaaaccagtgcgcgggacgcgtatggacggatatcgaccgtatgcagatgggtcgcgtgctgaaaaacctcgcggataacagcatcaaatataaaaagagggattcacgcgtcaaaagcaggatctatatcgtgctcgaagacgcgggcggcggtatggtgcgcatcgtgttttcggataacgggatcggtatcgcggaaaacgaaacggacaagatattcgaaagtttttaccgcagcgacccggcgcgcggcaatgcggcgaaagggagcggactcgggctgtcaattgcacggaggattgtgcgccgcatgggcggacggatcagcgcacagggaagaagcggcttaggcctttccgttatgatcgtgttgccgcgaaaaggagagtaaacgttgaaacgtattttagtcgtagaggatgacaggagtatagcggaactggagcgcgattacctggaagcgaacggttacgacgtatatactgttttttcaggcgaagaaggcctcaaagaggcgctgatgcgggactatgcgctgatcattatggatgtgatgctgcccggcgcggatggttttgaaatttgtcgggaactcagggaaaagaaggatacgccggtgatcattgtttctgcccgcagagacgatattgataagatacgcgggcttggactgggggcagacgactatatggtcaagccgttcagtccttcggaacttgtggcgcgtgtgaccgcacatatcaaacgtttcgagaggctcacaggcggtggaaaaggggaaagcgcaaaggtcattgaagcggatggactgaccatcgacttaggagcgcggcgtattttccttgacgggcaggaagtggtttttaaaaataaagaatttgaactgctcgcctttttagcgtcgaacccgaatattgtattcagcaaggagacactgtttgataggatttggggcatggaatcgtttggggacaccgcgacagtgaccgtgcatattaaccgcatccgtgaaaaaatagaaagcagcggaaaaaaatttatcgaaacggtatggggttctggttatcgttttcgtggataggcaacgatgacctccaagtggattgtaatttccgagatgcccgaaagatcgaccgtttctatgggtggtacatgggaagtcaggggcgtcattttataaaaggaagcaagctgtttttgtgatacgggcagcgtatattgtattgttttatgatcggcgatatcggcgttttccgccatatggccgattgttttttgattggagtattccttataccgcaaatctccggcgacacatgcgcgcaattcccgtaagtaataccggccgggaaacaccttgatcatgaccccgcccgcgcagagcacgcgcgcaaactccgtatagtttgccggagcgaggatattcagcagaacgcctgctctgccgtcatggacaggtatccccgcaagatcggcaactgcgaagcatgcatcgccggactccctgaccgccgaaaggattgcgtctttcgaattatccagcgcgaaaacgcgaatatcggaaagctgtgacaggaaaatggcatagtagccttcgccgcatccggcatctaatattgttcggctttgttgaggcatgaatttttggacggactcacaaacagaacgggcgacgggttcaaaaaaaccgtcgtggaaaacagctttacgactctggaacaactcacttgcatatcgtgcatcgcgggcggctgtgccgggcagtaaatggacatagcctttggacgacaaatcaaagcaatgattgttactgcaaacaaagctcccatcccccgtcagggaaaaggagtgctggcagatcgggcagcgaaaaaagtcgccgctgtttttaaatttttcgatcaccgttgcaattttcatgacttcgccaattgataacaggacattgttacctgataacattatagcattggagggtaatgaagaaaaggttgcgcgattctttatggtttgtttagagatcgtttagaaatgaaggatattctttgaagaacgataaacaaagagaaaggtatcttgcctatggaatggattatttccttgatggatcaatttgggtatgttggtatcgcctttttgatcgccgtcgaaaatatatttccgccgatcccttccgaagtgatcctcaccttcggtggctttatgacgacctacacaagcatgaatatgtggggcgttgtcattgccgcaacggtgggttcggtcgcgggcgcacttgtactttatgggatcggacgcattttgaatgaggaaaggttaaagcggtggctgggcggaaagctggggcgcatcctgcatttaaaacccgaggatatagaaaaggccagggtatggtttgaaaaacggggcgggaaagcagtctttttatgccgtttcgtaccaatcgtacgcagcttgatttctatccctgcgggtatgacgaaaatgaatgtgggaaagttcgccgtatttacggcagcaggaacgttcctttggaacctggtccttgttaatctgggggttttcgcaggcgcatcgtgggaaaagatagcgggggcaatcggcgtttatgccaatgttgtgttggtcatcattattgcggcgctcgttgcaggcgtggtaatcttcctgtggcggcggtcgcggaaaaagacagcagaaccggaatgaggtaaaacggataaagggctgcgtaaggggcgcggcctttttctttgcctgcattgacagctttttttgaaaaagttacaataaagaagtatctatcaaatcatgcagtaaatcacggaaaagaggaatagaagatgaatagtcaagtcgtgcagattgcagcgcggatacgcgagttgcgggaaattctcgaaattccgcaggaagaagtcgcggaaaaagtcgggatcagcctggaagaatataaaaaatatgaaaatgcgcaggacgatattcccatcggcgtgctttatggcgtagcggcggaattaagagtcgacccgacggagcttctgacaggagaagcgccccgtatggatgaatatacgatcgtgcgcgggggtaatggagtgaacgtggagcggtatcccggttacgcattcacctcgctggcattcaactacaaacaccgcgatatggaacccatgatcgttacgatctcgccgaacgacgaggcggagctggtgacgcatgaaggacaggaattcaattatgtgctggaaggaagtatcaagattgtgatacaggacagggagtttattttgaatgcgggcgacagcatttattttaatcctatgcttccccacggccagcgcgcggcaggcggccaggccaggttcctgacgataatcaacgagtgagatgggggcaggatcgatggtagagaagtttttggataaaacagaatttgaagattatgacgatttcaagcagaattataaactgaacatacccaggcattttaactttgcttacgatatcgtggatgaatgggcgcggctggataaaaacaagcctgcgcttgtgtggtgcgatgacgatgggaatgaaaagaggttttcgttcggtgacatcagcaggatgagcaaccgtgcggccaatatgctcaagggcatgggcatttgcaaaggtgatacggtcatgttgatgatgaaacagcggccggaggtatggtttatgatggtcgggctgcataagctgggagcgatttgcattcccgcgaccttccaactgacgcccaaggatatcatttaccgttgcaatgcggcggaagtcaaaatgatttgcagtgtagacgacgaggagatgctcaaacatatcgggcaatccctaggggaatgcaggacgcttaaaagtgtcggaatagtgggtgaaaacattccggaatggggatacgacctgcgcgcaaagcttgaggaagccgacgaaaactggacgcgcgagtatgtgaatgaaaatgacgatccgatgctcatttatttttcatcgggcacaacgggtatgcccaaaatgatcctgcatgattttacctatccgctcgggcatatcgttactgcaaaatactggcagaaggtggaagacggcggcctgcaccttacggtttcggattccggctgggcaaagttcggctggggtaaaatctatgggcaatggatctgtggagcggtcattgtcgcctatgatacggaaaagtttaagccgtctaaaatgctggagacgatagacaggctcaagctgacaacgttttgtgcgccgcctacgatttaccgcttcctgatcaaagaggatatgagccattgcgatttttccacgatcaagcatgcgggcatcgcgggagagcctttgaatcccgaagtatataaccgcttcctggaagcaacgggacttgcggtgacggaggggtttggacaatcggaaacaagcgtactgatcgcgaattttggctgggatccgattaagccgggttctaccggcaagccctctcccctctatgatgttgatatcgtggacgaagagggaaattcctgcgaggatggtattgttggttcaatcgttgtaaaaaatacggataaaaaacatccgacagggctgttcaaaaagtactataaagatgaggaagcgacggaccgttgctggaagaacggcgtttataatacaggagatacggcttggcgggatgcggaaggctatttttggttcgtaggaagaaacgacgacgtgatcaaatgctccggctacaggatcgggccgtttgaagtggaaagcgcactgcttacacatccatctgttcttgaatgcgcggtcactgcggtgccggaccctgtgcgcggccaggtggtgaaggcgacggtggttctggcacgcggatatgaagcgggtgaagaactgaaaaaagaattacagacgcatgtgaaaaatgtgacggctccatataaatatccgcgcgtagtggagtttgtaaaggaactgcccaaaacggtgagcggaaaaatacgacgcgtacagatacgcacggaagacgcggacaaagcttaaaatagctaagatacaaaaggcgcggcaatgccgcgcctttatcatatcgtcatttatttataaacttctgcttcaacctcggcaaaggcttgcgattccttcgcgcatttctctttcatttcgggcgtgaggccttccagatgctcggcattcagccaggcattcgccatttcgataccaagcacgtgtccgacgatgaacccgcccatgcaaaggacgttggtattattaacggccttggaacgccatgcggtatacacactttcgcacaacgccgcataaacgcctttatatttattggcgatgatactgatccccatgcctgtgccgcacatcatgatgccgcgatcgtacctaccgctttgcacgccttttgctacggatttggcaacatcctggtacaataacggaccatcaggggaaacatcggatatctcgtatcctttactgagaagatcggcctttaccgcttctttgagctcataaccgccaaaatctccacccataataattttcatgtgtaaattcctttctcgatcaaatctgatatgttcaaggtagcatatgaaaaaaagagagtcaatcccatatctattgccggttaaaattgggaggcgttccagaatgtgaaaaaagatgagtgtattcgaagggaagccgccgctttatcaaccaagcgccacgtcgaggatcatcataatcacgaaacctgccattacacccgccgtacccgaatgggaatgttcgccgagatgcgcctcggggatcaattcttcgactacaacatagatcatcgctccggctgcaaacgcaagaagccatggcataatgccggaaatgaggccgattaaaagtactgcaagcacggcggcgacgggttctaccgcgccggacaacgtcccccagagaaaagctttgccacgcgtgaggccctcttgacggaggggaagggaaatcgccgcgccttctgggatgttttggagagccatgccaattgcaagggcgatcgcagaagcaagagtgaccgcatcggcagagccctgcgctgctacggcaaaggcaaggcccaccgcaagaccttcgggaatattgtgaagcgtgactgccaaaaacaacatcgagcgtttaccgagatgggcatgcaggccctccggctgatcgctgcccggatgctggtgcgggatcagatggtcgagcgcaaataaaaacaggccgcccagagcgaagcccccggccgcagggatccagccggttacaccctgttcttcggccatatcgattgcgggaatgagtaacgaccacacggaagcggcgatcataatgcctgccgcaaatcccagcataacacgctgcaccttgggattgatttcccctttgaaaaagaaaacagaagcagcgcctgaagttgttgccgcaaacataaggccggagccggcaagagccagcaaatatggattcaaatctgtccacataaccataatccccctattgataaaaactctcttcataaaataagcaaaaaagcggggcgccaaacaaaattcattaaaaaagcgccgctgatacggcgcttttggacaaatacggtcatccgttataacgcattgtatgcaaaggatgcaccttggtgatatgcgcggggataccgatctggttcatcagttccacaaaacgcttgcatacgccggtatccgaaaaacgctgtgcaacattgattacgagttgccctttgtaagaaaggagcgccatcgtaaacggattttgcgcggtgggaaggcagggatagatttcctgtatatgttcttccatacaagccggaagcgaaaaatttcccatgttggtgatgatgtaagtcgtctgcgaagacgtttccgtaatcgactgcttcacgatttcccgttttttttctacagggatttcggcatctaaaagcgcgagggtatcaagcgcattctttttggcatcatgcgcaagctctttagcctgtgtctggaaatccagaaggccttttgaaatttcgaggatctgctcgaaatccaagtcgcgcatttttttgtcataagggataccggcgcacgagataaaattgcgcgtggtctcgcttggaaaataggggcgcatattaacgggaatcgctgcaatgatcggcttctcgtattcagaatccatacaataccgctcgtaaagcgcatgggaaaataacggacagataaatgtaactggactggcttggtattgttttgccgcgccatgcaaatttttaaatggcagacggatttgcactaccgtatccgcagggtcgtcttccgtgctgatgttgggaacgcgataagcaggaaaacgcggatattccgcacggttatctgtttcgatctttaatacgacatcttccgcctcgcaatcggaaaattccgtttcctttgtgcgaatactgccgtcgttttcgattggaaggcccaactgctccagataatggtagagcactgatttgataaaaatcaggaaacccatcccatcgccgagcgcatgaaaaaagtcaaagcatatttctttgctgttatatgaaatacagaacaggtagccgttcgtatcgtccgtccccatgctgcgcaccgtgccgccgcagttgttaaacaccggaggcggggtggtcagaggcacaaaataataatagtaagcatcgcggtcaataccgaccgccatttgcggaaagcgttcaagcgtgaccgatacggcatctgcgagtacgtcgccgtctacggtctgggccagtttaacgatgaaccgagggacgcaaccacatgtaagatggctgccataaaggtaggtcttgccgttggtatctatggtaagagctgcactttttttattcattatatattaactcctggtttttaaaaatttagaaaccccaaacgaagtttgttttttcttattgtaacatttgaataaggggtcgtacaatagtatttccagaatattcaaaaatgaaaatgactatatcttgtgcttgattttaaagaaaaacacaatttttcattttttggaaaaaacgcaaaaaaagttcggaaaaatgcttgaaatcaaggtttctatgttgtataatctagtacgttgcgctatgtgtgcgcattttgggttgaggcgagaggttaccgaaaagccatcggatagttcccgctgacaagcgtcccggcatgactggggcgactccaaaaaagagcagagccaaaggctttctgctcaaaaaaagcaatgcgatacacacggctatgtgtatcagcaaaggcggctcggccgcacactaaaggaggataaacaaatggcaagccagagaatcagaatcaaactgaaagcttatgaccacaacctgatcgaccagagcgctcagagaatcgtggacacagcaaaacgtacaggcgctaagatttcaggccctgtgccgcttccgacgagcaaagagatcatcacgatcctgcgcgcgacgcacaaatacaaagactcaagagaacaatttgaaatcaaaacacacaaacgcttgatagatatactcgaagcaaacgctaagacaacagacgcgctcatgcgtcttgacctgcctgcaggcgtggacatcgaaatcaaactgtaaaacaagcgataagacggaggagaaaacatgaaagctatactgggtgaaaaaatcggtatgactcaggtcttcacagaagacggcagagttgttcccgtaacagtagttaaagccggaccttgcgttatcgttcagaagaaaacggtagaatcagacggttacaacgcattgcagttagggtttggggacatcaaggaaaagaatgtaaacaggcctaaaaaaggtcatttcagcaaggtgaaagcaacgccgacgcgttatctgcgcgaattccgcttagcagaagcgcctgaactggaagtgggcagcgaaatcaaggcggatgcttttgaagcgggtgagaaaattgacgtttcgggcatttccaaggggaaaggcttcctcggcgttatcgcacgctggggccagcacagagggcctatgagccacggcagccgttaccacaggcgccccggttcgatgggcgcatgcgcgtcgcctgcgaaggtcatgaagggcaagcgtcttccgggacgcggcggctttgacaaagtgacgatccagaatttggaagtggtcaaagtagacgcagataaaaacctgatattagtcaagggcgcgatccccggttctaagggcggccttgtaacaatcaaaaaaagcgtgaagtcgctttaagaccgcttaagaaggaggaaagcaattatgccaaacgtatcagtttataagaccgacggcaaagaagctggcaaaatgcagcttaacgataaagtcttcggcgtagagataaataaagcagtaatgcacgacgctatagttgcgcacctggccaacaaacggcagggcacgcagtcggcgcttacgcgcagtgaagtgcgcggcggcggcatcaagcctttcaggcagaagggtacaggcagggcccgtcagggtacgatccgcgcgccccaaatgacgcacggcggtatcgtatttgcgcctaagccgagaagttatgcaaagaagcttaacaaaaaagtacgcgcgcttgcactttgctccgcactttccatgaaggtggcggacagcgatatgatcgtgatggaagaccttaagatgaagactcccaaaacgaaagaaatggttgcgattctgggaaacctgaaagcaaacaaagcgcttatcgtaacaaacggcaaagacgaggacgttgtgcgcgcagcggccaatatccagggtgtgaaaacgacgatggcagatacgctcagcgtttacgacatcttaaagtatgacaagttcattatcaccaaagatgcggtgaaagcgatcgaggaggtgtacgcgtaatgaaagatatgcatgatattatcattaagcccatcctttcagagaaaagctacgacctgatccccaagaaaacctacacatttttggtggacaagggcgcaaataaaacgcagatcaaggctgcggtagaagaaatctttgaggtgaaggtgaaatcgatcaccacttcccgcaaagagggcaagctgaaaagacagggacgcacggagggcagaaggcccgaaacgaaaaaagcttatgtgacgctcaaagaggattcaaagccaatcgagttctttgagagcatggcacagtaagcggttagggaggttacttatttatggctattaagaaatacaacccgacttctccgggcagaaggttcatgtcggtttcggcttacgaagagattacaacaactacgcccgaaaaatcgctgcttgtttccctaaagaaatcaggcggcagaaatatgcacggcaggatcacggttcgccacgtgggcggcggtgcaaagagaaaatacaggatcatcgatttcaaacgcaacaaggacgacgttccggctaaggttgcgacgatcgaatacgatccgaacagaagcgcgaatatcgctctccttcattatctggacggcgaaaagagatatatcatcgctccggttggactcaaggttggggacaaagtactctccggtgcgcaggcggatattaaacccggcaacgcattgccgctgtccgcgattccggtaggtacgatgatccacaatgtggaaatgaagcccggcaagggcgcgcagctcgttagaagcgcaggcaacgcagcacagctcatggcaaaggaaggcgcgtatgcgcaggtaagacttccttccggtgaagtaaggatgattccggtgggcgcgaaagcgacgatcgggcaggtcggcaacgttgaccaggaaaacatcaacatcggtaaagcgggaagaaaacgccatatgggtgtccgcccgacagtacgcggcagcgttatgaacccgaacgaccatccgcatggtggtggtgaaggtaaatctcctgtcggacgtccgggtcctgtaacgccgtggggcaagcctgctcttggctacaagacgcgtaagaagaagaacccgacgaacaaatttatcgtaaaacgcagaaacgctaaataattgaaggagtgaatttgcagatatgagcaggtcagtaaaaaaaggaccatttataaatgaaaaacttctggcacgtattgtcgagatgaacgacaagaacgaaaagaaagtgctgaagacatggtcgcgtccgtcgacgatcttcccggaaatggtaggacatacgatcggcgtacatgacggaagaaaatttgttcccgtttatgtaacggaggacatggttggtcacaaattaggcgaatttgccccgacaaggacttacaggggtcacgcaggcgagaaatcgtctaaataaccgagaaggaggctaagctttatggctacgagacaaagagaaaaagccgcaaaacggcaagaagaaaaagatagaagaccgcaggccattgcaaggtacgttcgcatttcctcccgcaaggttaaggctgtgatcgacctcatcaggggacttagtgtggcggatgcaaaggcagttttgatgaatacgcccaacggtgctacagagcccgtcggaaagcttctgaattccgcgattgccaatgcggaaaacaacatgaatatttcggcagatacgctgtatgttgcagaagtttttgctgatcaaggcccgacgctcaaacggtttcggccgcgtgcgcagggcagggcgactcggattcgcaagagaacgagtcacatcacaattatcttggatcaggtcaaataaggaggtacacgatgggtcaaaaagtacatccccatggttttagggttggagtcatcaaagactgggatgccagatggacggcgaaaaagtctaaatttgcggattatatcgttgaagatgataagatcagaaaatttttgaagaagaaattatatgctgcaggtatttcgaagatcgagatcgaacgtgcggcgcagaaaatttccgtcaatatctttaccggcaaacccggtatcgtgatcggaaaaggcggcacgggcgtagagcttttgaagaaggatcttttaaagctcgtaggcagtcctgtggtcgtcaatattattgaagtaaaaagagtagacgtagacgcgcagctcgtggcggaaaatgttgcgcagcagcttgaaaagcgtatttctttcaggcgtgcgatgaagcagtctatcggcaggacgatgaaggccggcgcaaaaggaatcaaaatcatgtgctcaggcaggttgggcggcgctgaaatcgcaagggtagagcagtatcatgaaggttcgatcccgctgcagacgattcgtgcggatatcgactatggttttgcggaagcaaacacgacttacggcaagatcggcgtaaaagtgtggatctataagggcgagattcttgggaatccgctgaaggacagagcaaaaccttcgacagtggaaggaggcagaaaaaatgttaatgccaaaaagggttaagcgcagaagacagttcaggggacgcatgaagggcaaagcgcttcgcggaaatacgatttcttacggcgattacggcctcgtggctcaggagcctggctggatcaaaagcaaccagatcgaggcggcccgtgtcgctatgacaagatatatcaagaggggcggacaggtttggattaaaatcttcccgcacaaaccggttactgaaaaacccgctgaaacgcgtatgggcagcggtaaaggttctccggaatactgggtcgcagttgtaaagccgggcagagtcatgtttgagcttgcaggcgtaagcgaagaagtggctagggcagcgctttcgcgtgctgcgcacaagctcccgatcaagtgcaaatttgcgatcaagcagacaaataacgaagcaggtggtgagcaggatgaaggctaaggatatacgtgaactcaataaagacgagctgagcgcgaagctgaatgatctgaaatcggaatttttcaacctgcggttccagctcgcgacgggtcagctcaacaatccttccagtatcaagaatgtcaagaaggacatcgcgagagtaaagaccattttgagggaaatggaattaaaccagaaggttgccgagtaaggagttaaggaggacgtcttcaatgagtgaagagacaagaggttaccgtaaagagagaatcggcacggtagtaagcgataaaatggacaagacgattgtcgttgcgataaaaagcagaaaaacgcatcccttgtatggaaagaccatcaattacactaacaagctgaaagcgcatgatgaaaataacgagtgcggcatcggcgacacggtgaaggtgatggagacgagaccgctttcaaaggacaagagatggagattggttcagattatagaaaaggcgaaataagcttttctcttaataaggaggagtcagaatgatacagccagagacacgcctcaaggttgcagacaattcaggcgcaaaagtgatccaatgtattcgcgtaatgggcggcagtgttaaaaagacagccaacatcggcgatgtgatcattgcatctgtaaaaacagcgacacccggcggcgttgtaaagaaaaaagacgtggtaaaggccgtcatcgttcgttccgtgagcggggcgagaagaccggacggttctcacataaaatttgatgaaaatgcagcagtgattattgatgccaataaacagccgaaaggcacccgtatttttgggcctgttgcaagggagcttcgtgaccgcgattatatgaagatcgtgtcgcttgccccggaagttctgtaagggggagataacgcatgaatacactgaatatcaaaaaaggcgatacggcggttgtcatctccggtaaagaaaaaggcaaggaagcaaaggttctgcgtgtgatccccggtaaaaaccgtgtgattctggaaaaggtcaatatgctcacaaagcataagaagccgaaaaaccagacaacgccgggcggtatcatcaagcaggaaggcccgatcgacgcttccaacgtcatggtcgtttgcccgaagtgcaataaggcaacgcgcatcggccatgaaattaaaaacggcgaaaaagtccgcgtttgcaaaaaatgcggcgcacagctgtagagtgaagggaggttttatctgatatgcctagattaaaagacacatacaaagcggatattattcccgctatgatgcagaaatttgaatacaaaaacatcaatcaggttcccaaactcgaaaaagttgtgatcaacttaggattgggagaagcaaaagataacccgaaggtccttgactccgcagtggaagacttaacggttatttccggacagaaaccggttgttacgacagcgaaaaagtctgtcgcaaacttcaagcttcgtgaaggaatgaaaattggtgcaaaggtgacacttaggggcgagcggatgtacgaattcattgataagctgattagtatcgctatcccgcgtgttcgtgacttccgcggcctttctccgaaatcttttgacggcaggggcaatttcgcaatgggcttcaaagaacagctcgtgttcccggaaatcgaatatgataaggtggacgcgatccgcggtatggacatcattgtagtgactacggcggaaacggacgaagaagctagggaactgcttacccagatgggtatgccgtttgctcactaaggaggagaacaatggcgaagaaaagcatgatcataaaacagcagagaggttccaaattctctacgcgcaattacacaagatgccgtatttgcgggagacctcactctgttctgaaaaaatacggcatttgccgtgtttgctttcgcgagcttgcataccgtggtcagattcccggtgtgaaaaaagcaagctggtaatctttaggaaggtaaaggaggaaaacacatgccggttacagattctgtagcagatatgctaacacgcatccgcaatggccttatcgcgaagcatgatatggtagacgtacctgcttccaacatgaaaaaagcaattggacaaattttgcttgaagaaggctacatcaaaggctgcgaatttatagatgacggcgtgcagggcacgctgagaattaagctgaagtacggtccgaatggtgaaaaggtcattacgggacttaagaaaatttccaagcccggtttgcgcgtttatgcaagacatgataagctgccgcgcgttttaaatggacttggtatcgctattatttctacgtcgaagggtattatcacggacgcgcaggcgcgccgtgaagccgtgggcggagaagtgatcgcctacatctggtaagtgaggggagagtaaagatatgtctaggataggaaaattgcctattgatttaccctccggcgttaccgttacgcaggcgaacggtgaagtaaccgttaagggtaaaaacggcgaattgaagtcgaaattcgataaaaagatgacgatctcgcaggaaggggagcagctcatcgtaacgcgtgccgacgacacaaaacagtcaagggcgctgcatggtttaacgcgcgcactcctgcagaatatggtaacaggcgtttcggaaggattttccaagacattggaaatcgtcggcgtcggctacagggtgcagctccagggcagcaaacttgttttcggacttgggtattcccatccggtggaagtgcaggcgcctgcgggcatcacgtttgaagtgccaaaccccaacacagtgatcatcaagggaatcaacaaacagcatgttgggcaatgtgcagcgaatatccgcaccttgcgtccgccggaaccgtataaaggcaaaggtattaagtatcagggtgaatatatccgccgcaaagtcggtaagacaggtatgtaacggagggtgatgagcaaatgattaataaaaaagacagaaataaaattagaaaagcacgtcacgagagaatccgtaataagatttccggtacggcgagccgtccgagaatgaacgtatacagaagcttaaataacatctatgtacagttcattgacgatgttgcaggtaatacgctttgctctgcttcctctatggacagcgaactcaaaggcaagcttgccgaagcaacgaaatcagaggccgctaaaatggttggcgagctggctgcaaagcgtgcgagcgccaaaggcatcagcgaagtcgtgtttgaccgtggcggttatctctatactggcagagtagctcaggtggccgaaggcgcgagagctgccggcctcaagttttaataaggaggtacggagaaattgcagaaagataaagcaatcgatgcaggtgctctcgatttaaaagaaaaattagtggcgatcaaccgtgttgcgaagaccgttaaaggcggccgtaacatgcgcttttcggcacttgtggtcgtaggagatgaaaacggtcatgtgggcgtcggcatgggcaaagcggctgaaatcccggaagcgatccgcaaagcggtgcaggctgcaaagcatgatatgattacagtatccttaaagggaacatccattcctcatgaggtgattggtaagttcggacgcggcagagtgctgctgctccccgctgcggaaggtaccggcgttattgccggaggtcctgcacgtgcggttttagagcttgcgggcatcaaggacatccgtacgaagtcgcaggggtccaacaatccgatcaactgtgtcaaagcgacaatcgaaggtcttcgtgaattgagaagcgcagagcaggtagctcgtttgcgcgggatcagcgttgaccagcttcaatagtaggaggggcctgaaatgaatttgaaaattaagcttgttaaaagccccattggttatgcgcaggaccagaaagatacggtcaaggcgctgggtcttcgcaaattgggtcaggaagttgtgaggccggacaatgcaccgatcagaggtatggttttcaaggtaaaacacctcgtatcggttgaagagacgaaataacggagggaaagcctatgaaacttcatgaacttgctcctgtagagggcgcgaaaaagtcgcctaagagagtaggcagaggatgtggatccggtcttggtaaaacttccgcgagaggacagaagggccagaaatcccgtagcggcggcggtgtccgtccgggattcgagggaggccagatgccccttgcaagacgtttgccgaagcgagggtttacgaatatatttgcaaaagagtatgctacgatcaacgtggctgaacttgagaaatttgacgacggagcggttgtcgatttcgaaatacttctcggcagcggcttgatttccaaggccagcaacggcttgaaggtacttggaaacggcgatctgaagaaaaaattgactgtaaaggctgcaaagtttacaaaaacggctgagcagaagattacagctgcgggcggcagtatcgaggtggtataatgtttaaaaccattgcaaatgcatggaaaatcccggatatcaggaagaagatactgtttacgttgcttatgctgctcgtataccgtatcggtgcgtatattccgatcccgggcgtcaatatcgactttatatcgagccaggttgggcaatacgaagtgctggggttcctgaatctgttttcaggcggatccctttccaacatgacgatttttgcgcttggtattacgccttatatcaattcatccatcattatgaacttgctgacggtagcgatcccgaagctggaacggatggcaaaggatgaagacggcaggaaaaaaattgcttctatcacgagatatttcggtgttattttaggtcttgtgcaggcgatcggcatcatgcttgggctgggcgaacaggcggttgagaatacgcagccctttacgtatattacgattatcctctgcctgacggcaggtacggcgctcattatgtggatcggcgagcgtattacggaaaaggggattggcaacggtatctcgctgctgatctttatttcgatcgtagcgggcatgccgagtatgctcaagagcatgcttgacggcgtagccaacggcagcatcaatatctggacattcatcctcgtgatcggtcttgcgtttgttattgtcctgggaatcacgtttgtggatcttggcgagcggcgcattccggtccagtacgcaaaacgtgtagttggacgaaaaatgtacggcggacagtcgacgcatattccgatgaaggtgaaccagagtggcgttatgcccctgattttcgcaattacgatcctcatgcttccgggcatgatcggacagttttggccggaaagtggcttttatgcatggtaccgccagtatgcgggccctggaacaatcacgtatggcgtcatatatgcgctgctcatcttgttcttctcatatttctactcgcagattgcgttcaatccggtagatgtatcaaagaacctacagcagaacggtggatttatccctgggatcagaccgggtaaaccgacgtctgattaccttgcgaaaatcctttcgcgtatcacgttgttcggcgcaatatttttagcaatcgtggcggcggtgccgacgttctttacctttatgacaggggtgtcgagcgtgtttggcgcaaccagcgtgctgattatggtcagcgtggcgctggagacgacgaagcagctcgagtcgcagatgatgatgaggcattacaaaggcttcctgagttaagggagagccgtccgaacctatggttcggctaacggcaccccggcaagggatgtccgtgagcgcaagcccgcaggcgaagcgaaaatgggaacatcccactgcctgtactctatttattctatgatatacgatgctcttcatgagcagagagggaacaccatgaatgtaatttttcttggacctcccggatcgggcaaaggcacgatggcggagagagtatgtgaggaaatgaatctggcgcatatctccacaggggatatcctacgcgcggaaatcaaagccggcagtgagctcggaagccttgcaaagtcatatatcgacaagggcgcccttgtaccggacagcgtaattatcgatatgatgcgtgagcgctttgggcagttgggcgatatgggcgttttgctggatggctttccgagaacggttgcgcaggcggaggcgcttgattccctgatggcgatcgacgcggtcatcaacttagaggttgatgtgcaggttatcgttgacagagtcgtggcacggcgcgtatgcgaaaagtgcggtgcagtttacagcgtcaaaacgcatgaaggcgacgattgtgatagatgcgacggtaaattgatcacgcggccggatgacaatgaacagacggtacgcgaacgtttcagggtatatgaagagcagacacagccgctcatcgatttttatgcggagcgtggtttggtcagcaatgtagacgggacgatgccgatcgaagaagaggcagcgtacattattgatatactgaaaaagataaaaatatgatcaacattaaaacagcgcatgagatcgctctgatgcgggagtcaggccggttgctttgcgcatgcatggaagaacttttaaagcatgtaaagccaggggtgacaacaaaggagcttgatcgtattgcggagcaatacatcaccgacgcgggggcgaagccttcgtttaagggatataatggttttccggggagcatttgcagctctgtaaacgacggagtcgtgcatgggatcccctcggacaaggaagtccttcgggacggcgacatcctgagtatcgatatgggtgcgatccttgcgggctggcagtcggatatggcgcgtacagtcggcgttggacagatcacgaaggaagcggagcatcttatcaagatcacgcgggagagcttttatgcgggcatgaacaaggcctgtgcaggcaaccgtttaaatgatatcagttccagcatcgagcaggtgatccgcgcacacaggatgggcgtggtaaaggagcttgtaggacatggaatcggcaagcagatgcacgaggcaccggatattccgaatttttcgtttaaaggggcgaatccacggctgagagaaggcatggttttcgcaatcgagccgatggtgaccctgggaacggacaacgttcggtggatggacgatggatggctggtaaaaacggcggacggaagcctggcggcgcactatgaaaatacggtggcgatcacggcgaacggtccggagcttttgacagcgccataaggaaggaacattgagtaattacttggcagaggtcggacggatcgtaatttctaaggctggcagggacaaaggcaaggcatttatgataacagcagttcttgatagccagtatgtagaggttgcgaacgggaccttaaggaagttagcaaaaccaaagaaaaagaagctcaagcacctcgaagtcacgccatttttactgaagaacattcgggagaaggttgagcagggtaagaaagtgtttgacgcggaactcaggagcgcgatcataaacacgcttgagtctcagaaggaggagtaaatttgtctaaaagcgacgtaatcgaagtggaaggaacggtcacagagacgtaccccaatgcttcatttgaagtagagcttgaaaacggacacaaggtactggcacatatttccggtaagctgcgtatgcattatatccgcatactgcccggagacaaggtgacggtagaactctcaccctatgacctcacaagaggcaggatcacatggcgcggcaaagcataagcgcgctctgttgtatcgcataaagacgattattagaaggaggcttttaagatgaaagtaagaccatcggtaaaacccatttgcgaaaaatgcaagatcataaaaagaaaaggtaaagtaatggtgatctgcccgaatgtaaagcataagcagaggcagggctgaaccaaaacggacaatactgtttgtacggcggctgatttgcgcacaccgcgcgtaaatttcgtataagctttatatatctgaagaagtgtgttaaaatatttgacatatgcttaaaattataaaggcagcgggaaaaccgcttatgattcacggaggtgtttaaaaaagtatggcacgtattgctggcatcgacttgcccagggacaaacgcgttgagatcggcctcacctatatctttggtatcggcctcaagacttctcaacagattttatctgcgacaaatgtgaaccctgacatcagagtaagggatttggatgaaaacgaccttgctaagatcagggagtatattgacaaaaatatcaaagtagaaggcgatttgagaagggaagtatccttaaatatcaagcgcctgatggaaattggctgctatcgcggcatccgtcatagaaaaggcctgcctgtacgcgggcagagtacgaagcagaatgctcgtacccgcaaaggacccaagcgtacggtcgcgggtaagaagaaataagcaaggaggaatcagataatggctgcacctaagaaaaaagtgtccagaagacgcagagaaaagaagaacattgaaaaaggccaggcgcatattcgttcttcctttaataacacgattgtgacaatgacagatatgcagggaaatgctctttcccagtcgagctccggagctatgggcttccgcggctctaagaagagcactccttttgctgcgcaggttgcttccgaaacggctgcacgggccgcgatggagcatggtcttaagtttgtagaagtatttgtaaagggtcccggctccggaagagaagctgcgatccgcgcactgcagacagcaggacttgaagtaacgctgatcaaagacgtgacgcccatcccgcataacggatgccgtccgccgaaacgcagaagggtataaggagggtaagtaaaaatggctagatatacaggaccggtttgccgcttatgccgcagggaaggcgcgaagctctttttgaagggcgacaggtgctattcccagaaatgtgcgtttacgcttcgtcccaacgctcccggacagcatggagcgggcagacatggtaaaatgtctgaatatggaacgcagcttagagaaaaacagaaagtgaaacgcgcttacggtattttggaaagccagtttagaaaatatttcgatattgctgcaaagatgaaaggtaaggccggtgaaaacctgctgcaacttttggaaagacgtcttgacaatgttgcgttccgcttaggaatcggcgacagccgcgcgcacgcgcgccagctcgttatgcacgggcatgtgcttgtgaacggcaaaaaggtggacattccttcctacattgtagatgcgggcgacacggtaacggtcgcgagcaaatccgcttcgcaggaatacttcaaagcaatcaaagaagaaggcggcaaaggcgtgccgaagtggctggaatttgatgccgccacactcgccggtaaagtgcttgctctgccggagagagacgatatcgaccttacgatcgaggagcacttgattgttgagttgtattctaaataataggcgtactccctttatggatatcctatttagaaggaggttacaatatgcttgaaatagaaagaccaaacatcgaatgcactgagatgagcgaagataagaagtacggtaaatttgtgatggagcctctggaaagagggttcggcaccacgctgggaaattctctgcgccgtatcctgctctcatccctgccgggtgttgcggtaacaagcgtaaagatagacggcgtcctgcacgagttctcgacgatcgaaggcgtgcacgaagacgttacaaatattgtgctcaacttaaagggcctgtgcgcaaaaatgtatacggatgaacccaaaaagctgatcatcaatgcaaaaggcccgaaagatgtgacggctgccgatatcgagacggattccgaggtggaaatcatcaatccggatctgcatattgcaacgattgataaaacggcaaatctttatatggagattatgcttgcaaagggcagaggttatgtgctcgcggacaagaataaggaagcgaacatgccaatcggcgagattccgatcgactcgctgttcacgccggtaacaaaggtcaactttgcggtggaaaatacgcgtgttggccagatcacggactttgacaaactgacgatcgaggtatggacgaatggcagcacgaatgccgacgaggccatttcccttgcagcgaagatcatgagcgaatacttatcgcagttcatcaacctgacggatcatgtgagcgacgtggagatcatggttgagaaagaggaagataagaaagaaaagatcctggagatcacgatcgaggagctcgatctttcggttcgttcgtataactgcttaaagcgcgcgggaatcaacacggtagaagaactcattatgcgcaatgaagaagaaatgatgaaggtgcgtaaccttggtaagaagtctttggaagaagtagagcagaagctcgaagcgctgggactgtccctgcggaaagacgattgatttcggacattaacggaggttttagaacgctatgagaaaattaggcagaccgtctgaccagagaagagcgatgctccggggactcgttacgtccctcatctggaacggcaggatagaaacaacgatgatgcgtgcgaaagaaacgcagagaatcgctgaaaagctgatcacaaaggcgatccacgtatatgacaatacggtcgaagtggaaaagacggtggacggcacaaagacgaaagtcacgaacgattctcctgagaaacttgctacgcggcgtattttgatgaaatatttgtatgatttccctgaaacaaaaggggaaaaggaaagcaaatacgattacaaaaaacgtacaagcgacgtaaagagcccggtagttgaaaaattgttcagggacattgcgcccaaatatgcgcagcgtgcaaaggataaaggccagggcggcggttattcgcgcattatcaaaaaaggaccgagacgcggtgacgcggcggaagttgttattctcgaactggtataacaacgcagcggtttaaacagagaatgaaaaggggaggaacgggcgagctaactgctgttccttctttctttatcagggaaaacgatatgcaaaatgtgatcgaagcggaaaacttaagatacgcataccctgctgtggaaacggaagagggcgagcaggaaaaacccaagaagtatgcgcttaacggcatctcccttactgttgagaagggcgagtttgtagcgatcctcgggcacaatggcagcggcaagtcaacgtttgcaaagcacatcaacgtactgctgcgtgcgcaggagggagagcttacagtcgttggcctcgatgcggaaaatgaagataacatctgggagatccgctcccatgcggggatggtattccagaatcccgacaaccagatcgtttctacgatcgtggaagaggacgttgccttcggacccgagaaccttggggttccgcaaaaggagatcgtggagcgtgtgcatgaggcgctcggggcagtcgggatgcttggttttgaaaagcgcgcgccgcatatgctttcgggtggccaaaagcagcgtattgcgattgcaggcgtgctggcgatgcatccggatgtgatcgtatttgacgaaccgacggcgatgctcgacccgcagggacggcatgaagtcatggatacgatccgttttttaaataaggagcagggaaaatccgttgtgctcattacgcattatatggaagaggcttccgaagcggacagggtctttattatgacagacgggaagatcacggacgaggggccgccgcgcgaggtgttttcgcacaaggataaactggacgaggcggggcttttgccgccgcttgcaacgcaggtatacacggagctcaaggaaaaggggatcgacctgaaacagtgtccggtaacgctcaaggaattggtgaacgaattatgccggtagagttaaaaaatttaagttattcttatatgccgggttcgccgttcgaggtgcgtgctttaaaggatatttcgctgcgcatagaagacggtgagtttgtgggcgtcatcggacataccggctgcggcaaatcaacgctgatccagcagatggcgggtctcctgcaaccctccggcggcagcgtggaagtgaatggggacgacatcaatgcatccggttatgaccggaagaagctgcgccggacgctgggagtcgtattccagtatcctgaataccagctttttgaagaaacagtcggcaaggacgttgcctttgggccgcaaaaggccggtatgagcgaggaagaagtcaagaaaagcgtggacgatgcgctgatgctgatggaccttgatcccgagaaaatacgcgaggtatcgccttttgatttgtcaggcggccaaaagcgtaaggttgcgatcgcaggtgttctcgccatgaaaccgcagattttgattttggacgagccgattgcggggcttgacccgatggggcgggaacagttcatgcagctcattcgaaggctgaacagccagggaacgaccattgtaatgatttcgcacaatatggacgggcttgcagattacgcaacgcgtatcatcgccatggatcatggtggaatttacatggatgggacgcctaaggaagtatttgcggatattgaaaagctgcaggccgtagggcttgacgcaagcgaagcgcggcaggcggcttatctcttaaagcaatgcggatgggatattccggacgacatcattaccaagcaggaactggttgattttattgcaacatatcgtaaagaggatggcagatgatcaaaaatataacattgggccagtacttcccgggcaatacgattgtccacagactggacccgcgcataaaaatcataatcgctcttttattcctgatcgccgtattcgtggtacgggactggtggggatttttagcgcttggcgttttattcatcgtaatcaccgtactggcgaaggtcggcatgcgcacgattctgcgcagtatcaggccgcttttgttcatcattatttttacgttcgcattgaacattctgttttttgcgccgcaggacccgtcgcatatcatttggcagtggggtattatcaaaatatccacggatgggatcgaaaaagcgatctttatttctatccggctgatcctgctgatttttgcgacaagcctgcttacgcttacgacgtcgcctatgcaactgacggacggcttggaaagccttttaaagccgcttaaaaaaatcaagtttccggtgcatgagatggcgatgatgatgagcatcgccatgcggttcattcctacgctggtcgacgaaacggaccgcatcatgaaggcgcagacagcgcgcggagcggaatttgacagcggtaaccttttgaaaaaagcaaagaatatgatccctcttctggtgcctctgttcgtcggcgcttttaagcgggcggacgagcttgccatggcgatggagagccggtgctatcatggcggcgagggcaggacgcgcatgaaggtcctgcactttgaaaagacagactggattgctgccgttttgatgtttgcgctgtgtatcgcgtttatgatctggctttaagcgaaacgattgcattcccatgaaaaaagggctatgatatacaatggtcactaaccatacgcctgttatatggcaatggaaggcaccgtaatttatgtggtgagggagaaggaaccaatgagaaagaagattgcacttattttatgtattctggtggcggctgtattgttcgcatgttcggcatcggcgaaagaggtaacgggtacggtggccgacgcgacgaatatgacggtgacgatcaaaacagacgccggagagcaaatggaattcagcaaggaaggcgcggacgaatccggccttgcggatggaatctccatcgatcagaaagtaaccattacatatacggagcctaaagacggcgagcagctttcgcaggcgaccaagatcacagatgcaaaataaataataaaatcgttgaaaaggccgccggaaggcggcttttttggttgaaaggacagtggtggttgttgtatgataagtaaggaaataatgtcgtatgggaaatggagtaaaattttttgcgggtagcgcttttgatcgaatatgacggcacaaattattgtggctggcaaatacaaaaaaacggcgtcagtgtgcagcagaagatagaggaagcgttatttgccgcgctgggggcaaagacggctgcgcacggttccggccgcacggacgcgggcgtgcatgccctggggcaggtcgctcattttgacgcgcatacggacataccggcagacaaatttttttatgtgctgaatacgctcctgccggacgatatccgtatcaagaagtcatatgaggtagcggacaatttccatgcgcgtttcgatgcgaaaggaaagcattaccgatatattatccataatgcgcgggccaaaggtgcggtgaataggctttacagcatgtttgtgcctgttccgcttgattttgagcggatgcagcaggcggccggatatatagaaggaacgcatgattttacggctttttgcgctgcgggaacagacatcaagggaacggtgcgcacggtaagcgaagtgagccttacgcaaggcgacgaatatatttatatcgacgtaaaaggaagcggctttttatacaatatggtgcggatcattgcgggtacgttgattgcagtcggaaaaggaaaaatggaaccggagcaggtgaagagggcaatcgagcaaaaggacagaacgcttgcgggcgcgacagcgcaggcgcagggattgtttttggtggaagtatattatgaatgagaaaaaattacaaatcagggaatgcaggcagcaggatattggggaaatgacggcgttatggaacagtgtcgtagaggcgggaaacgccttcccgcaggaagaaccgatgaatgaaaaggaagcgggaatcttttttggcgggcaagcctataccggagtagcggaatatgagggagaaattgttgggctgtatattttgcatcccaataacattggacgctgcggccatattgccaatgcttcgtatgcggtcaaagaggggctgcgcggcctgcatattggcgaaaagctggtgcgcgacagtattgtgcggggcggcgaaatgggctttcggatattgcaatttaacgccgttgttgcggataatacggcggcgatcaggctttatgagcggatcggttttgagcggatcggcatggtacgcgatggattccgtgataaaagcggtatctataaagacatcgttttattttatatagagctgtgaatcacagttttaatcaaaatacttgacaaccgtgcgcattttcagtagaatatttaatgcgcctatatgcacaattagccctgtgtatgcgcaaaagcagcaatttttgcaacgggacttgggacatcccgcatgcgggaggaagctgcgcctaaaaagaaaaatatgaagatactcatgggaggaaagcctaatgaaaacatatatggcgaaacccggtgaagtgcagcagaagtggtatgttgtcgatgctgagggacaggtattcggcagactcgcaagcaaagttgcgaacattctccacggcaaaaacaaaccggaatatactccgcacgttgatacaggcgattttgtgatcgtgatcaatgcggataaagtagtttttacaggaaagaaactggaacagaaattataccgcagccactcgggttatccgggcggcctgaaagaaacgccttacaaggacttgatggcaaagaaaccggaatttgccttgtatgaagcggtgagaagaatgcttccgaaaaacagactgggcagaaaaatgctcaagaagctgcgcgtttacaaaggcgctgagcacgaacatgcggctcagaagccggaagtaatcgagctgtaagggagggagcaaaagatggcaaagaaagaacagttcttaggaacaggtagaagaaaaaaatccatcgccagagtccgcatcatggcaggcaagggcgagatcaatgtaaataaaagggatattgaagaatattttggttatgagacattgaagatgctggtacgctctcctttcgtggttacggaaaccatgggcaactatgatgtattcgtaaacgtaaagggcggcgggtataccggccaggcaggtgcgatccgccacggtatcgcaagagcgctcatcaaagcggagccggagcttcgcggcgcgctcaaatcggcagggttcttaacgcgtgacccaagaatgaaggaaagaaagaagtacggcctcaaggctgcacgtcgtgctccgcaatttagcaagcgttaaaaaggtacaaataagagtaaaaccgcaaatctatatggatttgcggttttttatttgctgaaatggcagagaatattttgtctcctaaaaccggcagtgattatacggcgaagaatctggacggacagcagaagagagacaaaaagagatcggaaaagctcccttgggttatcgacgtaaaataggattttttttgacctcctgttttcattttagtggtcatgcaatataatacttattgtaagttgttttatattaaggtatcaatataaaatagcttaataaggtgaaaataaatttttaataagttaccagtggtaataaaaagtacttgacatgcaataccaatggaaatataattattttagatgcaggaggaaccggaatggtgaaacaggatgctttatcggatgcaaagaaaagcgaggaagtacaggacggcggaaatacaaaagggccgctgtatcaagtgatcagagagcgcctgctcaatgactttggaacgcttccatattattcgacctttccgagcgaacgggagatttgcgaaaaatatgaggtaagcaggcctacggtacgaacggctcttaatttactcgagcaggaaaagaaaattatccgtatgccaaggaagggcgcgttttttattgggaatacgccgcatgtagaccatcagttggctgccgcgacaggattttataacgatgtaaagatgcagggaaggaacacgacaagcaaggtattgttccaaaatatcgacagggctcccgaagaagtggcggagcgtctgggcattgcggcagatgaacctatttttcgtttggagaggctgcgttatctggatggaacggtatattccctgaccaattcctatttaccgatcgaatatttaaaagaccttatcaaagtggatttcacggaacggtcgctatacgatacgctgtctttacagggcgtggttccgtaccgtggtttccaaagcctgacgtttgcgcccgcaaacgcatatgaagcgatgcatttggatatcgaaaaagggacgccgctcagcgttctgggatcgctgatgtatacggcggatggcaggctgatcgagtttgtaattgtaaaatcagaggcgtataaaacgcgttatgaaatgacggtttatcatgataatcaaaaataatcgctgagaggtagtgtgtcatgggttatgacgtaacggtaattggcagcggcgtgattgggagttttattgcgcgcgaactgatgaaatggcggcttaaggtttgtattgtggaagcacagagcgaccttgcatatggctccagcggggcgaacagtggaatcgtccacggtggattcgatcctaaaccgggaacgctcaaggcgcgctttaatgtgcagggatgccatatgatggatgaggttgcaaaagaccttgatatcccatacaaaaagattgggtccctcgtttgtgcgtttgaagaaaatgaaaaagctgtcttattccaactgctggaacagggaaaacaaaacggattgaaggacctcgtgattctggaaggagagcaactgcataaattggagcaggggatctctgaaaaaattgttgcggcgctttattgcagggaaagcggcattgtttcgccttatgaattgacggtcggcgcggcggaaaacgcggtacaaaacggggctgaattgtatttcgattcaccggtaacagatattcaaaagcagggtggcaacggttttatcgtcaccgccggcagtaataaattgaagacaaaatatatcgtcaatgcggcaggactttatgcagacgacatctataaaatggcattaagcggcggggcgggcggactgcgcggtgtttttgaaattattccgcggcggggcgaatacctgctgatggacaaagcgcagggaaatgctgtcagccatgttatcttttgcgttccaagcaagcttggaaaagggatacttgtgacgcctactgctgagggaaacctactgctgggaccaacgagcgtcccgattgcaaacaaaaacgataattgtacgacgcatgaaggtatcgagaaagtgaaaagcgatgcgctgcgcatggttcccgccatcaatttgagggatgttattacctcctttgcaggactccgggcgtcaagcgatgcggccggcggcgattttatcatcgaagaaagcgcggattatttttataacgttgcggcaatcgattcgccgggactgacctcagcacctgcgatcggaaaatatgttgcggagcaggtggcgcaaaaattacatgcagaagaaaataatacattcgaaccgaagtgtgcgccgcgcatccggtttaattctttaaatgatgagcaaaggaaggctgtaatcaaaagtgagccggcttatgcaaatattatctgccggtgtgagacggtttcagaaggcgaaatacgcgatgcgatccgcaggcctgccggagcaaggacgatagacggggtaaagcgccggacgcgcgcaggaatgggacgctgccagagcggattttgcctgcccaaggtagtggatatcctggcaagcgaacgggggatatcgccgtttgaggtgcaaaagtcaggagcgggatcgtatatccttaccggttacaccaaggttactttgaaagactaaaggaggattccttttatgaaaaagcatgtgcagctattggtgatcggcggcggtcccgccggattggcagccgctgtagaggcgtacgacaaaggcgtacgcgatatcctgattgtggaacggggcgatatgctgggggggattttaaaccaatgtatccataccggttttggtctacatatattcaaagaagaattgaccggaccggagtatgcgctgaagttctgtgatatggtgcgaaagcgcgatattccataccttttgaattgtatggtgctgcatattgacgaccatgcggttacggtcgttggaaaaggctgcggcgcggtgcggatatcttgtgacgcgcttgtattggcgatgggatgcagggaacgcccgcgcggcgcgatcggtattctgggagatcgtccgtcaggggtttttacggcgggaacagcgcagcgttttattaatttggaaggatatatggtaggacgggaagttgtgatactgggttccggcgatatcggtcttatcatggcacgccgtatgacgctggaaggggcgagggtaaaaatggtatgcgagatcgaaccttactccaacggccttgcgaggaacattgagcaatgcctgaacgattttgatatcccgttgctgttatctcatacgataacggcaatccatggaaaagagcggatcacgggcgttaccgttgccagggtggatgaaaaaaaacgcgtcattccaggcagcgaggaagatgtgaaatgtgatacgttattactttctgtggggctgatccccgaaaacgagctgagcaaaaatgcggaagttgagttggacgtgaaaacgaatggcccaattgtaaacgaaggaatgcagacgtcgaaagaatggatatttgcatgcggcaacgttgtgcatgtgcacgacctggtggactttgtaacacaggaaagcagacgcgcggggcaggctgcggcgcagtatatactggaacatgcatatcgcagagaggacgagacgcgtatggtcgaagtggaaaacggacagggcgtacggtatgtggttccgcaaaaaatatggacagatgcgccggtggaagcgaccacgcttttcttccgttccgatcaggtttacggggatgcggtgatcaaggtgtatatggggaacgaaatgctggcgtcggtccgccggaagcgtatcatgcccagccagatggaaacggtgatccttcccaaggaaaaaatgatggatatggaaaatatcggcggtacggtgctcaaagtggaaattgtgccggcaagccggcaggagcaagataaaacagacgaggtgaatgattgatgagcaatatattggaactccctttaagtaaaatggcaggtatttcgtttgactgcgcctgcggaaggcgccattccctgccgatcaagcatctttcaatcggcagcggcgtattgccggagattgtcgggatggctaaacaatttgagggtaagccggttttcatgctgagcgataaccatacgtttgaagcggccggaaaacgcacgatggagatattaagtgatgcgggacacaaggtaaaaagttttgtgtttgagacgggagaggatatcctcataccggatgaaaaagcgctgggcaggctgtttatggaactggaaggcggtacgggtctgattgttgccgtcggttcgggaacgcttaatgaccttggaaaatatatatccgcgcgtacagggataccatatatcatcgtgtgtacggccccatctatggacggatatgcttcggacggcgcgccaatgatatgtgacggctttaaaatatccttcgtagcgacgcttgcatacggcattgtagccgataccgacatcattaaaaaagcgcccactcacctgatccacgcaggctttggggatgtacttggaaaatttaccgctcttgcggactggctgctggcaaaagaggtatgcggggaatactattgcgagacatgcgccgatttgatccgcgctgcgctgcaaaaagtgacggacaatgtggaaggcctgaaaaaccaggatgaacaggcaatttgcagcctgacggaagcgttgatactgagcggtgtagccatggggctgatcggtgtttcgaggccggcttcgggtgcggagcatatgctttcgcattattgggaaatgtattatattgcgcataaccggtttccggaactgcacggcatcaaggtgggcatcagtacgccggttattgcggaaatgtttgagctgatgcaggacaaggtccctggaagcgttatgcaaatctgtccttcccgtcaggagatggaagcattgttgcggcgtgcaggtgcgccggtgctgccaacggatatcggtctggaaaaagaattgttccacaaaagcctgttggaagcctatactgtgaggaaacggtacagcattttgcaacttgcagtggatgaaggccggatcggggcatgcgctgatacgatcacgaaacgtatctatggataaatcaaggtgagcactatgaaaaaaataagggaaatcacctgtatcacctgtcctgtgggatgtgtgatacgggtagagactgaggacggtaaaattctttctatggaaggaaacggctgcaagcgcggcgcgcagtatgtacaagcggaggtgaccaacccggtgcgtatgctgacgacgacagtgcgtgtcgatggggggaaacagccggtggtatcggtaaaaacggcaacgcctatccccaaggaattattgataccttctatgaagatattacgcgaagcggttgcaaaggccccggtgcataggggcgatgttgtcgtcaagaatattttggattccggcattgatatcatatcgacaacggaagcaggatgtgtataaacaatagatagaagggagaatgtggggaatgaaaacgaaaaagatagcgattgggtgtgacgaagccgcttttgacatgaaagagacgctgaagaagcacttggtggaaaaaggatatgaggttacggattgcggcgtttataatacggatcctgttctttatccggatatcgcgtataaggtgtgcagggaaatcatggaagggcgctgcgaacgcggagtgctggtatgcggcacgggaatcggcatggccatgacggccaataaaatacaggggatacgcgccgccgtatgtcatgatcccttttcaacggagcggtctgtaaagagcaacaatgcgcagatctgctgcatgggggcgcgcgtgatcgcgccgcagcttgcggtattcctgctggatctttggctcaactgtgaatttgtggacggtccgtctacagagaaggtagagcgcatctcctactatgagagcaggtgatcctggctggcgctgggcgggtggttatattaatgatttcatccttcgtaagagaaaaccggaatatccaaaagatattccggttttctcttaccttgcagttaaagttttgcggtcacaattctttaaacgctacaattggcattcgttcagcaagatacgcggccaggtctgccatagaaaacgacttttccaccttgatggatagctgtacctgtatgacgcccggccgtgaggctcgtcttggattatcattgatatccacattacgtatatgtgcgccacatgctttcatgcccgatatgagggcgggaagatcctccgtcttttccagttcgaccatgaggtcgatccatgtgaagatattggacgaaccgcgcgattcccatttgtgcagcattgctatcgtaacaagtacgatcaccgtggcgacgattgcaccttcaaaataaccggcgccgtaagcaagcccgatacatgcggtcgaccataagccggcagcggttgtgaggcccgttacctgccttcctgtgattaggatagtacctgcgccaaggaaaccgataccactgatgacttgcgcgcccaaacgggcagggtctgcattgggattcatgtacgtgaccaggtattggtccgtaatcatgacaatacaggcgccaagagatacaaggatatgcgtgcgcagtccggcggcacgccccttgcgtccgcggtcaataccgataataccggcggacaggcaacaaagcgcgagcctgagtatcgcagataatacgctaaagtcccgaacggggtcaaaaattgctaaaatggaggccacctcccctctgtttcatatttaagatttatgcctttatccggtaggtgcacgatggccgcatttggcagcatactgccagccgcatacaagtcaggcgactggcagtatacgccgaacactttggtattatgttctaccaaacaagcttaccggctttgagcagttcgtcttgttcacggcgcagctttaagatataggaatcttcatcaagatcgaccatgtcataggtgatcagttcgcctgcctttacgtctgctttcagctttgtctttttattgaccagtcccaagggcagcgcattttttgcctgcgcatccttgaagctgtaaaaaccgccatatacggtataaccaccgatgccgtcaagcaactcgcccgccttcatgtcttttttggcaatggtcgtggtttcggaatacggtgcgccaagcttcggaacgatgctgggtacgccaaattgcacgatcctggcaacggacatgggtgtttcgagactcgtgaggtgataggggcggaacagtgtgtagttcggcccggggccaacctgcagataagtgagctcatgacggacttcaggcagtttactcgtaatgatcgcgtatacgccgggtgcaacaccgttaatatagtcgacagactgatagtggtcaaggataccgccttcgctctttaaacggtatacctgatcgagctctttcacagtcgactcgtagccggtgccgttggtaacggcgggaaggaatcccgttgcattggacattgcagtcatctctaccatggtttttgtaccatctttgaaggccgtcagcatcttaggactcatgaccttacgggcagcttcttctgctgcgacgtcaggattacatgcgaggtttactttattgttcttgcctttgccgatcacgaggacgtcaaagccgagggcagtagcaaaatcatataattccataacagcacccggttcgtcccctgcagagccggaataaataacgccctcttccttggccatcttataaagaagcggtccgacaacgacatcagcttccacattgagcataacgatgtgtttatgcgccttgatactattcacagcaaggcgggcgccaatttcagtcacgccggtggcatctacgatacacgggataccgtcggcagcaacggcgacgtccgcgtcttcagtgatcacatatttgccggccttgatataatcgctggcctcgctgccggtttttgccactttgatttcctcttcgggaatacccgcgtgcagcaaagcgttgcgcgcattatcaagctgtatatcagctacgatcgaggggatcatacctttcatcaatacgacctggctcaccatgccgcgtcccatctgccccgcgccgatgacagccattctgatcggtttaccctgctcctctaatctcaggagctcatcgctcattccaaacatagaattttaccttcctttaccgtaaattatttttatcgtataaactatggaagtgaagcatagttatacacaaagctaccaatgtgcttatggcaatctttttttaatctgctctaaaaacgaatagggtacgcaaagatccccataaccggtaccgagggcaagccccggcttgaaaataccgtggaaatcactgccgcctgaacgcgctgcgccgtattcgcgggcgatcgcgtccgtttgctgccgccagaaatcattgtattcgcaataaagcgtttctaatccgtccgcaccgtctgctaaaagacgcttgcaaatatcgatacaatgttccggattatccggatcgatttggtggagatgggcgacgaaaacaagtccgcctgccccatggataatttttataaattccgcaggatcgggagtgcgtcgcttgacgtaaccgaccgtgcccttgctaagatagcgtcttatgacctcttttggcgtcaagtcatgatatttgttttggatcaacgccttcgcaatgtgcccgcgcgagatcgcgccgtccccatattggttgacatcttccatagaaattgggaaatcagctttttcaagggcccgcaccatgttgatattccgctcgtcgcggctggccgcgagatccccaagggcatccttcagagcaggataatcaggatcaaagaacaggcaaaccaaatggacgtcgcagtcgtcaacggaaacggtggtttccataccacgtatcgtttccagatgcagatttttgccagcctgcatgaattcctcaaggccgtctatcgtatcgtgatctgtaagcgcaatggcgcaaagaccaattttttttgcatgctccgctagctgcgtgggcgaataagaaccgtccgaggctgtactgtgagcgtgtaagtcgatggttttcaagctaaatcctccttaccggaaaactggttccaaaagcagattttacacaatgtctacgcaacacatatgtaatttatataataagaatctattataaatactatattatccaaaacaagggggtgaattccacgatgatcgatctatctgggtgaccagatgtgacatctggtcatataacttgctgaaatattgaattctgtttacaattcagtattctattccctttttaatttggtgtcaataggatgagcaaaatttttgcaataaatatactgacttttataaaagttgcacaaatgtgaatttatttttaggggcatatgtattgacatgcgtggaataggggtgctaaaatgcaataaaagaaaccccaacagagcagtttgaatttttcagcataggaaatttttaggcgcgtaaaatggtgggcgcgcaaataagaaatcattactcaaggtccccattgcttatactcaacaagttaattaaatagcataacaaaaggcttttttaggcttgcttgttgatgcgaatttgccttatccgacatatgaaaaatagttttttatcttttcaagttttcgcaggagcgaaacataaaggaattaggaggaatagaaaatgaacttaaagaggatttttgtaacggtacttgctgtagcgatggcgtttacgctgtttgcttgtgcaccggcgacggaaagcgaaccgagcgactcggcggcggcttccacagagcctagcgcagatgctaccactggtgcagaagaaagcaaagagactgctaccactggtagtgatgtaaaaggtgaattgacgctttatacgtctgagccggaagagttggttgcggaaatgatttccgtattcaatgaaacctatccggacgtgagcatcgaagtgttccgttcagggaccggtaaagtaacatccaaactggatgcagagctccaaacggggagtactccggcaaacatcctttggtttgcggacattggatatatcaacagcctcgatcaggaggggatgatcctgcattattcaccggaagccctggcaaacattgatgagcagtatgcgtacaatgaaggtatgggacacgaagtccgcctgatttataacgttcttgcttataacacaaatgaagtatcggaagggcccaaggattggaaggatgtcacgactgaagaatacaagggaagcttcggtatggcgaacccgaactattccggcggcgcattctccgcattggtcgttcacacccagtatccggatgtggtaggttgggattggtaccaggcaatttctgacaacgactgcaaatatgaagaatccaatggaaaccttcagacaaaagtttcttccggcgaatataaagcggtagagctggtagatttcatggcacgtaatgcaaaagcggatggttcccctgtggaagttgtttatccggaatccggcgcagtattggttcctacgcctatggcactcatgaacaacattccggaggaaagtattccggcggcacaggcgttcgtcgattggtgtctgacggacgaagcacagcagttgtttgttaaccagggatacatccctgtaacggacatccaggggccggaaggcgcgcctgcggcatctgaaattaaagtactgccctttgacctcgactactacgtagaaaactccacagcgatacgtgaagaatatacggaacgttttggcggagcgaatgcgtaaatagtattttcaattaagccccgagcaggatccggccgcagcctctctaagggttgcggccgggttaaaaaggggatatgtgaagcggtgtgacttcaggagggcatttcatggggaaggaactttacaaaacgaaaaagggatggattggccctgccgccatctggtggattattgttttatttttaatctttgtcgtagtatatccgattatcgttcttattcttaacagttttcagaccggcgataccttttcgcttgccaactacgcaagaatttttcaggacaaatctattgtaaacagtatgttgaattcgctcaaagtggttgtgccttcaacattgatagcaactgtgctgggcgtatttcttgcatgggctgtagtacgtacgaatgttccgggaaagagagtatggaaaaccctgctttccatcccgtattttatcccgccgtttatcggcgcgattgcatggacctttttacttggaccgaaaggattttttaacgaagcggcgatgtcgatgttcaatttaacagaaccgctcttcgacgtgtatagtatcggcggcatgattttcgtaatgtctatttacaggttcgcggttccgttcattgtcgtgatgccgacaatgcaaaaagtttccgcgtctgtggaggaggctgcgcgggtttccggcgcttctccatggaaaacgatgaaggacattaccctgccgttgcttggaccgtccattatcggcgcgatgcttctggtatttatgtttctgcttgcagacttcggcgtttctgcggttttgggagcgccaaaccagattcgcctgatgacgacggagatattctatattatcaaccggccggatatggcggatcacttacagatcgcggctgcatattccatgcttttgtcggtatttgcgctattgggcctgtgggcctacaaccgtgtcctgcggaccaacaaatatgcggtcgtaagcgggaaaagcgcggttgtggaaccgacgaggctgagcaataaagcaaaatggatcttgtttgcagtcctgctcgtcattttcctgattacgacgtgttcgcctattgtggcgtcgttgatgacatcgctcacaaaggtttacggagtgccgtttgggccgggtaatataaccttcgacaacttcttaaatctaatggatatcaaaaatatcgcgcgggcgttccaaaacagtgcggtattgtccatcgtctcggcccttgtgatcatggtagtcacgctcattgtggcgtacatcgccattcgcaagaatgtgcggggcgtggcaggggtgaaagtcatgcaggtcatggtcaccttgccatatgcgctgcccggaacgatcattgccctgggtatgatcctatcctttacgcaaccgctgccgatcgtcggatgggagctttacggaacctttggaatattattgattgcttacatcgcccgcttcctgaatttggggtacaacaacatagcgggcgcaatcagccagatagatccatcgctggaagaagctgcacgaatatccggtgcaagccagatgaaaacgttcaaggatatcgtcgtgccattactcaaaaccagtttgttcagttccttcttcctggtagtcgcgccgacattgtcggaaatcagcctgtcttcgttgttgtggtcggttggaaacgaaacaatcggtaccgtggtgtattcatcacaggaggaggggaaaatactgcgaaccgccgcgcttgcaatcctgttgattgtaattgtcgtgctgctcaacttccttgtacaggttatttcggaacgaagcggaaaaaaacgtagtaaaaagaaaaaaacatcaggggatatcgatcctgcgtttacaatggaggagtattaaatggggaaactaatagtaaataatctggtgaaaaagtttggggagacggtggccgtaaataatgtatcgctcacggtagaagacggcgaactgctgacggtcgtcggcccatccggatgtggaaaaacgacgtttctgcgcatggttgccggctttattgaaccaaccagcgggaagattatgatcgacgaccacgtgctttcggaccgtgcgaaaggattgcgggatgtaacgccggaaaaccgcgatatcggcatggtattccaatcgtacgcggtatggccgcacatgaatgtgtttaacaacgtggcgtatccgctcaagatcagaaaagtaaagaaagcggaaatacatgacagtgtgatgtcggtattgaagctggtgcatctggatggactggagcaacgcatggcttatgagttatccggcggccagcagcagcgtgtcgcactggcgagggctctggttatgaggccgaggctgttgctgctggatgaaccgctctccaacctggatgcggcgcttcgtgaaacaatgcgcggcgagatcaaagagatccagcgaaagctggggatcacgatcatcaatgttacacacgaccagatcgaagcaatgacgatgtctgataaggttgcagtcatgcgtcttgggaatttggttcaatacgattcgccatacaacctgtatgaacatccggtcaacacatttgtggcacagtttatcggctcggcaaatatcattccggcgaaaaaagcggcggatgcgaaggcggacgccgacggcatgatggatgtcagcgttatgggaaaagcgacgatcaaagtaccttacgtggaatcgagccagacagaaggatttgttgcagtacgtgcacaccacatactgatcacggaagaagaaaccgctatcaagccaacgattgcaagaagactttatcagggcaatcaattcgagtatttcctggatatgggagaaggcatcacgatccgtatgctcacatccacaacacaggatatccctacgggaaaagaagttccgattgaactgacgaaggcagtgtggctggatgaataacagttggaccatgaaggcgactgtccttgggtggtgcggtggatttccacggagcggcgaggcgacgtgcgggatcttggtcgaaacatctgagggctcgatacttctggattgtgggagcggcgttttgtccaagtattttggcgcgtcggacgtcgatcagttgagcggtttgctgatttcacatttgcattatgaccatatggctgacctgggatgcctgcagtattcgatcaaccatgcgatgcgggtagggatgcgcagcgaaaagctgccgatatatgtaccgggttcgccggataatatgtggaaggcgatacaatatccttatacagagtctatcgccattacagatgggatggaatttgaactggcgggcatgacggtcacaaccaagaaggtagagcatacgatcgaatgttatgctttcaggctggaacgggatgggaaatccatcgtctattatacggataccgtctatttgccggatggaaaggaatttattgatggcgcggacctgttgttctgcgaggcgacgatttcggaaggaacacggcattcaacaggtaaggggcatatgacggacctggaggccggttgtacggcacgggaggggaatgcaaaggaattgtgcctttaccacctgcccagcgacggggatcttttgttcatgcgggaacgcgctgcatctgaatttggaaaggccgtactgacgccggacctgcggcatatctattatgtttgaaaaatcaaggcttgcttctgtcaaataagaatgcgaatcggggaaaacgggttctcgtaaagaggacccgttttctttttcgcagataatcgatcagcggataaaatttgaggaaaaagtatgagcgaatacgctttgcggacgttacaaaagatatgctacaatataaagaaaacgcaatttaaaaagaaaagaggccggaaaatgaagaaaaattgggatatcatgcaggtatgcatcgttgtaaaggacttgaaaaaatattgccggaacttttgggagaaaatggggatcgggccgtggacattgcggcatttttccaatgaaacgttgagggattacaaagtggatggaaaagtggtcgaggaagattttgacttttatattggattatgccaggcgggcaggacacagatcgagattatccagcccatcaaggggccgaattgttattggcggttcctggaggagaaaggcgaaggcctgcaccacgtgaaggcagcgattacggaagatgagataggcgatgtgatcgcaatgtttgaaagcaatggagaaccgatcctgcaaacaggctggtgcagcggggatttccatgcgtatccggatacgcagaaggatttggcgatgatgttcgaggtcggcgtgcccggggaaatcgacgtaccgtacgaattatatccgccggaggcagtcacggcggacggtcaataaaaaacggaggattctaaaatggagaagctgagatggggcattgtcggaacagggtatattgccggaaactttgcatgcagcatgcggcaggtggcggatgccgcgcggatagcggtcacgggcaccagcagtgaaaaagcgtgcagatttgcagaccgatatggatttgaagcgggcttcgataactttgacgaaatgctgaagcaggcccgattggatatcgtttatatcgccgttccaaaccacttacattatgatttcgtgatgaaggcgctctcggcgggcataaatgttttgtgcgaaaagccgatggcggataatatgctgcagcttcaacacatgatggataaagcacaggaaaagaaggttttcctcatggagggcatgtggacacgttgttttccagccgttcaaaaagccgtggaatggatagaaaacggaaggatcggcgatgtacagtctgtccgtgcggattttggattgcgttctgcgccggactggcagaactggaaagcaagcgcacaggcgagcgcgggtgctctgcgcgatgtgggcgtatattcaattggtatggcatttttaggcttcagggaagcgccggagtcgatcgtttcgtcctgcaaggttgaaaatggggcggatacgcatcaggaaatgatgttccggtatgctggcggcagggcggcctacctcacaggatcgtttgagatgataacggatcatcatgcgtatttttatggaacagaaggagcgattgttttaggcgacaaattttggtgcccgacatacgcggagctttattcctatgacggcggcgatgttttcgaaaaaaagctggtggaacgttttgaagaaaaatacgaaccgtttggattccaatatgagattatccatgttcaggatcgcatcaggagcgggaaaaaggagagcgatttttatccgcttgcagaaagcgccgctatcatgaaggtgacggacgcgctgcgcagggaatggggcgttcgctatgtgtctgatcccgaatgataagcagaagcagaaaaagattgataaaaaggccttgccggtttagcggcaaggcctttttataggtatgggagcgcccggcgcgctggtaaaagcatatggatttttacatctgattggtgtaaaataagaggaagtatcggaggggaaagcatgcaggaaataaagtttactaccacaacaaattacgcgatttttaaagactattggatgttctcgttatttgaaaaaaaaggaccgaacggcaagatgaacgcctttgcaaaatttgtaacggttttatgcgtactggtagggattgccgttgtgctcattatatgcaactatgcgcttctggataacgcgatgggcgtagtaccggtgattcttttaggcgcggtcgcggcggcgtttgtatcctgttatgttactgtgacaaggacgcagcccaaaaagcaataccagacggtaaaggaagcggtggaaaatccgcagaattatacgttcagggagacgcaaatggaggttcgcgaacatgacggacaggaggacagggaaacgcttgcggagtttcagtatgatgatttggcgtatgtatatgaaacgccaaaagcattttacctgtttatcagcgatatgaatgcgtttttgatccccaaggaacagcttaaggacattacgccggaacagtttgcggcgtttttaagcgggaaaacgaaagaacggtatttgaaaagtaaaaaatgcggttgagcagggtgcaaaccgttttatagataccggaatggacatgcagtatatttatcctgtataatatataatggtaggaaaggcgcgctttatgtaagcgcataccttctaaggagatgaaacaaaatgtatgatgtaatgattgccggctccggtccggcggggcttacggcagcgatttacgcatgccggagcggcctgaaaacattgctcctggagcgggcgtttgcgggggggcaaatggcgatcagccatatgatcgataattatccgggctttgagcacgaagtaacgggagcggcgcttgcaaacagtatgaagctgcaggcgcagaaatcgggcgcagatatggtaacagaggaaatcaaagcctttgaactcatgggagaggtcaaaaaggtcgttaccaacaagaacacctatgaagcaaaagcggtcattctggcgatgggcgcagaaccaaagcgccttaatatcccgggggaagaagaaatgatcggcgcaggcgtttcctattgtgcgacatgcgacggagcgttttttaaggatgcagacgtggcagtgatcggaggcggcaatacggcggtcgaggatgcgctgtatctggcgaagttttgcaggaagatttacctggtgcatcgcagggaccagttcagggcaagtccgtcgttggtggaagcggcccaaaaaatggataatattgaattcgtattggacagcattccggaatcggtcaatggggaatatacagtgcagagtttatccgtgaaaaataaaataacaggagaagtacggcagctttttgtaaccggcgtgttctttgcagtaggtcaaatccccaagacaaaattactcgaaggccaggtagaactggacgatggcggatacatcaaatctgacgaaggatgcaaaacaaatatacaaaatgttttttgcgcgggcgatatccgcacgaaaccgctgcggcagatcgtaacggccgtagccgacggcgctgtggctgcaacagcggctttaggattcgaaatataaagaaaacatagagtgccctgcaagaacccggcgaagtgggtcttgtagggaagaggaacggcagtccgtcagcgagacttttgaccgagagggcaaaaacaagtatgagggcttgctgcgacgagaaagtgaggaaaaagcatggcaagactttttggtacagatggagtacgcgggatcgccaacgaaaagctgacgtctaaattggcttatgatttgggacgggcgggcgcgtattgcctgaccaatgaaatacacagcgcgaaaatattgatcggtaaggatacgcgcggcagcggcgatatgctggaatcggcgatggtagcgggtatttgttccgcaggggcggaagcggtagtggcgtgtacgcttcctacctcggcgatcgcttatttgacgcgtcattccggatacgacgcgggggttgtgatttccgcttcgcacaacacggtggaatataacggtattaaatttttcaattccaatggatataagctggcggatgaaatcgaagaccgtattgaaaatatcatcatgaacaattccgaagaagtgccgcagcccacgggcaagaagatcgggcggcgggtgcgcctgaaaaaagcggcgcaggattatattgactttgttgtggaaacgactgatgtcagcctggacggtatgaagatcgtcctcgattgcgcaaacggcgcggccagtgaagtggcgccgtggatcttcaagctgttgggagcggaggtcattccgtattataatacgccggatggtacgaacatcaatgaaaattgcggctccacgcatccggagcagttgtcgcgcttggtgtccgaactcggcgctgacctgggactggcgtttgacggggatgccgaccgcctgattgccgtggatgagcacggcagtatcgtggatggggataaaatcatgtctatctgcgcgttggatatgaaaaaacgcggggctttgaagcaggatacggtagtgaccacggtcatgagcaatatgggcatggaggtcacgctcaaggagaacgatatccatatggtgcgcacggacgtgggcgatcgttatgtcctggaagagatgctggcaagcggatataatttcggcggggagcaatccggacatattatttacttggattacaataccaccggcgatggaattttgtcgggcgtgcagcttgcggctgtgatgaaacgcgaggataagccgctggcacggctggcgcgtccggtaaatatttatccgcaggtccttgtgaatgcaaaagtgagcgatgagaaaaagcacgattatgaaacggacgaaatgatcgcagatgaaatcaaaaagctggagcaggagttccatggcgaaggcagggtgctcatccgtacgtcgggtacggagccgctcgtgcgcgtgatgatcgaaggcaaggataataatgcgatcacaaagcatgcggtagcgatggccaaactcatcgaaaaacgcttgaaataagaaagagagaatacagggtatatgtgtggaattgttggatatgcaggtgataaaaatgtaattccggtgctcataggaggactccaaaagctggaataccgtggatatgacagtgcgggcgtagcgtatcttgacggcgggaaaatgaacgtcatcaaggaaaagggtaagctggtcaaccttgaaaagctggtagaggaaaagtgcgcggagcatacggtcgggatcgggcatacgcgctgggcgacgcacggcgaaccgagcagcgcaaacgcgcatccccatatcaatatggcaaatgaccttgcgatcgtacacaacgggatcattgaaaattatttgcaattaaaggaatccctggaaaagaaggggatcaaatttgtatcccagacggatacggaggtgatcgtccatctcatcaactattacctgaaagacgacttgaaggacgccgtggcgaccgcgatttccaagctgaaaggcagctatgcgctgggcgttgtcagtgagcggtttccggatgagatcgtagccgtcaggaaggacagcccccttgtggtagggcttggaaagggcgaaaatctgatcgcgtcggatattccggcgctccttgaatatacgcgtgacgtatactttttaaacaatggcgaaatcgcggtgatcaaaaaggattccgttactttgtatgatgaggtccttaacgagataaaatgtgagccgtataccgtggaatgggatgtgtcccaggcggaaaaagcgggctatccgcattttatgatcaaagagatcgaagagcagccgcgtgtattggccgatacaatgaacccgcgtatcaagcgcggggaagtgtgctttgatgaagccaatcttacggacgaggcgcttaaaaatatcaaaaagataacgatcatcgcatgcggcacggcgtatcatgcgggctatgttgggaagtatatcatcgaacgctttgcacgcgtgccggttgaagtggagatcgcttcggaattccggtataagaagccgatcatggatgaggataattttgtgattgtggtaagccagtcgggcgaaacggctgacacgatcgctgcgttgagggaagcgaaaaagcatggcgcgcatgtcatggcgatcgcaaatgtggtaggctcaacggtctcgcgtgaggcggacagcgtgctgtatacgcgtgccggaatggaaattgcggtagcttctacgaaggcctatacgacgcagcttatgtgcttgtacctcttttgcctgaagcttgcttacgcaaagggagagatgacagaggagaaataccgcgcgaatgtggcggagcttgaaacgattccggataaggttgcggcgatccttgaccaaaaggatttgctccagaaatttgcatatgagcattttacggaaaagagcgtgttctatatcggacgtggtctggattatgcgcttgctatggaaggttcgctgaaattaaaggagatcagctatatccattcggaggcgtacgcggctggagaattaaagcatggcacgatcgcgctgatcgaagatggcacgttggtggtggcggtattgacgcagggtgagctaatcgaaaaagcgctgagcaatgtgaaggaagtgacggcgcgtggggcggtcgtactggtcattacgcaggaaaaatataaagatatggcaaaggatgtagcggataagctggttgcaataccggattctgaggattttacggcgacgatgacggcaattatccccatgcagatttttgcttattttatggcggtgcagaagggatgcgacgttgacaagccgagaaacctggcgaaaagcgtcacggtggaataagcagatatgggaacaaaggaaagcaatacaggcagccgcgtcgagcaaaaaaagcaacaggtaagcgttaagaaaaaagcggtgtggggatggatccttgcgatcgtgattgcagttgcggcagcgtttttaattcgcgcattcctttttgagatcattatggtggacgggccatccatgcaacctacgttgcacacggatgagcgccttgctgtagaaaaggtgacgcggtatggcggacttccgcagcggggagaaattatcatcgttcattatccggacgggacgaacaggaattatgtgaagcgtgtgatcggcctgccgggagaaaccgtggaagtaaaagacagcactgtctatattaacgggcaggtactgcaggaggactatgtcagcactgagccttatcaggatgcgccggccgtagtcgtaccggaaagcagcgtttttgtgatgggggataacagggcaaactccatggacagcaggatggtaggggcgattccgcgcgatcagattgtcggccatgcaatggcggttatttttccattcgacgaatggcgagggctgaataattgatgaaagagaacaaaaaaacggaactgcgaatggcggtcccgtttttgatttgaaacagataacagataaaggaattatgataaagaggaagcgagccaaagaaccagcgcggtgatagctggaacaagaaaaagaataagcaaacggccgcttgatcgatgaaggaacggagtatttttcatcgaatcatcatccgaaagaccgtcgcgatcggtttcccctgtcgtttcggcaactaaaaaattccccaaaatttcttgagcgcggtcctgatccgcttcatcgacatacagctttttcccatacaccgaatagccggaatagatgctgatatagtccccgacaagcgttttagaacgaaccaaaacaggaataccttcctgttctaaaatattggcaataatcttactattaagatcgtccgcagaatataggaaaacaggatgcatagcacgtggttcaggatcagggggctcttggggctgctgcggcagtttatctacaagctcgcatccgcaatcagcgcagaccgtatatccttcgtcatattcatcgtggcattgtggacaaaaaggcatggattacacatcctttcccttgccggtttccttttcttttttctcgagtcgattcaggattttcttttgctgttttttcataagtacggacaacgcgcccttagtgacgacgcgctcgatcagtttcatgataaacggcataagaataacaatgatagcgattacgatgatctgcgggaggctcagcggcgagatatcaaagaatccgcgcaggaaaatgagacacaggacaaaaacgcccagggagctgccaagtataatttttcgcgcggtcgtaaacggccggctgaccttgacaacaacccaaagaccagccatggtagccagtatcatgcacatggtggaaacagagtccggcgaatattggaatatgcctgccagaaggtctacaacgaggatgctgatcattacacacaggccgccgggcagcgatttttccaggatactgatgagaaagtgcttttgaataggagcataatttggctccagagcaaggaagaatgcagggaaaccgatgttgacgaaactgatcagcgttagctgaaggggcgtaaacggatagctgctgtcgatcaggatcagcgtcatcagcgcgatcaaaacagcatagacagtttttgtgataaacagcgtcgctacgcgctggatgttgttgataacctttcgaccttcgttgacgatggaaggcatcgttgcgaaattagaatccatcagcacgagattggaaatgttttttgccgcgtcgctgcctgaagccatggcaatgctgcaatcggattctttgagggccaacacgtcgttgacaccgtcgcctgtcatggcaacggtatggtcctgcgccttgagcgcggcaatcaattcctttttctgggagggcgttaccctgccaaatacactgtatgttttcgctgcgtccgcgattttttcaggtgtatcgagcgtagccgcatccacggcttccggatttttgactcccgcattacgggcgatcgcgcttaccgtcaccggactgtctccggatatgattttgatatctacctgctgctgttcaaaaaaagccagggtttccgcggcatctttacggatacggtcggcaatcataataaaagcaagggggtgcattccctgcgggacttcgttatcctccgcaaaataatcgctgtgcgcaagaacaagcacgcgagcgccgcccctcgcatactggtcaggatcgacgccggggaagggctcgggaaaaataaactcatatgcgcccaaaaggtatgtcccgcggtcttcaaatgctacgccgctatatttccgtgcagaagaaaaagggatgatgtgtttgacagaatagtcaaagcgtttcccaaatttttcacggatggcgttcatggtggcattgtcatcttgcagcgcaccggccatgttggctagaaggttggaaatatcagccttacgaagggggataacatcttcgacctgcatccggccttctgtgatcgtccctgttttatcaagacataaaacgtcaacgcgcgcaagcgtttcaatacagtataggtcctgcactaaggtgtgtttggtagcgaggataactgcgcttgcggcaagcgacatactggtgagaaggattaaaccttccggaatcataccgataagggcacccacggttttcactgtattgtctgcaatgggaaggccgacacccagccattgctttaaaaacaagaggataccgataggaataatgatgatactgatgatcttgaggattttattgagcgcgctccgaagttcggagtgacgctttttagttacctttgcatctgcggaaattttattggcgtaattttcaaggccgacatgctcaacgcgcgcatacgcattaccggaaaccacaaagctgccggaatacaggaagtcgcccggggacttgatgatcacatccgattcgccggtgatgagagactcgttgacttcaagcgttccttcaagcagtatgctgtccgcactgatctggtttcctgtctttaaaagcataacgtcgtcaagcacaagatccgttacattgatcgtattttcggcgcagtcgcgcacgacagttaccttggccgtaaccaagacggaaagtttatcgagggttcgtttggtggtaagctcctgcacaaggccaatgatcaggtttccgccaacgaccagcaggaaaacgagctctttgatgtagcctgtcatcacgatcagaaccgtaaaaaccaaattcaatatattaaagaacgtcaaaaaattgtctttgaaaatctgccggtaagttttcgtcgtatgtgtattgtacgcattggtaagcccctgatcgatgcgttcctgcacctgctgggctgtgaggccggacttacacggcgactcataacggggagtttctgccataacgttcctttcaacgaatcaatgatatctctgccgaaggacaaagtaagaaaactaatatttattatatcatattttatggactatgtatgaagaaagacgaaggaatgtattacgaaatgataaaaatgagcaggatttggattgggatattgtttagtcgtttatataaagcaataaatagttcgtatatgggagatgaacaggatgaatgcacctgaaaatttaagatataccgcgacgcatgaatggatcctttttacggaggatggtaaggccaaaattggcattacggattacgcacaacaggtattgggcgagatcgtgtatgtaagcatgccgcattcaggagaggaatataaaaaaggtgatatttttgccgatgtggaatcggtaaaggcggaagcggaaatatacatgccgatggacggcaggattttaacggcaaatatgggactcgtggaacaaccgcaaaaagtgaatgaggatgcatatagcgcatggcttgtcgaggcgcgcggtttaaaggatgaagggcttatgagcgctgctgagtaccggaaatttgtagaagaccttaccgcaaacggataaagtagaaaaagagcaaaattgtttgcccttttttaataaaatcttttgcatgcatatgaaaatgtgatataatatttctcacggaggcatagctcagttggtcagagtacctgcttcacatgtagggggtcgctggttcgagcccagctgtctccaccagaccaatataatccgaatcctataccaatcggcgaagggttcggattttttgtttatttggttttggaatcaattcacaagcgataattatttcgtggattttcgttaatatatcagcctaataatcatctttttattaaactgggattgcttaattatggtataataaaaacaagtaatatgttataagcatgcgcagatgcagcttgagaaacaagaattttactctcggaatatttttttgaccaaagggaatcgcagggcgagcaataagttgctgcataatgaaaaagtgataattaatatataagggggtatgaaagatggaagattggtcacaaaggcaaaatatgcctgatgataagattttacggagccctatgttgcgagtggaaggaaatattatagcaacagattcggatatattacaaatttccagtatatcccgggtttggactgcttacatccctccgaaacccaattccaaaaaaccgttagtttttggaactatattattgttgattggttctatgagcctttgtgcttatagtgaatataaagatatgtcgctaggcatttttgccggttgttttatacttgtgggtattctatgcatactggtatttgcattgaaaaaagttggcaacaatgtatatatattgaatattcagttgaattctgggcggacttattcttacgcttctgatgcagcgccatttatttcagaagcctttattatactacaacgaatactgcttgatggcaataaacgtcatgaaaactatttattcaattttggcgatggtaccatagtgaataattcatcaaatgtgcaagtggaaagataggtgttaaatgtgggagatcgtatttacaattatggaaatggcaatattgtaaataaatccgataatgtacagattgtaaattcaacagaatatcagcaattgttggaggaattaaaaaagctaaaggaagcttaccgtacggaatatcctgaggacgaggctggatgtgaggttattaatgaagctatagttgccgtccggaataaaacgggggcgtctattcagcctttgctgaaaaagctggggaagaacgcacttaaagtagccatggatttatcattgacgtttttggctaaattgatttgcgaggcaactggtcttctgtaatattaatagtcctgttttttggcaaaagttccttaagtaaaataagtgattcgggtttaaaagagtatatgcaccaccaattaaaaccctgataaccactatggttatcagggttttgttaggatagctataattttcattgaaacaaaatcatgtattcaaaaaagtttgtctgatcgtgactgtttttctatgcattattttcctggcttctacagtgtgtttcgcaggaagtacgcctaaggcggttttggacgcaagggcaggcgttgcaagggtggtctgcgaatatccgggcgagggtggtatcgcatccggttcgggattcgctgtgggcgacagcgattatgtggattttattgtgaccaattaccatgtagtggagggcgacccttcggagatcatcgtcgtaacggacagtaatatgcaaacaaaggctaccgtatacgcaacacgcccctcgtctgatttggcgattttgcaattggaacagccgatcgacggactgaaaccgctttatcttgacacgggcgatgtggaaaataatattggagcagaagtgtatgccttggggtttccaggcgcggcagattatatatttgacgaggccgatacgtttagcgaacaagtaagcatcacatccggcattatcagttcggtcaagccgttttccggctataccaattcgacgaaaagcgtccagacataccagatggacgtcccgatcagcgccggaaattcgggcggccctttgctaaacggcgccggcggagtagtgggcatcaatgcttttacactgtcgcctgagggaaaaatcatactaaacgccgagaatatcaatggggccatcagtagcctggagttgaaatatttccttgacgacgaagaaattggatatatgcacaacgagtctttcccaatttggattcccattgtaattgttgccgcagtggcggctttgatcgtatttttatggatgaaaaagagaaagaggagcaaggggacgatgaagaaaaagggcaaagggaacttaatcacattaagtgaatatctgggaacgatgcatgaggcgattacgtttgataccgcgatacggattttggcgccggtggcgtaccggttggcacaaatgaacgcgcaaatgcaatggtacgcaaatgttacgccggacaatatccagatcgatccgtctacgggcttggcgcaactgaaggaacaaccgcaagtcgctgtatcgagtggaaacgttgtgatcagccctggatattcgccgcttgaaaaataccgtgcagatattgcggacggcgggtatactgacgtgttcggccttgccgccgttttataccgcttgttgttccgtattgatccgcctgaaatattttcccgcatgcaaaacgaccaggtggtcgcaaataatatcaattccctgccggtatacgatagctacaagcaggcgtttttgaagtgtcttaaccctgacccgcgggaacgctttcagaacgtgggcgaaatgatcactgcgttatccatcgcgccgccgcaggcggcgcctcagcagaatacggcgtggacggagaccgcagcggggacggaggcggcgccggcaaaaaaacggaaaaagaaacttttgtggctgataccgataggggccgcagcagcggtggcgatcgcactgggcgtgctgttcacccaaaattccggtatggtaaagtctgcggaaaaattgttggagcaggagcgttatgcacaggccgtgcagaaatatgacgacgcatatttcctttcggcaggggataatgccaattatgcgctggcgcaggccggagcggcgttccagaatgaggaatatgaaaaggcgctggaatatttaaaaggtgcggaaggcgttgaacaagcggagcagctcagaaaaaatattgcgatcgcttatagcgacgagctatattacgatgataaaaccgatgaagcgctggagatattacagccatacgagggcgaaaaggagtttaaccagcaaattgcgaatatcatttgtcgtgaagcagactggcagtttggacaggacgaagatgagaccggttatgaatggctgggaaagctgcccgatacgcaggaagccagggccgagatcaaagcatgggctccggcatgggtagaaacgtggtatgtcgaggcgggcgactatgagaagacgatagggatattgcagcacattcctttccaggatgaaaagcgggtgacagatgcgattcaagaaatcgtgctgagcgaagcgggatatgcattggacaataacgactacgaacgtgtctctgagttaatggcgttattgccggatgatgaagaatatgcagggatgtccgatgcatacaaggcgatggcgctgatcgaaaaaggcgaatatggcgaggcgcgttcgattttgtatcaattgattgatgcgggtattgaaggggccgacgaggttttagaagaaataaacaatgcagaatatttgggagaattgattaccggatggtggtacaatccaacatatttttatacacggggtgaagatggatgggctaccgatctgccgcttacgaatgaggcgtcttatcagcgtattgaggacgggaagctatgttttgtgaatgatagcaacgaacctgtggtaatttacgaaatatggaagctgatagaagatgaacttgtattaaagagcgagtctggggaaatgtatgaatttgagcgggtaggctagaaaattatattttctgaaagaactgaactaaaagtctttagtcctatggactaaagacttttttgtatccataccattgacaagctagcgaacgctagctatactaaagctagtaaacactagcttggagaatgaaatggaaaaacgaaataccaaacaaacgatattggaagaggcgctgaacctgttttccgtgaacggatatgacggcgtatcggtaaaggacattgcgaacgcggtagggataaaggacagttcgctttataaacactataagagcaagcaggaaatatttgcgacgctgcttgacggtatgaacaaacgctttgaagagacgacggcgttttacaaattaccgcagggagaaatcgagcaggtatacaggcaatatggggaaaacgatctgctgtggttaaaaaaggccgtggaagcgatgtttttgttttttatggatgatgcatacgcaaaaaaatttattcaccttctcatgatcgagcaatacaaaaacaacgaagcggcgagattgtttgaggactggttcataagcggtgcaatcaccttccaatcatccctgtttgaacggctgatgcaggaaggctattttcgcaaggcggacccgatggctgcggcaacgcagttttacggcccgattttgctgcttttgctgatgtacgatgcaaagccggagaagcgcggcgaggcattaaggctgctcgattgtcacgtagaagaatttgcaaaaaattaccacatttcacatggagaaaacgaatgaatttgagtcaatatatgaatgaaggaatctcccagcttgtcaaaacggcgggaaggttctacctcaataatccaaggggaatcgcattcctgatgaaaacggtaccggaaatcaaaaagagcgcgcgccgacgcgagaaaacggaaagagaaggattgcacgtcccgccgttcctcattgcgagcgtgacttcgcaatgtaatttgcattgcgcgggctgttattcgcgcgcggcgggcgcatgcatggatggagcgggacgaagcgaggatatggacggacagcaatgggaaactgtttttgcacaagcgtcggagataggggtttcatttattatactggcaggcggagagccgcttatgcgcagggatgtgatacagacggcggccgcttttcccaatatgatctttccggtttttaccaacggtacgttgattgatgaagagtatctcacgctgtttgagcacaaccgcaatctgatccccgtgttcagcatagaaggggaccggactgcgacagacaaacggcgcgggcagggcgcgtaccagacggtggagcgggtgatgcggcatctggccggaaaaaagatgctgtttggaacttcggtcacggtaacgaaggaaaatatgatggacgtgacgcaggaaaactttgcaaaaggcttgcgcgacaggggatgcggcgtgctgttctatgtggaatatgtaccggtgcagccggaaacagaatatttgatgctggacgaagaggatgtaaaaaaaatgcagggaacgacagaaaggctgcgcaaacaatttccggacatgatccttgtttcgtttccgggcgacgaagaagcgacaggaggatgccttgcgtcggggcgcggctttttccacatcagtgcgagcggcggcgcggaaccatgcccattttcgccctattcgaaattgaacctgaaagcaaactccctgaaggaagcgctgcaatccgaatttttttccgagctgcgcggcattgccgctcgcgcagggcataacggcggatgtacgttgttcgaccaccgcgcagaagtggcggcgctcgagggaaagtaaccgtttgcggtattccggcaattgtggtttttaaaaggaaaggatatggtatataataatatagaaaacttttgaaagagggatgcgactatggaattttttgaattgatcgaagcgcgggaaagctgccgcaaatatttggacaagccggtagaaggcgaaaaaataacaaaaatattggaagctgcgcggcttgcgccaagcggatgcaacagccagccctggcattttacggttgtaagcggggaacaggaagtaaatgcattacgtgatatggtgataaacggtgcggaagatggatcttccaaactcaatacgtttgtaaaaagcgcgcccgtgtttctggtggtctgtgaagaaccggccaagctgctgccgatgccggagaaaaaatatggatctcagcattttgcgcagatggacgtggggcaggccgtcgcttatttgacgctcgccgccgccgatctcggactcggtacgtgtatgatcggtatgtttgcggacagagaggtcgcaaaacttataaaagcaccgcaagaaagcatagtgcgcatgatcgttgcactcggctatccggcagacgaaagcaagccgccgcgcgaaaaagtcaggaaggatttgggagacattgtagcggagcaccacagatagttgttttttatggattttatgccaattttacctaaatatagcactggacaagcgatttcaaaaatgttaaaataaataagtaatttagagtacgaagtgattttacatatttgagaatcatttgtccttttaaatgatcatcaagtatgtattttttcattctgaggtctctgttacacatatttttatttttttgggaggtaccggaatgagtaatggtacagtaaaatggtttaatgcagaaaaagggtttggatttatcacgaacgatgagagcggcgaagatgtattcgtacatttctctgcaattcaggcagatggctacaaatcgctccaggaaggtcagaaagtgacttttgacatggaacaggatacgcgcgacagcagtaaaatgagagctgtcaacgtttccccgatgtaattgacattaaacaaacaaaaaagcatccggtttaccggatgctttttttgttcctttaaaccggttgtgaatagaaaatatgcggatataccgtaagaataatgcttatgcagggctttgttgtggtatacttaaataagaaacacagggaggaatattcacttggtaaaggcagttgttttcgatttggatggaacgcttctggatacgctgacgtctctggaaaaaacggggaaccagatgcttgcggatctggggcttgaaaagcaggaacgcgaaaaatataaatattttgtaggcgatggggctgtggagcttgtaaaaagggcgctttatgctgcgggggatacagggcttaaatactttgaaaaaggaatgcaggtattccgggaatattttaaggagtggtgcggctatgaggtgcatccttatgacgggatccccggcatgctgcatgagcttttaaagcgtggcatcaaaatagcggtattatcaaacaagccgcatgcgcaaacaacaggtgtgatccgagaatattttggagatgggatttttacaattgtacgcggacagatggataatgtgcctaaaaagcccgatcctgcgggtgccagggccattatggatgagcttggcgtaaagccggaggagtgcctgtacgtaggggatacaaatgtagatatgaagacgggccgcgcggcgcacatgcatacggttggcgttttgtggggcttccggacgcgcaaggagcttgaagagaatggggcgcagagtatcatcaaagaaccggaggagcttctggggttggcggaaacggtctgttaaagctctttgatattaaaaggatcgaactggagcgtataattttggtatttggtgcgctgcccatagatcgtggagtagatgtgtagcccgcgacgaaaaaagggcacggttatttccaaaaaatcacagtattcatcctgcaggcgcaggccgcggcgaaaggcggctacaagcttttcgagcggcatgacttttaaagtggcccagcggtcggcaaggtattcaaaacgctgctgcaattcaggttccagttctaaaagattgacgggacaggtatactggtgcccaagttcatgcaccgtggcggcatttcgttcggcagtgtctttcagtttgctgctcaggataatcgtattatccaccgtgagcgcgttgaagtcattgcgaaaggtttgcgtcgtaagtgtcgcgccaatattcttgatttcttcatccagtaagtcgtttaacatttctttatcctcttattaacaagtataacaccgcaggctgtcgaatcttgtcgctgtgtgtaggtgttttgaagaaattgaaaaattttcctttttggaaaggggaaaataacgttgtgagttttttaaaatggcttggaaaaataatattcatgtatgcagcttttgtcatattgttcgtgttctattactttgcttcgcccgaccaagtcgcttggtatttaaaggcaatgtttgatggcagcggatacagcaaaccaaagggtttccagagttacagggacaaggtggagattctggaagacatcgattacgggtcggcgtatacggaaggaaagatggatgtgatccggccgaaggggcggcatgcaaagcttcctgtcatcttttggatgcatgggggcgcgtatgtgggcggcgataaaaaagatacggaaccatacgggatatgccttgcaagcaagggatacgtcgtggccaatatgaattatgcgcttgcgccggaagcacactatccaacgcccttattacaggtcggcgaagcgtaccgctatatcgaaaaacatgcggaagagtacggaatcgatatggacagaatgttctttgggggagattcggcgggtgcgcagatcatgtctgtatttttgaatgcggaaacgtgcgggagttatgcaaataagctgggcattccgcagacgatcggtaacaagaaagcgatacgcggcgcgctgcttttctgcgggccgtacgacatgcgcaagcttgcggatatcgatgcgcctatcgtagggtttatgctgaaccgcgcagcgtgggcttatatgaaggataaaaaatggtatgactcaaaggcagggcaattgaattctctgccggataaggtgacgctaaattttccgccttcatttttgacagacggaaatacgggttcttttgaagggcaggcaaaaagcatgcagcgcgcccttaagggctgcggcgtgcctgtaacaggcgtctactattcacgtaaagaaagtatactgatgcacgaataccagttcaatatgaaggaagaacatgcgcagcaaaccttcgacgcagcgatagaattcctgaaaaagcaacaataaaaaaggcccgaataaacgggccttttttattgagggtgagtttttatgatgatttgtttaaatcatgttcgtgtgaacagttgctgcatgaactacatgagccgcaggaactgcaaccgccacgtttgcggttcctgactgcccgtacaactactgctacaacagctacggcgatcaggacgccgatgataatgtctgccataagatcacttccttttagcttccggcttccacagagaacagattttcttttttcgttttgggctggtaacctttgcgcgccatgagccatacaatgagcgcaatgagcgcaatggctattatggtgcctgcgttaaaggcggctccgaggaacatcacgcttccaagctggaagatgataaacgcgatcacataagcaagcagtgtctggtaaccgattgctgcccaggtccattttgcgctgttcatttcacggctgatagcgccgatagcggcaaaacacggagcacacagcaggttgaacgccatgaatgagaatgcgctgactgtcgtgaaggtcgcggccacgcttgcgagaagcgctcccgtctcttccgtcgcatccatgaggccgtgcaacacgcccatcgtaccgaccacgttttccttggcgacaagtccggtgatcgtagcgaccgaggactgccagtcgccgaagccaagcggcgcaaacacgggggcgataaacgtgccgatggcggcaagcatactgtcgttgatgtccaccatctccaagctggtattgaagttactcaggaaccagatcacgactgcggaaacgaagatgatggtaccggctttgatgataaacgattttgcgcgttcccacatatgcatgagcacgcccttggccgcaggaacgcggtattgcgggagttccatgacgaacggcgcaggctcgcctgcgaacggtttgagtttctttaagataatgccggagatgataaccatcccaatcccgaggaaataagcgcacggtgcaagccaccatgagttttcagggaacaacgcgcctgcgatcagcgcgatgatggggagcttggcgctgcagggaatgaacgtcgtcgtcatgatcgtcatgcggcggtcgctttcgttttcgatggtgcggctggccatgatgcccggcacgccgcagcccgaagcgacaagcaacgggatgaacgatttgcccgaaagtccgaatttacggaagatacggtccatgatgaaggcaacacgcgccatatagccgcagtcttcaagcagtgccaaaagcaggaacaggataagcatctgcggtacgaagccgataaccgcgcctacgccgccgatgatgccgtccacgacaaggctcaggacccaatcggacgcgccgatcgcggtcaggccgtttgtcgcccagtccgtgatgtaagtaccaaacagcgtatcgttcgtccagtcggtaacgagtgtgcctaccgtgctgacggcgatgaaataaacaaggaacattacgccgataaaaatcggaatcgctgctacacggttggtgacgacgcggtcgatccggtcggatacgctcagcttgtttgcgcgtttctttacgctttcacgcatcagcttctgaatatatgaataccgttcgttggtgatgatgctttcgctatcgtcgtcgaactgattttcacattgtgtgataatttcttcgatatactgctttttttcaggggtaaggcggaaagtctcccaaaccttttcatcccgttcaaacagcttgacgctataccagcgaagcagttcggggccgaccataccttcgatcgtgtttccaatagacaaaaggacgtcttcaacctctgaagcaaatttgtgaagcaccttctgtgtttttaccgtctgtgcggtgattgtcgcggtatcgatcaattctttaaggcccgtcgatttcaacgcggacgtttctacgacagggcagccgagcttttcactcagttttttgatatcgatcttgtcgcctgtttttttgatgacgtccatcatgttgagagcaatcacgacggggatccctgtttctaaaagctgtgtcgtcagatacaggttgcgttcaatgtttgttgcgtctacgatgtcgatgatcacgtcgggattttcgttgagcaagtaattccgtgcaacgacttcttccaaggtataaggcgataatgaataaatgccgggcaggtctgttatgatgatatccttatgaccttttagtttcccctcttttttttccacggttacgcccggccagttgccgacatattgcgacgcaccggtcagttcgttaaacatggtggttttcccgcagttagggtttcccgcgagagcgaatttcattttcattgtaccacttcctccaatcgccaattagccacagctaactgcttctcataaaatatgcagagctgacgctctgctaaaatttaatcgacaaatatcatgtcggcatccgctttgcggatagaaagctcatagccccgcacggttacttcgacaggatctcccaggggcgctaccttacggacaaatacgggcgttcccttcgtgatgcccatatccatgatccgccttttgacggcgccgtcgccggtcagctttgtgacagtcaccgtttcgccgcactttgtatgccgcaatgttttgacagcagcttcattcatattcagtttctcctttctttcaggacgcctgttcttcaatcatgatccggtttgccatgcttttgctgatggcaatacgcgcgtccttgacgctgacgatcatgttgccgcccatttcggaaatcacggtaacgttttctccctcaacaaaccccaggttcccgagaaaccgacggacctcgtctctgccgttgatcttgcagataaaactccgcacgcctgcacgtgccatggtaagaggcataatgaacagtcactcctttcagtggttagcaaaagctaacgtttgcacaaaatatattggttagcaatcactaaccaacttacaatttgagtttactaccgctaacctaatttgtcaatcatttttggatattttatgttataatcaatggaaataggtttaccaacgaatatactgaataaatacggaaaggggttggccatggatttaagggaatcgggcgaaaattatctggaagcaattttagttctggagcaaagaacaggcgcggtacattcgatcgatgtagcgaattatcttgatgtgacaaagccgagtgtgagccgcgcaatgagtatattaaaggaagcaaattatatttggatggaaagaggcgggcagcttcacttaacggacgcaggtaaaaagattgccgaaagcatctacgagcgccatcggctgctgacagactatctggtccatctgggcgtagataaagaaacggcagcgcgcgacgcatgccggatcgagcatgtgatcagcgagcagagcttccgaaaaatcaaagagcatgcaggcggaaaaaagtaatttgaagaggcgtaagccgcgttacaaataagatacaatcctcgtgtattgttaatgaagttttcatgatgttgtatactattttatgatataatgaaacacagatgatatatgggggatgataatcatttttaaaccttacggttcccgtatattttcgggaacctttttcttttgatccataacaacatctgcatgcttgcatttatttgggaggtatggcgtggagccgatcatcgcagcgagaaacctgaaaaaaatttaccgcatgggcaatgccaaaatacatgcgcttgacggcgtggatattaacgtgatgcccggcgaagtatgcgcgatcgtgggaacgtcggggagcggaaaatcaacgcttctttcgttgcttgcgggactggagcatccgacatccggtaaaatattcatcaagaaaaaacctacttataaaatgaatgaaaaagagctggtcgacttcaggttgcagcatattggatttgtgttccagtccttcaacctgatgcctaccatgagcgcggcggaaaatgtcgcgctgccgcttatgtttcgcgggatcaacaggcaaaagagaatgaaaacggcaaagaagctgctgagcgagatgggacttaggcaacagctcaacaatcttcccagtcagctttcgggcggccagcagcagcgcgtatctatcgcgcgcgcgatcatcgcgcagccggaaattatttttgcggacgagccgacgggcaacctcgactccgtaacggcgacgcagatcatggatattatgtgtgcggcggccaaaaagcgcggagcgactttgcttttcgtgacgcatgatccgcaaaaggcggaatatgcggatcaaatcatacacattatcgatggaaaagtggcgaagcgggaagtgcgcaatgagcagatagaagcggagaccatcatagaagcagaattaggaacacaaggagagaattgagatgaagaaacggattgtagtgtttgtgctcgtaatcatgttggcgctgggatgcgcggtttcgccggcgatggcagcggtatccgaaagcgacaggggaacggcgttgcggatcgataaccagacgcagtatatgggtatggattccacctataagaatggatacagccccacggtttcggataatcaggcgcatatcgtcctgccgcttattgcgagcaatggctcacaacaggtaaaagcaggcgagcccatcaacatatccgttaatttgggcgatccgcaaaaggcgcccttcgtgttcaacaattataatgaaaaggtcacgctgcaaaacaacaagctggcggatggaactacaaataccgcgcaatcatatttgattaacctggatctgccgcttacggaagggcgcgtcaatggaaattatcctgtggtgatcacggcgaaatatccgatcgcggatggaacgatcaagatgcaggaattcacggttttcgtgaaaatcacggacggcgaggatccttccggtccaagcacggaaccgactgtgggaccgacggaagagccttccgtaccggaagacccaagcggcggcggttcgagcggagggggcggcggaacaggggggccgacttcgcagcccaaggtgatcatcagcaattatgagatcagtcccgatccggtcaatgcgggagaaaattttaccgttaaggtgacgcttctcaacacaagcaaatcagtgacggtcaaaaatatcaccgttacattcaaaagtcaaacgacagacctgatgccgggggacaatacgaatacggcgtacattgaaaagatcgcgccgcaaaagacggcggagttcagctttacgatggcggcgcgcgcagacgcgaaggcagggccgcagaaaatcgatattgcgattgcctatgaggacaaccaggcggcgcagcttacggcggcggacgaaatcagcgttgaggtacaccagaagatacgccttgagtacgatccgccgaaattcccgacacaggtctacatgggggacacggcgtctgccagcctcaacctgtataacaaaggaaaaaatacattgtataacgtgacggtaacgcttgacgtgccggggctcacgccggaatccagcgcgtttttggggaacatggaatccggcacggcaaagacggcggacatctatgcttcggttgcgcctgatccgaatgcgggcatgggcggtatggacggcgcgatggatgctgggtccggcggcgacggcgatgcggcagcctatgatgcaaaaatggcgggagcggaaagcgcagccgtgatcggcggcgcagacgctccgacggatattacggtatcggaagaaggcggacagatcggcggcggtctttcccccgaagcggacggtattgatgcgggagtcatccagccggggccggtagaaggcaatttcgtggtcacatatgaggatgaatacggcgaagaatacgagatcaaggttcctgtttcgacggagctcatacccatgccgaactacaatgacggcatggatggcagcgaaattccgccggaagaaccggcagggtttccgtggtggggctgggtcatcattgcgggcggcgcctgcgcagtggtgatcgtgatcgtcgtaaagaagaaaaagaagaaacgcgcacaggaacttgaggaggaaatggacgacgatgacgttctttgatattgtttcgcttgcggcgtccaacctttggcgacgcaagatgcggaccatactgaccgttcttggcgtgatcatcggtacggcgtgtatcgtcatcatggcagcgctgggactcggcaatttggaacaatttaatgagagtatcatgcaaagcaccgacctgacgcagatcgagatatcgcctatgggttcgtcggagaatgctaagctgacagacgcaaagttaaaccagatccgtgcgatccccggggtaaaaagcgcgacgggcgtgatgtatatcccgtcttacatggtgatcgggaaatataaggcggatacgagcgtgatggcggtggatcccaagaccatggattttaatttcatggaaggcagtgtgtttggcgagaataccaatatcgaattggtggtcggcgcaaacgcgcgccagtatttttccgacccgaacgaccagagcggtatgtatggcggcatggtaatgatggcaggcggcggtatggcgatggcggtggaagaagatatgcagatgccgcaggggccggatatcgactggcttacctcgaatgtgaaatattatcccagcaatggatatttgatcgaaaaccctgatcccagtacccccgaccagccaaagccgaaggaataccgcgcgaaaataacgggtatcctcgagcaggcggacaaccagcaaagctacaatatttatatgagtattcccgcggcgaataagttgatccgcgagaacaggaagctgatggatcagcagaatgtgaaggaaggacagtatacgcaaggatacgtgaatgcggtggatgtggattccgtagcagaggtattgcaagccgtgaaggatatgggattccaggcgtacagcccgaccgaatggatcacgcaaatgcaggaagaacaggcgcggcagcaatcgcagcttatcgctataggattgatctcgcttcttgtttcagccatcggcattgcgaacaccatgctggcaagtattttagagcgcagccgagagattggcgtgatgaaggtgatcggcctttccatcagcaagatcaaccagatgtttttggtggaagcggcaatgatcgggcttttgggcggcctgatcggacttggcatcagttacggtttaggcgcggttgtgaattcgggcggcggcggttttatgtcctttatgggcatgaattttgaaaacgggatacggctttcgattccatggtggctggcgcttggggcggtggcgatcgctgcgggtgtaggcattgtatcgggcatttatccggcgcgcaaggcgaccaaaatgagcccattggaagcgatacgaagttcaaattaaaacaaatagatcccttggctttttaccgccaggggattttttaatggcaaaaccgtttattttccgtcttttatggtattaataaagcatctgaggaaataaatgttacaaactaagaaagcgagggaatggatatgtataaccagaaaattcgtgcggtgcaatatggctgcggcaaaatggcgaagtacacgatacggtatttgtatgaaaagggcgcggagatcgttggagcgatcgacgtaaatccggatatcgtaggaatggacgtaggggaatgggcaggactcggcgtaaggctgggcgtgccgatcagggaggatgcggacgcagtgctggacgaatgcgacgcagatattgccgttatgacgctgttcagcttcatggacgatatgtatgagcacatcgaacggtgcgcgctgcgcggcatcaacgtagtgacgacgtgcgaagaagcgatctatccgtggacaacggctccggccatcacaaacaagctcgatgttcttgcgaaggaaacgggctgcacgatcgtgggcgcgggcatgcaggatatctattggatcaatatgatcgcgtgcgcagcgggcggcgtgcaccgcatcgacaggatcgaaggcgcggtaagctataatgtggaagattacggcctcgcgctggcacaggcgcacggcgtaggcctgagcgcggatgaatttgaaaaacagcttgcgcatccggagattctggaaccgagttatgtatggaattccaatgaatcgctgtgcgcaaagatgggctggacgatcaaatcgcagacgcagaagagcgtaccgtatttttacgatacggacctttattcggaaacgatgggcgcgacgatccccaagggaaattgcatcggtatgagcgcggtcgtcacgacgcagacacaccagggaccggtgatagaaacgcagtgtatcggcaaggtatatggcccggacgacggcgatatgtgcgactggaagattttcggagaaccggatacgacgttttatgtcaccaagcccgcgacggtggagcatacctgcgcgacgatcgtaaaccgtatcccgacgatcctgaacgcaccggcaggatatgtgacggtggaccagttggagccggtggaatatctctcctatccgatccagatgtatgtggatgaattctaaggaagcatggccaagcgcccggtaaaatatgccgggcgcttgttttttgtatgacaggataaacagcaggaaattaatatgatttttcggtcgtttgtgatagtataaaagaggatatttgacgtgcgagaggggatagaatcttgtataatgatttgtttacgataggccctattaccgtacatggttatgggctcatgatagcggtcggcattatctgtgcgttatggatgggctcataccgcgcaaagaaacgtaatatgagtgtggatgctgtgcttactctggttatattggcggttgtattcggctttttaggggcaaagctgctatacctgatccaggatttccagcatttcttagaagacccgttgcaggtgctttcgggcagcggatttgtcgtttacggcggcgtgatcctggccattattgccgcgatcatctattgccgcaggaagaaatacagctttttgcaatactttgatttactcatgccttccgtggcgatcgcgcagggatttggacgaatcggctgcttccttgcaggatgctgctacggcgcggaaacgacttgcgccattggtgtggtttttccggcagggtcgatcgcgccaagcggcgtgccgttattgccgacgcagctattttcagcgggcggggatttcctgctggccctgatcctcatcctgtatgcccgcaaggagcggcgggatggacgcacgggcgcactgtatctgattctttatgggatcggcagatttatcgtggaaattttccgcgctgatttccgtggggaaatcggaccgttttccacgtcgcaatttatctcgatcttcattgtgatcgcaggacttgttttgttcattcccaagacgctccccaaatgggtgacccgcagctagcgggacggaaaaaagcaataaatatacggtagccacaggctgccgtttttttatacttttagtttagcatacaatgatattgaggacagcatatggaagatagatataagcactattttaagcgaattggaaacaatataaagaaatataggaaagagcagcgtttgacgcagcagcaacttgcggataaagtagggatgagccgcgggtatttaagtcaaatcgaggcttctaccaataaagcaatgttaagcgtttatatgctgattgcgattgcggaggaattgaagatagaaccgaaagaattattaagcaaataaaaagctgccataggcagcttttttcataccttttttaaaaaaatccgatttgcttggcggcgctcttcttatgggcaaacgcaggaccttcggtcacgcttcccttaggaaggccgctcaagaacggcgagcgttcctctttgtttgtaagcaatataagttcgtcctgcgcgcgcgttacgccgacgtagaacaacctgcgttcttcctccggatcgcccgcatgtttttcattgcaaaatgggatcatgccattgttcacaccgcataaaaataccgccggaaattcaaggcctttggacgcatgcaggctcatcagcgtgaccccgccaagcgcataggatttagagccgcttcgacgcacgtcgccttccttgcccagcgtgagattcataaggaaatcttccatacgcgtatggaggaccgcgatattcagtaaacgctcaataggctgggggatttcttcaaacccgctttgctcgatccacatggaaatcagcttttcaggcgtttcttttttcaggataggggcaaaggtttccaatttctccgcaatgcctgtttcattaagttcgcgcagcaatccggaaagaacggaaacggtttgcttttcgtttccgtaccggtccaaaagctgctgcatggatgcaggcggcacgctttccgaacgcagataggtcgtcagggaaacgcgatctttgggattgcataaaaaacggaaaaaggagagcgcacccatgacgcggcggtcggaaagactgtcgtccctgcccgcgacgatataggggatcccttcctttttgagacattcttcgatgatctcggattggcggtgcgtgcggtataagactgcgatatccgaaaggccatagggcgcgtccgaatgctttttcgatttggaatgcgcggcgagcatatccacgccgcccaccatgcggttgatctccttagcgacgaacaacgcttccgaaaacgcagaatccgcagtgagcagccgcacgaattcgccgctcggacgcttcgcttccaatattttttcctcatgctccatcacatgaagcgcgcagtctatgatttgcggcgtggagcggtaattgtctttcaggcggatctcataaacgggggcaaggtctgcatggagacgttcaaagcatttcgcatcgctgccacggaacccgtaaatggactggtctgggtcgccgatcacaaaaaggtcgccttctttgttccaggcgcggatcaggtcatactgcacaggattaatatcctggaattcatcgacgagaagatgcgcaaagcgcggcgcgaaggcctgtgcttttggatcgcttgcgttgaatttttcgagagcgcatagcaggatatcgtcaaaatcgacaacgtccatttgcctgagtttgctgcaatacgcgtcataaacgacagagggaatatcgccggtgccgccgtttttgatgcgcgagatttcgctcatcgcttcgcgcgggcggacggggcaattacacgccttgagtacgtctgcaagtacgcttaaagcctcattttggtcaatgaccgtaatgtttttatgccatgcggacagcatatcgaggcaaagggaatggaacgtgccgatatgcatcgccttgactgtttttttgtcgttaaaatgttgcgtcaggcgttcgcgcatttctgcggcggccttgttggtaaaggtgaccgccgtaatgcttgagggatcgattccgcattcttccacgaggtaagcaatgcggtaaacaagggtacgtgttttgcctgtgccggggcctgcaaggactgcgacgacaggggcttctgccgaagcggctttccattgctcatcatttaaaccatagggatgcgaaggctccgccgtttcctgtggtgcgggttccggcacgtcggccttcgcttcacagaccgaggcgggagcctccggcttgtgcatcttctcctccgcagggaaaagacttaattgtcccgcaaacaagctgcgctcctccttgttcatcacaaggatcttaccgtattccccgtcgtagccggggtggatctccacttcaccgctccgaaggcggcggatcccttccgcaatgaaaggatcggcggaatgcctgatatcctcgatgggggactgccgcaggataaacaattccggcccgagtttatggatgatctcctcgtattgcgcctgtacttttttgcttgcggtcgtcatgcccatggatgcggcgatgacctccggcaggggcacgatgctttcaaagtgtttggcgtttgcgggcacgaaaccattttcgcggtcggccagctctaccacgcggtgatagacgcctactgtgatcctgcgtccgcatacgggacacttgccgcctgcggcaatcgtttcttcgggcgtgaagcacactttacagttgcggtgcccgtcgttatggtattttccttcttccggaaagaattcgagcgtgccgtaaaactcgtccgtgtcgcggttttgaagcgcgcgggcaatcgccggatatgaaagttccgtattgaaaaggtttgcttcgcgcgcaaggtttgccggagaatgcgcatccgaattggataccatcgtgaagcgatcgagcgcggaaagccgccagttcatgggcggatcggacgacagtccggtttcgagagcatggatatgcggcgttaggtcctcaaagcattcttcgatggaatcaaagccggaataggctccgaacaatgaaaaatggggcgtccagatatgcgcggggatgaaaatggcgtcgggacaggtatcgagcgtgatctcgaggagatcgtggctgtcgaggccaaggataggccgcccgtccgaatgcaggttgccgatcagctctaaacggtgggcaagcgcttccccggcttccagcgaggggagcaggatcacgttgtgcaccttgcggactttgccgtttttcttgtagatcgagctgatctcgccggaaatcacaaaacggggcgccatcgcgtccccgattgtttccgtgatgcggaaatcgtcctttaaacggtaaaggccttcttccgcaggaataaatttttctttcagttcctcgcgccatgcgggatgggtaaaatcacctgtgcctaaaagatcgatccctttgcggcgcgcccacaggtctaagtattcgggcatgcactgcttactcgttgcccgcgaatatttggaatggatatgcaggtctgcaacaaacatacgcttattcctgttcttcccttgggataaaatgatcgcattgatgcttctcgcccgtgagcatatcagggtcgatatcgccgtaaatttggcatgaacgcagttccggcatgcccggcgcaaacgtcaaaacaccgtaatggatacagttgaagcataacacgttttcttcgttgatataattttgtttgatgaccaatcccatacttggagcgctccttttttagtatagttacattataccgcgttttggacggaacacaagaaacggaaggcagaattaacgttttgtttttacagcagctctccataccgctttacaaatttattcttgagcagcgtgaccagcagcatataagcggcgatggtcacggcgagcatcaggaaatatacaccgggcagggcggccatgccaagctcgcgccccacggccgtatatgggatcaccgtaccgaggatgatgccgatgcttgtcaaaagggagacctgccatgacgcgcggctcttgataaacggcgtatgcggcgtgcggatcatgtggatgacaagcgtttgcgtccacagggattccacaaaccagcccgcgtggaacagcgcgataaaaccttcctgtgctgcttcgccaagcgtgtggtatgcgccgccgaaaacgagcgggcaaatgaggaagtaaagcaccaaatatgtcatgatatcgaaaaccgagctggcagggccgatccataccatgaatttactgatagacgaggcatcccatttgcgcgggatcttcaggtagtccgcatccacattgtcccacggcatggcgagacaggaaacatcgtagatcaggttcagcagtaaaatctgcacgggggtcatgggcaggaagggcaaaaacgcgcttgccgcaagcacggaaaacatattgccgaaatttgagcttgccgtcatcttgatatatttgatgatattggcataggtcctgcgtccttcgatcacgccttcttccagcaccatgaggtctttttccagcaagatgatattggcggattccttggcgatatccaccgccgtatctacggaaatgccgacgtccgattctttcatcgccgcggcgtcgttgatcccgtcgcccaaaaaaccaaccgtatggccgctactcctgagcagggcgacgatacgcgctttttgctgcggcgagagcttggcaaatacgcgcactttttctacggcttgcgcaagatgctcatcatccatagcttccacgtccgcgccaagcaggatgtttccggcggggataccgaccttttggcagatatattttgtgaccgcatcgttatcgcccgtaaggacttttacctcaacgccgtattccttgagcgcacgcagtgcgttttccgtactttccttgggcgggtcaaggaaggcaagatacccgatgagcaccatatccgcctcatccgcaacggaaaatgccccgacaggagatggattcgtcttatgggcgatgcccaggacgcgcataccgtttgcgttatagccggcaacggtttgcagtatctcctttctgacctcgtccgtgatcggttcaacatttccccggtattcggcatacgcgctcaccgcgagcatttcctcgatggcccctttggtgatcaattgcgtttttccgctttgatcttccacgactacgctcatgcggcggcggttgaaatcgaacgggatttcgtcgaccttatggtagtcacggataagctccgccatgccctgttcctccgcgtggtctacaacggcgatatccatgaggtttttaaggccggtctggtggtagctgttcaaaaaagcgtgacgcagtacgcggctgtctttattgccgtggatgtcgagcgaatactcgagcacgaccttatcctgcgtgagcgtacctgtcttgtccgtacaaagcacatccatcgcgccaaaattttggatagcgtgcaaatccttgacaataactttcttcttgctcatcgcaaccgcgcccttggcaaggttggcggacacgatcatgggcagcatttcgggtgtcagcccgacggccacggagatcgcaaacaaaaaggcctgcatccagtcgcctttggtgaagccgtttaagaaaagaaccacgggaaccatgacgagcataaaacggatgaggatccacgaaacggaattgacgcccttttcaaagctggttttgggcttcttttccgtgagctggtgtgcaagcgagccgaaaaccgtatcgtcgccgatcgcgacgacaagggcggtggcgcttccgcttacaacgttggtgcccagaaaggcaaggttatttttatcgaggatacttgcatcggaatcgcggcgcgcgcgcccgaatttttccacaggctcgctctcgccggtcagggacgattggctgacaaacaggtcttttgcctgtaggatacgtatgtccgcagggatcatatcaccggccgcgaggcggacgatatccccgacgacaatttcgtcgatcgggatctcctgctgctgtccgccgcgtaccacagccgtcgtggtttctaccatttcagacagtttttccgctgatttttccgaccgtgtttcctgcacgaactggagcgtaccgctgatcgccaccatggaaagtacgatcgcaacggacaggatatccttctctccgggggccgcaagcacgaagtccgtaataaaggagataacggcaagtacgaccaaaacgatggtgaacgggtttacaaacgcgcgtaccaaacgcttgaggatggaatcgctgttttcataggtgatccggttttcgccgaatttgccgcgcattttttctacggaatcctgggaatagccctcgtacgtgttgccgtattgcgccaggatattatcctggcttttttgggacgcagtaagcagtctgctttttgcctgaatggtttcggcagcctgcgccgccgtattttttaaaatcttattcattggccttacctccttcgcaggggcttttgcaagaccccgatgggtttagggttcaggcccgaagaaacggaaaacacagccgtttcccgggcagcatcgtttacttcggtctgtttccacgtttctcactcctttctgcaaaacaaaaatccccgctcaaacatgaacggggaataaacctcaaaataaaacacacaaaaagctttcttgcgctaccgttcaagcttcagcatcgcagggcgatgaaattgcgttagtctatgccttggtttcgacataaactgctaaccctctcatagtgtctccactactccgcggcagcaatccgtatccctgcggtaacctcacctaccgaaatattctttttacgggctttagtataacgtcggccttcttatttgtcaaacatggccggccattattgtaaatacagcccgtttgcggtaagatatctttatattataactaaacacaaagacggaggcagaacatgaaatttgcggataagatgaaagtttttgatatgaatatcttttccaagctggaagaaaaaaaagcggagcttcagggcgcgggacgggaggtcatcaacctttccgtgggcacgccggactttaaaccggacgaccacgtgatcgaggcgttaaaagaggctgcgggcgtggcggacaactttaaatattcgctggcggacctgccggagctgatcgatgccgtcattgcgtggtatcaacggcgttatggcgtgacgctcgaacgggaccaggtgatgtccgtttacggcacgcaggaagggatggcgcacgtcgcgcttccgatctgtaatccgggcgacctggtgatcgcgcccgacccgtgttatccggtatttatgtttggcccgcgcatggcggaagcggaaatttattatacgccgctcaaaaaagaaaacaacttcctgatcgattttgacagtatcccgcaggatgttgcgcgacgcgcaaagatgatcgtcgtttcgtatcccaacaatcccgttacggtcaaagcggattatgctttttatgaaaagctggttgcatgggccaaggaatacgatgtggtcgtggtacacgacaacgcctattccgagctggtgatggacggggagcctggcatgtcgttccttgcggtgccgggggcgatggacgtgggtatcgaattcaattcactgtccaaatcgtacaatctgacggggcttaggatctcatttgcgatgggtaaccatgaaatcatccgcaatttcaggtgcttgcgttcgcagatcgattacggtatttccttccccgtgcaaaaggcggcgatcgccgccttaaacggcccgcaggaaattttggaacggaaccgcgcgggataccgtgagcggcgggacgcgctttgcggaggtctgcggtccatcggctgggacgtacccgattcgcccggtacgatgtttgtatgggcaccgcttcccaaagggtatacaaaatcctgggattttgtactggagctgatggacaaaacaggcgtgatctgcgtaccaggagagagctttgggcccgctggcgagggctttgtacgttttgcgctggtcgcggatgcacagacgatgcaaaaggcggtcgggctgatcaaagaaagtggaatcatcaaatgaagtatgagtggttagacgaatacgtcatgggcaagaagggcgtaacaaaggattaccagccgcagtgggaggcggcgcgttactttatcggcgggaaaatgtttgcgatgcagggcggcgataaggaaggcaagcccatttttaccatgaagctggagccggaagtaaacgattttatgcggcagcagtttgcggaggtcgtgtccggctattacatgaacaaaatgcattggagctccctgtaccttgagggggacgtgccggacgatgttgtacgggacatgatcgaccgttcttatgagacaggaatcaaggcattgcccaaaaaactgcaaaaagaaatattggaatagaagaaggccggacattttggccggccttctttatttggctttttatggcgggatttgtattatccggttggcattattccgattctacatatcccataataccggcaaccggtaattcggtgccttcaacctctgtaatgtgcagggtaccatcgattggggcataaacagtattagcaatcttatcagtttctatattggcgattgcctcgtcctttgtcacgttatctccgtcctttttcagccattctgtgatctggccgctggtcatagtcattcccattttaggcataattacatcttcgcgcattgttttgtcatcctttctatacttgataatcgatacaattttttactgccgctatcactttgtttgcattgggcagatatgcgtgttccaggacggggctgaatggaaccggacaatcaggtgcggtgacccgctggataggagcttttagtaagtcaaaagcatcttctgtgactgaggcagcgatctccgcgccaaaaccgtttgttttcacacattcgtgcaggataaccaaacggccggtttttctcaatgactcaatgatcgtttccttatccaggggagcaatactgcgcaggtcaattacctccgcataaataccatcctgttccaactcctctgcggcggcttgggcaacctgcaccatacgcgaccaactgacgatcgtgacatcagaaccggaacgcagaacgtttgcttttccaaggggaaggacatattccccatccggcacctcgcccttttgcgacatcaggattttatgtgccataaataccacagggttattgtcgcggatcgctgcagccagtaatcctttggcatcggcggggcaggagggcgcaacgattttgatgccaggaatgtgtgcaagcagggattccaacatctgagaatgctgggcggcggctcccacgcccgcaccgcccgtcgtttttatgaccatagggacgttggctttgccaccgaacatataacgcatttttgcagcttggttcaatatttcgtccatagcaaccccgacaaaatccatatgcatgatttcgacaatagggcgcagacctgtggcggcggcgccaacaccgcatcctatgatagctgtttcgctgataggcatgtccaccacacgcttaggaccaaattctgcgatgaggccggtatcttccccaaagtcaccgccgcgaatccccacatcttcgcccgcaaggtatacttccggactatgctgcatttcgaaacggatcgcatcgtgaattgccgtagcaaatgttattttactcataatattctctctccttaatccgcaaaaatatttttcattaggtcatcttccgaaggactgggagctgcttcggcatccttgatcgcttcggccagttcatcgtggacgctttgcctgatttttttaaaatcatcctgggtgcacatacctttttccagtaagagggattccaggcgggggatcggatcttttttgagccactcttctttctctgccggatcgcgatagttgtcaggatcccctacataatggcccatatgtctccaggttttgcattcgattaaggtagggccttcaccggcgcgcgcgcgtttgacggcctcgtttaccgtctcatatacagcgcagacatcgtttccatcgacaattacaccggggaatccgtaagaggaagcgcgggtcgcgatatccttgattgccatgcaataccgctggtcttcagaaataccgtaaagattgttctcgcaaacaaaaataacagggagtttgagaatagccgcgacattgagtgcctcgtggaaggttccgcgattggctgcaccgtcgccgaagaagcaaatgacaaccctgccgttgtcttgatatttgctggaaaaggctgcgccggtagcaataggaattccggcagcaacaataccgttagcgcctaagataccgatatccatatcagcgatatgaagagatccacccttaccattgcaatatcctgttgattttgcatacaactccgccatcatttttttcaggtcgccgcccttggcgatcagatgtccgtgtccacggtgtgtgcttgtaatatagtccgttgtttctagtgctgcgcatgcaccggttgcgatggcttcttcgccaacatagaggtgcaagaagccgggaagaaggtttttggcgaacaaatctgccgccgtttgttcaaataatcgaatctttaccattgttttgtaaaaatccaataatttttcatcacacattttgtttctcctccatttatatgattgtttattggaaatataataatttactaaaagacaatactgattattttggattattaagagaatagacacaagtgcaccactgattttgttaaagtgattatataaaatattttagttaaagtcaatacgaaattaattaattttttacgaatcattcaattttatattgggaatatcttctgaaaattttagagaaaaatcaaatcaagcatgaaaaaagccttaatataagtattttaaagacttatgcttaaaaagatgcaatcatatacagaatataaatcgacaaaatatttaaactaaaataaaagtaaaaaacacttgacagattaataaaatttttatattattggcttataaaatcatttacaactaagccatacaacaaaataaaataattgttcgaaaatttattccagctttattgttgtaatcactaaacaaaaaataatataaaagaagtattttctgactctgtttccctgtcttttgaacaggagaataaaaatatactcataggaggaatagaaatgaaagggaatttctggaaagcggccctatgcatcgttttggcgctgggcatggtagtagcattggcagcatgcactatggagggcgaagcggccaagggtagcgcggccggtgattcggcagtatctggcgatacagcgccgcaggtaagcactgatgcaggggcgtccggcgatgcggtaaaaattgcggttatcgtaaaatcgacagattcagaatcatggcagtatatgctgactggtgcgcgaaacgctgctgcggacagcaacggcacaatcactattacggaacatggcgcagaatcagagacggacattgaagggcagattacggtgcttgagagcgtcatcagttccaatccggatgcaattgttattaccccttcggatagtgatgcgttgaatgcgtcgctggaaatggctcatgaacaggggatcaagattattgtagtggataccgctgttaatacggatgcatacgacatgtttatggctaacgataattatgccggcggcgaacaacttgctgaaatcatggtaaatgaactggaagcggcaggaaaaccgttggaagggacggtcgggattatcagtgcagttccggtacagacagtatacgaccgcgatgacggtttcatcgataaattgaaggaacttgcccccaatatcaaggttatctctgaaaattacgcggataacgatatgcaaaaatcgatggatatgacgatggattatatttcagcgtatcctgatttgatcggtgtttatggtgataacaacgtaactgggtcaggcattgcactcgccatcgcagaagctgggatgcaggatcaactgattggcgttgcctatgacggaaatccggaagaaattgccggaatcagggacggctcactgaaagcgatcctggtacagagcctttatcagtgggggtacgatggagtaatgaacgcttataaggcggttcagggggaagaactggaaaaatatttcgataccggcgtgacgcttgtgactttagagaatattgacgatgagtctgtgcaagatgtgatcgatccatccaggctggcacggtaaataatcggcgggcagcaatgagatagtaaatagaggatagattcgttaaggctattccgggccccgcggttaacgggtacggggtccggaatatatggagtattgatatgaatgatagcagcaatgaaattttaagaatggagaatattgggaaaagttttccaggcgtcaaggctctttccaatgtcaatttttctgtggagaaaggttctgtccatgcactgatcggtgagaatggcgcagggaaatcaaccctgataaaagcactgatgggggtctatggcaatgaatatgagggagatatttatattaattccgagaaaatagaaatcaaggatccgatccaggcaaaaaatcaaggtctgctcgcgatctatcaggatattacattggcgacgcacctgaccgtaggagaaaatttctttttgggaaaacttccatggaaaggagttgccgtagattggaaaaaagtttacggcgaaacaaacaagatactacaggaattgaatatcgatatcgatcccaaaagcaaagtgatggatctgacagtggcacagcaggagatggtgtcgattgcaaaagcgttaagtgaaaatccaaaattagttgtattcgatgaacctacggcgctgttgacggatgaagatacacagatgctcttttctatcatcaggaaaatgcaggagagggaaattggaatcatctatatttcgcatcgcatggaagaattgttcgaaatttgcgataaggcaactgtcttgaaagatggggagtatgtcacgaccgtcaatattagcgatacgacgcaggaagaattggtctctctcatggtcggccgcgatgttactgatatgtatgggattgaacacggagccataggggacgaagttttgagtgtaaagtcgatctccaaagagagggtgttcaaagatatctcattccaattaaaaaaaggagaaatcttgggcttatttggattggtcgggtcaggaaggacagacgtggtacgcagtatttttggagcggaacatttcgatgcgggcgaggtatgggtacatgggaagaaagtcaacatcaaatcaccggttgacgctattgcgcaaggaattggattattaccggaagatcgccgtgtacaggggttatgcctgagcctggattgtgcagtaaacatcaatctggcttcttacgatcaaatcagcaaattagggcacatcaacaagaagaaagagatggagattgcaaaagagtatatcaaaaccgtctcggtaaaaacgccttcgcccaagcagaaagtaaggaacctttccggcgggaaccagcaaaaggttgtcattgcaaagtggctttgccgtgacagtgatatttttatttttgacgaaccaacagtcggtatcgacgtcaacgcaaaacgggaaatttacaaaatgctggaaaaattagtaaaacaggggaattccatcatcctgatctcttcttatctgccggaggtgatggggctttcggacaggattgtagtattccatgaaggaacgatcgttggagagttaacgaaagcggaagtagaagcgatgaaccacgacgagtgcgaaagaacggtcttattgatggcgtccggattaaaaagaaaagaaaaactgtcgtaaggagaagaagcatgaaagcaattagtttaggcggaaagaaaggaaaaggattattatcgaagggctcattgatcttggtgttactcgcaatctgtattgcgcttgccatcatacggcccagctttatatcgtatcagaatttgtttaacttactgcgttcctgctcgattaccggtattgttgccatcggcatgacgttcgtcatcattaccggcggaatcgacctctcggtcggatcggttgtcggattcagcagtgtcctatgcggcgtatttatgaaagaaatagggatggcgataccggttgctatattcctgaccctggtactttgtttggcggttggggcattgaatggcattttggtacataaaggaaaaattccggcatttatcgcgacattgggtagtatgcaaatgtttcgggggttagcaatgctgatatcaaacgggcgaacgcttccggggatgccctctgagtttacagcatttgcgcaggtcaaaatcgcagggttaccatccttgttcatcgtatggattgttgtgatcatcgtttcggcatatttgctgagatcgaccagatacggaagaaatgtatacagcgtaggaagtaatatggaatctgcacggctttccggaatcaaattaggaccgacgatctgttggacctatatgatcaacgctctgttcgctgcaattgcagggcttcttctgacagcgcgtatcacaagcgcccaaccatctgcaggggaaggatatgaaatggaagcaatcgctgcggcggtaattggcggcgcaagtttgtctggtgcagaaggatccgtaggtggaacggtaatcggcgcaatcatcatggcagtattgacaaacggcggcaatctgcttggaattaattcatttacaatgaatatcgtaatcggcgcattggttgtgattgcggtactaatcgaaaagaacaaaagaccaagcattgcttaagttaaatgaaaagaaagggatgaaaggttaaatgaatgcattaagggaaaaggcaaatgagatcaggaaaagcaccctggagatcatttttcgagccaaagcaggccatcttggtggttcgatgtctgatgttgaaatattggttgccctgttctataaggcgatgaaatatgaccctgagaatccacagtgggaaggacgcgatcggttcatcctgagtaaaggacatagcgcggagagctattatgcagtattgggtgatgttgggtttttcccaaaggaagaattaaaaacttacggaaaataccattcgcgcctgatgggacacccgaacaccaaaatcccgggggtggaagtttctaccggagcattggggcatggcctggcttgcggggtagggatggcgcttggaaacaagatgaacggcgtggacggaaaatgctttgtactgatgggcgatggagagctggcggaaggatcagtatgggaagcggcgatggccgccgcgaattatcgattggaccatctggttgcagtaattgataggaatgagttgcaaataagcggacgtactgaagaagtaatgcgcttggaaccgcttgaagagaaatggaaggccttcgggtggaatgtgatcaatgctgacgggcatgacatcgataaactggctgatatttttgagacagtcccgatggtccggaaaaaaccaacgatggtcattgcccacacggtcaaagggaaaggaatgccctttgctgagaatatggcaaaatggcatcatggcgtaccgaatgaaaaagaatatgaaatagcgatccgagccatagagaacgaatggaaggggatgacggcagatgacggaagataaaaagacttgccggggcgcttttacggaaacactattgaaagaagcaaagaaagacaaggacattattgcactggcaaccgattccgcaggatcggtgaccttgacggaattcagggataccttgcctgggcagtttgtagaaatcggaattgcggagcagaatatggtggggatcggagcaggactcgcgacctgcgggaaaaaagtattcgcatgcgggcctgcttcctttctatcggcacgtgcgctggaacaggtgaaaatcgatgttgcctattccaacaccaatgttaagttgataggagtcagtggaggaattagttacggggcgcttggtgaaagccattattccatgcaggatattgctgtgatgtgcgcaattgcgaacctaacggtaattcttccttcggatgcgaaccagacaacgaaattgacggagaaattggcacgcatgtatgggccggcctatgtcaggatgggacggggtgcagttcctatgatttatggcgaagaagaaacgtttgagatcggacgtgcgaaaacattgctggaaggctgtgatatcacgattgttgcagccggcgaaatggtacattatgcgcttcaggcagggaagaagctggcaaaggaaaatattgcggcgcgtgtgattgatatgtttacgttaaaaccattggatgtagaaacgatccgtaaagcatgcagggagacaaaagcaattattacagtcgaggagcataattttcgtggcggattaggagcggctattgcggaaaccgttgttgaagaacggccattgcctatgaagatcatggcttttccggacgaaccgctggtagcgggagactcggatgagataagaaaacattacggactcgatgaagaagggattatccgtgcggccaaacggcttttggatcgttaacagggaggcaaagcgtgacaaaagaatcatatattatttctgttgaccagagtacggcaggaacaaaagcgatcgtaattgattgcaaaggtaaaattagatataaatacagtaaagcccatcggcagatcatgccaaaatcaggttgggtggaacatgatccatgggaaatttacggaaatgtatgtgaagtaattgaacattgcattaaaaactccgaaatgataggggcaaaacaggttgccgcaattgcccttaccaaccagcgcgaaacagttgtcgcatgggatgggaaaacaggagagccgatttataacgcaatcgtttggcagtgtaaccgtgcaaaagggatctgtgatagattgcatgaagaaaaagcggacgattatgtcagaaaaatttccggattgcggttatccgaatatttttccgccgcaaaattatcatggattatggaaaatgccgatattgctcccgatgtgcgtaaacgtctgaaagtgggaacaatagattcatggttggtgtggaatctcactggaaagaaaagtcatgtgacagattattccaatgcgagcagaatgcaattattaaatctggacaccctgcaatgggactgcggattactgcgtatgttcgggttgaatgcgtctatgatgccggaattgatatctgccgacgattatgcaggatatgcttgtatagatggcgttgagattccattggtaggaatcttgggggattcccacgcagcgttgtttgcgcaggtagccttccatgagcagatagcaaaagcgacttatggaacaggatcgtcggttatggtaaacataggaacccgcagggtggaaactgccgatctctcctgctcgattgcatggggttattcgggcgcggtatcctacgccctggaaggaaatatcaatagttcgggtgcgacaatgaaatggttatgcgaacatacgcagcttgcggctgatgtacaagaagcagagcgaatggcatctggtatttcagggtcgaatggggtatattttgttcctgcctttgtgggaatgaattccccttattggaatagcgatgcccgcgccctgatctgcgggatgacttttgagacaggacgggaacatattgtcagggccgctttggaggcaatttcttaccagatacgtgatattgttgaatgcatgcagacacagggaaatataaagattcaggaactgcgggtggacggacaagcgactgagaaccgctttttgatgcaactccagtctgatattctgcaaattcccgtctggcgaaacagcatcaacgaagcgtcggcttacggtgccggcttgatggcggggctgggtactgatttgtgggataaaaaagaaattatgggaaaaatcaattcaaacgagtgctataggccgcatatggaccaaggcgaagcggaagctttatatcgggggtggaaaaacgcggtatggcgttcgttggaaaaggataaatttgaaaatttattataagcgaggtgacagaaatgaagaatacatttggggtaattgtaacgagtcgagggatttttccggaacacttggtcaaacaggcaagggaagaaatacgggaaaaacttttggaaaaagggattgaatgtgttatgttgccgtttgatgcaacaccgaacggcgcggtgcaaacttttgaggacgcacaaaaatgtgcggcattatttcgggagaaatcgaagagcatcacgggaatcttggtcagccttcccaattttggggaagaagcgccggtatatacagcgatcagccaatccgctctggacgtaccgattttgatccaagcatatgatgacagggatgacgcattatcgattgatgagagaagggacagcttttgcgggaaattatccgtatgtaataatttatattatgcgggaataaaattcacaggtacatctttacatacctgtgagattggctctgctgaattcggcagggatctggatgagttcagccgtgtatgcgcagtggtatacagtatgcggcatgcgcgtattggcttacttggaatgagaccggatggatttcgtactgttaggttctccgagaagattttacaaaacaatggaataacgacttgcgtagcagatttgtcagagatcattgccgctgcaaacaaggtaaaggatcaggagcggatctctgatacaaagaaggctatcaaagcatatggaaggattgatgaaaaggtgagtgaagaaaaaatagaactccaagccaaattaatccttgcggtacgcgactggcttgcaacgaataaatgcgacgcttatgctatgcaatgttggaattccctggagtttaattatggatgtgcagcctgcctttccatgagcatgctgggtgaagagggaataccgggcgcatgcgaagccgatgtaatgggggccgtgacgatgctggcgttaaacaaggcggcaggagctgccagcgcctatatggattggaataacaattttacagaagatcgcgatgtatgcatcaaccagcattgcgggaatttccccaaaagtttttttgggacggacattgaaatttcctatcttgatgttttggcgaagtctattaatcctgaacaatgctttggagcctgcaaagcccaggtcgtgccgggcgatatgacattttgcaaagtaacgacagacgacaaccgcggatgcgtgaaggcgtatttcggagaaggcgaactgctggaaaatcatgtaccgtcgtttggagccctgtctttgtggaaggtgccgaagttacaaaacctgctatcttatctctgccagaatggattcgaacaccatgtagcagtcgtgcgcggaagttgcgacagaatattagaagaagcgtttgggaaatatatgggctggcaagtatacaaacataaataaaaagatggcatgggggggagtgggggtatatctaactcaggcgtgcctgtgagatggctaaaaatatatcaggatgatattatgaattatcaaaggaaatagtattattcttggagaaatttatgttattattaacataattaatggaaatctaatttacagatggatttggagtatcatttatgaaggtgagactaagcgacatagccaaacggctgaatatttcatccacggcagtttctctggcgattaataataagccgggggtcagtgagagcacacggagaaaagtaatcgatatgtgcaacaatattggatataagatgccgaacatggttgaacatgtaaaccgcaatgaaaatataaaattatgtatttacaaaaagcatggtctcgtcgtatcgaatactccttttttttccgcagtgcttgaaggtatcggactggaagcggaaaagaataatatcaacgtgatgtatacttatctttctgagaaggtcaattcccgcgaagagatctgcgacatcctgcagcatgttgatgcagggggcatgattgtccttgctactgaaatggatgaagaagatatcaagctgctggaaagctgcaatgtcccgttcgttgtgttggatgcatatttcgaacatatgaaaatcgataccgtattgattgataatattgcggcgacaaaagaaatagtggaacacctgatttcttgcaggcatacccaaattgggtacctgaaaagcaagatcaggatcaacaatttcagggaacgggaaacgggcttaatacaaacgctgcaaaatcacaatatcaagtatgataaaaaatatgaatttgaagtggggtctacaccggaaacagcttatgcagattttgtcgaattgttaagcaaagaaagagaattgccgacggcattttttgccgataatgatattattgcgctaggggctatgcgcgcgttgaaagagtttaatctgaaggtgccggaggatatttcaattgtcggatttgacggtctccccaatagtagtattgtatcgccgtccctaacaacagtacgcgtaaggggtaaagacatgggacgcttcgcggtcgaacggctgattggtaaaatggacaataatctcttcgcatatgtaacgaccaggcttggaacagatgtggttttaggccaaagtgtttgtcagccaaagtgaaataagatttttatctcagaaaaaactgataatgtataaaaaacgtcctaataaaaacaggagggtatttcgtgatgcaattaaaagaagattatgtaataaatgcaatcaaaaaagaggggatactggaaaaaaaagaggatatacagcatgtgataaatgattttagggaacaaccgctttcaaatgtcaggaaggtaatcgcaaaatcgatgcatgcatcactaacaaatattgcacaattaacccatactttttcgtttgatgcgacacagattctaaagtgccgtgaatggatcaaagaaaacaaagaggaggggggactcgaaaatatcacattgaacgatatgatattgtatgcggtatctcatacattgttgtcttgtccttcgttaaacgcacattttgaagaaaacaaaatgaagttattcgacgatgttaatctgggaatggccgtagatacgcccagaggtttgttggtaccgacaatttttcaggcaaaccgtctgagcctgaatgggatagcggctgaagctaaggatcttgcacaaaaagctcaaagcggaaaaattgatatggaatatctttatggcgcttcatttaccacttccaatctgggagcatttggcgtcgaacactttacaccggtgatcaatcctccgcaaacagggatattggggatcaacaacatccagacaagggtaaaattaacagaaggaaaacttgtagcctatccggcaatgggattgtcgatcacctacgaccatagggctgttgacggcgcgccggtttcaaagtatatgaagggattatgcgaaacgctcgagcatttcatggagcacttttttggatgaataaacatccgttaagccgcccaaaagtcagatagaaactcattatacaataaacaaaggaaccccaaatagcgggttcttttgtttagattgcttaacagcaaaagatgattttgaacaaaaatcatcaatcgtattctttatcttgctttcttctttttaaaatattcaacgagcataacgatcagtcccaagcatagcaggaggatccctaccacgaacaggccgcctagtccaacgccttcggcgggggcggagaacatatcatcctgaaggggcacgactgacccgctctggaatagaaccgcaaaaagcctggaaggatattcgctgctccatgaattaaaagacggcaaagcgaccgccgcgcaaagcagcgagccaaccatgcttaaaataccgccgataaataaaacagatccgataaacgcctttttcattacaaaaatctcccgcccattgtttttttcattatatcacaacagacggggaacaaggattgattggggtaatgaattgtcttgctttattccgcaggcataaggctgccgccacccgaaagggagatggtttgtccgtcaagccaagcgttcgcggctgcatctgcatcgtaatacacgttatatccgccggacagtatattggcgcaggtttcatccgcattggaaagctcggtcacatagctgtcgccggtgagcgtccacgtactggtggcatccagcgaaacggcggcgttttgggccgtatgatccgcattgattgctccggtatatgtggtgccgtctgtcaggtttaaggtaacggtactgatcgcgtcgcatgtgatatcgccggtaagcgtctgttttacgcctgtgagcgtaaagttaccgccattggaaccgggcgtaccccaattatttgtgtcgttaccggccacgtttgcgagggtaccgcctgggaaggaaagcatcgtgttttcaagcgtcgcctgcgcgtccgtattggtcacgtagaacatgggaccggccgatgtcgtcgtaagggaggaatccgtcgcggtaaaggaagcggttccttcggctgcgtcgccggacgtactctggtaaagcatcacgccgttttcacccgcgcccgttaatgcggtatcggtcatggtaatggagttcttgccttctacgaccgccgcctgactgccggttgccgtgccggtgatatccgatacggtgatgttgcccgtggaatagatacacgggctgccgtctcccgcggcagagagcgtgccgcctgtgacgtttaccgtgccctcgccacggtcggtcgcaatgggcgcgcagtgtgcaccctgcgtcgtgatatcaacattcgtggcgatgatactgccgccgtaagttgcgtcaaggccgcgcgatgaatccccggtcgtatggattgttatgccatctaccttcacaacggagccttcacctgttgagaatacggcatttgctccttcggcggaggacgtcagttccattccggagatagaagcgctgctgccgccggttacggcaagaacggcgttcaagccgtaaaaattgctttcgtcggcgctggaactgtcgcccgacttgctgagcgtaccgccggttattgtgagatcgccgccatttttgacaagcacggtattctggtcagcggaggcagaggaatacccctggttatccgccgtctctgatacagaatcaacggtatagacgccggtcagttctatgctgccggttgccgagccttcggtattgccggggccgcccataccaagggaaagaattgttatggatgtgggcttaaagttttcatcctcgcccgtacctgtcattttcaggatatcgccgacggcaatatccgcaaaagaagcgcttgattcttccattccattttgttttgtaacagaaacgctttcatccagtatgagagtaagagtcataccattcgaagtgaagttcccaggcattgtgccgcccatgccgccggatggcgcttctgtgtccggcgcgcccgaaccgtcaggcatatcaggcggtgttccaccggaagtattatctgaaccggactgcgcatcgccgcttggcataccggaagcgttgggggcgccggatgcatccggctggggattttcaccgattggcatttcgggcgtatccatcgtccccagcgttaaagtaacctgatcattatccgcggctgtaacctcgccataaacggtattttcattacttgcagagacggtattggaggcggtttccgccgcctgttgcgtacaagcggtgaaaagcgccgctgtcatgaccgcacacaaaatcaaagagattatttttttcatgttgttgctcctttccatgtctgctttttattatccacagtaatgtgacagccgtgtgtcgccggactgaacagcatatggaaaaggataaaaaacgataaatttaccacaaataggaaaatggtccaattgtattcttatgcggggaatcctaaaatgagggacataggaaagtattttgcgtttccggacaacacgataacaaaaagaaggagtataagaatggaaaaggatttatttgcgttaaatggaaaaaccgcgatcgtaacaggcgcggcaaaagggcttggcagggcgatggcgctggcccttgcggggcagggggctaatttggtagtggcagatatcgaccgggcggcaggaacgcaaaccgtcaaagaaatatgcgccttgggggtggaggccttgttctgccagcttgacgtacgcagccaggaagatatcgatacaatggcggaaactgtggtgaagcgttttgggacaatagatattcttatcaataacgcggggatcggcagaccggctccgtctgcggaggtgagccgcaaggattggcaagacgtgatcgatatcaacctgaccggcgtgttttttgttgcgcaggcggtgggtaaagtaatgctcgagcagggatatggaagcattataaatattgcttcgatgtctgcgatgatcgtaaaccagtcggtaccgcaaagttcttattatgcatctaaagcaggggtcgtgatgcttacgaaaagcctggcggcagaatgggcgcagtacggtatccgtgtaaatgcaatagcacccggcgtcatgaggaccgaacaaaccgactttatgttcaaggatccggaaaaagcggagcagatcaagctgtggatggagtatacgccgctcggcaggccggggaacccgccggagctgggaggcgcggccgtttatcttgcgtcggatgcgtcttcctttatgacggggcatgtgatggtggtcgatggcggatacacagtttattgatggatgcaggtttgtattttagggagaaaatatgcatgttgcacaaaggcgcttgcaaagacggccgcggcggggtatgctgaaaacaatgtaagagaaccggagggtgaaaactttgaagctattgatcgaccagtcgccggataacgaggaagttgagatcacgatcaaatgcgggatcatagaccccgcgctggaacagttgattgcacagatcaggttgtattccttttccgttgccgcgagaaaggacgggagaacatataccgtcagccttggcgatatttattattttgaatccatagacaatcgaacgtttttgtatacggaacatgaagtatatgaatgcgagtttaagctttatgagctcgaacagcagcttacaaaaacggattttgtccgtgtgagtaagtcgtgtattttgaatgtcagggtattacaaagcgtgcgtgcgctgctgaacgggaagatggaagcggagcttgataataaggaaaaagtgatcatcaaccgtcattatgtggaagacctcaagcggaagctgggtatggaggggggcaaagaagatgtctaagtttaaattttatatgacgatgaattgcgtatcgtttacaatattgatactgctttacaccattttgtgccttttcggcctgtcaacagtgaacgaggctgcagtactgatgctgctgatcatgacaacgagtattgcggtgctaatcttttttacagacaaactgcctatcaattccattggcgttcagatagctatagatctggcggttattctcgcggtggtgtataccctgggcggtgccacagggtttattccattagaaacggaatatgttctgattgttctggctatgatcctggtcgtttattttgtgacgtttggggtgcttgtcatcaagaataaggcggatgcggacggtatcaacaaaaaaatcaaagagtggagaaaaaaatagcgcagtgcaggaacagcgaagggaatgtccattggacgttccctttttgcatttcacgatatcaaaaatgcaccttgccgaaaactgcttgaagaggggactttcccatggtacttttaaaacgcggtcagaagaaaggaagaaacgaaatggataagatcattgaagtacaggcgctcagaaaatcgtttggggacgtgaaagcggtaaatggaatcgatttttatgtggagaaaggatcgttgtttgcgtttttggggccgaatggcgcgggaaaatcgacgaccatcgatatgatatccacgcaattaaaaccggatatgggcaggatatatgttggcggatatatggttgggaaagacgataatacgatccgccggaaaatagggatcgtatttcaggacagcgtactcgatccgcttttgacagtaaaggaaaatttgtttttgcgcggcagcctttacggtatggataaagcgcgattgaaaaacgcagtgtttaccgcggcgcatacggcggacgtgatggacttttataaccggccgtatggaaagctttcaggcgggcagcggcggcgggcggatattgcccgtgcgcttgtgaatacgccggaaatcctgttcctggacgagccgacaacggggcttgaccctcagacgaggcataaagtctgggatacgatctcgcgtttgcagaaggaaagcaatatgactatatttttgacgacgcactatatggaagaagcggcgcgtgcagactatatcacgattatggatcatggaaaaatccttgcgaaggatacgcctgcggcgttaaaagaacaatatacgaaggatattctcaagatgacgcccaaaaacgagaatgcgcttgcagactgcctggtaggcagggggattgcgtttgaaaaaacggggggcgacatcctcgtgcggctggatcatacgatcgacgctgttgaaatcgtaaacggttgcagggatgcaatttacggactggaagtgcggcggggaacgatggacgatgtgtttttaaatattacgggcgataaagtgagggactgacgatgctggcaatgacaagacgaaatctaaaagtatttttcagggacaaaagcgcggtgttttattcgctgctggcggtcatcatcgtgatcgcgttatatgcggtgtttttgggcgacacgatcacaagcggaatggaagggattgacgggatagattttttgatgaacagttggattatttccggtatcctcgcggtcatttctatgacatctacgctgggggcgtttggcgttatggttgaggacaaggcaaagaaaatcagcaaggactttacggtatcgcccatcagcaggggaagcctggcaggcggatacgtactttccgtttactgtgtaggcgtgatcatgagtctgctggcgctggtgatcggcgaggtttatatcgttgcttcgggcggagatgttctctctgccgaaaacatggccaaggtggtcgggggaatcctgctgtcagtgctttcatccagttcgatcgtgtttttcatcgtgtcgttctttaaaagccaaaacgcctttgcaacggcaagtacggtagtgggaacattgatcggttttttgacgggcgtatacatcccgatcggtacgctgccggaggcggtcggaaatatcatcaaggtattccctgtttcttattcggcgtcatatttccgtacggtgatgatggaacagccggccgccgtatcgtttgacggagcgagcgcatcggtggtgaatgagttcaaccaggagttaggggtgcatttccagttcggggatttcgccacaacgcttatgacatgtatcatcgtaatgatcgcgacaggagtgctgttttacctgttttcactttttaacgtttcacgtaaaaacagatgagaaaaaatacacccttaagggtgtgttttttatttctatgcttttgcttctttgaccgtgagataatcaactacatcctgaaccgtatcaaaaagccttaagtcacgatccgggatcgagaggtcaaactccttttcgaaactggataccgtatccagcaggctgaaagaatcaagttccagatcacgggtcagatgcttttccggagtgatctcggatgcgtcgaccggagagttttccgaaagaagttcctgtacttttgtaaaatccaccatgacaaaccccctgcgtttttctatgctttatgtttaaccgatatggacgacgtttaaaccacggaagctttgacgcttaaattcacttttatcatattctttttcgatctcggggtcaaccatgggaatcactgagaaatttttgtcatagcatttagcgggtgtatcgatgccgcagcattcctgccatccaagcttttttccttttgcaaaggcgacaaaatcattttgaatttcgctggagatgcggcgcgtcgttttgacggaaggcagcaggaacatccatttatagtgacctgcatggaaattaccgaatacaaacgggatgtcgcacgaatggcatgcgcgcagcgaaacagccttcattgcaggggtttcgtaatcaaaacggtacatccatgtattcgcatgctgattatatacttctgcataccagacgcttgccatacggaatacgcggtcggtaagcatcatcgattcggcacgcttgccgtagcggcggtaggcggccttcaggcgggtcttgacctctgctttttcctggtcaatattccgcctgagtattttactgatatccaggaccttggacaggatcttgatacataaaaaggacatttcttccttggttgtgccaatgaggatggggatatccctggccgcgccctgcatagccgcgggaatcgggtattcgggcacgagcgtcccgtctacctcgatcataaatgtgccgtccccaaggccgcaataggaagcgaatttgcgttgcctggataccagttcgtgtacgtccatgtcctttaattgccgtgcggttttgattcccataaatttcatgaatttgcgcgagacatcctgatactgctccttagtgtataaaagggatggtccgccgctcatcatgataactttggaaacatatttgcgcgcggcaggcataacgggaagtacagacgccgcgattgcgcctgcggattgaccgaggaccgtgatgcttccgggatcgccgccaaacgcgctgatgttgtcgtatacccatttgagggctgcgacgatatcggaaaggccgcaattgggagaaaactcttcgcccaaaaatgaaaaatccaagaagccaagcgcacccaggcggtagttgatggtcacaaccaccacgtcgccgtttttcgcgaggttcgtaccgttatattcaggatcgctccccgcgcccgaacaaaaagacccgccatgaatatagaagaacacggcgcgcttctttttatcggcggccggcgtccagatattgagcgtcaggcaatcttcgctggctgatttgtatttttttgcttggggacaggtggggctaaaagcggtggcgtcgaaaacacccttccatcggcctgccggttgtgcaggcataaaacgcagaggccctaccggaggtttggcatacgggatgcctttatatacgagcgtaccgttttcacggcttcctttgatttttccattcttgaccaatatgtttttttgcatttcttaatccttataactggtttgatttccctcattatactacctgaaaaaggaaagtaaacaaaataaggaaaccttttcaaaaatttaatatttacgatgccgccgctttgtttttcagaagggctttgttataatgacgctgtaaggtttatggttatcagtggcgggcagtaagcgatatctgcagggaaggaacgaccggatgaacaaactaaaattaatttttacaatagtgttttcttcaattttgctggcaggcggcatcttcctggcggtatatccggttgcgatcatcggcgttttcgcgcgggtgttgggcattttactgaccgtacttggcagtctcggcgtgatgttttttgttttttcgcgtgacaacaggccttatattacggcacaaaccctggtgatcggcgtgatttcgcttgcctgtgggattgtgttgctcgcctatccgggcgtgatcgatcaggtcgtatggattacgatgctggtatggctgttctttacgggcggcgtacaactcctgatcgcttattcttactatctgaacgcggaacgcagatgggggttggcgcttttgtggggcggccttttgatggcagcatttgtcatcttgctgatgtcccgggggctttgggtatttatgctttctacttttattgcggcttattgtatcctgcttggccttgccggatttatgcggctgtttttgatcgtgaaccagaaaaataaaaaacgtaaaaatattcccttaccattctggatggaagcgtttttgccgaaagcgactttggaatggatcaagtcctcgctggatgaagaggacgaagaggagggacagagagacggaagcgtagttaccagcgagaatatcgtaaagggacaaacggatatcgaagtgttgatccatatgtcggatatcgggacgaatgcgctcggccatgtggacctcgcaatagacgggcaggtgttttcctatgggaattacgaccacgataaatccaatatccatttgtttgggcttttctgggatggtgtgttcgcaatttgcgagcgcagcaaatatattcgtttttccctcgaaaatgcacgaaaaacgattattggataccagcttgcgctatctgccgaggacgaaaaatgtgtcaaagccaacgttgcggattttttgaaggaatgcgtgccgtggaagccggagcagccaaagaaaaacggttacgcgaatgcgcttctaaaacaaggcgcattgcttttcaaggtaaacaaggggaaatataagacatattttatgctcaatacgaactgcgcgcttcttttggacgatttcctggaaggaacgagtatccccaaagcacgcgtgctgggaggaatcatgacgcccggttcgctcctgtctatgtttgaaaacgaactgaaaagacagggaagccctgtcgtgaaacgcacgctttacttaagcgaacgcatggcgtcgatgcaggcgaaaagaaagccgcgcaaagcgcttgccgaacttcacgaatgtatcgaatgcgagataaatgaacaggatacaaaaaagaatcccgacgcataaagcgtaaggaattcttttgatactgttttagttggaagaataggcgtcgtctacaatggcgaatatttcatcgatccacaggccggaatcgcgcgcctgcctggtggcctgtacgaacatatcgcgaatttcgttttttctcaggtctttgatttgtgcggcattgtctgcaacaaaatcgcccttgccggcaacagaatataaaaatccttcgtttttcaggatcgtataggatttttgtacggtattcggattgatcccaagttcttttgccaaagaacgcacggatggaatctgttcgtgtgggtgaagttttcccaacatgacaagcgttttgaacccttggacaatttgttcgtaaatcgcatgtttcgacgttttatccagcttgatcatggaaaaggcccctttcatgagcatagtgtatgaatcgcattagtacaattttattgtattttatccctattatactgtcaagtaaaaaagttgacaaaaagaaagaaaaaaatgagtaaatttcctttgcttttcggacggaacgtattataatgaaaacgattgggatcagttctggaatttatttcaaaatttattatatacgtgccgtgtgggcggacatgacctatttcatattgatgactattattaatacatatatattattttgacaggaggagagaaccaatggacattatgttttgggctcttatcggggccgtcattgcgcttgtattcgcggcgatcaccgcagcgcgcgtaatgaaaaaaagcgagggcagcgagaaagttaaaaaaatcgctgctgcaatcaggaaaggggcgaatgcctacttaaagcgccagtacaaaacagtcgcaatcttttttatcatcgttacggttgtgctggcaatcttagcggcaacaggtttcatgaccttcttcgtaccgatcgcatttatcgtgggtggcgtgttctccgcattggcggggttcatcggcatgaagatagcgacggcggcgaactcccgcacggtaaacggagcgaccaagagcctaaattcggctctgcgcgtatctttttcgtcgggcgcggtcatgggtatgacggtggtaggactcggtcttttgtaccttacgatttggtattttattctgaacgcttacttccagggagatgtggcacagatcgcaagcaatatgctgatgttcggcatgggcgcttcgtgtatggcgctgtttgcccgtgtgggcggcggtatctttacgaaggcggccgatgtgggcgctgaccttgttggtaaggtggaagcgggcatccctgaggacgatccgagaaatcctgcgacaattgctgataacgtaggcgacaatgtaggcgacgttgcgggtatgggcgccgacctttacgaatcgtatgtcggttctattatttccgcaggcgctcttgccattgctgccggactcggcggcggcgggctcatgcttccgatgatccttgcggcggttggcatcgtagcaagcgtgatcggcagtttctttgtcaagacaaaggaaaatgcttcgcagaagaacttgcttaacgcgctgcataagggcgtatatatcgcggcggcaatcgttgcagtggcgggctactttgtagtaaccggtattcttggcgcggaccatgtaggcgtatatgtggcgatcatttccggccttgtggcaggtatcatcatcggatattatacggaatatgtaacgtccgaccatttcaaaccgacaaaggaattggcggattcgacagtgacaggccccgctactacgatcatcagcgggtttgcactggggatgaaatccacggcgatccctgtcatcacggttgtggcaagcgtcctgatcagctattttgcttcgggcggtactcttgggggcggcacgtttgaagtaggcctttacggcgttgcgatctcggcagtcggtatgctttccacattgggtatcacacttgcgacagacgcatatggaccggttgcggacaacgcaggcggccttgcggaaatgagcggacaagacccggttgtgcgggaacgtacagatgctctcgattcccttggaaacacgacggctgcgacgggcaaaggctttgctatcggttctgcggcgcttacggccctcgccctgatcgctgcgtttgcggatcagtgccagatcgatatgtcggcattgagtctccttgacccgacggtgttgatggggttactcatcggggctatgctgcccttcctgttctcgtccatgacgatgagcgcggtcggaaaggcagcgatgaagatcgttgtcgaggtacgcaggcagttcaaggagatcaagggaatcatgacgggtgaaggtgaaccggattatgaatcgtgtgtggatatctgcacgaagggcgcgctgcacctgatgctcgctccggcgatcctcggctttgttgccccgatcatcgttggcctgatcttaggcgcaaacggcgtagtgggaatgctcgcaggagccacggcgtccggctttgtgctggcggtcatgatgtccaattccggcggcgcatgggataacgcaaagaaatatatcgaaggcggcgcgcatggcggtaaagggtcagaagcgcataaagctgctgttgtaggagatacggtaggcgatccgttcaaggatacgtccggtccgtccctcaacattctgatcaagctgatgtctatggtagcggttgtatttgcggcagttatcatgcagtatgggattttgcagtagtaaatagaataagaaaaagcgctgctttatgcggcgcttttttttgcttaaaataaatgtgcgatgttgaatcgcacaaaaacgaacactaatctgagagaaccacatgcgggccgcgttgctcgagcgcccctttgacatcttcggaaaggccgcggtcagtcacgatatgattgatcttgcgcaaggtggcaacctgcgcaaaagcggaatcgtcaatatcatcacttttgatcatcacaatattgcgcttggcgcaatcgagcgccgttgccttcaaatgggcagacgtctcatcctttacagtcaagccataagcagtgtccagcttttcgccgttcaagaccgctacgtcaaaattatatttccggataaacgcaatggtagaacttcccaggaacccgcaaatagcctcttggtacggcccgggcgcgatcatcagttccaccttggggaaggtgcgcaggatattcgctgccgcgagggaattcgtcatgactgtaagacgcaaatttttgatgccatagacgataccggtcgtcatgtcgccgccatccaaaaatacagaatcgccggacttcaaaagtttgcctgcggcaacgccgatcttgcgcgcattaccgtctaattgtgaagcatccggcgatatgtttacgctgtccggtatatcgcgattgaggtatgcgccgccgtatgttgttgtcaggatcccctgcttttcatagatggcaaggtcccggcggatcgtcatgggcgaaacgtcaaaatgagcggaaagttcgctgacatcgaccgtttcgttttccataaggatattatagatttttaagcgccgttcagatgaattcatagaaatacgcttcctacacagtatgagtgttgttgtttctttgatgaaggaaccaagtacagtatagctctaattaagcggctattcaagctttttgaaaaataacagaattaaaaagaacaaaaaaacacaattattttaaaattatgattgatttatgttttttcttgtgctattatgaaaccataaaaaggtggccaacgaaattcaccacaataattacaggcagatattaaaaataaataactgatttaaaacttttactatatatatcctactataaacaaaaaaaaatttcactataaaatataaaaaatttagattccaataaaaaagaaaaggaggaatagtatgagcgtacccttttttagggaagttcatgcgaaaatggaagatgaaaaagaaaattgtaggtttgatgctcgcggcagtgatggtggttgctgtttttgttggatgcgcggcaccggcgggggaatcctcgacgccgacgccatcggaaaccagcggcgaaaaagcgtccgcggagccggcagcttcacaggaagcttcggcaagcgcggagggcgaagcgaaggcggacggcagcgggctgacgtttgcgtttatcgtcccgggactggatgcgaactggtatgtggagatcgcggacagctttaagtatgcggcggaggagatcggcgcggaggtcatgatcctgccgtccgactatgatgtggacaaggaagtggcaaacatcgacttgtgcgtaacagagcaggtggacggactatgtatgttctcgttcaacgaaaacggcgcggctcttgctgcaaaaaaaatgcaggaagcgggtattccgctgatcgttccggacagcgtgggacaggcccttaacaagggcgcagacctcgcggcgtgcgtagacttcgactgggaagaaatggggcacatgtacgcagattggatggcggaaaacacgacgggcgattatgtgatcattacagggaactttgagcactatccgtgcatttatgtcaataaaggcatggaagaccgttccaaagagctgggtaaaaacaatctgatcgatatccgtgacgctgactataacccggacaaagcggcagctgcggcagaagacctgatcaacggcggacttgagttcgagaccatcttcgtcatgcaggaagagatggcggcggcagtcgtacgcgtcttgaagaatgcgggcaaactcaataatccttacaaggtcatttcccaaaacggacaggaaatgggcatcgagatgatcaagggaggcgacatgcagatgacgatctccagctcgcccgggcttgaaggttatatctgcttccgtatgctctacagccagcagcagggcaagatcgattataagaacgagcagaaaatggttccgatcaccgcagtcacacaggcggatacggaaaatatcgacccgaaagtcatcattccgtggcacagggatccggtcttcaaggagctcacagcggaatattatccggaactgatgtggtattgatccaaaaacagtaaaacggaaaacaggcaggaaagcgcacgtccggagggacgtgcgcttgtcccctgtaagtgggactctgaagacaggagttttgtggtatgacatacggaaaacagattttagaactgacaaatataaccaagagctattcaggcgttaccgtactgcgtaacatggattttgccctgcatgaaggcgaggtgcactgtatcgtcggcgaaaacggcgcgggaaaatccacctttatcaaaatattgtccggggcgatcatgccggattatggggatatgatcctgtttgggcaaaaacgcgagtatacaaacccgcttctgcccatcgaacttggaatatcgacgatctaccaggattccgacctgatcgacacgctgaccgtggcggataatatttttttgggcggggaagtcgccaagagcggcgtcgtcaacaaaaaggaacaggaggaaatcacgcaggcgttgattgacgacctgcacatgaccatcaaggcggatacgctggtggaggatatctctcctgcgcaaaagcagatgctgcaaatcgccaaggcgctccagcgcaaggcgcgggtcatcatcatggacgaacccacagcctcgctgggagaagaagaatccagcatgctgcttgcaacggtaaagcggctggcaagcgaaggcatcggtatcatatatatttcgcattatctggaagaggtttttgaactggctcacacgatcaccgtcatcaaggatgggaacgtaacgggctgttatgaagcgtccaaggttacgaacgaagaaatcatatctgccatggtgggacgggaagcgtcgcttttttaccagcgcgagcgcgtgagcatcggggaagaatatttaaggatagaaaagatatcgcggatgcccgttgtgcatgagatcagcttttccgtgcgcaagggagagatattcggcatcggcggactggtcggttcgggacgtacagagctgatgcgccttttgtatggcgtggataaaaaacagacggggcatattttggtcgatggaaaggaaatcagcatcaaatcgccgcgtgacgcgattaaaaacggcatttgtatgctgggcgaagaccgtaagggcgacggtatgtttttgcagcgcagcattgaggaaaatatttgtatcgtccgcaacgaaaacaaggtgtttttgaacctgaaggaagacaaacgggcaacagaggaaatggtcaaaaaactgaacctcaagacaacgggcatcgaccaggatatcgagaggctgtcgggagggaaccaacaaaaaagtattctggcgcgctggctcttgtcggattgtaatatcatcatcttcgacgaacccacgaagggcgttgacattggtgcgcgcgaagagatatataagctgatggtcgaactggcacgacagggcaaagcgatcttgatggtgtcgtcggatatgccggagatcctttcgatgagcgatcggatcggaattttgcgcgaagggaaactggtgagtatcatgtctccggaaaacctgacggaggaaaaactgatgggaatgtatctggggattgcacaggaggaaagtcaaaatgaaagacaatagcagggcattattacagaaaaacgcgacgctgcgcaaggtggtcagctcgcagtctttttacctgatcctgatcattctggcgatcgggatcgtgacaacggtgatcaaccccaaatttgtttcgatagacaatattaagggcgtgctgtcccaggtatcgacgctggggctgatctcggcgggtgtgaccgtactgatcatatccggtaacttcgatatttctatcggcgcgatcgtggggtttgcaagcacgatgatgtgcctgtctatcgagtcgggcgcgccggacggcgtggcaatgctcgtggggctgggcgtagcggtcggatgttcggctttaaacggtgcgctgtccgttctgttcaaggcgccgtcgttcatcatcactttggcaacgaccagtatatatacggggctgtgcctgacgattacaggcggcggcaatgtcacgatattcaaccgcatggaatattttgcgggcacatatttgtttgatgcgatcccgctgctgttcgtcatcagcctgatcggctatcttgccatccacttcctgctgaagcatacgcagttcggacgtcgtgtgttcgcgatcggcaacaacacgcaggcagcttacctggcaggcatcaaagtcaactggaataagatcaagttcttcatcgccagcggcatcatgacgggtatcgcggtcatcatgctggtgtcacgtttgggggctgcacaggcttcgacgggcgcgggtatggaattgcaggcgatcggtgcggtcatcatcggcggcgcgcccatcaacgggggcaagggcaatatgctgggaacgttctgcggcgtgcttttgacgggcattatcttcaatgcgctcaatcttttgaaagtaagcccgtatttgcagcagatatcctttggcgtactgatcatcgtttctattgccatcagctctatgcgcctgcgcgtatcgaaataaggaggaagcgccatgaaactgcaaaggttggaagaaataaaccagaagatcaaatacgacttcgataaactaaaggcggagcacccggaacgcctgcaaaagaggatgaacctttcgttcagtacgtgggtgtttgggctggaggacttagaggaatcggtggagcggcttgcacgcttccaagtgccgtatatcgagctcggcggcaactacggcggcaaggatatcggctaccaggcagaccttgcggggacgaaggcgatccttaacaaatatgggatcaaatgctcgggtatctgtggcttcttctcggattccaacacgctgtccaccaacaataattttgtacggcagaccgcgcgcgaatatatcatcgaggaagtaaaattctgcaaggaggtcggcggggaatatgtgcttgtcgtaccgagcacagtaggaaggagcgagccttatgacacgtcggactatgcgcgcagcgtttctacgctaagatcggtggcggatatatttgtggagtatggcgtgaaatgtgcgatcgaacccatcaactcggcagaggtggcgatgtgctcgacgatcgcgagcgcgcagcaatatatcgctgacgtgaatcacccgggcgtgcagcatatcaacggcgatatcttccacatgctgtgcggggagcggcacatttcagaagcgatcctcgcggcgggggaacgccttgtgaacctgcatattgaggacaccaaccgcctgcctcttggaaacggcatgatggatgtggatacgatcattcgtgcgctttatgtgatgggctacaaccgcgacggcagatttgtgacaggggagccgttaggccccgggagaaactcctacgccatcatgtacggacagcactgtgcacaagcaaaggacaagcaggtcgcggatacgctgtatttcagggagcgtgaggaagaactattgaaataattttcctcaatcataaaatagtgggaaaacgatttcgatcgtaaataccacaagcagagaaccggcgttatgttcaaaaacaccggttctctgtttttgtgaaaaattttgcggggattgtcttgtgtattttgaaaaggtataatgaggaaaagcaaagaatggccataaaatgtatcttccgatgaataatactatttgaaaaaggtatgctattatgctgaatacgaatgatcccgaatatctcaaacaattgaacgacaatctgggtatgtgggaagcctttgtgtgtgaacagcggtcccttgacgcagtcattaaacgcttcatgcagtttgtcaaaggatatatccctctgcgcgggatggctcttttgcgttttgacacgaaaaagcagcttaaggaatatgcggcgtgcagggatgggaaagtttttacactacaggatcatagcatgtttttggatctgagaaggcctggatggggcgacatcatacaagaggaaggcggaatagagacctttaaaaaggaagcggcggccgtattgggggagcaggctgaagaagttttggcggtgcagccgattttttccggtgattatttgagcggcatcatggtcgccgagaaaacaggaaaatggacaagggaagaatacggggtgctggagtcgcttgcagcgacggtgaggatcgcttttttaaacaaagaaaaaaatgaaggacaggcagagcaaacatgggttttcaaccaattgatggatcatgtgcgtacgggggtattgataacagatccccaaacagaccggattctttttgctaacaatgtgatgcggagaatgtatgggctgacggagccggaagggaaaagatgttgggaagtattacaggaaggaaaaacacagcgatgcgaattttgcccgattccgcgccttgaaaaaagcgacaagaaaaatccggcttatgtttgggaagacagcagttcggtagcgggacgggttttggagtgttgcgacagcctggtgccgtggatggatgggcgcatcgtacatttccagcagtgtaccgatatcaccaattccaagaaaatgaccaaggctgcaagttttgatgagcttacgggacttaagaaccggcgtgcaggcaaagaggccatgaaagcggccattgaagatgcgcgcaagcaaaacgaaacgatcacggtctgcctttatgatatcaattccttgaaaatggtcaacgatacctacggacacatcgaaggggacaggcttttggtaagaatctcaaaagaagtggaggatgcgctggaccctgagcattttgtttttcgtttaagcggcgatgagtttgtgatcgtttttcgcggatgcggcaagcgggcggctgaacgtgtcatgcgcaagatacaggaacaactgaccttggttgcaaaacgcgagatgctgccatatgaacttagcttctgttacggcttggtggagcttttaccgtcagacaaaagaaaaatctccgccatcatcgccgatgtggatgagcttatgtatctgagcaagcgcgcataccacaccggccggatcaacgaagaatttaacagggagacaggcgcaagctcctttttatacgataaagagcatctttacgaggcgctcacggccagcacggacgattacatctatctgtgcaatatgcagacaaacctcttccgttttccaccggcgatggtggaggaattcgacctgccgggggaagtgatctacgatgccgcgcccgtatggggcgcgttgatccatgaaggcgaacgggaagactttttccggaatatgcaggatattgcagacggggccacagatgtccatgacctgatatatcgcgctttgaaccgcgatggaaaatgggtatgggtgcattgcaggggaaaagtgacgcgcgacgaaaatggaaacgcacaattgttcgcgggcattattaccaagcttcacagcgatgaactaccgcagggaaagggcggcagtacgttgaatccggcgtatgaaaagctatacggagatatatgagtgcgaccttataaacgatactatgaaccttgtcctgcaaaacaaggatattctgagcagtgttaaaagtacgggaagatatcgtcaggcttataaggactattccatgcgggtggtgcatccggatgacgccgttttgcgcgaccgcttatttgacgcaaatttgctgatacggcgtttcaacgatggggaaaaagaggtaatcggagagtacaggcggcttggcaaggacggcgactatcgttgggtcattgcgacggtcatcccggcaggagaatgggatgagcacaaccataagatactgatcctcatcaaggacatcacggaataccgcagacaacaggaggaacgggaaaagcaggagcacagggcgtataacctgtttcggcagtcgtgcgatacggtagcggaagtcgatctgaaaacgggagaatgtacatatattgtaaacaaaggagagggcgcgggcgagagcccgcaaaagggaaactatgcccagatacttcagtcgcgtctggaatacctggagggtgagatgcagcgggagcatatccgttccctgctttcgatagattccctgcgccggatggtgcatggagaccggcactacaaaacggcccaaatcagcctgaaagacaaacaaggaaaaacgaaatggttcgaagtcaatgtttttgtcgaagaagggaaagcaccggcggctattttggcggaacgcgatatcacgcagcaaaaagaggatgaataccaaaagcacttaaacgagcaatatgattcggcattacggaatatatatgatgaattgtatgaactaaacgctacaaaaaattcgtaccgtgtcgtttaccatgtccccgacaaatatgtgatcccggcggaaagcggagttttgaacgagggagtggccgaggtgtcggaaaatatggtgcatcctgatgataaagagcgctttttaaaattttttgaccttgaggcagtacgaaaggatttctcctccggcggggaaagcaggatgggtgaatttcgtaaacttttgcaaaacggggagtaccattgggcgtcacttacggtccttccggtcaagcggagccagggggacgacgagatattcctttgttttataatggatatcgacgaaaagaaaaaatcggatgccgtctttgaacaaaacaaagaactgcgcaggcagcaaatagacgacgagcgttaccgcattgtactcgaacaaacgggaacagttgtctttgaatggaacaggataacaagggaacggtatgtaccgcataagatggcgaaatgctcgcgggtgactatggcgattttaagagcagggatgtgttgctcgtttggctggaggacggggtggtccatccggaagatgagctgccgctgcgcaaatttatgcgggaaatcggggacggcaggcagtactcggaactggtattacgtctgaaaaaccgtgagggtgagtatcgatggtacaggatgtcgcagacgcatatcctgggtgaaagcggtaacgttgaacgcgttttgggaaccttaaacgatgtggacgaaattacaaagtcacaggaaactctgaaataccgcgcggaatttgacatgctgacggggatttataatatccaggaattttatgtgcaggcgcgtaaactgctgcagaaaaacatggataagaaatatgcgatcatacgcatggatatccatcgttttaagtatattaacgacctttacggaatggaagaaggcgataagctcttacagtttattgcaggcgtgcttcggacaaagttgtcggcaaaggatgcatacggcagattgggcggcgatattttctgcatgtgtgtttcttacaaccaaaagcaagagttggaaggtctgacgcagactttagcaggcgcgcttgaaaattataagctgggataccgcatcatgccttatttcgggatatgcacagtagacgacagggatatcccgatcagtatactgtgcgattgggcgcaacttgcgttaaagacggtcaagggcagcacacttgcccgctccgcatattacgatgaccgcctgcgtgcgaaacaactggatgaacaaaaaatagaagatgaaatggaagacgcgcttgagggcggccaattcgtcgtttatttccagccaaaacacgatatccgtacgtcgcgcatcgtgggcgcggaagcgcttgcgcggtggatccatccaaaggaaggactgataaacccttctaggtttattccgttgtttgaaacgaacggattcgtgatccggctggatgaatatatttgggaacaaaccttcaaaagcatgcgtacgtggcttgatcagggatataaagtggtgccaatttccgtaaacgtatcacgcctgcatattttcaaccggaatttcaaggcaaagatcatggagttgtcggaaaaatacaggatacccaaagacctgattgagttggagttgacggaaagtacgttcattgaaaatccggatgagctctatgaaaaaatgaacagcttgcgcaaagagggcttccgtttttccatggacgatttcggatcgggttattcgtcgctcaatatgctgaaaaacgcgatggtgaataccattaaactggatcgggaatttttaagcgagacggtttcgacggccaaaggacaaaccgtgattcgctgtatggtcgcaatggcaaaccaacttgatttacgggtgatcccggagggagtcgaaacaaaggaacaggtggaatttcttctggacgccggatgcagcgtagcgcagggcttttatttttcaaagccgatgcccatgcgggagtttgaaaagctgcttttggcagatacgcaaaagtaatagcagaaataaaaaaggctgcatgaaaaaatgcagcttttttattgccggcatgactggcgttttgacaagaaagcaaaatcaccctataatgcaaaagtaaagatttaggaggaggcctgtatgagggactgggacacatatcttaacagggagatcgcttgcggctgcgggaaaaagcaccgctgtgatattgaaacgatcatcataggaagcggcgcgctcgaacgattacccaacctgatcgcgggcagatacggtaaagtctgcatcgtcgcggaccggaatacctatgaggcggcaggaagaagcgtagcgatgcttctgaaagaaaatgggatgccgtgttcacaaattatatttccggatgcggaacttatccccgacgaacgtgcgctgggcgtgattctgtcggaaattcccgtgcagacggacctgattctgtcggtcggttcagggacgctgaatgatttgtgcaagtttgtaagttataaattcggcatcgattattttgcagtggcaacggcgccatcgatggacggttacgcttcaaatgtggcgccgcttattgtgaaagataccaaaacgacatacgaggtgggacggccgaaagctattatcggcgatacggatatcctcgcaaaggccccggcggaaatgatacgggcagggatcggcgacatgctgggcaaatatgtctgccttgccgactggaagctggcgcacatcgtgactggggaatattactgtccctttgtagaaaacatgatgcgaaaatctgtggatatggtgcgcaatgcggcaaagggcgctatggagggagacaaggaagcggtgaccgcagtcatggaagggttggtattatcggggatcaccatgagttatgttggaaattcgcgccccgcgtcaggcagtgagcaccatctgtcacatttttgggaaatgatgctcctgcagcagaaaaaacatgatccgctgcatggtattaaggtggcggtggggacagtaatcagtttagaactgtataaacagcttaaaaataatagtaaagaagcttttttgcaaaacgataccggatattcgcaggaaagatgggaagcggacataaagcggatatatggaccggctgcgacggaagtgatcaggctggaagtggatacacggaaaaacgaggcttcaaaggtaacggaaagaagaaaaacggcggatgcgcattggaaagaaatcacggcaatttcggaaagtctgccgtctgcagaagaaatggctgcgatccttgcgggaatcggcgcgccatacctgccatgccggatcggcttagacgaacaaatggtgagggacagtatcgtatatgcaaaggaactgaggaaccgctatgggttgctgcaactgctgtttgatgcagggcaggcaggaaaaatggcggaggttgcaatcaataagcagaaaaggagagatgtacatgaggaatgacatgcttgatttgatcaaaacgcggcggagcatacgtaagtatagtacaaagcaaattacggacgaggcgcttgacgcagttctggaagcggggacatatgcgccgagcggaaaaggaaagcaggtcgcgactatcgtcgcggtgcaggatcaagagacgctgcaaacgctcagacgcatgaacgctgaagttttggggatggatatcgacccgtactatgcgccgccgaccgtggtactggtgttcgcagatccaacgcgcccgacctatatacaggacgcaagctgcgtgctggagaatatgatgctggcagcgcatgccatcgggcttggctcctgctggatcaacagggaacgggaaatgtttgagacggacgaggggaaagcgctcatggaaaaatgggggcttgatgcaacgctcaaaggcgttggggcgatttctcttgggtatattgaaggaaatccgcccaaagcggcaaaacggaaagaaaactatatcgtcaaggtctgaaggaaagcatgcggccgatgatacgaaataaaaaactccccgtggtgacgagggagtttttatttgccgaaaaattcctgctgcggatattgcttaaaatattcgccgatacgggtttgcaggttgttctcaaggttcttataaaacaacgcaatatcgagcatatgcagggaaccgcggttcataaggaattttttaaagatccatttggccttatacaggcggtatgccgcatcgtcatcgatcacaagcacgccgcgctgctcgtcgatgcgggcgccggtatagtgcgggacttcaaagcggaagtgttttccgaaatcaaacagtacggcgccttcgttcagttccttgccggcataagtatcgtcgtgccgccagttgagggggttgacgcacacggaatcaggccggataaaacgcatgagcgggacatcccttgccgtcgtgttgtaggaaacgatcgtacccaggtcgcctgccgattgtgcaagctttagatggggataccgcttaaaatcgcggcgggtaagggaaaaaccgatcaggtatgcggcgataagtttttgctgcaactcagactttgtaaattcacggcgcatcagttcaaggagcatcgcgctgccttggctgtgtccggccaaaataaaaggacggccattgttatggtgcttaagataatacatgaaagcgtcgcgtacatcaccatagggcatacgttctgcccgcatgacctccggcaagggcattttaaagctttcaagccccagttggcggtaatacggcgcataaaaattgcaatgcctgcgaaaaagctggccttgccacgcgcacatgccttgtgcgatccacttataaatggggttgaccattcccatatgatgacgttttttacggaaagggtgcgcgtaaatcgtcggatagacgaaaaatacgtccaccggcttcaccgtatcctttttacggggcgaaaacgcccacaaacctttgcgagaataatccataagccctgccaatcaattgatatcgctacctatactatcacaccataaataccttttcaaacacaatcatgaaaggaatgcccgtttgaccaaggataatttaatgcaagagatgttgctttaaagcaacggctggggtaatataaggatatgaataaaaaataaagggaatgatcatatgaaggaagcattgacgggactgatcaaaaaagcgatcggggatcgtacattgaatggattttgcacacaggcagggatcaacgcgggcaacctgtcgcgcgtgctgcatggacaaaatgtgagcgcggatgtactggtccgcgttgcggagcatgcgcagggcggcgttacggcagaggagctgttttatgcggcggggtatcttgcccaaaggccgcagaatgctcgtatccctatctatggaacggcggcggcagggcttccgatcgcggccttcgaggaactggacggatatgtggacgcgggcggattggacggcctgccggaagaatactttgccttgcatgtgcgcggcacttcaatggacgcaataggaatcacagacggcagcactgtgatcgcacgcaaacagcaaacgcttttggatggggaaatcggcgtattcctggtagagggggaggcgacgatcaaaaagtttaagcgcagtgaaaaggatgtattgctgatgcctgtgagcacggacagagcgcatcgcccgcagaggtacgacaaaaatacgaagctgtgtatattaggaaaagtgaaaagggtaatcatcgatttttaaaaatccggcgcagggatagatgcgccaggaggtactgttttgcaaaacaaaaaacgttctgttttccatatagactgcgatgctttttatgccagcgtggaagaaacgctgcatccggaattgaaaaaagtgccaatggcggtgtgtggaaaccctgaaagccgcaggggaattatcctcgcaaaaaatgcaatggcgaaaaagtgcggcgtagtgacggcggagacgatctggcaggccaagcggaaatgcccgaaccttgttttggcgcctgcgcgccatcctttgtaccgcgaatattgcgaggcgatcaacgctatttacgaacagtacacggatcgtgtggagcgtttcagcatcgacgaaagctttctggacgtgacggggagcctgcgcctgtttcaaaaagacgaactgggactggcgaatgaaatcagggaacaaatcgagagggaaatcgggctgaccgtttccgtaggggtttcctttaataaaatactggcaaaaattgccagcgacctgagaaaaccaaactcggtcagtgaattgagcgaggaaaatttcaggagcattttatggccgatgcccgtatcgaccatgcttatggttggcaaatctacggataaaaaactcaaaagcctcaacatacggacaatcggcgacttggcgaccacggaccggaagtttttggagcgctctttgggaaaacacggcgtacaattgtatttgtatgcaaacggagaggacgacgatcccgttttgcgcattggcgaaggacaggaagtgaaatccgtaggcaacgggatgacatttaagcggaatttagtatcggacgatgatatcaggacggctgttaccgcgctggcggatacggttgccgcccgcctgcgtaaggcggggaaaaaatgttgttccctgcaggtgacgatcaaggatacgaacctgaaagtgattacacgccaacggccgacgccctatcccgtgtggttggccgccgacatcgcgaagcaggcatttgaaatcattgaagcgtcctggaaaataggcgtgcccattcggatgctcgccattaccggacaaaagctggcgcaaaaggacgatgtgcaggagcaattgtcttttttaacaccgggcaagcagttggaagcccgccgcaagcgggaaagcctggaaaaagcagtggacggcatccggctgcggtttggaaaaaacagtatatcgccgggcagcgtgattaaaaacgaccttggtatacaggaggaatataatggggatgcgctttaggcggaaaagtgatatgggacgaggatgtaagcggtttccaaacgaataaaactatggtatactggcaccggaaaagagggtatatatgaggaatataatgaagaagacagtggccgtgttttgtgtggggatccttatgctaccgcttttatcagcgtgcgcgaataaaggtgcgggggaaacccaatctccgcaggcgcagaaggaacagtttgctgctgcggcgcagggcaggcagatagaagaaatatccggtgtggcgacaaaaaatatcctggagacggaaggcaatacactggtgtcggtggattatccggtgctggagacttcaggcgctatctcggcggagctggaacaatttgtaagcaacgcggtcagcgagtttaaggcggaggcggacagcgcgcatgcacaggaaggaaatgcggataaggtttattcaatgacgatgacatataagccgtacatgacagacggtggaattttcagcgtgaaatttacgcgtaacacggatatcgggggcgatacgaacaaggtcaattatgtggatgcatttacatatgatgttgcgggcggcacaaaaatgggccttgcggatatctttgacaaggatcaggattaccttggaacagtttcaaagatggcggcggagtacctgctcaggaatgagatattgcgcaaaagtatggacgaagatatgtttgcgcagggaactgccgcaaaagaggaaaattacagtaactttattttgacgtcggacaagatcatgtttgtattcaacaaaaatacggtcgcgccggcgcaggccggaacgctggaagtcagcctgccgattgtcgatttggacgcgctgctcaatccggaaaacaagcagatgatttacggcgcgaagggggcgcccgaggcgatgcccagcacgcttccttcggatgcccggcagggaagttcggagtacgcggactttaagacatcgttgccgcagctgcaaatcgcaggggattttatgccgccaagaagcctcgatggaatcgatccatttaaagacaaggtagtggcgcttaccttcgacgacggcccgcacgagacactgacgcccaaaatccttgatatcctcaaggaaaacgatgtagtggcgaccttctttgtggtcgggaccaacgtggaaaaatatccggagctggtgaagcgggcctacgaggagggcaacgacatcggtacgcacagttggaatcatcctgatgatacgacatggaaaaatatgtctgtgagcgataagttggagcaataccgcaaggcgaatgacgcgatcgaggcggcgacgggcctgcggtccatgatcgaccggccgccgggcggcaggatgacagaggatgaggcaaaggcgcttgggagagagcagatcatctggtcgctcgatcctcaggattggaagaaagcgaaccgtgatccggatactatttacgagcatgtgatcaatggcggaggagacacggaaggcacgcttgcggacggcggcgtgattctttcgcacgatatccatgcgacgacggtagacgcctacgaccgcattatcaaagaacttaaaaaccaaggttataagtttgtgacggttacgcagatgatgcagatcgccgaggttcggggcggggatatcaagtacaaattctataatgcgcccacggcagaggaaggcgcagaaaacagggacggtgcaggaatgcaagaagcaggcgcttccgccagtccggatgcatcggccgatggaagcacatcttaaaaaggatcggaataaccacaatgaaaactccggggagccggagttttttattggaaagtttgcaacttggatacatatcgtattataatggaaaaccagaggggacaatacaggcttttcataccggcctgggaaggtaaagcaatgaaaaagacaggaaaatggatttgtatcgcgcttgcggcggcattttgcatgatgtgcgtaagcggctgcggcagcggatcagcagcaacgccgtcggctgcggcgacaactatcacatcaggacaggacgagccggtctccgagccttctgaatcggcgcaagagacgccggcagagacggaaacaccgcagccgaccgcaacccctgatcaggcacagcaggcagtaacggatatcaagcagttgcagccaaaaagtgataaatttatgcagccgaagtcccttgacgggatcgatcccttaaatgataaggtgatcgctctgacgtttgacgacggaccgaatccggtcaaaacgccggagcttttagatatacttgaggaaaacgacgttgtagcgaccttttttgtggtcggaaacttagtcgggcaatatccggacgtggtaaaacgcgcttacgaggacggcaacgagatcggtacgcacagctatacccatcccgaagccggagagtggaagggactttcggtagagggacaacttgcgcagtatacacaggcaaatgacgccatcgaagcggcgacgggcctgcggacattgtttgaccgcccgccgggcggtaatacgccggaagaaaaggcagagcagatcggaagggaacagattttatggtcggtcgatccggaggactggaaatataaggacgcggatacggtatatgagcatgttatgggtggctggaacggcggcgttgtgcaggatggcgcggttgtcctgtcgcacgatatataccagtccacggtagacgcctacaggaagattattcctgcgctcaaggaaaagggctataaatttgtgacggtttcgcagatgatgcagatcgctgaaatcaggggagagcagatcccatacctgtttaaaaaagcgcctgcagttgcggaagctgcagaagccaaataaaaaagacttctatgggtttacaagcagaaaagggttatattatactgtatatattggtagcagtataaatggccgaaaggaaatgataatgaacaaaagaacaaaatggatgtgtatcgtattggcaggaatgatgtgcacggcgctggcagttggctgcagcacaggcacaccgcccgccacggctacgacaattacgtctagccaggacgcggcagagccaagcggatccgcttcggcaacgccgacggcaacagaaacacctgaaccgacgccttccccaacgccaacggtttcgacgaatttgaagcaattacaggcaaaggatggttacatgccgcccaagagccttgacgggatcgatccgttaaacgataaggtagtagcgcttacgtttgacgacggcccgggtccgtatacggaaaagctgctggatattttaaaggaaaacgacgttgtagcaaccttttttgtagtgggtaccaacgtagcggaatatccggatatcgttaagcgcgaatacgaagaaggtcatgagatcggcacgcatagctggaatcatgcggacctcaaaaagctctcgcttgacgagatcatgcaggaccagtacggaaaggcaaacgatgccatcgaagcggcgacgggccttcgggcactcatcgaccgtccgccgtacgggtctatgacggaggaattggcagagcagatcggcagggaacaggtcttatggtcggtcgatccccgggactgggatgcaaaaggcggatataaaaatgcggacagcgtatacgaccgtgtagtaaacggcagcgacgacggaggatatgtgaaagacggcggaattgtgctttcgcatgacatccacgaaacgacagtggatgcgtatgacaggatcatcaaagcgctgaaggacgaggggtataaatttgtgactgtgacgcagatgatgcagatcgcggaaatacgcggcaaggatgttcaataccgctttgcggatgcgccgacagccgcagaggcagcaaaagcttccgaatcgccggaaacgtcgggaagcgcggaataaagaggaaaagagaaagagcatggatcgtttgaaacagtccatgctctttttgtgtctctccggagcggagaaacacatttataggatagaaacgggaaagggggccttgcccgtttcatagggtgggggctttagtcatcctgcctgcgcaggagcttgatggatacgaaggtgagggctgccgccgctgcggcgataatcagccaaaccgatatatccgtaccgacatcgcctgttttgggcgtatcggaggttgacgttgcagtgtctgccgttgccggggcggtttcccacttcgcgtacagtgtacggctttcgtttacgtcatagaggtcgaagaaccagtagtttacgcattcgctctcctggtaccagccgcggaagatatatccttcacgcgtgggcggggtgggagccgtgatgcgcgatccggaaacgatatccgtgatcggggctacggcgctgccgccctgggagtcaaaggttaccgtaagcagcgtctgcgctacgggctgccattttgcatacagtgtcgtatggcctatgactacgtcgttgtcaaagtcccacggattgatggtttccgcttctttatgccagccctggaacgtgtgacctgcccgggcaggaggttccggttcggaaacagccgttcccgaggggatatcatggatcgaagagaccggactgccgccctgtgaatcaaagtcgagcgtatacagggagacaggatctacctcatcctcccattgcgcgtacagctccaggtccgccacgattgggaatgtctggcctgtcgtgtaggaagtgcctgttccattgtctgccgtattccagcctgtaaacgtcgctccggtcttggccatagtcccctgccccgcgatggtggccgtgtcgccgtcgtcgtaagtctcgacaagcgggacggttccaatatcgctgccgttgccatggtagaggatcgtatactctgtggccggcacaggcgtgttttcccattgcgcgtacagctccaggtttgccgtgatcgggaacgtctggcctgcggtataggaagtgcctgctccattgtctgccgtattccagcccgtaaacgtcgctccggtcttggccatagtccccggccccgcgatggtggctgtgtcgccgtcgtcgtaagtctcgacaggcgggacggtgccaatatcgctgccattgccgcggtaggtgatcgtatattctattgtaggagcatccgcccagtgcgcatacagcgtctggtctgtcgcggtcacgctgcccgttattttattgccgcctgtcggcgcatcgtaccagccctcaaaagttttgccggtgttcgtgggcaggtcgctcgtgagcaccgatacgctgccaccggggttcgtcacaaggaagtaccctgtggaggcggtatcgtccgcatagtatttcgatccatcgtatgtgagggaagcaagaccgctccactcgccgccgttggcatcgaatttcacaaacttgatctccatcgcgcctgcgtccgaatttgcgctgtcgcgcgtgaatccgcgtgcatccctgctgtagacgggcgcgcccgccgtattgtcggcaaagcctgtcacgccgtcgttaggcaggatcgtcacggtcgaaagcgttccggtatgaccggagcttgcctttccggcagctccatactgcgtgttgtttgcacgcggctgcggactcgtgccgaatacggaatccgccgtgacagatgcgtcgaccggcgtgccgttatcgtaacctacattgcctccgaggtccgttccgtcagggatatcgacgttgcgcgaggcgtagttattgcccccgttaccgccgttcccgacaaagatattgttttggaacgttgcggaaggccgtaccgccgcgttggcagagtcgatatgctggccgatcgcggctcccgcgccgtgcaaacttgcatagttgggcgcggtattgccgataaacgtattgtttttaaagtggccgaccgtatccagggagagctgcaccacgccgccgctgtccgccgcagccaaaaggtatttgctggctttgttcccatagaacgtattgtgcgtcaggttggagacggtcaggtcgttgcggctttccgcaaagtatgcgctgccgtcgtcctgcgcggtgttgccgatgaacgtgcaattatccacattgacggtcgctgccgcgccggtgtttgtgttgaatacgccgatcgcgccgccgtcgctgttcgcgttcttaccggaaacgccgttgccttcgaaataactgtagctgatgttcacggtgccgccgaattggtagaatccgatcgcgccgccgtagcgggacgccttgttgtccttaaagtaggagcgcgtcacattgatgctacgccctgaaccgccgaacgcaacgatcgcgccctggatataaccgccgtccagagtagacgcactgtttacaaaactcgaatcctctaccgtcaggttgcccgagctgtagatcgcgctgccgtgtccgcccaggttgttccgcacattttcaaacaatgtgtttttgacgaccacgttactgccgccggagatccctacgccgttcatatcgctgaaggtacaatcgtcgatcgtgaccgtcccgctgcttccgacaataccgtttcccgtaatattttgcagggtgctgcccgtaacgtccagcgtacctgcgccgccgcggacgcccgcgccgtttgtgacgccgtcgatcgtcgtatccgtaatgctgacgttgccgctgcctgcggcgactgccgtcgttgcaatacctgtgaatgtagaatccatgatgtccaaagtaccgctgcctgtgataccgtttgtcgccgtatcgacagttacattattgagcgtggcattggcgcccgatatggcgactgccgtgccgctgacattttgtattgtcatgtcggaaagcgtaacagagcttcctgtgaccgaaagcataccgccgcttccgcccgtaccgtccagtgtcatattctgcaaagtaatacgtcctgagccggtattattgaacgtaaacgcttttgtgccggtgggcgaagtaaaggccgcgccgccgccatcgataataatgctgttgttatgcgtaatattcatcgtgaccgatgcagggatcgtccctgcaaggacggggtccagacgaataatcttaccgtcaacttctgcctgttcgacagaatccctgaaatcgtcccaggttgtgactgtgacgtcagggccgacagcgagcgtcaaaggcgcgatctcaagcatgtccatctcttcctgccctgcggccgcgtcatttggcgcagagggcgacggactgggggaggcgggggaggctgacggcgcgctgctttccgcaggcgttgacgaagccgtcggctcctgctcttttgcggtggaaaaaggttccgattccggctcattctcctcctgctctgtagtcgctgtagcctcctcttgatgcccgattgtcgggtccgcaccggattcgctctgtgcgaatgcgggtgacaccatcatgccgagcacaaaaagtacggccaaggtaaaggtcaataacttatttatgtgcttcattctttaaaaaaaatctccttcgttttaaatttttaaacaatggtcatagcggcttgggaacttgtgattttcgtagtttcacaaagatctggaatccgcttggactttaattcatctatcatttcctgctggaacgacttaaaaaacttgtgtactaggcaataatccgtcgccccgcggctgcaataaccgtcatgctccaaacaacggttgatcatgatttcgccctcgattacttttactacatcgtaaagcgatatatcctctgcccgtttggcgagttgatagccgccgttgcagccctgcacggatttgaggagtcccgcctgctttaaatagccggtcaccttcatgaagtacaggtaactgatcccaagtttttcggacagactggctgccgttgagaggtggttgtcgtgctcatgtaagtaacatagaatacggatcgcataatctgttgcgcgctggaatttcatgtgtttttcctcctgttgggtcctaaatgtcatttctgacctaatgggtattttttttagctatataccgccgaaaatatcttcatatttagtataaacggcgtaaaatgcaaaaactggcctatagaaatgcaacacgcgcaaagtgtgacaaaggtgtgatacatttacggattgcggaatatatggataggaaggaagaattttactttatgggaaataatgctataatgaaaagaaaacacgcgcggagggctgctttgcaaaagctgaaattatatggattcaacaacctgacgaaaacgttgagctttaatatatatgatatttgttacgcaaacacggcaaaggacaggcagagttacattgaatatatcgatgaatattacaacgcggagcgcttgacgcgtattttaaaggatgtggcaggaaggatcggcgcacatgtcttaaatatcgcgcagcaggattatgatccgcagggggcttccgttactatgctgatcgccgaggaagagatgccttccaaaaagagcgtggtcgggcacctcgataaaagccatctcacagtacatacctatccggagagccatccgcagaacggcgtatgtacgtttcgcgtggacatcgacgtttcgacatgcggggaaatatcgccgctcaaaacgctggatatgctgatcggcagctttgattcggatatcataacgatggattaccgcgtgcgcggatttacgcggacggaagacggaaaaaagatatttatggatcacgatatgatgtcggtgcaggattttatccccaagcggatccttgaccgctaccggacatacgatgtgaacctttacgaggagcgcgtgttccatacaagcatgatgctcaaggaatacgaccttgataattaccttttcaacctggatgcggcggacctgaacgaaaagacgaagcacaggatcgagcggaacctggagcgggaaatgaaggagatattctatggcagaaattttgaatgatgaatggttctatgaatattttaccgaaaatgccaaattcggtatcaaaatcaaaaatcactttatcgatacgaagagtgaattccagaagatagatttttatgattcgtatgaatacggccgcttttttacgctggatgggtttatcatgctcacggagcgcgacgagtttatttaccatgaaatgctcgtacatgtgccgatggcggtgaggccggatatcaaacgtgtgctgatcatcggcggcggcgacggcggcgcagtacgcgaattggcgcgctatgcagggattgagcagatcgacatggtggagatcgacagggtggtggtcgagctttgcgcagagcacttaaagcagaccgcagcaaaattagacgacccgcgtatgcggctgcattttgaggacggcgcagcttttgtcaaaaatgcaccgtgcaaatacaaccttattttggtggattccactgacccgatcggcgtgggcgaaggacttttttcaaaagagttctacaaggattgttttgcggcgcttgatgaaaacgggatattgatcaaccagcatgaaagtccctattatgaaggcgacgcgctggaaatggaacgcgcgcacaaaaaattatcctcggtatttcctgtttgcaaggtataccaattccatatgccaacgtatgcgtcgggacattggctgttcggatttgcatccaagggattagaaccgcttgattttgacgaagatgcgtggaatgcgcttcatattgacacaaaatattacaatacggctcttcacaagggctgttttgcactgccaaattatgtgatagagcggctttcgaaggcaaggaaataacttcatagatttttaacaaattacctcttgccaaaataaaaattgtggtatagaataaaagcatatcttaaacaagttttaggatatgtcaatccccacccttttattatttttggaaaagccgattcgtaaggatcggcttttctcgtaaataaatgaattttggtgaaggaggataaagaatgaaaaccttgcttcatatgtgctgtgcgccgtgctcagtcgcgtgcatcaaaagcctgcgggaagaagatatagacgtcaccggattttggtacaatccgaatatccatccctatacggaatacaggagccggaaaacggcggcaatggaatatgcaaaggaaatcggtttaccgcttgtgatgacggacgaatacggactgaggacgtttgtcgcgcaggtgtcgccggattttgaaaacaggtgcggctattgctataaggtgcgtatggacgcggcggcaaagcatgcggcggaaaacggatttgacagcttcacgacgacgcttctcatcagcccgtaccaaaagcacgaggaaatctgcagtgcggcgctggccgcggcaaaagagcatggcgtggaattcctgtaccgcgatttccgtccgctttttcgcgaagggcaaaacgaggcgcgggagcgcggactttatatgcagaagtactgcgggtgtattttcagcgaagaggaccgctataaaaagaaaccgaagaaatagagttggcaaaacagtgtgaattacaacatataaacggtatggccggataaggctataccgtttttttatgtaacgcgcctttttaaagtaaactgtgtcattcacgtggcaaaagtgtcgttcacgatgttagcgacgcaaaacaaccctggtgtgatataaacatggataacaaaatatttaaagtatttaaggagaagaacatgaaaaaaatcacactcattatggtaacagtcgtactttgcgcggctatgctcgcaggctgcagcacacccgccgcggatacggactacatgtcttggacgggcacggaatggaacgcggcaacggacgcggaaaagtttacggcgacagaggcggtgctccttgcgatcggcgattccatcatggataactatacgcagcttgtggaaaccgcgaaaacagacgaaacagtgaaagcgcagatcgatgcgcaggtcacgtcgctgcagggaacgatcgatagatttttcgaaagctccccggcggctacgttaaatgatttggtcgaggcgagcaagcaggcggcagcaggcctggccggctaaacggcataaataaaaacggcaaacgaaacaagcggcatatccctgagcgaaaatgccgcttgttttgctatatttatgcatatagtgttttgaacattttttccttgttcctgacaagcaccaacaggatcacgatgtaaatcgcgcaggcgatataggtagacggcaggcgcccgacaagtaaaacgagataaggcgtgccgtataagagatacagccaaaaggtattgatgaggatagagcaaatcgtctgaatgaatataccccccaatattagcttaggagtggaatcgtttttcttgtaaaacaagaggccggcaagcaaaccatatatagccatggtaatcgtgaagccgggaaaataagcgccgggcagggatttgacgagcaataccaggaggtcggaggccgccccgacgatcgcgccgctcacaggacctaaaataatgcccgcaaacataacagcgacaggagcgaaggcaatcttgatatcttcactcaagtaaaaggaaaacatactgagtatcaccgcgattgcgataaacgtagcacaataaacaagacgcagcgttttcggagaaattttcgacataaaaatacccttcctttcgtaaaaaatggcacgcctctgcaaaagaaagagtcatggatattgcatttcttttgtgagcagcggacgcagttttgaaccgcaagaccaaaaagccttttcgttataaggcgacatcccatccttatacacttgacgcgcaaaacctactctgcacatttttatttaattttcttcagtataccactgcaggagccgcttggcaataccaaagcgtcagcgctttgcctttgctgaggtaaacctgtattgcgcgatcataccggcaatcgcaaaaatagcgacaggaatgaccatgatccatatgttcgcctgattaaagacgttgatcgaattgaaaacatcacgataattatccactgtgatgctgcctaaaagggcggtgttaaaacacaggccgatgagtgcgcctgccgtatgaatcagcgaataagcgccgtagatcgatgaaaaaatgatcacaaaatgtttgcgggatgcaaacgtcaggagaccgagcaggataaagaatgtaagcccgacaagaaaaagcggcaaactgtcaagcgaagaaaaccattccggaaaagagttgcgcaacaaatcaaaaatcatcaggccaatgataccgcctgtaatgaacatcgcgaatttgataaaaaagaatgcaaggaaagcgagcaaaaggccaacaccgattgcaatcagccataaccagttgccaaggtcgggaaaagccccgccgaggtaagtataggaataatatgcgcccataaaaaaggcatacaggaacatgatgactttcaggtaacggtaaccccagaagcaataaaggatggccaaagccagcgttacgactaaaatcagaatcgggatgatgccactcaaaatcgatttcctccgcattattttgataaatctattctagcccgttccatgaaaaaaagcaataaatcataaatttttaagaattgacgcgacaggacaaagagctttatgattgtgaaaagaaagacgattaaaattcaataaaaaaagcatgtttttccctgttgccatccgcatatttgtgatacaataggtaaggtattttggaatcaggggtcgcaattgggaggttacaaatggggcttacattcgcgggcggggttcatccgctcaaagcgttacatgaaggaaaaaaattagcggagaaccgtgcaatagaagagatgccggcaggggagattgtaaaaattcctttaagccagcatattggcgcgcccgcaaagccgatcgtagaagcggggcagcgcgtgctcatgggacaaaagatcggcgaggcgcaaggctttgtaagcgcgaacgtgcatgcaagcgtttcaggcattgtaaaggagatcacggaaataccggggctgaacggaaaaccggcgtctgcgatcgtgatcgaaaacgattttaaagatgagactgcctttacaccgctggaaaatgcggaagaattaaccaaagagcagatcatcgaaggcatcaaggaagcgggtaacgtcggtatgggcggcgcaacgtttccgacgcacgtcaagatttgccctccgccggataaaaaggtcaacttattgctgatcaacggtgcggaatgtgagccgttcttaacggcggattacaggctgatggtggaatgccccaagcggatcatctatggtgttaagcttttgatgcgcgcacttgaggtgaataaagcgattatcggcattgaggacaacaagccggaggcgatagaaaaaatgaccgcggcgatagatacgcatgcgatccgcgtggtgtccgttccgaccaaatatccgcaggggtctgaaaaacaactgatcaattcgatcacaggccgtatcgttccggcgggcggactcccgatggatgccggcgttgtggtcgtgaatattgcttcaacgaaggcgattgcggatgcgttttatacgggggaaccgcttctgcggcgcgtcgtgacggttacaggcgcggtgaataatcccaaaaacctattggtgcgtttcggcgtgagcgcgcgcgaagttttggattatgcgggcggcgtttcaagcgaaccgctgaaaattgtctcaggggggcctatgatgggcttgcccgttccaacgatggattgcgtcattaccaaaggcttttccggcctgcttgttttggataaaacgtacaccaaaaaagagaaagaaagcaattgtatcaagtgtggtaagtgcgcgcaggtatgcccgatgcgcctgatgcccatgatgatttcggcgtctgcgatgtttgaggatttcgaaaaagcagaaaaatacaatgcgcttgactgcatgagttgcggttgctgcagttatatttgtcctgccaaaaagccgatcgcgcagaacatcaagtttgccaaagatatgatcacggtaagcaagatgaaggaaaaagcgaagcaagaggcgcaaaagcgtgagggagcgcaggaataaaagagtttatacatcaattttaaaatataaaaaattttaagctgaagagcaggcatgctttttcggagcgccggcaggcgcgcttaaaaaagaaaggaaatgctatgcaacaggagttgattctatcaggctcgccgcatatcaagtcagggcagagcacgtctcggatcatgctggacgttattattgcactcatacccgcgtgtattgccgccgtgtacttttttggcgcaggttgtatcatgaccatggcgctgtgcatcggaagcgcggtcggctgcgaagcggcgatccagtatttcacaaaacgtgcggtgacgatcagcgatctttcagccgtggtaacagggcttttgctggcgctcaaccttccgccgaacgtgccgtggtacttgccggtatgcggatcggcgtttgcgatcattatcgtaaagcaatgtttcgggggactggggcataactttatgaaccctgcgctcgcggcacgctgctttttgctgatctcatggccggtcgcgatgacgacatttgtcgcgccctttgccggagtggacgcggtcgcttccgcaacgccgctcggggtgctgcatgagggggggacggcggttccgcctatcatggatatgtttatggggaaaatcggcggcagtatgggcgagacgagcgcgcttgcgcttctgatcggcggcgtttacctgcttgtacgcagggtgatttcgctacgtatcccgcttgcatacatggggacggtggcgctcataacgctgctcacggggcatccggagatgatcctctttgaattgtttgccggcggcctgatgctgggggcgttctttatggcgactgactatgtttcatccccgtcctcgccgaaggctcagatcatcttcgggatcggatgcggtgcgatcacgatgatcgtacggctgtggggcggttatccggaaggggtttccttctccatcctatttatgaacctcttgacgccgcttcttgataaggtattgaagccgaaaccgtttggggaggtgcaaaaagtcaatgagtaaaacaaaaaacgacagcatcttaaaccttaccctgcggctggtgatcatcacggtatgcgcaggccttatcttaggacttgtctacgggatcacaaaggggccgatcgcggagcaggagttgaaaaaggcaacggaagcacggcaaatggtgctgccgaaggcacaggaattcaagcaggttgcgctcgagggaatggactacgatcaggacagctttggggatatcaccgaagtatacgaagggatcgcagacggacaaaagatcgggtatacgtttgcgataacaacaaagggatataagccgggactcacgctgacgataggacttggtatggacggcaaggtggaaggcgtggagatcacgtcccacgatgaaacgccgggacttggcgccaacgcaacgaagccggagtttttagaacaatttatcggcagcgacggcccgattacggtcgggaagacgccaagcggggcggaaaacgaaatacaggcgctgacaggtgcgacaatcacaagcaaaggcgtggcaaacgcagtaaaccttgtgcgtgattttgcgtcgcagtacctcggggaaggggcgtgaggactatggataagaaacagatgaaaggcgtttttgtaaacggtatcttaaatgaaaatccaacgttccggctggtgctcggtatgtgcccgacgatcgcggtcaccacgtcggtgaccaatgccctgggaatgggcgcagcggttattttcgtactgatgtgctccaatatgctcatttcgttgctgcggaattttattccggagaaggtaaggattccttgctacgttgtggtcatcgcgatgtttgttacagtggtacagatggttatgaaggcgtttctgcccgcgcttgacgcatcgctgggaatatttattccgttgatcgttgtaaactgcatcatcctggcgcgcgcggaagcgtttgcagccaaaaacagcgtggtgccggccatgatcgacggcatcggcatgggcgtaggttttacctgctcgcttacgctgatcgctatggtgcgtgagcttttgggcgcgggctcgctgtttggcatttccgtgttcgggccggactatccgccggcgttgatgttcatcttagcgccgggcgggttcctcgtactcggattattgctggcactcattaataagatcgtgctgcagcgtgaaaaaacgaaaccgaagaaaaaggcggaagccgcagcaggggaggtgcttaaataatggatatgtttattcgtattctgacgatcctcctaagctcgatattggtcaacaacttcgtgctttcccgttttctcgggatatgcccgttcctgggcgtttccaagaaggtggaaacggcggtcggcatgggaatggcggtaacgttcgtcatggcgatggcttcgctcatcacatggctggtgcagtactatatccttgttccgctgggcgtcggatatatgcagaccattgcgtttattttggtcattgcggcgttggtgcagcttgtggaaatgattttgcagaaaacgagcccggggctttaccagagcctgggcgtatacctgccgctcattacgacaaactgtgcggtgcttggcgttgcgatcctgaatatcacagagaattataatcttgtagagtccctcgtgaacggcgtgggcggcgcgcttggctttacgctggcgatcgtgctttttgccggcatccgcgaacggctggagctttcggcgatccccaagcctttccggggattcccgatcgccctcataacggcgtcgctcatgagcgtagcgtttatgggattctcaggtttggtgtgaggtaaaagaaaactatgttagaaccgattatttggtcgatcatcgtactgggcgggctcggtgcggtgttcgggattatgctgggagtggcttccaaaaaatttgccgtggaaaaggacgaaacggctgttgccgtgcgtgaatacctaccgggggcaaattgcggcgggtgtgggttccccggctgcgatgggctggcggacgcgcttgcaaagggcaaagcagaaatcacggcttgtgcagtgttatcgcaggatcaggcgaaggagatcgccggcatcctcggcgtttctgtaggaaaaatgaaacctaaggtagcgcgcatcatgtgccttggaagcgaaggacactgcaggaataaatttgaatatgacggcgcgcaggactgccgcgcggcttatgcgatcgcaagcgggttcaaggcctgccggtttgcgtgccttggtcttgggacatgcgccaaagtatgtaagtttggtgcgatcacgatggggccggacggcattgcgtttattgacgaggacaaatgtacgggctgcggcaggtgcgtcgagcaatgcccgcagagttctattgcggtcattgagcgcgatatcgacgtgtatgtcgggtgtaccaataccgataagggaaaagcggtcatggaaaactgcacggcggggtgtatcgggtgcggaaaatgcgtgagcgtatgcccgttcggggcaattgaattggcggagggcttggcagtcattaatcctgacaaatgccgcagttgttggatgtgcgtggatacctgtccgcgcaaatgtatcctgaccacaaaatccgatatgctggcaaagatcaacgtgcaaaaatgcgtgggctgtacattgtgtgcgaaggcatgcccgtttggggcgattgaaggcgatttgaagcaaaagcacaaggtaataaccgacaaatgccgcggatgcgccttgtgcgtcgagtcctgtaagctgggcgctgtggagatgattaaaaaatgatcgtcctggcatcggcttcgccccgcaggaaagaacttttatcactgcttacgcaggattttgtggtggagccgagccatgcggatgaaacctgcgatatcaaagaagcatctgagttggtgcgctttctggcacgcaagaaagcggcagatgttttcgcgaaacgtccgggcgatgttgtgatcggcgcggatacggtcgtaaaggctccggatggggaaatttttggaaagcccaaagatactgctgatgcacgccggatgcttaagacgctttccggcaatacgcatacggtatataccggcgtgtgcgtgatgtatggcgataaaattttagaagatgtaagcggcagcgaggtacgctttgccgagatttcagaagcggagcttgcaaaatacttagagcgggaaagcgtaatggataaggcgggtgcctatgccgtgcagggcggcgcggcaaaatttgtcaaagggatcaacggttgttttttcaatatcgtcggtttgccggtttccatgctttatgaaatgcttacctcacttcatgttgtttaaacaggaaacaactaaataacgaaacagaaatacgctgcaactgggcgtattttttgcattcaggtacaggaaggtatgtggtatgaatatctatgggtatgcacgcgtttccacgaaggaccaaaatgaaacgaggcagcttatttcccttgcggcctttccggtggataaaaataatattttcttagataagctgagcgggaaagatttcaataggcctcagtacaagaagctgctgcgcaagttaaaaaaaggggatatcctggtcgtgcagtcaatcgacaggctgggaagggattatgaggaaatcataaaccaatggcgtatgatcaccaaagggaagcaggctaatatcgtagtgcaggatatgccgcttttagatacgcgaaaggggcgggacctcacgggaacgctcatcacggatatcgttttgcaattgctgtcgtacgtagcgcaggcagaacgtgagaatatcaaaaaaaggcaggcggaagggatcgccgcagcaaggcggagggggatccgtttgggccgtccgtgcaaaaaaataccgccggaatttgagacgatgcggtctttgtggaagcgcggggagatcagcggacgggaagccgcgcgcaggttgcaggtatcccacaacacgttttttcattggatacgtgcacaaaagagatgtttcgagtaaattttttcactttaaatgtcgattccgatttaaaaggtagacttttttagtcatttcatttatactatttttaataattcaatgatgctcattcacctgctttttgcaggaaaaactggaaaacctgccgagtcaaacagtgactaaaaaagtctacctttctgaccagacaggcattctgtaggttctggcaatggaccttgggcaagctatactggacgattaggagagaggtatgaacggataccaaaaagatgatctgctggatatgctcgcaaaacagacggattgtgcatatttatcggaattgagaaatcctgatttttatcctttgattgcaaatatcctggaatggatcgagccgaatgcatacagtctttcggaatggaaggaagcgatctcttatattacagggagcagggaagaagtaagggaggcggcgcaggcgcgtgatgtgctgcttcaaaaagtaaaagaggcgaagaccgttcatgccaaataatggtttcaatgctctgtgcagatgacaggtatctcttgcaggggcaagtaaaagggagacaatctcaaagattgtctccctttatttatttcttatttttacgataccttgcaggcgttataccgaaagtctttttaaaagcgcgatggaaattgctgagatcgtggaaccctgagttttctgcaacttcctgtatggtaagcgtattgtttttcagcagtgcgcacgcttttttcagacgtgtttgcaaaaggaggtcgttaaaggaacggcctgtgcttttcttgacgatacgctggagctggctttcgctgtaatggaactgctgcgcgacgccggacaaggaagcggtcttgtaatggtcgagaatatgattgagtacatcgagtgtatcgccggatgtctggtcgctgccgctgaatgcaaaatcgttcaggtggaatctcagaagccgtacgcacagccattcgaactggatgtttaacaggcgtgcggaataatcgtcgcggctcaggctgtccaaatacatctggtaaatccagtcccgcagcttactatcgtctgctgtcttgaaatgaagataggaaccctgctttttttcatagatgacatgggcgaagaaggtagagagcaggtcgttatgcttaaggagcgataaaaatacggtatcgaaggtcgattgccgcgcgatgatgtggaacacgatgcaatcgtcttcgaagatatccatgcggtgccaagtccccggcgcgtgcaggaagaggtcaccctcgtccatctcgtatgcgctgtccccgatgtattccgtgcaattcccttggtaaacatacacaaattcgataaattcatggctgtggcttttgacaggcatgtaacgggggtggagctggatgcttacatccgcgccttccggaatcatcgtgtcctcgttgaagcggctgaccgcatctgaaaactcggcgtataaggtcgttttgtcttcgcggaacgcccgcacgtcaaagtcctgtatcttctcgaccgaagaggcggaggaaagcagggggttaaggtcgagtccctgttgataaaaatatttacatagctgttcgtttggcgaaagggaaatcttaatcatatactaaatataccacaaaacttgcgccaatatgcaatatttcatgttgtgatcttctggtaccataaaatcaagagaataataaaggaggctttttcaatgatcagaaaagcagaagaaatgaaactgaacgttaagccggtgttcatcgcactggtacacaaatacttttatgaaggcccatgccggtttggtaagggggatgcgctccagcccggatatgacgagatcatggaacgcgagatgtataaacagtttcaggaggacgtgaaaaaacacatgccgcaggaggtcaatatcctggagcctgtgtatgtggaacgctatgacgactggaaccaggaagaagatatgtacgaaaagatcatggaggacaacgagaaaacggacatctatcttttcaggacgtatatcggacggaacgagatcgtgttggaaatcgcgcagcgctccaaaaaacccataaccgttgtgccgacagcctgctgcgaagtgctggctctttccgccgcgctttcgagcagggaactggaattttacgccgcgcgtacatggccggagcttgcgaccgacctaaaagccttgcgcctgcggaaagtccttgcaaatacaagtgtgcttttgagctcgcgttttaattcgacaatgtcattttcgagcgtggacacgttccgttcattagaggaagtgacggagaagctgggcgtacggttccgctacaaaaacatccatgagctcttagaccagatgtctccggcacgggaaggcggtaatccgacgacgcccggaagggaaacgcccgatttaacagacgaagacatggcggaagtgaaccgtctcgcggacgaaatgatgcgcgatgcaaaagaggtgcatgtggacaggaagttccttgttaattcactcatcgcatacgtgactgtcaaaaagaacctggatatggcggattgcaacgcatttaccgttccctgtccggatgtatgctccacgcgcaggatcaacgagcagcagtttacgttctgtatgacgcattccctcttaaacgagcaaggcattccgtcggcatgcgaatatgatatcaacgcgctgctttctatgatgctgttgacgggcgtgtcgcacaaggcgccttatatgggaaattgcgtacccctgcccatggaaaacgggaagctcaaccaggatgcgatcgaaagctcgttctttgtgcatgaagaagacctcgatttcatcaaggaccataacgacctgtatgtgatcgagcattccgtccccaaccgcaaattaaaggggcttaacggacagcaggccgattttgccgttcgccattttgcatatgagcaaggattcggcgcggtgctgcggtatgatttccgcaaggacgtcgaccaagtaattacgatggcgcgtttttcaccggacgtgaaaaagctgtttgtaggtaaggggaccattgtaggcggcggcggttacgactatgacaactgcaatacggcggtattctttaagccggaagaccagaagactttttacgatgcgcagaaatatgtgggcaatcacatgccgctcgtctacggggactatagggaagaattaaaacgcctgggcgaaatcctcgggcttgaagtgatcgaagcgtaaggaaatggataaacagatcaagaagcggctcttgcagtcgaaaaaagctgcggctgagcaggctgcggccatactggcggacaagggactgacacaaccgtcgctgaagcagcgcttgaaacaatatttgtgctgtaagtttatgctggaaaacggggagtgcgtttccgataatatcgacgagctttcgaaggcgagtattgccaaaagcctgaaactcagcaaggaattgctgaaggaagtggacatagcgacgagctgcgagggcgcgacgtccgcaaccatcaagaaggtgctgttttttatggcggtgcagagggagttaaatatccggctgaaaccggatgagatcgctggggtcgaaacggtaagtgatctttgcaatattgtatttccggtacttcaaaaacggtgagcagaacaaggagcaggaaaaatgtttgatattgccgcatgcaggaaagattttccggtgctcagcaaaactgtatacggaaagccgctcgtttatcttgacaacgcggccacaacgcaagtgcccgggcaggtgctggatgctttgcgcgcgcattacgagcaggagcacgcgaacgtgcatcgcggtatccactatttaagcgagcgttctacgcaaaggatggaggaggcgcgggcagttgtgcagcgtttcctcggcgcgcagcatttagaagagatcgtttttacgcagggcacgacagacggaattaaccttgtggccggaggattcgcacaagatatttgcgaagacgatgagatcgtggtatccgcactggagcaccattccaactttgtgccgtggcagcagctctgcactcgcaacaaagcgaggctgtgcgtgattcctgcgccggacggggaggtcgatttagaagcgtatgcggctttgcttaaagataggacaaagctggttgcgctgacgcaggtctccaacctgacaggcagcgtgctgccgcttcggaaaatgatcgcgctggcgcatgaaaaagggattccggtgctcattgacggcgcgcaggggatccggcatgagcagacagatgtattcgagcttgattgtgatttttactgtttttcagggcataagatgctttcccccaccggcatcggcgttctgtacggcaaaacaaaatggcttgagaggctggctcccgtccgctttggcggcggaatggtggacgttgtaacgcgggaatacacgacatttgccccgcttccggcgcggctggaagcgggtacgcccaactttgccggagcgatcgcactggcgcaggcggtccgttatgtggaagaaacaggccgcatggacattgcggacagggaaagcaagctgctcgcttatgcggagcaaagactgcaaagcatcgacggattgcacatcctcgggcatccgcgcaaaaggagcggggcgttgtcgttttggatggaggacgtgcattcctacgaccttgcaagcatgctcgataaaatggggatcgcggtgcgctcgggcagccattgcgcgcaggtcgcactgcgggaattctcccttacggaagccacgcgcgtttcccctgcgttctacaataccatggaggaaatcgacgcgctgtgcgcgggcattgtgcgcagcgcggaaatgctgcgtaaatggaggaacaggaaatgacgatccgaaagcaggagcaggagtttatcaacgatttcaatgagcttaatgactggtttttgcaatacgaatacctgatcgaactcacgtgcggaatgcacgagttggaagcggaaaaaaggacggagcagacgcgtgttgccggctgccagtcgggcgtatggctggggcttgaaaacacaggcggggttatttccgtcaaggcttacagtgaagcgctcatcataaagggaatgctggcggtgatcgtctcgctgctgtcggggcgcagcgcacaggagatcatggcatacgaaatgcgttttgtagacgaaacgccgctcagggaacaaatgtcgacagaccgcttcaagggaatgtcggccgtggtggataccatcaaggcgtttgcaaaacagtgtatcaaaaaaggataacggcgattggacttttcaggcgggctttccggtttttgcgggaagtccgtttgaattttgcggtaaaaggaagcgggtcaaatgttacaaaaagtttacttatttcatgacaattggcatgtggttgtgatataatctatagaaagtcggcgcccggcgccagaaatgattggaaggtagctatttcgtgggtttttttagaaataaaccgcttgttgttacgattatcatagtagtgatactgatcatattgatggctgtgacaagctcgtcaggcacgtccgcaaccagtgcgaatgtggttgggggcgcgtttgttcccgtacagaaattcttttaccaggtttcggattcggtaggcgagtttttcgacaatgtttttaacagcggcgacgcgatcagcgagaaacaaaggctggacgaggaactggcaacggtcaaagggcagatgaacgattatgacgaactgaaggcgcagaacgatcgactgaaggaaatgcttgattataaacagaaaaatacatcgcaagagcttaaggtcgctacgatcatcggcaaaaaccccggcaactggttcgacgtatttacgatcgatctgggaatcaatgacgggatcgaaaaaaatatgccggtcatcacggcggacggccttgtagggcgcgtggaagaagtgggtcttaactgggcgaaggtcatggcggtgatcgacggcaggagcaacgtgccggctatcatggaacgcacacgggaatacggcgttgtaaaaggcagcatttcacaggactcgctggacgcttcgctctatatgaattacctgccgctggattccgacgtggtggaaggcgataaggtgctgacttcggggctggatgggatatatcccaaaggactgcttgtcggcacggtggaaagcacatcacaggccggctcaaccggcgtcaatgtaaagatcaaatcgtctgttgattttcgcaggctggaagaagtattcgtagtagtggctgttgacggagaggcaatgggaggaaataatgcaaacgaggtgacggggaacaattccgatgttcctgagcccagtattacgccgcagccggacacaagccagagtccggacgcaacggataccggacaggggtgatagcgtatgaggtatgttgtacttacaataatgggtgtattcagcgttattttttccggttcgctgctgcgtgatctaagtattgcggggataccgatgcaaatagatcttttgctgctgattgccttgagccttgcggttgcggaaaaaagcagtatgcccattatattcgcggcggcatccggactgcttatggatatcatgtattccacagtgctgggaacgtatgcgttttgctatacggtgacaacggcgctggtcgtaatgtttttccgcaggacgggacgtttcaacgtgctttacttgtttgtggtgggagcaggcggctatattgtaaaagaactgctgacggcgcttttggtgtttatacagagcgcgcgtttctctatgcctgtaatgctggtatacaatatcctgccatccgcgcttcttaccggggtgctgatgtttgcggcatattatttgatcgcgaagctgatgaaaaacaactggatgcgcctaagggcatcctatcgtttcgacgatatttaagaggaccgttttataagaggaaaaaatgttaaaaaagttaaagaatagatttttgataagttttacagtgattgcgttgttgttcgttatgctgatggtaggcctcggaaacctgacgcttgtacagggcgatacgctcgcaacacagtcggaagataaaaaggtgcgtacgatcgcgctgaaaggcgcgcgcggccagatcaccgacgcgacagggatcccgctcgcatacgaccagagcagctacgacattcaattcacaaaggacccgtccagaaatacgacgacagacaaagcatattatacggatgtgctgatccgcgcgatcgcgctcattgaagaaaacggcgggagcacgatcgacacgtttgcgatcaaacggagcgatgacggcacgtttgcgtttgatttcggcatcacggatgcggatgctatagaaacacgcgaaaaagactggcgcaaaaacatgttcgtttcaacaaccgccgaaccagacgttatttatcgcgacctgcgcagccgttaccgtattcccgaagaatatacctatgagcaggcgcgtaagctgctttccatctggcaggaggtgcagttatcttcttatatcgcttatgtgccggttacgatctgcgaaaatgttgacatgaacctggtctctgttttggaaggacattcggatgacctcgatgggatcgagatcgccgaaagcgcgacgcgcgtctatcccaaagacgacgtaatggcggttttgcttggctatatgggcaaaatgaacgatgcagataccgtggccgaataccggaaaaaaggctattcttcagaagacctgatcggtcagacaggacttgaaagcacgatggagcaatatctgacgggaaattccacagataagcagggaagccgccaggtcgaggtcaacagcaagggtaaggtaatccaggagctttcctatacgccgcccaagcaagggtacgacgtgcgtctgaccatcgatttgcaaatgcagatggcggctgaaaaggcgatcaaggaaaacgtggaagaggtttatcagaagcaatacgatatgtattacaaccccacgacggaggaacaggctaaaaagcgtgagtcgtatgacgaagagcttgacaagcgcaccttgaaagagggacaggaaacgaattttgacaagctcaacctggcaaaatcaggcgcgctgatcgttatggacgtaaagacaggaaatgtccttgcgatggccaactatccgtcgtatgacgcgaacttatttacgaacggcatttcgacggaagccatgcaggaattgaacgatgatccgggcacgccgctctttaataaagcgatctcctcgaaggggatcccggggtctatcttcaagatggttaccggcatgggcggtctgatggaaggcgcaattacgctcgatacgaccatctcttgccaaaagcaatatacgaaatatgtagaagaaaattatatcgggcatgtcccgtcgtgctggatcagcgagtataatctggaaaagcatgcgaatctggatatagaatatgcgctggcgcagagctgcaactattttttctatacggtcgcggataatatggggattgacaacgttgtgaagtggggcgagaatttcggcctgacgaagccgacaaatattgagctcacaggcgaggcagtcggtcagatcggtaaccaggacgtgctttacgatccgacaaagcctttaaacgaacaaaaaacatccctgccggcactggtgcgttcgcagatcatgggatatctggaaaaatacggcgaagaattgggcgtaacgtacaccgaaaagcagatcacggatacgacggacaagctgatgcagcttgtggcgcctgtccttgcggaggagggcaatgtaaagctgggcgaacagatcaggacggtattgtttgaagagttggatattacatccaggacctccgcaaaccgcggatgggacaacgatatcaaccaatccctgatgcagcttaaatggaacccgaacgagacgattacagcgggtattgggacgaactttacaaccataacgccgatcgcagtcgcgcgctatgtatcctcgctcgtgaacggcggcacagtttataatgcgcatatcgtggacagcgttgtggatcaggatggcaatgtaatcgagcaggtgcagccggaggtatataaccagatcgatgcgccggacgaatattttaccgcgatcaaaaagggtatgaaggacgtggtaagcgatgatgaattcggcggcgcaagggacgcgttcaagaacgacgacggtacggactggaaataccttgacgatatcggcggcaagacgggtacgggacaggtttcggaagtggagttggaaaacaacgcatggtttgttgcctttgcgccgtacgacgatccccagatcgcggtggtttcgtatattccgaacggatattcgggcgcaagcgcggcgccggcggcccgtaacatccttgaatattatctggatgggaaagcggcggcggaaacaccgaagacggaatcggtaccggcagaaaatcagatcgtgctttaaaagatttgctatgatatatattatcatgtataatatatgacgtgatagtagggtgaaaaaggctttcccattagggtggcacggaggttaacaatgcagaatatcgtgacaatcaaaggcaaagaagacggcttggaaatctatatggatgaaaagtctacttaccctgtgctgcgtgaagaactcatggtaaagctcaaaaaaaacaaggagtttttccgtgacagcgatacaaaagtcgtgatcaggggaaagaagatatccgatgcgcagcgcaaggaaatcaagcgcgtgtttgcaatggattttgggatccgcgatgtgctcttcggggacgaggctgacatgatgcgtgaggtggagctgaaaatcgagagtccagctgtgcaaaaaggcggcggtaaaaagcaaaaggacgagtacctcgacgaggtggatttggtttcaaattcttactttgacgcaaagtctatctttatcaataacacgatacgctcagggcagagggtagagtgcgaaggcgacatcgtcgtgatcggggatgtaaaccccggcgcagaagtgatcgcgggcggcagtatcgcggtcttcggcaaattacgcgggctcgcccatgcgggatgcgcgggaaggacggacgtgtgcgtggcggcgctcaatatgtgtcccaagcagcttcggctttccggcagggtagtcactttcccgaatgagcgtgaagaggtcaacgacgcggagatcgcggagcttcacgacggcaaggtagtcattcgcccggcaagcgtcagataggcatttaaaatcggaagtatcatatataaaggaaaggtatcataactgatggaaaacgtgattgtcattacatccggtaaaggcggcgtggggaaaacaacctctacggcaaaccttgggaccggccttgcgatgcagggaaaaaaagtcgtactggtagatacggatatcggtctgagaaatctggatgttgtgctgggccttgaaaaccggatcgtatatgatttggtggatgtggttgaaggtacgtgcaaattaaagcaggcgctcatcaaagataaacgttatgagggattgtatctcttgccggcggcacagaccaggaataaaatggccgtgacgcccgaacagatgaaagaactgatcgcagaacttgaaaaagaatttgactatgtgttgatcgattgcccggccgggattgagcgtggttttaaaaacgcagtagcgggcgcaaaatccgcgatcgttgtgactgtgccggaggtttcgtccgtacgcgacgcggaccgtatcatcggcttgttatccgcaagcggtgtggatgacgcgcggcttttgatcaaccgcctgcgtcccgatcttgtacgcaagggcgatatgctggcgatcgacgatacgctggaaatcctggggattgacctcattggcgtgataccggaagacgagatgattttccgttcctccaacctgggcgagcctgcggtaacggataatagttcgctggcgggcgaagcgtaccgcaacgtgacaaagcgtatcatgggagaggacgttccgatgctcgacctggagcaaaaatctggtttctttggcaaactgaagagactcttctcgaaataacggaggggttttaatatgggatggttttttaatcgaaaaaagagcagtcaggttgcaaaggacaggctgaagctggttctgatctacgaccgcgcgggaacgacgtccaacgacgatatgatcgacatgatcaaaaaggacatcatgcaggtgatctccaaatatgtggagatcgacgaatcggaatttgccattgacttcaaaagcgtgcccagcgaggaggaagaaggcatttcctcgcagctcgcaatgaatattccgatcaagaagatcaagcaaatggtaaaaaacagcggcaggtaagcagctgcttgcagaatcaatattgagaccaaaaaagcccgcgcctgcgtgcgcgggctttttgtaaaacaaaggggaaatatgaaaggttctatcatcaataaaaacatgtggaagtttgtggactggctgctggtggtgatcattttcatcctggtgggatacagcctgctttccatcgccaacgtaacggcaagcccgtttaccggagacgaacagggaatcagggagtttatcgcaaacctggatttaagctccatcctctggcaggtattgttttttgcgatagggcttgggctgatgtttcttactatgctggtcgattaccatacgctggggcatttgacggactggatctattgggcttcgatcgcattgcttgtcgcagtcgtggccttcggaagtaagcagaacggcacggtcggttggtttatgatcggcagcagggggttccagccgggcgagctttgtaagataccgattatcgtggtattggccaaggtgctttcggacaggacggaggggcacgaaaacggaatacagaccttcaaggatgtactgcccgcgctgtggcggctggcaataccggttgtgcttatcgcgatgcagccggacatggggacggcgatcgtatatgtcgttgcctttgccgtcatgctgtttatggcaaaagcgaactggaaggtttggctgatcttgatcggtatcgtggtggcggtcttgggcgtctatgtgatctatctttcgcagcatccggacaattatatgtggaagcgtctccttgcgttcttcaaacccgaatcggaagtggtgcaggcagccgacgccgatatgcagatggtccaggcaaagctggcgatcgggtcgggcggatttctgggaaagggcctgttcacgcccggatcactgtcgcagttaggatatgtattggaagggcaaaacgacttcatctttgccgtaacggtggaggcctttggttttctcggcggactgatactgatcattttgtactttctgctgatctcccgcacattcatgcttgcgctgcgcgcgaaggacgactttggggcgtatatcattattggcgtagcggcgatgacgctgtttcatgtggtggagaatattggtatgaacatcgggctgctgcctgtcacgggtattcccctgccatttttctcatcaggcggatcgagcatgatcatgaattgtatcgcattcggcatggttttgagcgtcgatatgcgcaggcagcgatggcagggacaatagataggagttattgattgaatttactggataaggtggaaaaacctgcacgctacgtcggcggggagctgaacagcgtcgtaaaagaccccaaagaagtcgaagtgaattttgcgctctgttttgccgatacttatgaagtaggcatgagccacatggggcttaatattttgtacgaggtgctgaacgctattccgaacgtatatgcgcaacgggctttttgcccgtgggtcgatatgatggccgcgatgcgcgaaacaggagagccgctgcgttcgctggaaacgggaaagccgctctgtgattttgatattgtaggcatcaacctgtcttacgagatgtgttattcgaatgtgctcgcgatgctcgatttggggaaaatccccctgcttgcacgggaccgcggcaacagcgatccgctcgtcgtgggcggcggggcatgcgtgatcaatccggagccggtcgcggatttttttgatttgtttgtgattggggaaggcgaacaggccgttcgtgagttatgtgcgctatacggcgagcataaaaaacagggatttgcacgggaagcgtttttaaaggaagcggcgcagctccaagggatttatgtgccggctttttatgatgtggaatataacagcgacggcacgatcgccgatatgataccgctctgcggtgctccggcaatcgtcaaaaaacgcgtgatcgatgattttgacagggaacagacggtgcaaaagccggttttgccatatatcaataccgtgcacgatcgctgcgtactggagatcatgcgcggatgtccgcgcgggtgccggttttgccaggcgggattcgccatgcgtccggtacgcgaacggaaggcggacacggtgcgtgaaaatgcgcgcagggtcatcgcggcgacaggatatgatgagatatcgctgtcctcattatcttccggcgattattcgcagatcgacgagctggtgggcgggctgatacaagaattttcggcacagcgcgtatccgtttctatgccgtcgctgcgtgtggacagctttgataaggattttgcgaatcaattgcagcaggtgcggaaaacggggctcacattcgcgccagaggcaggaacgcagcgcctgcgggatgtgatcaataaaaatatcaggcatgaggaaatcatccgtacggtgacgcgggcattcgaatcgggcgtcaatacggtcaagctgtattttatgatcggattgccgactgagacatatgaagaccttgacgggattgcaggcctggtgcgtgagatccgcgaggcgtactatgccgtgcccaaggaagcgcggcgcggcgcggtgggaattacggtttcggcttcgtgttttgtgcctaagccatgtaccccctttatgtgggaagcgatggacgatatcgaaacactgaagcaaaagcaacaatacttaagggaaaagctaaaaataaaaggtgtgaaatttaattaccacgatgcatacttgagctttttggaaggcgtgcttgcgcgcggggatcggaaactcgcggcggtattgctcgaggcatataaaaatggagctgcctttgacgcatggcatgagcattttttgtttgaacgttatatggatgcgtttgaaaaatatgggatcaatccggcattttatgcctgccgcaaaagggacgaaagtgagatcatgccttttgcgcatatcgactttgggatcgatcaggcatttttaaaacgggagcgcgcaaaggcatatgaggaacaaacgacgccggaatgcaggatacagtgctctgcgtgcggattgcagaaaacatgcggatttgtgcaggaaaagctatgagtgaagaaatcaaaaaacataagatgatcatcaaatacagccgcgacggtgcggcgaaatatatttcgcatctcgatatgcagcgcgcttttgggcgcgcggtcaggcgggcgcagcttcctgcggaatattcgcaggggttcaatccgcatatcgtaatgtcctttgcttcgccgctttcggtggggtatgcgaccaagggagattatttggagatcagcctggaaaagccagcggacccccttgcggtaaaggaggcgctcgacgccgtaatgccgcgtgatatccgtattctcgatgtgcacgaggcgaaagagcatgcgaaaaaactgatggcgcagaattacagcgcacgttatttgatatattttcattttgaaaatgaggaagaatatggtaaaataatagctgcggcggatgccatgatggcatccgatacatatccggcgacagacaggcgcggcagacagctcgatatccgtccgcttatccttgaactggagagcgcgggaaaagacggaatttcagtgatgttaaaaaacgggtcggatggcgcgctgaatcctgcggtggtggcgatggcgctatgtgctgcagggaatacagaagcggaatatgaaatctgcagggaagattgctttgctttggataacggcgaaatgaagccgtttagcataatatagttttgaaatttttatagtttaaggagtttttttgaatgatcaaaaaaatcatagccgacgcgaacacgcatgaagcgcgggtcgctttactggaggataacgatttagtcgagatccttgttgagatgcgcggcaaagaacgcttagtcggtaatatttataaaggaagggtcgcgaatatccttcccgggatgcaggcggcgtttgtggacgtgggcctcgacaaaaacgcatttttgtatgcaggtgatatcctgtgcgatgaatcggattttatattcgagggtgtgcaggacagcactaatgtcaaaaagaagctggaagtcccgaatatcaaggagcttttgaagcccagccaggaaattatggtgcaggtgttaaagcagccgggcggcagcaagggcgcgcgcgtgacgacgcatatcacgctccccggaaggctgcttgttttaatgcctaccgtagaccatgtaggcgtttcgcgcaggattgaggacgaacagaaacgtgaacagctaaaagaatatatttcagaaattaagccggccaatatgggcgttattgtgcgtacggtggcggagcaggcgacggatgaggaagtggcttccgaattgcatttcctggtacgcctgtggcagaaggtacaggagaaatctgactttgtgaccgcgccgcgcctgatccacgcagaggaaaccctgttgtttcgtacggtacgcgacatgttcacgtcggacgtacaggaatttatcatcaatgacaaggattattatgaaaaggtcatggcggtggtgaacattttgtcgccgggtatgatggacaggctaaagctatttgaagagaagggcaatatttttgattattataatatagaagataaaattgccaaggcattgcagcgcaaggtgtggctgaaaaacggatgttacctcgtgatcgatgagacggaagcgctcacggtcattgacgtgaatacaggcaaatatatcggcgaggataatctgcaggatacgatcctcaatgcgaatatcgaggcggcgcatgaaattgcacggcagcttcggcttagagatctaagcggcattatcgtaatcgatttcatcgatatggaggacgacgggaacaagcaaaaggtagtggatgcgctgaatgaagcgctaaaacatgaccgtacgaaatcaaacgttcttgggatgacggagcttgggctggtagagatgacgcgcaagaagacgcggcgcaaattatccgcgctgacacagaccacatgcccgtgctgcggcggaagcgggaaagtttataatcttgataatatggcgatgcgcgtgcggcgcgagatcatccgtaccgtagaggatgatgcgcacgggatgttcatcgtggagacgagcgaagcgctggcggaatatattgtggcgcataataaccagaaccaggcgatcttgccgcactatgaaaatgcgcatttttttatccgcagcgtcaaaaatgcacatccggaatatattgcggtggcacaggtaacggacaaaagcgcgctttcgggaacgcaggttttttgttgacatggcgcttttagtgtgataacatatttaactgagccgctcgcataggcatgaaacgcgcaggcgattcgtttgcgggccaaacgcggcgagactgggtaagggaggtaaagcgttatgtatgcaattatcaggtcaggcggaaagcaatataaagttgagccgggcatggttatcaaagtggaaaagctggatgccgaggtaggcagcgaggtagcttttgaagcgatgatgacgtccgacggcaaaaaagttgctctcggcgatcctattctgaaagatgttgcggtcaaaggcaaggtgcttgcacaggacaaagagaaaaaagtcattgtgttcaagtataagcccaaaaaagattaccgcaaaaagcagggacacagacagccgtttacaaaagtagaaattacgcaggttggcgacgaaaaggttgctgccgcaaagccggcaaaaactgccaatgcgaaagcggagactgctgaaaaggccgctgcaaaaccggccagcaaagctgctgcgccgaaggctgtagacaaagcgaaggcaacgccggctaagaaaacggcaactgctgaaaaggctacagagaagaagcctgctgcgacaaaaactgctgcaaagaagcccgctgcaaaagctgctgcggacaaagcgaaggcagcgtcggctaaaaaaacggcaactgctgaaaaagctgctgcggaaaagaaagcgccggctaaaaagcctgctgcaaaagctgcggatgataaaaaggctgagtaacccaggagtaaacgtacaaagcgaggtgtgaataaatggcacataagaaaggtgtaggtagttcgagaaacggacgtgattccgaatccaaacgcttaggcgtcaagcgcgcagacgggcagtatgtcctcgcgggtaatatcctcgtgcgtcaaagaggcacgaagatccatccgggcaacaatgttggccgtggcggtgacgacacactgtttgctcttacaagcggtatcgtgaaattcgaacgcaagggaagagataaaaagcaggtaagcgtttacgcgaactaatcaagacattgaaaacagcattgcccagggcgatgctgttttttgttatccccgggcagccgtttctccgttttcgccgtatgggaagtgggtattaacatagcatggaagagacggggaagaatgtaaataatactctgaaacaaaatttagggaagattttcggcggcattgttggcaggagccttcttgtgggtacgcttgcgggtgcggttacggtagcgttccgcgtgagcgtgacgcaggtgttttccgtcgcccaaaaattgatcctccttgcccatgcgcaggtcccgatgatgattttgtggtttggagtcatactattggcggcatttgccgtcgcgcgtttcttgaaatgggaaccgatgatttccggaagcggaattccgcagatggaaggagaactcaaaggtgttttctcgcaaaatcctcttaaggtactcgttgccaagtttgcaggcggtttgctctcgctggggatgggactgtctttaggacgcgaaggcccgtgcatacaaatgggcgcggtcgtgggcaaaggactttcaaaacgcggcgacgacgagcaaaaaaagctgcttatgacgggcggcggcgcggcgggactcgctgcggcgtttggcgcgccgcttgccggaatattgtttgcgcttgaagaagtgcataaaagtttttccgcaaggatacttttcacatcgatcgcggcatgcgctgccgcaggcgtggtgacccgccttttgttgggacctgcgccgattttttcaatttccttatcgcgggacataccgcttacaggatacccgctgcttgtgctgttggggattcttttgggagcgttgggcgcattttataattttgcaatacaaaagatgcagaatacgtatgaaaggatgaaaaaaatacctgcgccataccgtgtggtcctgccctttattgcggcggggatactggcatttgttttgcctgagatactcgggggaggcgttcctttggtagggcaaatgacgggcggaaattatgcggtcatggcagtgctgcttttgctggcaaccaaatttgctttttcggtattcagtttttcttccggcgtgcccgggggaatattaatgcctatgatcgtaatgggcgcgcttgtcggaaatgcgttcggccttatgggaacgcaggtgtttgggctgccgtccgcgcttacacagaattttatgatcttcgcgatggcgggacttttcggcgcgatcgtacgtgcgccgcttacgggcatcgtgcttgtctgcgagatgacaggggcctataatcaattcctgccgcttattattacgacgctttcagcctgcctcatggcacgtcttttgcgtgcaaaacccgtttacgatcagcttctggaccacgatatatccaggttttcaaaccgcaaaacagcatagtatgggggcggggaagtgttgactatccgcccaaaaaaatatatcataaagagtacaccttactattatggggaaatatgccttgtgcatagcaaagaaggtttgaaagtggcggaaaaaacagaggaaaaatacgaaaaattatggtgcatgctggcatgccttggggcgggcgtcgccctgatggcgctgggcgtccttaccaattggatcattctcattctggtttcgttgtttgtgcctatggcattcgtgatcgcgggcgcgcgcggcggacaggggatgggcatactgagcgtactgatcggcggagtgctggtacttttgtttgcaggagtgaatatagccctgatcatgacagtgtgctgcctgccgatcgttatcgtcatgacatacgtcattcggaagcgcctgccgctttattacagtacgctgatttcatgcgtggcgcttttggcttccctggggctgcttattttgctgacacagttattatatcgtaccgatttgatgacgttgcttttagggaatatcgaagtgtttttgaatgcaaatcctgagtttgccaagctttattatacgatgtacaatgcgctgcttaacgggacctcgtccctggatattacggcggctatgaatacaccgctcgacgtggcggtttcagggctcatgcaaacctttacagtgcagcttgcaacgctggttccacaggctgcgatgttctgcgtcgctttgttcggactgcttaactacgtcattccgcgcgcgatcgtaaaaaaacagggcgtggccgtaggaaaggtcccgtcgttttctaacctggcgcttcccgcaaaatacggaacgtggtcgctggtcgcattggtgatcgcatttttaggcgtccttatggagtggcgcaacttcaaccttgtttatgctatcattatgggatttttcagcatcacgtacatgatacagggaatggcgtttaccgactggctgctcaagaagaaaatgacctccgcttcgggtcggatcgcgattattattgtgatttttcttatcctgcagttgtttggactcaatttgtttatgtggatcggattcatggagcaggtcgttaagttccggaaaaggcaatgggtaacgcggggataacatgtaatgaaagaaaagacaaagatcagctatgtttcaagtgaattggtgatctttctggtgcttctcgcggcagtcgtttttgtgttgatgctcgtgcagcatatgtatttgcgtatggcgatcctggtggtggttttcgttatcgccgtattgtatttcgtgatttccacgatgaacaagcagcgctggttttatacggcggcgcaaatattgacatcgtgttcggagaagatcgataaatatgtcaatgcagtcacgatccccacggcgatcacgaaagaaaacggcgtgatcggttggcataatcccgccttctttatgcttgcgggtatgcattgtgagggaaaaaatattttccgcgtttttccgcagctccagaagccggaaaaggataaaaaggtaaagatacaggggaaggtttattacaaagagacgatcggatgcgaatgggggggcaaggaatacacgatacaccgcctgatcgattttgataaaacatatgaagcctccgcgctttcgaaggcggcgatggctacgatctgccatatacaggtcgataattatggtgatctcctgcggggaacggagcaaagccgccatgcggagatcagcgcggagatcgagcgggtggtttccaaaaatgtaaagaatctgcggggcgcatatcaaaaatacgaccgcgataaatttgtgttggtgttcgagcggcggttcctgtcttcactcatgcagggtaaatttgatattttaaacgaaatgcgcaagatcagtacgggcaacgacgcttttcatcctacgatcagcgtaggaacaggcgtagggatgtcccccgaagaggcaaacgataatgcggcggcggccttggaacttgcgcttgcgcgcggcggggaccaagctgtaatcaaggatgaagcaggatacaaattttacggcggtacgcagcaaggaatggaaaaacggacgcgcgtaaaatcccgcatgttcgcgcatgccctgaaaaacatgatggagcagtcgggtaagatcgtgatcatggggcacagcgttcccgaccttgactgtatgggcgcggcgatggggcttttagcctgcgcccggcaggcagaaaagaaagcggttatcgtgctcgacaggccgaatgcagcgatacaaggcctggtagacgaaatggaacaggatccggattataaaggcgtgctggtaacgccgcaggatgcggcatctatgatggatcctaaaaccatgctgattgtcgtggatacgcagctcgaggaatttgtgatcgcgccggctctgctgcataaaacgaatacggttgtggtgatcgaccatcatctgcgcggcaccaaccatattgaaaacccgacgctttacctgcacgagccgtatgcctcttccacagcggaaatggtaacggagatcatacaatatttttcggacaaggtacatgtaagaccccttgaagtggaatcgcttttggcggggatcatgatcgatacgaagggattttctttcaagacgggcgtgcgtacgtttgaggctgcgtcttatttgaggaagctgggcgcggacacgacgtccatccggcacctgttccaggacgacctggagacgttcaatgcgcgcgcgaaggtcgtgcagaatgcgcatatacttcctgaggggattgcgattgcatggtgtccggatgacgcaaaaaatccacagcttttagccgcgcaggcagcggattcgctgatcgggattcgcggcatcagcgcgtcgttcgtgctgtgcgagcaaaacgatacggtgttggtctccggccgttcgatcggcggcatcaatgtgcagcgtattttggaaaagttgggcggcggcggacatgcgaccattgcgggcgcgcagctaaaaggtatgagtaaagagcaagtagtcgaagatttaaaagaggcaatagaagaatacaaaaaggagagttaagcaatgaaagttattttgaatcaggatgtagcgggaaaaggaaaagcgggagatatcgtcaatgtaagcgatggatatgcgcgcaatttcctgtttccaaaaaagctcgccagccaggcgacggcgcagaacctgaacgcggcgacgatcgcacaagctgcggaaaaacataaaagggcggttgaaaagcaggatgccaaggaactcgcggaaaagatgtcaggtatgacgctgaccattgcggcaaaacatggcgagggcggtcggctttttggcgcgatcacggccaaggaagtggcggcagagctttccaaagtaatgggcgtagagatcgataaaaagaaggtaaacgttccaaatatcaaggagcttggcgaatacgacgtttctgttaaagtatatgcggaagtaagcacaaaaataaaggtagtggttgtcgatggctgacggtagacccgtccatgcgggcagcaggatcccgccgaataatttggaggcggagcaatcaatattggggagtatgctcctcaacgaaaaatgcgtatacgaagcgatggaagccttgcgcgaagaagatttttaccagcagcagcacagggatatttttcgtgtgatgagtgaattgatggaaagcggcgtatctgtagaccttgtcacagtgagccagaaattggagcagcttggcaagatgcgtatgggcggcatggagtatttgtcgcagctgacgacagtggtcccatccgttgccaacctcaagcattatatcaatatcgtacagcagaaatcttccctgcgtaagctgatcgacgtaagcatgagcgcagcggacgaaagctataagggcgaggacgacgcggatgcgatcattgggcgcgcgggggatgctatttatcggatcgcgcttaaaaattcacatagctcggtcgtgcacatcaaagaggcgctgcaggaaagctatgtaaagatcagcgaagccatgaaggcgcaggatggcatgatgggtatcccgacagggtttccctatatggatcaaatgctgtcggggttccaggggacgcagctcattatcgttgcgggccgcccgggtatgggcaaaacgagttttgcaatgaatatcgtggagcatataggccttaccaaggggataccgtgcctggtattctcgctggaaatgtcggcagaccaattggcgacacggcttttatgctcggaggcgcgcatcgacagccagctcacgcgatcgggcaaaatgggggcgaaggagatcaccaagcttgcggatgcgatgaaggtattgtcagccgcgccgatttatattgacgattctgcgacgatcacggtcacggagatgctcgctaaagcgcgcaggatgcaaaagcaatccggcctcggcctgatcgcgatcgactatttgcagcttttacagggaacgggccgcagtgagagccggcagcaagaggtcgcgcagattacaagatccttgaaaattatggcgaaagaactgaacgtgccgatcatgctgctgtcgcagctttcccgtgcttcggaaaaaagggagaaaaagacgcgttacccgatgctttccgatttgcgcgaatcgggcgcgatcgagcaggatgcggatgtggttatcttcctgcacagggaggactattatccggaagataagacgccggaaaatgcgggcaaggcacgcattattattgccaagcaaaggagcggacctacgggcgcgatcgcgatgcaatggcagggcgaatatacgaaatatatggaaacggattatatccatgatgacgaggaggcgccggaatattgattaccaaccaatggatatgcggcagcggcgatcttacggacgttatggctgtgcgtgagaatgtatttgtatccgagcagggctttgccccggaagacgagttcgatttgtttgacgagcaggcgatgcatgtcgtgatctatgacgacgggtgcccgattggaacgggacggctatatcatgatgggaaaacgttccgcatcggtaggatatgtgttgcaaaagaggagcgcggacagggcgtgggcgatttgcttatgcggctgctgctcatgaaagcatttgagtataagccttcgcgggtattgatcgacgcgcaggagcgtgtgtgcggtttttatgagaattttggatttacagtgaatggagatgcgagggaggaagcggggatccgccatgtgcccatgtgcgtcacgaaggaaacgttggtattcaaaagcggctgcggaaaagaactgcggtataaggatctgtttccagaaaagtaaagaaataaggaaatccggcatgacgccggattttttgttttgtttttaattgcaaaaaagaaaaaggcgttgcaaatgaagcgggaaatgatacaatatatagtgtgtttatagaaaaacatagctacaagaagtattaagagcagaaggggacatcaatgatcacgcttgaaattacacaggaccaggaaggcttgcgcataacggaatgcgttgcggattgtgtgccggagctggccgctgccaacctcaaaaaaatgatacgcgcaggcgatatcaaactaaacggcagccgcattaaaaaagattttgcggtacaggatggggatattatcgaaatctatgtaccgcttgaatatgaacggccgccgatccttgacatcgtttatgaggatgagaatacgatcatactgaacaaacagccggggacggtagtggcagggacgggcatatcgcccgaaacgccggaactaatgtctatggtcatcaattatatgaaggacaacaatgaatactcagaagaactgggcatgataccgtttgcgtgctttaagcttgatatctatacgggcgggcttgtgatgttcgctaagaatgtggaatatttcgaggcagtgcgcgtagcgacgcgccagaggcgcattgcacggacgtttcgcgcgatcgtcaggggttgtcccaagtatgaagaaggagaatttcagcatttttatgtgaaggaaggcgaagataagtaccgcgtgaccaaaagcaaggtgcgcggcgctgcgccgatttatacccgttaccggatcataaaaagcaacggcacattgagttttctcgagatcgagcctgtcacgcagtatatgaaccaggagcgcgcacatatggaggctgccggatatccgattttaggggataatatttatggcgatcccaagctgaataaaaaaatggggattaagtaccaggcgctgtgggcaacgggcatccgttttgcgacaggcgtgaacaatatgctggaatatctcaatggcaaagtggttgaaacggacgatgtgcagtttccggtggtcaattgggagcagtgatgcattggaacatgtcccatggatattgatcgggcggcaggcaagtaaaagtcagccgctctttttttgtgggatggaggatggaaagggaataggaccataaactcaatttttcagccggaaggccgccgtatttgacgtcgccaacaagcggggcgcccgcgccttgcatctgcacgcgaatctggtgggaacggccggttttgagcgttatatcgagcaggaaaagatgatcgcggcgttcaattaccgtataatcgagcgacgcatatttgctgccctgcgtgccttgggggacaacgcgcgaaatattggttttgccgtcctttaaaaggtaatcctcaagcgtgccggacgccggaagcgaagcggcgaccacggcataatattttttttggaacgaaccgtccttgagctgggactggaggcgcgcggcggctttggacgtccgcgcaaataccatgaccccgccggcagggcggtcgagacggtggacaagccccagatacacctcgcccggtttcccgtatttttctttgatatattgcttcagcatacttaaaaaatccatatcgtgagaactgtctaactgtgtcggcatgttctggggcttgcttgcgacaagcaggtgattgtcttcgtataagatttgcggcgtcatggtatccaccgcgttgtggtgccgcacgggagaagcacgctttgcccttcaacaggcaggcacagatcgcctgcgtcgatctttccgcggcggcctcctaaaaaaatctcaagcatatttttgcataccacagaagaaaggcctgtggtataagaattgatgatgaaaaaaacaggcgtatcggaaaggagtttggcggtttcgccgatcagctcatacaggttgtcttccgtccggaaaaccttgccgtccgcgccgcgcccatagctcggcggatccatgatgatcccgtcgtagcggttaccccgccgttgttcacgcagtacaaatttcaggcaatcgtcggccaggatacggataggtttttggcaaagacctgaaagttccgcattttctttggcccagccgttcatgcttttggctgcatcaatatgagttacatgtgctcctgcagcagcacatgcaagcgttgcgccgcccgtatacgcaaacaggttcaagacgcgcggcgcactgtgcgcttttttcacctgttgcgccataaaatcccaattggcggcctgctcgggaaaaaggccggtgtgcttaaatccggtcgggcgtacataaaaccgcagatcgccgtaggcgacagtccaccgctcaggcagttttttcaaatagttccactgtccgccgccgtgctcgctgcgcacatactctgcattcataccgccccacagttttggacgctgtttagcccaaatcacctgcgggtcggggcgggacaaaacgatatccccccattgttccaacttcataccgtctccggtatctaaaattttataatcgtcccagccgtttgtgatgaacatagccttcctcgctttcacgcaatcattttaccatatagggtgtttttatgctataatgaaatcacataagagatatttccaaaacaattgcgggggttgtttaaatgagagtaaaggcatatgcaaagcttaatctggctcttgctattttaagcgttcgcgcggatgggatgcatgagttggatatgctgatgcagagtatctcacttgcggatgtgctttccttcaaatgtagcgacagaatcgacgttcgttgcgacagtatgacgatcaacgggaataatacggtgaagcgggcggcaaaaatgtttttccatacgcttggcatccgtggcggcgcacagatcgtgctcgaaaaatacatcccgtcacaggcggggctgggcggcggcagcagcgatgctgcggcaacgcttttggcgctgaaccatatatatgaggcgggactcgacgcacaggaattaagggcgctgggggcgcaaatcggcgcggacgtcccgttttttattggcggagggtgtatgcgcgcgcgcgggatcggcgagaaacttgagaggataaacaaccggtgtgatttccgttatttgctgatcaagccgaaaaggggcgtttcgacggctttggcttataaaaaatacgacgagtatgagcatgtgaacggtgagcgggctgatatagaagcggcagaggcggcgctcaaggcgggtgacggtaaaagctattttcgtacagcaaagaatgtattgcagataccgggaatgacaatttgcccggctgtgggggagatccttgcaaaatgcaaagcgcgcggggcggattttgccatgatgacaggaagcggaagctgcgtttttgcagtgttcgagaacgaatcggttcgagaatatgcataccagaagtttgtcaaggaatatccgttttgcaaacgtgcggaaaataaggatatgggaatagaagttttataaaaaaggcacgtttcggcgtgccttttgttatgccatcagataagaggcgttactgtcaatataactcaggaactcctgctcaatcagctcctggcctttttcgttgggatggataccgtccgcacaaagaaaatcgcggtaatcctcttggcgcaggaaagctgcgcggacattgataatatggataccgaaggaagcggctacctgttcggcgatataagaatacttttcctgccaccaatagattttggaaacgtcgtgtagccactttaagatattatgtgcgcgctggggatcgtttttcgtaaaccagcgaaaataagaagcggcgcaaagcggcggtaaattcatcaggacaggtattttattcagcttgagcaaagaagagatcatcccgctgagcttttcctcatattcgcggaccggcgtattcggcatatggacagccgtgggatcaagggcgatctcatcccacttataatcgcaatcgttcccgccatattcgatgagcaccaaatcaggattcaggtctgcaagcttttcttttaacaatttttcgccgtaagaggcagtagtaccaaatttggaaaaatcatgcacgctcgctttgaggcgttccccaagacgccggataaatccatttttagaaaaaatataccgacccttttcagtgtggaagatgacgccctttgcgacggaatcgcccatgaccaaaatggactgtacgccgccttttatcggaatacttttgccgtacatagttataaacgctttcttatgatcaatattgcgtccctgtggacagtttcaatttagcatgttcataataaattgacaagtgttttgttgaatttgcatgcaaatatcattataataaacctcataacgaaaaggagagagcggtttgaagagatattcatcgaccgggccgaaaatgcctcagggtacatttttcaaaatgaataaaaaacggcttatgaccatagggatcgtagccgtcgcagctgtcatctgtattgccgtaattatgggcgtcgcgaccaggaaaggctttgaatccagcgtgcttatgacaaacgatacgattcggatcggtttgcgtacagatatcgaaggatttggcggcatggacgacgaaggcaagattacaggatatgacagggattatatagacgcgattctgcaggagcttgtgggagaccaacaaaaagtatatgaatattatgtgcttagttcccaggacgcaggcggcgcgataaagtatgatacagtggatatcgctatggggctattaacgagcggaaccgacaaaaccaaaggattccagctcacgaaaccctattatacggatcaggtagtcgcgatcacgaccgcagattccagattggaaaaactgtccaatttggaaggggggaaaatcgggatactgagcaatgcgatcctttccagcgatctgagcgattatatagaaggaaaaaagatggattataatacaaaggatatcctgcggtatacggactacgaaagcatccgtatggatcttgatgcaggtcgcgtaaacgcggtcgttatgccgcaggccattgcgaagcagtttgtaaaagaaggatatcgcatgctggccgagccgctttataccgtcggctactccattatgctgccgtcagggcaagaggcgatggctgcagagatggatcgtgtgatcgaacagtttgaaaaagatggaacggcgcagtcgctgcgcagcaagtgggggctgtagcctatttgttgtttagaaaacaaacccttatgtttagcggaatatggatgtgtttatattgacagtgtagggatggttgtgttaaaatgacagcaatgggtgagctccaacaaactcccccacgacccacaaatttttatttgtcaggaggacaatggagtgaaaatcaaaaacattagtgaaccgcagaaattctttgaacttctcaaagactgcaagggcaaggtagaactggttacgtcggaaggcgacagattaaacctgaaatccactttgtgtcagtacatcgcattgacccagatgtttaaagatgcacagattgacgagttggatttgattgtatccgagcccgaagatttgaatcttttactgaactacttggtaagaggttaaatcctctcgtaatttccaaggttgcggtttatgccgcaacctttttttaattgtttcaatccaagccgcgtccgctatttgtcgcccttggcagtaggctgttcccattctcgcgccgtctttgcaaacgaagtgcgcaggctcggaaggcaaatagccatctaagactgcggtaaggtttgcctataaatatggtataataaaacagaatcaatatgctggtataaaaacgggagaaaaaatgggcattgagtttgtgctgggcaggacggccagcaaacgcgacgacaaaatcattgaaaagattggaaagctggttcacttagatccgcttgcgaatattcttgttgtcgtgccgccgcaggcaacgtatataacggaaaagcaactgatagaaaaacttgggctcaaggggcttatgggcgtatgcgtgcaaagccctgcgcgtatttgtgaccgtgtgcttgaaagcacgtacggaaaagcggtcgcgggcattgacgcggcaggcaaaagcatgatgatgcgcctgcttcttgaccagagtgaaaatgatttacatgcgctgaaaaagtgcgcgaaaaaaggtgatctgccgcttatgatgggcggtattatctctgaattgaaaacactggattttacgccggatatgttgcgcgggattgtcacagagaacaaaaatacaacggagaagtttgaagatattgcgtatctttacgagcaattcaacgcgctttccgaaggactctgcgatacggaagataagatcaacatggtgatcgagcatattccggacgccggattcctttttgacgcgcacctgtttatccacgggtttgatatttataatgcccaaacggtccgctttttgaaggcgctgatgggagcggccaaggaaacggtgatgtccttttattatgcggacggcaatgcgccggatgcgggcgtgtatgggatctgcgatgagaacaggaataagtttttaggggacgcgattgccgcgggactgaaaacgtccattgtcacagaggacagggaaatatcgccggacatcctgcacatagaaaagaacctatatgcgtatccctttaaaaaggctgggaaagcgcacgatgtgagcattacctatgcggcggacaaggaagaagagatccgtgcggttgcagcgcagatcgcatacctgaaagaaaaaagaggatatacttttcgcgatatggcggtcgtcgccggcagcgcggaaggctacgcgggagatttgaaggccttactcaaggaagcggggattccgtgctttacaagcgaaaagaggacgctcaaggaaagcgtatttgcagaatacctgttgagcgcgctcgagctttcacaaggacggctgaaaaaggatacgctgctggcgcacgcaaaaacggggattgcccaggtgacgctgcgcgaggcagggcaactgcaaaattatgctttttcgcatgtgcgcgacggttttgcatttttgaagccgttttccgacccgatcgccgaggaggcgcgggaaaaactgatggagccggtcatcgccttgcgcgactgcgcaaaaaacgcgcatacggcgggggagatgatccattgcctgatgcagtatatggaatggaccgacgcggaacataaattattgaagcagatcgcggcggcgcaggaagcggggcttcgggaaagcgctgaatttggcgcgcaggtgtttgaaaaagcggtacatattttggaagaggcgcaggagatattaaaggattcccctgttaccaaaacgcagcttgccgcacttttgagaacaggctttgaagcgcaaaaggttggcgtgatcccgccgggggcggatgaagtggcgatcggcgaaatcgcgtacatccgtttggacgatatccgcgccttgttcgtggtaggggcaaacgaagggatcttaccgaattatgcgcaaagctcggatatccttgcggattacgagcgggaattgatgctcggacagttggcgggattgaagtttacgggcaatgtggaaaaacaaaagctggctattttaaaggcgtttacgaaaccgacatgcaagctgttcatgagttatacagacgacgggaaggctaagccgtcccctgtgcttaaacggatcgccgcgctctttgaagacatcaaggttaacagggcggcggacattgcggccatgctgaaaacaaacgcttacgtcgtgactgcgggagccttgcgcgactttgcggacgggatcgagacggaatatgatgcgccacgggccgctgcggttttaagtgacaatgaatatccggaaaagctgagggcgattgagcgcgggattaccaataagaatcgggcaatgccgcttaagggggcaagcgcacaggagttatacggcgagatcaggggaaacgcaagcaggttggaaaaatactacgaatgcccgtacaagcattttgtgcaatatgggcttaaagcagacgtgccgcaggaatatacgatagggccgatggatgtgggcaattttgcgcacgatatcttagacgggctgcaaaaagcggtaaagcaggacaagcggaaatgggcggatattccggagacggagtttttgcagatgataggcgattgtgccaacgcggcgcgcgaggcgcaaagcaagtttactttgaatcggcataacgaaagtgtgttgcacgcggtggagcgagaagtgcgcctcgcggcggaaacgatccggcggcaaacgaaggaaggaatgctccagccgcaggaaagcgaattctggttttcacaggagttcgagggcggtgtaaaaatcgacgggaagatcgaccgcatcgatacggcggaattagatggtatgcagtatttcgatatcgtagattataaaacgggcgaacatgatttcgaccttggacgctttgcgggcggcgtttccttgcagcttgtcatctacatcatggcggtaatggaacttttgggcggcgacgcgcaattcgcgggagccaattatttcaacatccacttgccggaattttcggtgcaggacggagatatcgacgcggcgtaccgtatggcgggaatatgcggggtggacgaagaaacggcggcaaagctgtttggcgcggacggcgggagtatcttttcactgaagctgcggattttgcgcgacggcagttttgacgcgaacgcccgccggcggcagtacggcgcagaagagattgcggcaatgctgcgttttgccaaaaaactgatcgcagatgcggcaggtaacataaaagaaggggacaccaggatacgcccctattcatacaaagcgtccacaggctgcgattactgcgatttcgcaagcatatgcatgtttgacgcaggatatgagggcaacgcgccgcgcgtgattatggaagaagacaaagacgaaacgatgagacgggtacggcaggaagaatagatgcagtttacggaaaaacagacaagggccatccatacggacgggaaaagtatattggtctccgccgccgcaggcagcggaaagacaagcgtgctcgcaaagcgggtgacgcgtcttgtcgtatccggatgcgatatccgcaatatgttgatcatgacgtttacaaatgccgctgctgcggaaatgcggcagcgtatttcgcgtgagcttgctgacggtgcggcggaaaaaaacgatatgaggctgatgcagcaggcggagtttgtctccatggcggatatttccaccttccattcgttttgcggcaaggtggtgcggcaaaactatcctgtgctggggatttcgccgaatttcaggatagcggaccaaaatgaagcggacaggctgcgcggggaagcgctgcgcgagttgttcgacgatttgtacgaagcggaagacagcggttttttgcgattggtagagcgttatacgacgcgcgccaatgacgcgcgcctgatggaatacgttttcgatatctatgattatatgatgagcaagcctgacccgtttgggtgggcggaagaatcgctgcataaggatgaagcgtatatccgtgcgctcaaggcagagtacgagcaggggatgctggacaagctatgcgaagcgcaaaagatgatggaactcgccgcagacgtctcgtctggctttgacggggagcagcaaaagaaggacgaagcgtgcatcgcgctgcttgcggatatgctcgcctgcgcgaagagcgacggcgtagggaagatggcgaagctgtttgcgggaagcatattgcccgcgtgcaaacgcaaccttgaggaggcacacaaggaaaagataggcccgttgtataaaacggcgcgggcatatttgaaggatgttttaaaagaccctgcctttgaaacgtttgaggttacggcagaagaagagcttgcgcacacgcaggaggatatcggcgcttttttgaggctggtacgtgaatttgccgcagggtatgccgcaaaaaaggaagaagcgaatgtgctcgattatgaggatctgcagcattttgcactgaaggctttgcaggacgaagccgtgcgcgatttttatgccgcgcaatatgaacatgtgtttgtggatgaataccaggataccaaccctgtgcaggaagagatcattaaggcggtcagcgctctgggcagcctttttatggtaggggacatcaagcaaagcatttataaattccggcttgctgaccctatgatcttcaagcagaaggctcaggaattcaaggcaaagcaggcaggcagcgagatcatcctcatgaacgacaatttccgcagcacacgcagcgtcatccaaacggtcaactacgtgatggacaaggtcatgagcgaacgcaccggcgagatcgtgtacgacgaaggggaacggctgctcggcaatatggaaggcggccatgcggagatcctgctttgcgaaacggacgcggaggaaaaggataccgctcaggcggccatgatagcggacagtatcgaaaaacaaatgcatgaaacggtgacagacccgcgtttagggcaggcgcggcctgttcgttatggggatatcgccgtgctgctgcggtcgcgaagcgcttttttgaatgcgcttaaaaatgagctgggcaggcggggcattccgtgtgtggtggatatggatcaggcgcaggatctaaaggagatcgagttgtttgtcaacctgttgcgtttgatcgacaacgtaaagcaggatgtgccgcttctttcggtgatgcgttcgtatatcggcgggtttgacgaaacggattttgcggagatcaggctgctgaaaaacgaacgcggcatccctttttatgcggcggcagagacatatgcgaaacaagagaacgccgtggcaggccgtttgcgcgggttttatgcaaagattgaaagattgcaggtgtatgcgcaatcgctttccctgccggaactactggctgccatagagcgtgaatacgattttgaaacgtatgtggcatgtacgccgggcggcgcgggcaaacggagagtgttcctgaattttatgaaaatagcggcggaaacggcgcaggcagtaggccacagcctgtatctgttgctgcgtgcgcttcgggaaatcaaaaaacgcgacggggcgtacgtgaagacgggagtctttgcaggcgacacagattgcgtgcgcattatgacgatccacggttcaaagggccttgaatttccggtggtctatctggcacggatggaagcgcagttaaggccgcaggagctcaacaaaagcatcctgctgcattcggattatggtatcgtggcaaaatatgtggacggcgaaaagctggtcaggcgggatacgctggaaacgtcgctggtaaaagagcgcctgacgcaggagtataaatccgaggagctgcgtattttgtatgtagccatgacgcgggcgcgcgacaggctgtttcttgcaggcagcgtcaaggattatgcgaaacaatgcgcggcatgggaaatgatgcatatgacgggcaactaccaggaggccaggagcatgctcgactgggtaatggcggcgggcgcgggggaaagcgcgattaaggtatcgcttacccggtacggcgaaaggcaggaacagcaaacaggggctgcctttgattaccagggctttaaagaaaaattgcttttggaaacacaaccggaggagcttttgagcgtacacgccgggaccggcgttccggcgaaggtatcggtcagcgcggtaaaacaagcccagggggtgggagtgcgcagatttttgcggccggaaacgcaggaacaggaagaaatcacgggcgcgcggctgggtacgcttttgcacagcgtgatggagcgcgcgacgcagggacaggggatcggcgatattgcagaggacctgtttgcgcggcgaatcgtgacgcagcaggaaaaagaggcgatccttaagaaccgcgaaatggcggaggcgtttttaaaaacgccgctttttgagcggatcacaaaggcgcagcgcgttctgcgggagcagagcttcaatttgcaggtcgacgcgcaaagtatcggctttgaaggacaggagaacatgcttgtgcaggggatactggacctggcatttttagaagacggtcagtgggtgctggtggattacaaaacggaccgtatagatgaagagggcatgcaaaaggcggcgcagggctatgccgtgcagctcgagctttatgcgcgggcgcttgaggatatcacgggaatgcctgtaaaagagaaatatctatattttatgcgtctgcaaaagtatacgaatgtgtgacaggaaataaaggtgtcggcgttctttcatgcaaagggcgcttttttgataaaaaaacgaagtttgtactacaaaaacgatgatttttcacgttgcggcatatcctgatcgattttaaaataaagttataatcaggatcgggaggtgacgcaaatggtcaaccgttgttattatctgacgaaggatcacagattgtttatcgaggaaaagaaaatgccgcgtccggacgtcggcgaggtgattatcaagccgatggcaaattccatatgtgggtccgatatccggatgtatacgcttgcccacatggggaagtcttatatcagggagggaagacccatcagcatggggcatgagtgcagcgggatcgttacggagctgggcgaaggcgtcacaagcctccggatagggcagcatgtggtgattgaaccgggcgtatattgccgccgatgtcacaattgcctgagcgggcggtataatatatgcgacacgttcaattttacgagcggtacagaccccgacgacgtggattgtgtcgagggacacgggaccggatcgatgcgggattatttggccgtaccggagcacatgctgcatgtgataccaaaagaactgccttttgacgtggcggcgcttgcggaaccggcggcagtcgctatccatgcggtggcgcgtgcaggcagcgtattggggaaatcagtcgcagtattcggcgcagggccgatcggcttatttgtgatgcaggcgctaaaggcggcgggcgcgggggcggtcactatgatcgcgccgggaagcgcgcggcttgcaatggcgcttgaacggggagcgacggatatcatcaatacaagcgaaataaaagcgcttcccacgtatgcgtttgacgtcgcaatcgaaacggcggggtcacccgtttccacggcgcaaatgatcgacgtcgtgaaacgcggctctaccatcgtacaggtagggtggctaagcgaagacgcgtccatgaacatttacgagttcaattggaaggagctcaattatttcggctcggtggattatgcgggcgaatttccggttgcaatacagtggctggccgacggacggatcaatggagaggcgatgatcacaaagcgtttccggtttgaagagataccggaagccttccggtatactgcggagcatccggcccagagtatcaaaacagtgatcctgcacgacgcatagtgcagggcggtataaggagcgggagcaaggggtatggttgcgcatttctggatgccggaggcgtatgtgctgtcagtgaaacggacggtgtgcatctttcaaaaaaggccatggcaagttggcggatgctgtctggacgacgcttaagataatgggcgcataagattatttggattttttgttttataaaaaggatctggtttatcaaaagcaaggggatagttgcgatgtgaaaacctgtatccttttttatttaaaaactaatacaggaattttattcacttttgtgcaaatatttatgaattgaaggattaggtgaagtgtagtagaatggtattaaaggataaatagcgggcatttgtctgctaaatatataattaatttaagaaggatgatgaaagatggcaaagatcagtaaggcaaagtatcaggaaatgctcgaaaagatgctgcttacaagaagattcgaagaaaaagtaagctatttcttttccatgggtatggttcacgggacgacgcatctttatatcggtgaagaagcggttgctgcaggcgtatgctgcgcacttgctccggaagacctcatcgaaagcacgcaccgcgggcacgggcattgtatctccaagggaattgaccttaacaagatgatggcggaattgcgcgggaagatcacaggatactgcaaaggcaaaggcggttctatgcacattgccgatctggaacgcggtaatcttggtgcaaacggcgtagtcggcggaggtattccgcttgcgacaggcgcggcgcttactactaagatgaagaatatagacaggattgttgtctgcttcttcggcgacggcgcaagcaacgagggttcgttccatgaagcgatcaatctggcttctgtttggaaactgccggtactgttcgtttgcgaaaataataaatacggtatgtcggtgccgcttgctcattctatgaatatcacggatatttcggagcgcgcaaaagcctacggtatccccggcgtgaatgtcgacggcatggatgtgcttgcggtttatgaagaaacacaaaaggccatcaaatatgtcaagaaaaatggcccgatgctgatggtttgcgatacttaccgttatcttggccactccaagagtgacgccaacgtatacaggacgaaggaagagatcgaagcgtggaaaaagaaagacgcgattaaaaagctggagaaataccttgtagataacaagattttcacgcaggctgagattgacgccatcgagaaggacacgaaacagcagatcgaggatgcagtggcgtttgcggaagcgagcgagttcccgggtatcgaaacgatcgagcgggatgtatacgcggactaagcgggaggtagaagataatgagagaaattacatatgcgcaagcaattaatgaagcaatgagccaggaaatgcgcagggatcctgacgtattcctgatgggtgaggacgtgggactttacggcggcgctttcggcgtttccgtaggaatgtttgatgaattcggaccggaccgcgtacgcgatacaccgatttctgaagcggcgatcgcaggctgcgcggccggcgcggcggtaacgggtatgcgcccgatctgcgaaatgatgttttctgactttatgacgatcgcgacagaccagatcgtcaaccaggccgcaaaaatgcggtatatgttcggcggaaaagcaaaggtgccgatggtcatgcgcatgccggaaggcagcggcacgggcgctgcggcacagcacagccagagcctggaggcatggttttgccatatccccggcctgaaagtggtaacggcctccacgcctgcggacgcaaaaggactccttaccgccgcgatccgcgacgacaatccggtaatgtttttcgagcagaagcttttgtatcgcgtgaagggagacgtaccggagggcgaatatgtgatcccgcttggcaaatcgcatatcgtgcaggaaggaaaagatctcacgatcgtgacatacggcaggatgctccaggtagtgcagcaggcggtggaagcggtagcaaaagacggtatcagcgtagagatcatcgatccgcgtacgctttatccgatggatacggaaacgattattaattccgttattaagacatcccgcgcgatgatcgtacacgaggcggcggtaacgggcggactcggcggcgaaatagcggcgaagatcgcaggaagcgaagcattctattatctggatgcgcctgttacccgtgtatgcggattgaatgttccggttccgtattgcccggagcttgaaaagaatatcgttcctacagtggacaaggtaacgcaggcgatctacgatatcatgcgctgagggaggcaatcaaaatggctgaaaaagtagtaatgcccaaggccggaatggcgatggaaacgggaaccatcatcaaatggctgaaagaagtgggcgataaagtagaatacggcgaaccgatcctagagatcgaaacggacaaaacgtccatgcaggtcgaagcgatgaacgacggatatctgctctccaagctttacgaagcaggggcggaggtgcctgtcgttacgacgatcggttatatcggtgaaaaaggcgaaacgccgccggaaggcgatgcgcctgcgagcgcgccgaccgctccgaaagaagaagcggctcctgccagcgcaccggtggcggagcaaaagaagcagacgggttttcagacaaatggaaagctgcgtgccacgcctgccgccaaacggatcgcgcgtgaaaggggaatcgatcttgctacgatcgataccaacggcgagccggtcaaagcaagggatctcgagggcgcaacagcgaaggtcaaggcaactccccttgcgaaacgggtagcggagcaaaatgggatcgatatttccacggttgcgggaagcggttttggcggcaaggtcaagaaggacgacgtgctcgctgcggcgggagcgcacgcggctccggcagcgcaggcagcagcagaagaagacgtgctcatgcccctgaacgggatgaggaagacgatcgcgaaacgcatgttggaatcccacaacaatgttccgccggtcacgctcaatacacaggcggacgttacgggcttgtttgcgctgcgtaaacagatgaacgatatttcggatgtcaagatttccttcaacgatctggtggtcaaggcctgcacggttgctttgcgggaatttccgaatatcaatgcttcctatacggaagaaggcgtgctgtataaaaaagacatcaacattgggatcgcggtcgcgctggacgacggactgatcgttcccgtattgcgcaatgcggacggctactccttaaaagggctcgccgcagcggcaaaggatatggcgggccgcgcgcgggaaggaaagctgctgccggatgaatatacgggcggcacgttcaccatcagcaaccttgggatgttcggcatccagtcttttgatccgatcatcaatatgccggaagcatgtatcctcggcgtatgcgcgattacggatcagcttgtgatggaagaggacggcagcatcaagaaccacaagaagatgggcttttcactgacatttgaccatcgctgtgtagacggcgcttcgggcgcgaagttcttgcagcgcgtagtgcaactgatggaaaatccgctgggaatgctgatctagggaaaggaaatagcgatggctgaaagaattattatgcccaaggccggaatggcgatggaaacaggaaccatcatcaaatggctgaaagaagtgggcgacaaggtagaatacggcgaaccgatcctagagatcgaaacggacaaaacgtccatgcaggttgaagcgatgaacgacgggtacatcctctccaagctttacgaagcaggggcggaagtgcctgtcgttacgacgatcggttatatcggcgaaaaaggggaaacgccgccggaaggcgatgcgcccgctgcggcggttccggctccaaaggcggcacaggaagcagctcccgctgcaaaagcggcgccgaaaggaaacaaggaatacgatatcatcgtgctgggcggcggtccggcaggttatattgcggcgatcaaggcttcgcgcctgggtgcaaaaacagccgtggtggaaaaatccgcattgggcggcacatgcctgaaccgtgggtgtattccgacaaagacatacctcaagaccgcggaaatcatccatgaaacgatggaagcaaaaaagcgcggcgttgttttcaaggatctttcctacaccgttaacatgaaagacgtggtagcggagaaaaacggcgtggtgaaaaaactggtaagcggcgttacgggactgatgaagagcaacgggatcgacgtataccggggcgaaggccgtatccaaaaggataagacggtcgtgatcgacggaaaagaaacgatcgcggcggataaggtgatctttgcgggcggttccaaggtttccaggatcaacttaaagggaatcgattcccctgcggttatgacgagcgacgacatccttgacctgacggaattaccggaaaaactcgttgtgatcggcggcggcgtggtcggcgtggaaatggcttctgcgttccatgcattcggcagcgacgtgactgtgctcgagatgatggacaggatcgttccgggcatggaaagcgaactttccaacatgctgaaacaaaaattacaggcgcagggcatcaaagtattgaacagcgtcagtatcagcgagatcgagcagaagggcgcaaaggcatacgtcaaattgaaagacggggatccggtggaagcggacaagattctgctttcgatcggcagggtgcctgacctgagcgggattgaagatttaggcgttgcggtagatgtagatgagcgcggcagggtcaaagtggacgacggcatgaagaccaatatcgactggatctgggcgccgggcgattccaacggccggacgatgcttgcgcatgcggcgttcaacatggcggagatcgctgctgcaaacgcgatgggcgcaagtgagaaatacacaggaaaatatattccggcttgtatttataccacgcccgagctggcgtctgtcggcatgaaggaagaggatgcgaagaaaacgcacgacgtaagcattggtaaatttttctttgccggcaatggacgcgcgcttgcgtccggtgcgggagacggtttcatcaaagtgatcacggacagcaagacaggtgagatactgggcgtacacatcatcgggccgtgcgcggcggaaatgatcaatgaagcgtgcgcgctgatgacgatggagattacggcatacgaagtaccgtccatcgtgcatgcgcatccttcgttcagcgaggcgctgatggaagcggtggcagacagcattggagaatcgcttcacctgccgaagaaaaaataaggcatacacccaccaagaataatatatgtgtgaaaatggcagacaaaaatatgtctgccattttttatttgggaaaagaaatacatattccttgatttgcatgtgcgtaatgggcttgccataaatgcaatgataagcggtagagagaaagctcaaagaaaaacagaaataaaaataataaaaaagaaataaaaataagtaaaaggttgaaatgtaaaagcggttgtgataaaataaagatagaaaagaacactatccatgcgacacgtgagcgatattattttgttgggctcatagcagtatctaaccattttagatgattacctgattcaatatttccaaaaaatacaatatctttaggagacttgtcatgaatgtaaaagaaagaattgaaaaagtgacccgtgcgatgctttgcatggaacggtacccgtgggagcagggggaagcctcgcaggctcttttggagttgggagattatgaacatgcttacctgatggcgcatgacgccgtgcttcgtcagtccctcgacggaaggctgggtacaactttttatcgcgaccatgttgcgatgttcggcgatacgagtacagttaccgatgccgtaaacaatggacaggctgtcttgtattttgcaaagaagaacggcgatgagtcgtttatgaaagcagctaaaaagcagatcgctttcttgatggatatcgctccccgtgcaaaaaatggcgcgatcagccatgtgctcgaccatccgcaggtttgggtggattctatccaccattgtccgccattcttggcgcaaatgggtgaatacgacgaggcagtatatcaaataagggcgatgcgcgatctggtatatgatccggaaacaaagctgatgtaccacgtatgggatgacgtggaagaaaaatatgtcaatcctgatttttggggcatcggcatgggtctcgccttgatggggatggtaaagacggtacattaccttgaggatgagaaacaaaaaaacgaaatcaaggcatacgcaaaggagttgctggacacgctgcttcaatataaagatgaaagcggaatgttccataatatcgtgaacgatcccaatacgtttttggaagcggatctttcacaggaagtagcatgtgcgatctattccggaatataccaaggctggattccgaagtcttaccagccacaggcggatcagatgcggcaaatggcccaagggtgcgtagacgagttcgggtttgtacggaacgtgtgcggaacgccgacatttgctgccctgagcgtttcggtagaggcgcaggcaatgttcctgcaaatggaggcgagcgcaattaagctaggtttgtagcaatgaggattttgggaaagcaggaaattaacattaacaggacaatgaccatgggaaatgcttttcgctgatccaaaatcacgaaagcgaggccataatgtaaaaatggatgtgcgccgtagggcgtaacatccattttttgaaaaactgtcccggttgaaccgagaaaatttattttgtatagaaaattatgtgcaacgttatttcagcgcgccatttacgccccaaataggcatttcgccaaatttaatatacaggttgggaacaggaataccgtactccttgtccataagatcgacgatagccttggtcaggtcggatttgaaactgaacggctgcatctggtaaagataaatctcaatcatgcacaacgcgccgtcaaatccgcgccggtacatatcgcattcatccgaaattttgataagcgtctgttcggcggttttgccgggcaggatggagatcagatcaccgagctttgtctggagttcctgtttttgtgcaggggcaagttgtttgttcgtgcttacattgataaatggcatgggtaaatccctcctttgaatgtgcttgatagtttcattttactctgggcggcttaagttgtccacggcacatacaaaaaagttgtttttcttttcttgcttctgtataatataaaaaaacatattacacggcaaaactttctcaaaggatagaatcatgaactatacaattggaaaatttgcggcgcagacaggtgtaagcgcgcccttgttgcggtattatgaacagcagggctttttaaaagtggggcgcggcggcgcaggccggcggcagttctgtgaagcagacatagaatgggtacggttaatccgtttgctggtagatacgggtatgcccaaagagcaaatccgcgaatatgcgcaactcaaacaaaagggaaaagaaacaatgcctttgcgccttaaaatcctagaggaccaccggcgcagggcagaagaggaaaaaacaaagtgggagagggatttgcagcggctgcgggacgaaatcgtgcatagccagaagcaggttacgcagcaaaatagaaaaaaataaaagagaagggcttctcccttctctttttaattgtcaatatccctgttcttcgatataggacgcaaggtctaagaggatcggttcctgctcctgcgtgtgcggaatctcacgaatccgttttgcaaggtcttcgctgcggaaagcgcagccgatcagggcgggggcgatgcagtccataaagtcggcatccatggcgtcggaaaaaacctgcgcttcgttgatcacagcatcttttaaattgagcatcagttcgatcccaccccaggggaagcgggtcttgatggtaatatcgaattggggcgactgtccgaatagccaatcccagctttcgttgcgcgctgcgatcttagcgatgtccgtccaagcttcatccgtgaatggataaggctgaggatcgccgtattcggccttgtatgcggcaaggagagcttctgtcatcctggcaggggtaatgtcagggttgagctctttcaggttcacaacgcgcgcacgcaccgaagaaatgcctttggattcaatcttgtctttggaaacggcaaggtattgcgacaatttgtccatatcggaatcgatcaggatagtcccgtgatggaaagcgccatttttccgccggcaaaaagcattgccggaaaatttacggccgtctgccaaaatatcgttgcggccggaaaattctgccttgataccaaacatattcgccgcatccagcatgaccttcaactgccggtgtacatcataggtatcgtgcgccgcgataaacgagaagttgaggtttccgatgtcgtgaaacacagcgccgccgcctgagatcctgcgggcgagcttcccgccgtcggcaagtagcttttcatggcggcattccgcccagacgttttgatgtttgccgatgataacggaatcttcatgcgtgtaaagatacatgatcacatcaccgggctgcacatgtcctaacatgtattcctccacggcgagcgtatggtgcgggtcaagtttaggattgatataataaaaaaaacggttttgcatgcgagtatcccttccgaaaatatttctaaatctattataatggatgtagaaactgcattcaagttttgcattgcgaatttgactttcatgctatatgataagaaagagggggaacggaggaacgttatgagatattaccaggcggaaacacattgccactcggcagaggtcagcccatgttcgcgcataccagcgcaatatctggtcagggaatatgatgaagcaggatacaggtatgtttttttgacggatcattaccaccccgctgtgttggaaagcccggcgctgcaaggctgtagttgggaagaaaagattgaccatatgctttccggctatgaaaaagcgcggaaatttgccgaaggaacgggcgtacatatgctgctcggcatggaagtagtccttaacagaaatgaggaaacggggatcggcgacgatttcttggtctatggttttgacaagggattcctgatggacaacccttatctttatgagctgtcctacggggaattttatgaaaagatcaaggcaaacggtttgctcacattccaggcacatccataccggtatggcctaaagcccgtagaaccgatctgctacgatgggatcgaggcagtgaacacgcacccgcgtcatgcttcgcgtaacgccatggccattgattttgtggccgagcatgatttgtatatcattggcggcagcgatgcgcacagcgaagaggatatcggcaggggcggcgtgatgcttccggacgggatcgaaacgcctatggactttgtccagtattacagggagaacggctcgccggagctgatcgtaacttttggcgcggacaacatataaattcgtttaatatatcgcccaggcggttatatatgaaaagtaaaataaatgattgagggaaagaggtacgaaacaatggctgaaaaaattacaaaagacatgaatatcatggacatcctccagatcgacgaagggcttgcgccgatcttcatggaagcgggcatggggtgcctggggtgcgcggctgcgcattttgagaatcttgagcaggcatgcggcgtacacggtattgacgcggacgctttggaagcgaagctcaacgcttatctggagagcaaataaggtttacaggaagcggcgcaatgttgcttctgaaatatcaattcacgaaatcaaaggagaatcagaaatgaaaaagtatgtatgcacagtttgtggttatgtttatgatcccgcagcgggcgatccggataacggcgttgcacccggcacaaaatgggaagatgttccggcggattgggtttgcccgatgtgcggcgcggacaaatcggcattcgaagaggaataagacggaggggtatgtatgagcgctcaaccaacgaaaataatggacggcatctggtgggtaggggtgcaaaaccccgaactgagaattttcgacgttattatgaggacggaatggggaacatcctataattcctatcttgtaaagggcgcggaaaagaccgccgttatcgatgctgtaaaagcgggattttcagacgaacagcttgagaggatcagcgcggtcgtagatcccaaaaccatcgattatattatatgtaatcacacggaacccgaccattcgggcgcactcatcaaattgatggaagttgcaccgaacgcagtggtcgtatgttcccgtccggcaaagatgctgatcaaagagatcatcaatcgtgatttcgaatgcattcttgcgggagacggcgcaacactagacctcggcggcaagacgatcgagttcatctcggcgccgtacctgcattggccggattccatctttacgtatgtaaaggaagatgcgttcctctcgtcgggcgacgtattcggattccacttttcagctccgcagatttttgacgatcttacgaagctggatgcgaacatgatctcttctcaaaagtattacttcgatgtgatcatgtcgcctttcaaaagctacgttctggaagcggtggaaaagatccgtaacttaaagatcgacgtgatcggaccgtcgcacggacccgtgctgaggcaggacccgtggggggccgtcaagcgttacgaaaactggtcgataccggtgatcaacgatccgagaaagatctacattggttatgtgacctgctacggttacaccgcttgtctcgcggaacagctttatgcaggcgccgaccaggacggcgtggaagtggagatcgaagatgtttccaaacttccggcaggagaggtcgcggcaaagattcaggcagcagacgcttttgcgctcggctcgcctacgctcaaccgcgatgcgttaaagcctatatgggatgtgatgtcctccctctgctcatatgtggtcaaaggaaagccggcggcggttttcggtacatatggatggagcggggaagcctgcaagtatatgagcgaacgcctttctaacctgggcgtcaaagtgatcggcgaagcaaaagcaaagctcaacccgaacgaggaggaactcgcggcggcatatgagcttggagtggagctccgcaaaacagtaaaatagtaatactaagaaggaaaagccaccgtaaatattgcggcggcttttttgttttatagcggtatataatatagaagaaagcggcttaaaaaagaaatacaataaaaaagtaaaataaaagtaaaaaacttgttgacatggggaaggtagtttggtattataaataagccgcaaaaaacgcggcg

SEQ ID NO: 6 - DNA, 184489 bp, Christensenella sp.
  misc_feature (86959)..(87055): n is a, c, g, or t
gtactataatagtattaaataaagaatttttgcgcgatttgtatatgagtgcaaaacaacataaccaatcattgaaattctaatatttttacaaatgaggtaagcgggtatgacgaattttccttcaacgtttgaagcaaaagagcagattcttgaaattggaagaagaatgtatcagaaagggttcgtagcggcgaacgacggtaatattagctgtaagatcgctcctgacgtgatccttacaacgccgacaggcgtatcaaaggggtttatggaccaggatatgatcgtaaaaatgactttagatggtgaggttttatcgggcgacggcaaatataaaccttcgtcggaagtgaagatgcatattcgggcttataaagaaaatcctgagatcatggccgtaacgcatgcgcatccgccggttgcgacatcgtttgctattgcgggcatcggcctggaccagccgattctgaccgaggcgatcatggggctgggaagtattccggtagccaaatacgctacgccgggaacgcaggaagtaccggattccattgcaccgttttgcagggactacaatgcggtgctgcttgccaaccatggcgcgctgacatgggggacaagcctgatgcaggcgttttacagactggaatctgtggaatattatgctacgatcatgatgtatacgggtaatattattgggaaggcaaacccgttgagttgcgaacagatcgcgccgcttttggaaacgcgcgcaaagctgggaatccacggcggcggagttccggcgtgcgcggtgagtacaacgaacgatagggatgtattgcctgcgtccggcccgcttggtggatgccagtgcagcggagataagagtaagacagtatacggcggcaatgcggaaacgcagcctgtttcccagccggcagactgcgaaattgatcacctgatcgatcaggtgacaaaagagattttggcaaagctgaggtaacggccgtttctgaaatcaggaggaatacgggttgaaagtaattgtagcaggcggagtggcggcaggaatgtctgccgcttctaaaattataaggatgcaaaaggacgcgcagatcaacgtctacgaaaagggggggtatctttcctatggggcgtgtgggctttcttattacgtcgccggatataatgacgaccatactaaaatgattgcgcgttcgcgcgcggcgtttgaaggaatgggcatcaatacatttttgcatcatgaaatcattgctgtggatacctataataaggtagtgacggttaaaaacctgaaaacaggcgaaacgtttaaggatgtctatgacaaattgatgatcgggacaggggcggcagccattaagccgccgattcttggaatcgagaaaaagggtatttatgttttaaagactatggaggacggcctgcgcttaaaagaagttgtagcgggatatggaatccagaacgttgtggtcgtgggcggcggctatatcggaattgaagttgtcgaagcgatgcatgccttgaagaaaaatgtcgtttgtatcgaagcggccgacaagatattggggccttttgacgaagagattactgcgatcgccttaaaagagttgcaagacaagggaatagaaatccgcactggcgaaaaggtgatggaatttcggggtcctgaaagcgtcaatgaggtcgttacggataaaggaaggtacattgccgacttagtagtagtttctgcgggcgtacggccgagtacgcaattccttgaaggaacaaatgtagcgctggaaagaaatggcgctgtggtcgtggaccgtgaaatgcgcacatcggattctaatatctttgcagcaggcgattgtgcgatggtgtatgaccttaccaagcaaaaaaatgtttatttaccgcttggaacggctgcgaacaagtgcggccggatcgcgggaaccaatatttgcggcggacacgatgtgtttgtcggtatgacaagctcggcggcgctcaaggtttgcgatatccagcttggacgcacggggcttggggagcgtgaagcgatcgatatggggtacacggtcggcagcgtgacgattgagggacgaaatcatccggcgtattttccggggatggaacccctgaccgtcaaagtgatttatgaaaagccaagtatgcgtatccttggcgcgcaactggccggtaaggatggcgctgcgctcaggacggacgtgtttgtcgtagcaattaacgctggcatgacgaccaggcagctcggtatgaccgacctgatttattcgccgccgtatgcaggcgtatgggatgcgatccaaattgcatgcaatgccgcaaaatagacgaggtatattgtgggaaagattatgaaattgaaagacgctgccagcttggttgaggacggcggtgttcttgcgataggtggtaatgtgctgcatcgtgcgcctatggcgcttgtacgggagttggcacgccaaaagaaaaaacagttgaagcttgtaaagaccgcgggggcaatggatgtagatctgctttgctttgcaggatgtgttgaaagcgtagatgcgggctttatcagctatgaatcaaagtattcgcttgcgaaccattatcgttatgctgtgcaaaatggggatgtaacggcgcatgagcatgcatgttataccgtcatatcggccttgcgggctgcgcaggcgggtattccgtttatgcctgtcaaaggacttatggtgagcgatctaatagagcgaaacgattattttacaaaaatcaatgatccgttttcgatggaggaagtaacggtggtacgcgcgattgtgccggacgcctgtattttgcatgtcgaggaatcggacgaactggggaatgcgattataacgccgcctcttttcgaggatgtactgatggcaaaagcgtcgcgcaaggtaattattacaacagagaaaatcgtgcccacatcacagctaaggcgagaaaacgaccgcgttatgattccccattttcttgtcagtgccgttgtaccggtcgaacaaggcgcgtccccttgctcctgctatccgttatatgatatcaacggacgggatattgaaaagttcaggaagctaaaaacgcaggaagatctggctgcatggctgaaatcttatgaatacgcggacaatacgtcaagggaggtttactaatggttgataaaataagcgaaccggcccgagactatacgatcgcggatctgatgatatgtgccatggcgcgtctaatccaaaaccacgaaactgtatttcatggcgtttcctcgcatatgcccatgctcgcattgctgcttgcgaaaagtatgcatgcgcccgaggctgtttatcttaacatcccgggaggtgttgatccggatgtggtaaaaatcaaagactataccagtgcaggcggggaactgtgcgaggatgcagaagcgatatttcctttacaggacgtatttgatctttccatgcgggggggacttgacgttgcgtttttgagcgggatacagtttgatatgaatggaaatgtgaatgcgtctgtgattggtgattataaacgccccaaggtgcgcatgcccggcggggcagggagcgcggtgcttatcccgacaaccaaacgcgcaattatctggcgtactaagcatgatacccgaacgtttgtggaaagggttgattttgtgaccacgcggggcaatatcgataagatcgtgacaccgctttgcgtgttccggttccggcaaggaaagcttgaacttgatacggtgcatccaaccacaacgtttgcgaatgtgcaggaaaataccgcatttccgctttcagaaaatgcagtaggcgtaacgcctgcacccacggttgatgagatcgctatattaaaccggatcgacccgcaccagctcagggaaatcgaatttacaaaataaagaaggaaatgaccgcgcctttccaggaattgaagggcgcggttttctttatattgggagtacacaaattagaaattttcgtgtataatgtaaaaagacacacatttgttatatttttgtaatgactgtatgcataggtggtttggggtaaatatgaaaaaaaaatatttcaaaaaaagaaattactatggctggtcatatcgtattaaaaatttcttcaaggatttccggttaaactttgcgagaatgtccaagaaaaagaaaataacgacatatgccgggactgcggctgctgtggtggtcgtggcggtattgattttatccctgaacggcgggttgcctactatggcgtttggctctgatgatcaggaaaagcagggagtggttgtggatgcttccgtatcggcagcgcctacgcctgtaccgacaccggagcctacacccacgcctacgcccgatccgacgcttaaggaaggtatggaaaatgaagaggttgcaaagctgcagcagaggctgatggaccttggttttttgcagatcgacgaaccgacgaactattatggtcctgccacaaacctggcggtacagtatttccagcgccagcatggattggagcaggacggcgtcgcggggccgctgacgctcaatatgatttattcaaatgacgcaaaaccctatacactgttgcagggaacggaaggcgaggacgtagaaagcttgcagagccgccttaaggagcttggttatttaggcacgatatcgggttattacgggacggatacgatcgaggctgtaaaggccttccagtcgcgcaatgaacttggggttgacggtaaaaccggagagatgaccttaaacctcatttattcaccggatgcggaacctacggaagaaatgaaaaaggctgtccagcgcaaggggaacattgatgcgtttatcagtgctgctgctgacaagcttggctgcaaatatgtatggggagcgcaggggcctaatacgtttgattgctcgggtctcgttacttattgcctgcgggaagcaggatcaacgacaggacgttataacgccgcgggattttcccagaacagtgcctgggaaaaaatatctttcgataacctgcagcgcggcgatttgattttttatacaaacaacgcggggacaagggtcggacatgtaggtatcgtaatcggagacggaatgatgatcgacgcctcgtcttctaacggtaaggttgtcgagcggacatacgattcttcctattggcgcacacattttgtctgtggccgccgcccttggtaaaatattgtaatattaatttagaaaaccggaacattttaaatgtatgttacgtctaaattacgaaatgtaaaataacggatatgaaaagtttcattccatgtttttttgcgaatatcaatagaagcgggaacgattatgacgtgcaggcagtgcaaaaatttaattaatgaatatattgatggaaataccggactcagaaataagatcatgagccacatttcctcttgcccgcactgcgaaaaatattaccggcaaatgatcaggatgaaccgctctttggcacatcagccaaggcagattgttccggaagaatttcattattcatggagaaatgaaattcaaaggcatcccaaaaagaaacgtttccaatataagattttgattcccgcgctggcgggggcgctttgctgtgtttttgtgatcaccgcttttgcgacaggtgggttcacaatccattcacaaaacggtgttatactggaaggcgcaaagcaacaggccgctgctgcggagcagggttctgaggaagcggacgatgcgggacaggacgccgttatgccggaagcggcacaggagccgcaggtgagcgaagaatctgagctgacggaaagcactactaattcgcaggcaacttcttcttcggcggataacgcggtcccatcgcaatcgcaggcacaggctaccgataaggcacaggcggcatcagggcgcgcggctcttttggatgttgcgcctgaaaaaatacaggcggacagtacagtggacaagcagacgctgttgcaaaaagcggctgatctggcgataacgatacaggaaaatggcaatagcatattgctgaaagatgatggaacagataaaatcgatacgctcttaaaagaatttggattaacccgcaaaaatagcggaacagatgttgaaattgtttttgcataaattttgtctttgaaaggattggttatgcagtcaaaggaatatgaaagcaaactccggtatatgatcttaacgatgcctgaggtgatcaggacggcgccagggataaaaatatttggcaggacgcttaagtccttcctttttgcaacagatacttccctcatcaaaaatacggatgcggacgcagtcatggcggtgtatccgtttcctccgcagccagcgatcaatcaggcgattctgcagacggcgagtattcccgtcatgtgcagcgtgggcggcggggaagtagaagacgaccgcgtgctccatatggcgatggaggcggaatggggcggtgcctttggggcggtactaaatcccacggcggataatgaattggtagcgaaattaaacaaacggatcgatattccaacggtggtaacggttgtatcggaaaaagaagaccttgaacgaaggatcgaaagcggcgctgatatactcaatgtgtcaggggcggagaacacttgcaggatcattgagcagatacgcaataagtatccatatgttccgattattgcgacaggggggccgacggacgaaacgatccgcgagaccattgaatgcggagcggatgcgattacttatacgccgccgtcaaatgcggaattgttccgcatgacaatgcaggtttacagggaaaagctgcaactgccggaaacatgaaaataagtgtattaaaaaactccggtttccggagttttttaataccatgaattttgtttacttggtgaattgccccgttgcaatgccatatataacaaatacggcaagaaaaataacaagcccgatcagccagaacttgacgaacgtacgggtcgaaagaccgagcttgcgttccacggcacgctggatcagcataacagctgcaaatacaatgacgaaaagatattgcagcaatacattatccgatgtggaaccaaacgtaatacacagccaaatagcggcgcccgatgcgattcccagaatggcctggattacattgatcgttttctgtgaaaatttagatacgtgtgtaatgacaggaagttcttcatcttcctcgtcttcggtgctttctacctctttatcttcgctcacagctatttctgtttcaggctgaacggaatcctcgtttttttcttccggctcttccgtaacatcctgatcctgttccaatttttcattatcagcttcactcatgtccatacatacctcacaattttgttatttgtaacaatattgaatattatatataatattccgatgctctgcaagaatttccggcgaacaataaaaaaagatttcctttttacctggatatctgttaaactaataatgtacttttccactcgaattttgaatttaaagacttcacataaattatttcatttggaggtctggttatatgaaagaatacaatccacaggacatcttgaacatagctgttgtcgggcatggcggtgaaggaaaaacgacgcttaccgaggcaatgctctttgattcgggcgcaacggagcgcatgggcagagtcgaggatggaaacactgtaacagactatgacaacgaagaaaccaaaagacatatctccatcggtatgggacttgctcctattgaatggaaaaataaaaaaataaatttgatcgacgtccccggctactttgattttgaaggggaagctgtggcggcatatggtcttgcagacagcgcattgatcgttttgggaccgaatggggtcgttccggttggcacacaaaaggcttatgattattgtgtaaaacataatattccgcgtgcattcgtgatcaatcagcttgacaaggagaatacggattttgtcaagacggtaggagcgcttggaacaaaatatggcgcggcggtcacggcggtgcagatgccgattatgaataacggtaagtttgagggcgttgtagacctcatcgagttaaaggcgtatgtgtttgacggaaagtccgtaaaaccggctgatattccggcgaatatgcaggatgaagcaacggcgttgcgcgagacattggtggaaaacgcggcgggaaatgatgaagcgttgatggaaaagtttttcgacggccaggaattgtctaaagaggatattatgagcggcctcagggaaggaattatgcaagggacggtcgctcctgtttttgcagtggctgccgcacttgatttaggcgttggcgttttgatggatgggcttttgtcggtgatgcctgcggcatcggatatcctgccgatccaggcagaagatgcgagcggaaaaaaaatcgaactgaaaagggattcggcggctccgtttgtcgcgcatgttttaaaaacaattgccgatccgtttgtagggaagctgtctattattaaagtagtacaaggcacgctgacatcggacatgtccgttaccaacggcaataccggaaaaccggaaaagtgttctaatttgggtgtaatgcgcggtaaaaagctaatcaacataggaaagcttttagcgggagatatcggcgcgatcgctaagctgcagaatacggctacgggcgatacgctatgcacgggagcctgtactttgcgctttgttcccattgcgtttccggagccttctatttcccttgctgttacagcaaagaaaaaaggagaagaagagaaggtgtttgcgggactgcaccggctcgaggatgaagatccgacatttaagctggtaaaggatacggaaacgggtgatatgcttgccaacggtatgggtgagatgcacctggagatcatcaataataaattgaagagtaaattcaatgtggaaggcgaactgcacgatccgcgtattccgtacagggaagcgatcaaaaaaacggtaaaggcacaaggtaaacacaaaaagcagtccggcggacatggacagtacggtgatgtctggatcgaattttcgccggtgccggatgggcttgcagacttcatttttgaggataaaatcgtaggcggcgtcgttccgcgccaatatattccggctgtggaaaaaggacttaaggaaagcattaagaaaggcgttctggcgggatatccggtcgtaggccttaaatgtactttatatgatggatcgtatcacacagtagattcgtcggagatggcgttcaaagtggcggcgaaccttgcttttaagaagggtattgcggaagcgaatcccattcttttggaacctattgtaaaagttgtggtaacgataccggatgagtatatgggggatattatcggggacctgaaccgcaggcgcggcaggattctgggaatgaatccggttgacggtgtgcaggaggtaacggcggaagtacctatgagcgaaatgtttaaatacgcgacggatcttcgctccatgacgcaggcgcgcggaagctttaggcagacgtttgagcgctatgaagaggttcctgcgcaaatggctgataaggtcattgcacaggcaaaaaaggatatggaagaataaaggatacgggatgcttcaaaagctgtgccattttcaggcacagctttttcttttgtcaaaaatcttatgatgcgaatgtgatttttttttgcttttgtggtaaaatgaatataacaaatttgaatttttaaaatttatatatatggagtgctgtaacatgaggaaaacaaagattatatgtacgcttggccctgcctgtgaagatgaaaatacaattgaacgcatgatggaagcgggtatggacgttgcccgctttaacttttcgcatggggaacatgatattcagaaggaaagaatcaaaaaaatccgaaaaatcagtaaaaagatgggacggtatatctcctgccttttggatacaaagggaccggagatccggatcggccagtttaaaaatggctcgattgagttacacgcaggagatacgtttactttaacttcacgggaagtcgtaggggatgaatccgttgtatcgatttcctttaaaaatttgccgcatgatttgaagcaaggggcagttgttttgatcgacgacgggttgatcgaattgcaagctacctgcattaccgatacggatattatatgtaaggttctaaacggcggacgcctgggggacaggaagggcgtcaacgtgcctgggttctccatctcgcttccgtacatcagtgaaaaagacaggtccgatatcgtgttcggtatcgaaaacgagtttgattttatcgcggccagctttacgcgcaccgaacaggatatcctggatatcaaaaaaatactggacgaacaccagaaccgaagcattcgcgtgattgcaaagatcgaaaacgccgaaggcgtacgcaatatcgacgatattttaagggtatcggacggcattatggttgcgcgcggcgatatgggcgtggaaataccactggaggacgtgccgatctaccagaaaaggctgatcgacaaagcctattcagcaggcaagattgttatcacagcgacgcagatgcttgacagcatgatgcacaatccgcgtcctacgcgtgcggagacgacggacgtggcaacggcgatttatgacggtaccagtgcgattatgctttcgggagaaacggcggcgggaagctatcccgtggaagcggtacaaacgatggcgcgtatcgcgcgcagggctgagcgggacattgattataaggcgcgctttgaaagcaacgatatcgcgtgcttttccgatgtcaccaatgcgatatcgcatgcggcatgtacgacggcgtatgaccttggcgcgtcggcaattatcacagtgacgaagacgggtacgtcggttcgcatgacgtcaaaataccgcccgtctattccgatcatcggctgttcgccggatccgattgtttgccgacagctcagtatgtcctggggcgtcgtacccttagaggtagagcagaaggacaatacggatgaattgtttgagacggtcgttgatacggcgaaacaggcggggtatttgaagaatggggatctggtcgtcattatggcaggcgtgccactggggatcgcaggaacgacgaaccttttgaaggtgcatatcgtaggcaatgtgctcgtaaagggcgtgggcgtcaataatctgtgctcatccggaaatctttgtgttgcaaatacggaaaaacaggcgcggcagcttttcaaacgtggcgatattttggtcgtgcccaaaacgtctaactatattttggatttaatgaaacaatcttcgggtattataacagaggatgataatttggattcacatgccgcgatcgtaggtatggcgctcgatataccggtgctggtgggcgcagtgagcgcgacacagatattaaaaagcggaacccatatcaagctggatgcggaacgcgggctggtatgtaatgaaaatcgtgaggactaattgatatttatgctgaattttaaacctttggagcttgaggataaacctctttttgacagctttgtactgcacaataactacaggcattcggaagcatcgttttccaacatgtatacatggcaggaggcgtgggatatacagatggcaacatatgaagacgcattgttcatcaaaatgtatagcgatgtgtataagccgtttatgcttccgccgtatttgaaggatttggatgagtccattgcgccgtatatgcagatatgcgaagaatatatggtgaaggaaaacggcgttttttacatcaaatgcgctacgccggagatggtggaaaagatcaagaaggattgcggagaccgctacggctttgcatacgacgaatataattccgagtatgcatataatgcggaggacctgatcaacctgtccggcaaaaagtatcattccaagcgaaaccacgtaaacgcatttttgcgcgattacgacagtacttttgaattgtatgacgaccggtaccgttcggagtgcctgaatttacagatcgaatgggcaaaggaaaaagatgcagaccccagggaagcggaagaggaacttttgtctatcacaaaggctctggatcactggcgtgcactgaatttccaaggatgcgttattaaaataaaaggagaagtggttgctttttcatttggggaacagatcaacgatgatacggcgattatccatatcgaaaaggcaaaggctggagtaaacggcctttatgcttatgtaaaccatgaatttgttaagcgcgtatggtcgaactgtaaatacatcaaccgcgccgaggatatgggtgtaccgggcatacgcaaagcgaagaaatcctatcatccggtttttatgctggaaaaatacgatgtgttgttgagcggagaagaaagatgacaatccgtccgttgcaaaaattcgaggaaaatgttgcaaagcaggtttggaaaatctgctttggcgattcggatgcctttatcggccaatatttcgatagttttgtcgattatggcagcacgcttggttattatgaggataaccgccttttagcagacctttttatgctgccgttctgtgtaaaacttcaacgaagggaatatgcagcggactttctggccggctgtgcaacgttgccggaagcacgcaaacgcggactgatgcgcgaactcgtcaagagcgctatgaaggacatgagggcgcgcgggcaatgcgtaacctacctgcatccgttcctgcatgcgttttacaggcaattcggatacgaaacggtcgcttatgtacgccgcgcggctatgcaggggcaaacggcagacgacaaaaacgtatatattcaatcgaatctgcaggatgtaccgtggaaaaaattatcaaatgcatataacgcatatatcgctaagtacgataatgcctttataaggtccgaagaacgtttttcaggatggctcgcgctgttgtttgcggatggcgggaagtgcgcggtgctccaagatgcacagggttgcgcgtatgcgctttactatgtggaagacggcacagcggatgtattcgaaatcgtatgcgaaaatgaggcgcagcgggataaactactgaagggaattccagaaaaaacgatacggtattttgtaccatcggcaaagggcgagatagaggcggaggagtttacaatgatgcgtgtgctggatcccgtaccagtgctaagcggggtgcacataaagcgggatcaatttgtaatcggcattgaagacggctttttagaaaaaaagtataattttttgattgtgcgcggagcggatgggaacaacaaagtattatcttccgatgcacctgcggatattgatttatccattgcggatttagcgagagccgttgcaggcgctttcgaaccgaacgacactttatctggctttttcgagagacaaacagcttgtttttttgagacctattgaggttttggaaatttggcagggttgctcacttgcattctcaaccaaataggtctattatagtatatattttatggaagacaaggatggcgcagccgttatgtggggaatctttgtagggattgggcttggagtcctggagattgttattttaaagaaactcatcaatatgatgacccagacgcgcagttctgcggtaactgcggtgcccatcacgattttgaaactggctcttatactggtcgtgcttttcttgatggccgagtttgtttccttggaagcaatgatatggtgtgccgcaggtaccgctgttgcgatgatcagtattccggtattcgaaagcatttcaacgattaggaaatataaacatcagcagcatggaggtgagcaaaagtaatggatatacccagtgtctttcccagcaaaatgacgatatttggcgggatacaggttagtcagactcttgtcgctgcatttggtacaacgatcggtatcattatttttgcacttatttttcgttttgtgattttgaaaaactttaagcgcgttccaaaagggttccaaaatgtaatggagttgatggtcgacggggtgaataaattttcttcatcgatcatgggtgataaggctaaggcgattgctccttatattttgacggtctttgcgttcattattttgagcggcgcgctggaatttctgggcattcgttcccctgcaactgaccttgactgtacgattgggctggcagtgattacatttatactgatcattgctttttctattcgttataagggagtgaagggctggttaaagacatacgcagaaccaaagccgttcatggtgccgatcaacgtactttcatcgttggcggttccggtatcgctggcatgccggctgttcggcaatatgttcagcggacttgtggttatggatatgctgtatggcgcgctggggtattttgcaatcggcattccggcgctggcgtcgatatattttatcctgttccatctggggatgcagtcctatgttttcacgatgctgacgatgtcttttatggaagaaaagctgtaatcaatgtttataaactgtgccatgcacagtttaaaatatttcatatttcaatgtaataaatggaggtagaaaaaatggatatgggtttaatcgcaattggcgcaggcctcgctgtttttacaggtatgggcgcaggtattggtatgggtatcgctacgagtaaggcttgcgaagccgtggcacggcagccggaagcgacgggtaaaatcaaccaggtacttttgatcggtctggcacttgcggaatctaccgcaatttatggtttcgttatttctattattatgatctttacaatgggaaaataacagaaataaaacaagacactctgagggattggtatggaaatcaatataattgaaatactgctgtatatcgtgaatattgtgatattatttttctttttgcggtggttactatataagccgattaccaaatttttggcgaaccgcacgaatgaaatacaaaaacaggttgacgaagctgcgcaaaaatactcggatgcggagcaattaaaggcgagatacgacgaaatgatgcataacgcacaggatttggcgacggaacttatcaataagggtaagaacgttgcagacgaacaggcgaaacagatcgttcaggatgcggaagaagcggccgaagagatccgcatgcgtacggaaaagcatatcgaatcgcaaaagcagcaggcagtcatcgagatgaggcaggaagtgaccaaaatggcgatccagattgcagaaaaggttttggagcgcgaagtgtcgtacgaggataataaaaatattatcaacgaattttttgagaaggtgagttaacatttggaattgaaagggaaattggtttgtgcaactgaatttactcccgatgaaatttctgcaattgtcacgaagtttgaaaagctttttgatgcgaaaatagattttacggtcaagatcgacccgacgctcatcagtggttttaccgccacgatcaataatatggtatatgacctgagcgcaaaatcgtatctcgacaggatgcaggattatatcggggaccattcgggatatcaaagcaacgaaaaaatagaagatatcattgaaacgctgaaaaacaaagtaaacggagaactgaaggaaagttctatcggaagcgaactggaaaagaagatcacgcagtatgacgtgaagtacgatatttccatgatcggtatcgtagaacgtacgggcgacggcgttgtttttgtacgcggtcttgacggttgtaaatatggcgagcttttgcagttcgaaaacgaagcgtacggtatcgttatgaatcttgaacttgaccgtgtgggcgcagtgctgttaaatggcgttgcggacgttacggaaggttctatggtgcgccatacgggcgacgtcgtaaaagttccggtgggcgatgcggttttggggcgtgttgtgaatccgctgggacatccgatcgatgggaaaggcagtattttgacggatgaaagccgcccgatcgaaacgcccgcgccgccgatcatcgacaggcaatcggtgaatacgcccttgcagacgggcattatggcgatcgatgcaatgatccccatcggcagaggacagagggagctcattatcggcgaccggcagacaggtaaaaccgcgatcgcagtggatacgattatcaatcaaaagggtaaaaatgtaaaatgcgtttatgtcgcgattgcacaaaaagcatctacgattgcggaaatcgtaaacaggctagacgaatttggcgcgcttgactatacgtcggtcgtcgcgtcgacggcaagcgatactgccccgatgcaatatattgcgccttatgcgggatgcgcaatcgcagagagctttatgtatcgcggggaggacgtactcatcgtgtatgacgatctttccaagcacgcggttgcatacaggacgatgtccctgctgctgcgcaggccgccgggacgcgaggcatatccgggcgatgttttctacctgcattcgcggcttttggagcgcgcggccaagctgtctgaaaaactcggcggcggttctatgacggcgcttccgatcatcgagacgatggaaggggatatttcgtcgtatataccgacaaacgtcatctccatcacagatggacagatatatctggaaacggaattattcaactcaggtcaaaggccggctgtaaacgtcgggctttccgtatcgcgcgttggtggcagcgcgcagattaaagccatgcgcaaggtcgcagggccactgcgcttagagctggcgcaatacagggaactggaagtattctcacagtttgcttccgaccttgataaggcgacgcaggatgccctcacaaatggcctaaaagtaacgcaggcattgatccagccacagtatgcgccgtattccgtggaaaaccaggtaatcctgctttgcgttgcaacgaataagcaattgatggatgttccggcggacagggtgcgtacatttaacaacgattttttggattttgtgaatgcaaagtatccgcaggttaaaagcgcgatcaaaaagacgggacagctatcggacgaggatgaaaagctgatccttgatgccgcagcagaattcaaacgtggattcttgcaggaaaaagcggaaaaggatgagtttccggtagctgaaaatccggaaccgaaagtgagtgtggatacacaatgagaagcacggctgacgtaaaaaacagcatgcacgcgatcaatgataccagcaagatcacgaaggcaatgaagctgatcgctacttccaagatgaaaaaggcgatctcacgctacgatgcgaatttgttgtatttcaaccgtgttcggagcgccatcaaggatatattggtgcattcgcatgaattgcatcatacctttttggaaaagcatgagcaggggagtccggcttatatcgtgattgcggcggacaaggggttgtgcggcggttacaaccataacatcctgaattttgcgcatgattttatgacggacggggataagtttgttattacaatagggcaggaagcgcgcgctttttttgagcgtaaaggcgtaccgatcgacgtggaatatctgcatatttcacagaatccgacgctttatgaagcgcgtaacctggcatccgacctctcgacactttataaaagcggcgagatgaacgaggtctacctgatctatacgcggtatttttcatctgttaaacagattcccacggcgctgaaattgcttcccgtggaactgcatgaattcgacgatatcgaaacggagcttgactatgataatgaaatgaattattatccgtcgcccaaaaaggttttcgatatcctggtgccgcaatatatcatcggacttatatacggtgcgctcatacaggcatttgccagtgaaaacagcgcgcgtatgatggcgatggacgcatcttccaagaatgcggatgaaatgctcgcaaagctggggatcgaaatgaaccgtgcgcgccaggctgcgatcacgatggaaattacggagatcgtgggcgcaatggacgcattaacctaagaggagttatgacctatgtatgattataaaattgtgagcgaaggcgagatcatcaagatcacgggacctgtcattgacgtgcggttcgaggaaaatgccgatccctccatcaatacgatcctttatgtggaaaatgaaggcagcaaccggatctggatggaagtggcttcgcaaatcggcgacaacgtggtacgctgtatcgctcttgaagcaacggaaggccttgcctgcggtatgaaggtagcaaacacgggcgaaccgatcaaggttccggtaggcgacgggatattaggacgcgtcgtcaacgttatgggcaaggcgatcgacggcatggaagatatcaaaacggaggaatattggcctatttaccgtccggcgccggatttttccgagcagaaccctgtttccgagatttttgagacgggattgaaagtcatcgacctgatttgcccatacgcacagggcggcaagatcggtctgtttggcggagcgggcgttggcaaaacggtgctgatcaacgagctgatccataatatcgccacggaaagtggcggctattcggtttttacgggggtaggcgaacgcagcagggaaggtaacgacctgatcagcgagatggcggaaagcggcgtgcttgagaaaaccgcgcttgcgttcggacagatgaacgagccgccgggctcgcgtatgcgcgttgcgctgacgggtcttacgatggcggaatacttgcgggacaaaacagggcagaacgtgctcttgtttattgataatatttaccgttttatccaggcgggttcagaggtttcggccctgctgggcaggataccgtccgccgtgggataccagccgacgctggccaatgagctgggggcgctggaagagagaatcacatcgacgacacatggttccattacgtcggtgcaagcgatctacgtaccggcagacgatcttaccgatcccgctccggcaacgacgttttcgcaccttgatgcaatcacggtgctttccagaagcgtatcggagttgggcatctatccggctgttgatccgcttgaatccacgtcgaggatactcgatccgcgtatcgtaggcgaggagcattacgaggtcgccaaccaggtagtgcatacgctgcagcgttataaggaactgcaggatatcatttccatccttggcatggaagaattggcgccggaggacaagatcatggtgttccgtgcaagaaagatacaaaagttcctttctcagccgatgtttgtggcagaagtctacaccggtatcaaggggaaatatgttccgcttaaggatacgatcaggagctttaaagcgatcctgtccggcgaagtggacgatctgccggaacaggcgttccacatggtcggcgatatcgacgatgtgaaagaaaaagcaaaggatatgaattaaaatggcttcggaattccttgtagaaatcttaacgcctgagcgttcgtttttttgcgataatgcgcagtccatcatttttccgacagaagacgggcagatgtccatccagaaagggcacgaatcggaagttgtgacggtggtaccgggcgaagtgaaaatcaataccggtaaaaagtggatgatatgttctgttgcggaaggctttttagaggtgcggcctgacgagacgatcatgtttacgcaggcggcggagtggcctgaggaaattgacgtcaagcgtgcggagcgcgccaaggaacgggcggaagagcggctcagacaaaggaagagcgcggaagaataccggcgtaataagatcgcgctcgcgcgggcgatggcgcgtcttagccttacaaagagaaagacgacgctataggccaaaagcgcgtatatttgcgcggcataaaaaaatatttaaaagacgaggcatgtaccccgtcttttttatcggcgggggaataagacaatgggaatgatcatgatgctgacaggcggtgcgcgcagcgggaaaagcgcatatgcgcagaaatttgcggcggactaccgcaatgtggcgtatatcgcgacggcgatgaatacggatgccgagatgcgagagcgcatcgaaaagcacaggcagcagcgtccacgggattggaagacatatgaagaaagttacgacctgaaacgggtcatcgatggttctgaacatgacgtatacctgatcgattgcatcactgtgtatatcacaaatttactgttggaagataggctggactgggagcagcaggaaattttgccgccaggggaacaaacacggctggagcaaaaaatcgaccggaaaatagaagaactgatggaagcgtgccggaaaagcagcgcggattttattattgtgacaaacgaagtgggaatggggctggttccggaaaattcattggggcgtttattccgcgatgtgagcggaagggtcaacaggatgctggcggagcaggcgcacgaagtatatttcgtagtgagcggtctgctgctgcccttgaaaggcggacaatgaaaaagttcggtttggcaatccagactatgaccggattgccgctaaaaaagcaatttgaggtaacatgccaggactatgcggatagcgttgcatggtttcctgcgacggcgcttttggttggcctcgttatgctcgtggcgtaccagatattttcttttgcgggcattccgtttttggcttcgtttgtgtgtgtaatcgccgccagcttgtttacgggcgggttacatgtggatggctttgcagatatgtgcgacgctttttttgctggtaaatccaaagaacgtactttggagatattaaaagacagccggatggggacttacggcgtgctgggaatcatatttgtggttgcaagcaaaacgatcctggcggcggcgctgccccaaagcaatgtgctttggattttgctggcaacgcctgtatgcggaaaaatcccgatggttttgtgcgccaaactgagcgggtatccgcgcagggacggcatggcgaaatgtattgtcgagaacctaaaaacaaatacggcgctgatcgccgtcatcgtgtgttcagtcatcgttttgttggtcagcggcttttacgcgggcacgattgctgtcgcatgcggggtcgcgattggggcgcttatgcacttcctttcgcagaaaaagatcggcggagcaacaggcgacgttctgggcgcgtgcaatgagctgggagagatcgtctatctgtttattattgcggtaatgatatgaagacggagatcactttcttaaggcatgcgcaaacggacgccaacataggcggaaaattcagcggccgccttgaccttcccctaaatgagacgggaaggaaacaggctgaaaacgccgcgaggcaattgcaggaaaagcattttgacgttgtcgtttacggcaaggcaaaacgcgtacgggaaacggcgcgggaagtgctggaccgtttggaaaacaaacctgaaacccttttgctgtcaggcgggatcagggaaatggattttggcgtgttcgagggaatgcattatctcgagatcgcggagcagtaccccgacgaatggaaaaaatatatggagaactggcaaacgtatacctttcctgatggagataatgtttcagagttttatgcgctgtgcagggaatggatcgatggtatcgtagcggaatactgcgggaaacgggttttgatcgttgcgcacaaagggtttatcctgaattgcttgtccgcgcttttgacgcaggatggatcggacgtacttgggagagagatcggcaatgcgcaaacgatcacgcttgagttgtgattatgccttaaaaaacccagaatagtgtttcttttttaacttggttgtattataatatttatgatttgtatgacggctcaggccgttttcattttaggagggtattttcgtggaacatattatctggaataaggaaatggagtgcgcagaccgtaacacaatcaggcaactgcaactggaaaggctcaagcatacggtagcatattgttatgataatgttccgcattataagaagaaacttgacgaaatcggcttgaaacccgaacatatccagacgttaaatgacctgcaaaaattgccgtttacaacgaaggatgatctgcgcgagaattatccgtatgggatgtttgcagtccctatgaagcaaatcgtacgggtacacggctcgtcagggacgacgggtaatccgacgatcgtgggctatacgcggcatgatctcgatatgtggactggcctcgtatcgcgtattgcctgcgcggcaggcgttacggcaaacgatatcgcgcagatttcgtttggttatgggctgttcacgggcggtttcggcctgcattatgggttggaaaacgtaggagcgagcgtgatccccgtttccagcggaaatacaaagcgccaaattaagttcatgcaggattttggcagtacggtgctcatcagtacgccgtcttatgcgctttatctaggggaaacggcgcagagcatgggtattgactttaaaaagttgaaattgaggctcggccttttcggcggagaaggccataccaaggaaatgcaaaagcagattgaaaaatatttaaatataactgacacagaaaactatgggctttccgaagtcatagggccgggcttctcgggcgaatgctatatccagaacggtatgcatatcgcagacgacgaatttattgcagaagtgatcgatccggatacgggcgaggttttgccgatgggtgaaaaaggcgaactggtcgtgacgagccttacgaaggaagctttgccgatcctgcgttaccgtaccaaggatatcacgcgtctcagcgacgaaccgtgcgcatgcggtaggacgagcatgcggatggaaaaggtatccggacgtacggacgatatgctgatcattcgcggtgtgaacgtattcccgtcgcagatcgagggagtacttcttgggatggacgccgtcgctccgcattatgaaatcatccttacgacggaaaagcaccttgacaagatcgaggtcaaagtggaggttgcggacgaaaagctgcttatgagttatggcgcgctcgaagcgcttagggagcgtatcgcgcacaatatttttactgtgctgaatatgcatgtaaaggtaacgcttgcagaaccgcagtcgctcaaacgttttgaaggtaaggcgcagagggtaacggacctgcgcacaaactaatagatggaagaggaagcagaatagatgaagaagattatgcttggaaacgaagcgtatgcgcagggagcgtatgaaggcggcgtaaaggtcgtttcatcctatccaggtacgccgagtacggaagtgacggaaaatattgtcaaatatgaagaggtatacgctgagtgggcgccgaatgaaaaggtggcgcttgaggtggctgcaggggcatgctacggcggcgcgcggtctttgtgctgtatgaagcatgtgggactcaatgtggcggccgatccgcttttcacggcctcttataccggcgtaaatgcgggtctggtgattctcgtggcggacgatccggggatgcattccagccagaatgagcaggattcgcgtttttacgcgcgcagcgcgcatgtaccgatgctggaaccgtcggacagtatggaagcaaaagaattcatgaaatatgcattttcgttaagcgaaaaatttgacacgcctgtccttctgcgttccaatacaaggatttcgcattcgcgcggcatcgtagagacaggggagcgcgcagaagtgccggtcagagattaccggaaggatatcaaaaaatatgttatgatgccgggaatggcaaaagcgcgtcacatcgtggtggagcagcgcatgaaggatttggaagcgtttgcagacgactgcgggctgaatcagtcggaatattcaggcgatgaaatcggtgtgatcaccagcggaacatgttacaactacgtgaaagaagcgctgccaaatgcaagcgttttgaagctgggcatggtatatccgcttcctaagaaaatgatcagggagtttgcttcaaaggtaaagaatttgtacgtgattgaagaactggagccgttttttgaaaaccagatccgcgtaatgggtttgcccgtaagcggaaaagagttattcacactgcagggcgaatattcggtcaatatgatcaaggaaaaaatatgcggggaaaagtgtgatccgctcaaaattgaggcattgccgatgcggccgccggtgctttgcccggggtgtccccacagggcggtttattatatgttcaataagctggggcttacggcaatgggcgatattggctgctatacgcttggggccggcgcacctttaaacgcgatcgatacgacgctgtgcatgggcgcttcgatcggcatggcgcatggaatggaaaaggcgcgcggcaaagagtttgccaggaaacttgtcagcgtgatcggcgacagcacatttatgcattcgggcatcacggggcttgtcaacatgctttacaatggcgcgacttctacggtgctgatcctcgacaattcgaccactggtatgacaggacaccaggaccatccggctacgggcaaaaatgccaaggggcagcctgcaccggcggtggatattccaaaattggtggaaacgataggcgtaaagcatatccatgtggtggacccattcgatcttccggcactggaaaaggcgctgaaagaggaaacagcacgcgaagagctttccgttatcattacaaagaggccgtgcgtgctaattgacagggcgtctgtcaaagacgcgttgtgcgtttcggatgagtgcaggaattgcggcgcatgcatgaagttgggctgccctgctattgtgaagggtaaaaacaaagtagatatcgacgcatcgctgtgcattggatgcggattatgcgcggatatatgcccgttccacgcgatcggaggtgcggcaaaatgaagagtattgtgattgccggagtaggcggacagggtactttgcttgcaagtatggtatttggccaaattgcattgaaactcggatacgatgtaaagctttcggaagttcatggcatggcacaaaggggcggaagcgtcgttacatatgtacggatcggcgataaaggcgagaaaatttattcgcctgtgatagacgaatgcggcgcggatatcctgcttgcatttgagcagcttgagggcttgcgctggctgccgtatgtaaaaccggacagcgggaaagtatactgcaatacgcagcaaattttgccgatgcctgtcattacaggcgtgatggcatatccggaagatattccggataaaatcaaggagcaggtaagcgacgcggtgtttgtggacgcgctttccctggcaaaccaggtggggaatgtcaaagctgtgaatacagtacttttgggtgtgttggccaaaaacatggagatcgacaaggaaatatggctggatgcaatacgcacagtcgtaaagccaaagtttgtagagatgaatgaaaaagcttttgaccttgggtataatttgtaaggagaaccgatatgttgatcaagcagatttccgtatttgtggaaaataaaaaaggacggctttaccatctgacgaagacgcttgcggatcacggaatcgatctgaaggctctcagtatttccgataccgcggagtttggtattttgcgttgcattgtaaacgatccgcaaaaggcgctgcagatcataaaagacgccggttttacggcgagtgtgacagaggtgcttggggtagaggtcgaagacgaaccgggcggattggcacgtttgcttgatgttttgaatgaaagcgatgtcagcgtagaatatttgtattcctttgtgggtacgcgcagcgacaatgcgctgatcattttccatgtggaagagctggacaaggcgcttgcgcttttgaaggaatccggttttaaaatactgacggaagaagtagtttataacatttgaggttgtattttgtataggaaaacatatgctcgaatccatcttgggaacctggaacgtaatatcaaaaatgcggcggctcatttaccggaaaattgcggggtcgtcgcggtcgtaaaggcggacgcttacggccacggcgcaatagaatgttctttggctgcaaagcgcgccggagcatgtatgctcgcggttgctttggcggaagaggcgatccctttgcgtgaagcgggaatcgatatgcccatcatgattatcggacgttccaattccgcgcagttgaaattggctgtggagcttgggctggaggcctgcatctttacgcccggcgaggtgctgcttttacaggaagaagcaaagcggtcgggtatgcaagcaaaggctcatttgaaaatcgatacgggaatgagccgaattggtttgcgcagctttgaagaacttgaccgctttgtggacgcgcttaaggaaagtaacaatgttgtactgagcggtgtgtttacacattttgcaaacagcgacgcgcaggataaagcgcatgcctatggccagcacgaactgtttatgcattacgtcgaaaaattaaataaatatggtcttaaccccgcggtccatgcggacaacagtgcagctgcgattgatttgccgcagtttggacacgacatggtgcgttacggtatttccatgtatgggtattatgcatcgccgtatgtgaagcgggagcaagtgaagatttttcccgtcatggatgtgcttgcggaaatttcccatgtaaagacagtaccggcgaacacgtgcgtcggttacgggagcaccttccggacggacagggagacaaaaatcgcgacggtgcagatcggttatggggacggctataaccgccttctttcaaacaaggggcgcatgattgtaagaacgaaatgcggagcgttttacgcaccgatcattgggcgggtgtgcatggatcaaacaatgctcgacgtaaccgacgtaattggcgagattacggtcggggatgaagcgctcgtattaggtgaagcggacggcaaacggatagacgccgacgaacttgccggtatctgcgggacgatcagttatgaaattctgctggatttcaatagtcgtgtgccgcgcgtctacgaggattgatggagaagaaaatgacaaagcaggaaatacgtgaaaaaatgctggatatgcgcagaagcctgacatcgaaatatattgaggacgagtcggcgaaggtaatagagcgccttctggcgttgcctgctttgaaaaaggccggaaacgttcttgtttacagcgattttgacagtgaagtaaaaaccgctgcattgacgggctggctgctttaccaaggttcccaggtatttttaccggtggtttatcaaaaagaaatgcatgcagcgaacatcaaaagcgcggctcttgaattgagctgttttggtgtagcgcagccaaagtatgaagaagcggagatcatcgacccgggaaagctggacatcgtgattgtgccgggcgtagcctttgacagggaaaaaaaccgtatagggttcggcggcggttattatgatagtttcctgaagcatgcgccgcaggcaaagaagattggccttgcttatgatttccaggtgctggaccaagtgatgccggaaacgcatgatgtaaaaatggatatgatcattacgccggacgagatagtcggatgacgcgtatcattgcaggggaaaaacggggaacgcaactttttacaccgcagggacaaaagacgcgaccgacgacggatagggttcgcgaagccctttttggcagcatccagtttgagattgccggagcgaccattttagatctttttgcgggaagcggcgcgcttggactcgaagcactctcgcgcggggcaaaggaagttgttttttgcgataggtatgaagatcctattgccatcgtgaaaaaaaacattgcaaaactgggatgctcgctgcatacaaaagtcttgaaaaatgactatattcatgcaattaaagtgtttcaaaatacgaaaaagtttgatatagtatttatagatccaccatataaaagcggatattacgctgatgtttttaagcatttggcggaagaaaacgttttgaaatgcggcgcgatactgattgccgagagcgaagagcctattgaaatacaggatgatagattttgcaactacaaaaacaagaagtatggaagaacgcatcttgcattcttcaggtggggtaatgatcaatgaaagcatgcgtttatccggggagttttgacccgatcacaaaggggcatttggacattatcgagcgggcaagtactatttttccggtggtatatgtcgggatactcaataatgtatccaaaaaatgtatgttcagtgtgcaaaagcgtgtggaaatggctcgtgcggcaacggcgcacattaaaagtgttgaggttctggccttcgacggcttgctggttgatttattaaaaaagctagacgcaaggattattatacggggacttcggacgggggcagatctggaactggagcagcagcttgcgtttatcaatggaaagcttttgccggggacggaaacattagcgttgctgtccaagccggaaacgcactttatcagttcaagtgcaataaaagagctgattgccttcggagcggatttttcagaatatgtgccaaaggaaatccttggtatgattgataaaggagaataacatgaagattttcgatttgattgacgaaattttggacgagatagaaaacggaagaaaatctctgtttggaaataaaaaaacgatagaagttgatttcgtgctggagattttgaatgaaatcaaagaggctctgccggaagaccttctatatgcgcaggaagtgctgggacacaagcaggagatcattaaccaggcgcaggaaaaagcgaagaatattttggatggggtagataaccgtttggcggagctgatcgaagaacaccgcgtgacacagcttgcttatgaaaagtctaacaggatgatcgatatggcgcagaaacaggcatacgagatccgcgttaacgcaaatgattatgcggtcaatgtgctggaagacctttcgtcttatatgcgcgaatatatggatatcattaaagaaaaccagtctaattttattaataagaagaacaaagaccaggcggagttctgattgttgtttaagacagcccaatgaaaggtataaaatctttatattttgcgatataaagattttttcatgtataggaggaaaatggaatggcgaaaaaagttggtttggcattgggcggtggcagtgcgcggggatttgcccatatcggcgtgctgaaggtattgctggaggagaagatcccgtttgattacattgcgggctgtagtatggggtcgttgattggcggcatctttgcatccgaaggcgatttgaacgcgcttgaaagcttggcgatcgtctttgattcgaaaaagtattttgatatcacattgaataaatccggttatgtcaagggaaacaaggttcaggacctgctcaaactgatgacgaaaaatatcaacatcgaaaaagccgcgattccttttagttgtatcgcgacatgcgtcgaagatgcaaaattgcatcgctttgccaaggggcctatccatgaggcggtacgtgccagtatttcgattccggggatttttacgccgtatgaaattgacggaaagacttatatcgatggcggcgtgatagataggacggcgatccgcgcagcgcgcgaaatgggcagcgatattgtgatcgcggtggatgtttcctatcgaggagagcctcttgaaacacccaagacgatcgtggaccttttgcaggatacgtttactatttccgaatggtacctgacccaaacgtattggaaagaagcggatgcgctgattcttcctgcgatcaatgacatcaaaggaaatgattataaggatacgcaagtaattattgcacgaggcatggaagcggcaaaggccgcgcttccggagatcaaaaaactccttgcaattaaatgaccaaaaacttttgtgtgaaatcgcgtcgagccggcgcgatttttttatgcaacaaagcataaaggtcgctcgcaagtatatccaagtcaaaaagcggattttcaggaaattccgacgccttggtgatcacggggatcgctgccttttttttcagttccgccaaaagatcgagtcgttcctttttgacagccagaacacgtgcgtacaggttttgggatgaaagatcatgggctttttgttttgtgaggccggtcatgatatagagcatgatgcgatggatgcgtgtttgcgtgtaacgtttacttttaaccatattgataaattcatcgcaagaccgcgcatcgcgcgccgcctgctgcaatttatattcaagaccctcggtcacctcgaaaatatcgccgatttgcataatgctcatgcttctcaggcgaaacagtacatatggaaaaacagcgtcaggagcaacgaaattatctgtatagaggggggttacagtatccggaatatcggatgtttttaaatgggacgtaccgttccgcagcagttcggaccgtatggcggcggcactggaaaaggatgcagaaagctgctcatcaccgtggtggctgccatgacggacaatattgacgggaacgatggaactgttgatccgtgataaagcctttaggtattcgattcccaggatgttatttggtaagcaataggtagcctcgtcgatatgcggacaacatgtcttcagcgcaattgaacgcgcggccggataggaaaggcccgcgctcaattgttctttgagaacattcgaaaaaggagcaggctcttcacacaggaacctggcaacacattgcaagtcgctgatattttcagattcgctgccaaaggaaagcagggaaacgcaatggagcgcatccagtatgttgaccgctccgcgcgcaaatccttccgcgctttgcgccgcataaaaaaaagggagttccaaaacgagatcggcgccgcccaaaacggcggcttgcgcccgcgtccatttgtcataaatcgccgcctgcccgcgctgtacgaaatgtccgctcataatacaaattgcagcgtccgtaccgtacaattttgacgtttgtaaaatatggtaggcatggccggcatgaaatgggttatattcagctataattcctgctattttcataaattccctttgcaaagcattgttttttatatataatatatgagtgtcattataacagagaaatcaatgttttgaaatataagaacaagaggtgtattgaaaatgtcattaatggacaaaatcaaagagaaggcgaaaacggtcagcaagaatatcgttcttccggagggaaacgaggcaagaacgatcgaagctgccgctaagatcgcggagcagggaatcgctcatgtgattttgctgggggatgaaaaagagatcgaagccgccaacacaaaaaacgtggatttgtcaaaagccacaattatcaatccggctacttcgccaaaactggacgaatatgcggaaatgttttatgaaatgcgcaagagcaagggtatcactttacagcaggcgaaagaaacctgtaaggataccctttattatgccgttatgatgatcaagatgggagacgcggacggtatggtttcgggcgcggtgcattcgacaggcgatacgcttcgtccggcgctgcaggttatcaagacaaagccgggcgtttctatcgtatccagttgctttatcatggatcatccggacaaaaagtggggagatgacggtgtgatgatctttgcagactgtgctatcaatatcgacccgactgcagaggaactggcggcgatcgccatcgcttcggcggatacggcaaagactctcgcgggtatcgatccgcgcgtggcgatgctttcgttctcaacgaaaaacagcgcgaagcatccgaatgttgataaggtgattgaagcgacaaaaattgccaaagagcttgcgccggatttgaatatcgacggcgagctgcaggcagatgctgccctgatcgaagcggttggccagcttaagagcccgggcagcaaagtggcgggacatgcaaacgtgcttattttccctgatatccaggcggggaatatcggctataagctggtgcagagattgggttgcgcggaagcgatcggccctgtcagccagggactggcgcgtccggtaaacgatttatcgcgcggctgcagtgtggaagatattgtatctgttgtggcgattacagcagtacaggctcaatctttttaaaagagtaaggggtatagtaaaatgacaaatgttttagtaatcaacgccggaagttcttcgcttaaatatcagcttattgatatggatacggaaaatgtgatcgcaaaaggcctggttgagaggatcgggatcgaccactctgtgatcaagcataagccttccggaaaagataatgtagcgatcgaaacgcctatgaaagaccataatgatgcgatggagcaggtcattaaggcgctgacagacccggtgcacggcgttgtagcagacctttcgagtatcaaagcggtaggacaccgtgtagtgcatggcggtgaaaaattcagtgggtcagtactcatcaacgatgaagtcatcgaagcgctcaaagagaatattgaacttgctcccctgcacaatcctgccaacctgatggggattgcggcatgccagaaactgatgccggaagtaccgatggtaggcgtgtttgatacggcgttccatgctaaaatgccccagaaggcgtttttatacggtattccttactccgcgtacacggattacaaggtaagacgctatggattccacggtacatcgcataaatacgtttcgcaaagagcggcagaaatactcggaaaagatatcaaagacttgaaaatcattacctgccaccttggcaacggttcgtctgtcgctgcggtaaacggcggtgtttccgtagatacgtctatgggctttacgccgcttgagggccttgtgatgggtacgaggagcggcgatcttgacgcagcgatcgttccttacctcatggggaaactcaacatggatgtggatcaggcgatcaattacctgaacaaggattccggcgtatgggggatttcaggcatttccagcgattttcgcgatctttgggcggaagaggaaaagggaaatgaacgtgcgaagcttgcgcttgatgtatttaattaccgtctaaaaaaattcattggcgcatatgctgcggcaatgggaggcgttgacgtgctgacctttgcaggcggcgtaggagagaatgactgggatgtccgcgctcatgcggtagaaggccttgagttcatggggatcaagcttaataaggaaaagaacgctggaatgcgcggcgaagaaatggatatttctgcggcagattccaaagtaaagattcttgtcatcccgacagacgaagaaatgacgattgcaaaggatacgtacgaaatctgctgcaaatagtccgtggtaaaaaagatattgacaagcaggcggcataaaaatataataatatggtagctgttttcttgctgaggaaaaattatgattgatatcgacctttcaattgcactgaaaaatgagggaacgacgtactcgtatgagtatcatgcagttcctgatttgggcaacgatatcgcatttcatgaacctctgcatttgcagtcggaatactgcgtgacggacaggcgcgtacgtgtgagcggaacgtttgctactgtcataaacgggcaatgcgaccgttgcctagaggagatggcctttgattttgacgggaagttcgacgaagtgttctttccggagaatgtgcagtgtgaagacgaatacacttatcggggagaaatgctttctctggataagatggtgtacgatattatcgtattaggcttgccgcaccagcttttgtgcagtgaggattgcaagggactttgcccgtcatgcggccagaacttgaacaaagcacaatgcggctgtgaaaagaatgacacggatgaaacaaatccgtttgcaaaattaaagggattgttttgaaacccagggaggtgtagaaagtggcagtaccaaagaataggacgtctaaacaacggaaacgtacaagaagagcgcattggaagctgactgctcctgctgtatcgcagtgcccgcagtgccatcagcctaagctggcgcatagagtttgcccgaattgcggatactacaacggaagacttgttgtagctccgaaagaggaagcggcaaaataaggttgtttttagaaaaggcctgtaaatgattacaggccctttttcatttattaaggctttaaatatgcaacattttcatgtatactatatttgtatttgctaaaagatttgcgagggaaagacatgaagatcattattgacgcaatgggcggcgacaatgcgcccgaagctaccgtaagaggcgcggtaaaaggcattaatgcttttgtggatgttgatatcacgctgacgggcgaccggaaacagatcgaagaaatattgagcggactttcatacgatgaaaaacgcctggaaatcgtccatacgacgcaagtgattgatatggaagattctcctgtcaaggtgttgaaggcaaagccggattcctccatgatcgtggcgcttaagctgctttccgaaggcaaaggcgagatgatgatttcagcgggcaatacgggagcattggttgcgggagcgacgctcgtcgtcaagcgtattccggggatcaagcggccggcgcttgcgccagttctgccaacgcagacaggagaagtactgctcattgacgcaggtgcaaatacggagtgcaagccgcagtatttacagcagtttggcgtgatgggcagcatctatatggataaggtataccacgtcaggcagcctaaggtcggactggtcaataacggcggcgaggaagaaaaggggaacgacctcacaaagcaggcatttcagcttttaaaggcggctccggtgaactttgtgggaaatgcggaagggcgcgaccttttgagcgggcagtttgacgtactggtgtgcgacggttttacagggaatattgtactcaaattcgtggaaggatgcgcaaagactattttgtctatgctcaaaggatatatcaaggaatcgaccagtgcgaaacttggcgctgtctttatgaaaggagctttttccaaactcaagaaaaagatggattataaagagtacggcggcgcgcttttgttagggctcacaggcggagttgttaagacgcatggcagttcggatgagcaggtcgttttcaatacgattgcaaacgcgcgaaagttcattgacggaaaagtagtcgaagtgattcaggaagaaattgcaaaattagcgaacgaataatggataaactgcttaaggacctgcaaaaacgaatagggtatgattttaacgacgaggacttattggtgcgtgcattaacgcatccttcgtgcgggagtatgccaaactatgagcgcttggaatttctgggagacgcggtaatagagcttatcatcagcgattatctgtttagtcactatgacgatttttcagaagggatgcttacgcaaaaacgcgcggatatcgtttgttccaaatcgctcgcaggcattgcgcgggcaattgatttagggcaatatatctttcttggcaatggagaagaacaatccggcggtcggaataaaacgtcgatcctggaaaatgtcacagaggcgttgatgggtgcgatttatatggacggcggcttctatgcggcgcaaagcgtcatcaatgtactgtttttcaacacgatcaaaggagcgatgtcgcgtatttcagatcacgattacaaatcgcaattgcaggaaatggtgcagaaaacggtcaagcaggacatcaattatctggtcagccggcaggaaggcccaccgcacaatacgacgttttacgtgcgcctgatcgtgggcagtgaggttatatgcgagggagtaggcggctccaaaaaggaagcggaacaacatgcagctaaatttgcgatcgcaaattttgataaaatttataaggggtaaaagaacatgcttaatttttctgaagtgaagaaagcggacactgaagtatatgactccatgatgagggaactggatcgtcaagagcacaacatcgaactgattgcctccgagaactttgtttctccggcagtcatgcaggcgatgggttcccaccttacaaacaaatatgcggaagggtatcctggcaaacggtattatggcgggtgtgaatttgtggacgaggtagaagaccttgcgcgcaaccgtgcaaaacagcttttcggtgcggagcatgccaatgtgcagccgcactcgggggcgcaggcaaacacagcggtttattttgcaatgctggagccgggggatacgatacttggtatgaatctttcgcatggcggacatctgacgcatggcagccctgttaacatttccggaaaatattttaatatcgtaccttacggcgtgagtgaaaaggatgaaaaaattgactatgaccagctttattccttggcacaggagcataaaccaaaaatgatcgtggcgggcgccagcgcatatccgcgtacgatcgactttgcaaaattcagagagattgctgattctgtcggcgcataccttatggtagatatggcgcacattgcgggtctcgttgcggcggggcttcacccaaatccggtgccgtatgcgcattttacgacaacgacgacgcataaaacacttcgcggaccgcgcggcggtatgattttgtgttccgaagaatttgccaaagcggtcgataaagcgatttttccgggtatccagggcggcccactgatgcatgtgatcgctgccaaagctgtgtctttccacgaagcgctgcagcctgaatttaagcaataccaggagcagatcgtgaaaaatgcagctgcgctggcaaaaacgttaatggataatggaatccgccttgtttccggcggcacggataaccatttgatgctggtggacgttggacagcaggggaagacgggaaaagaaatcgaagcgcttcttgattcggcgcatatcacagtgaataaaaatacaattccctttgagacgttgagtccatttgtcacgagcggcatccgcatcggcacgccggcggcgacgacgcgcaacatgaaagagccgcagatggagatcattgggacgctgatcgctaagatgatcaaagaaggcgagagcgcgaaggacgaagtcacaaaacaagtatttgccctttgcgaagaatttccgctttacaaataagcggggtaattacaattgaggcattgaagagggcgggcggtttgcccgctttcttttaggagtttggtatgggacgcctgatcgcgacaattgaagaaggaagcattgccgcacagtgcgggcttaacgcgggggatattctgcttcggataaatgaacagcctatcagggactatatcgattacgcttatgctgtcgcggaggaatcggttcttttattggtccgaaaacaggacggcagcgaagaagagatagagatagaaaaagatccatacgaagaattggggattgggtttgaagacgacggcttcggcaaaaaaatagcctgcaaaaacaagtgcattttttgctttgtggaccaaatgcccaagggaatgcgcaggacgctttattttaaggacgacgactggcgcatgtccttcctgatggggagctatatcacactcacgaatttaagtgatgtggatatcaagcgcattgttatgcagcatatctccccgttgtatgtctcggtgcatgcgtacgatcatgcggtgcacaatatgctgcttggaaacgacgacgcacaaaagacctttgatatcctcggatattttgtggaaaacgggatagaagtgcatacgcaggtcgtgatgtgcgaaggcatcaatgacggcgaggtcttgcgcgaaacgatcgaacggttatacggtctatacccgggcgtcaggtcgctggcggtggttccggcagggcttaccaaatttcgcggaggccggtatccgcttgctccggtcagcaaggaaaacgccgcgaaaacggtcgggatgatcgaagcataccaaaagcgtttttcagatgacaatcatgagacgcgatttgtttttgcggcggacgagatgtacctgcgggcaggcatgaacgtgccggactatgaaagttacgagtcctttgagcagatagaaaatggcgttggtatggtgcgcatgtttgtggatgacgcacggaccgcgcttgacgatttgggacgcataaaagcgcgttaccgatccgtcggtattgcgacaggggttgacttttatccgtttttggagcggatcgcgcaggatgcggagcggctgttaggtaccgaaataaatgtttatcctataaggaacgacttttttggtgaaacggttacggtcacaggattgttgacaggacaggatgtgatcgcccaactgaaaggcaaagtgaaagaggatacactttttttgagtagttgctgttttaaggaaaatgaagatgcaatgctggatgacataacattggaaggccttggtaaggcgctgggcgtttcgtgcaggaaggtcgaaaacgatgggtatgcgttcatccacgcgatgatcgaggagtaaaaaggagaatgccatggcaaaaccgctggtagcgattgtgggcaggccgaatgtcggcaagtctacgttttttaacaggataacagggacaaagttggcgatcattgaagatacgccgggcgttacgcgcgacaggatctatgcggacgcagagtggctgaataaagagtttacgctgatcgatacgggcggcatcgacatgaacacggatgacgttctattgagccagatgcgcgcgcaggtggaaattgcgatcgattcggcagaactgatcctcttttttgtggatgggaaaacagggatcacctcggaagattacgaggtggcgaaaatgctcaggaaatccggcaagcctgtcatcgttgtcgtcaacaaaatcgataatgcatccgacgagcagaatatctttgatttttatgaattaggcctcggcgatgtgctggggatatcttcttcgcagggcctgggccttggagaattgctcgacgaaatcattgagtatataggcgattatcaaagcgacgaaggggatgacgattcgcttaaaatcgcgctcgtagggaaaccgaatgtcggaaaatcctcgctgaccaacaaaatcttggggtatgagcgcgtgatcgtgagcgatatcccgggtacgacacgcgacgcgatcgattccaaatttgagcgcgacggggtcgaatatacgatcatcgatacggcagggatgcgcaagcgcggcaggatcgacgataaatccatcgaacgttacagcgtgatccgttcgttaaacgcggtgcgcagggcggacgttgtcgtggtgatgatcgatgcgacggaaggaatcaccgagcaggatgtgaaggtcgcgggctttgttgacgcggaaggcaaaccgtgcgtgatcgccgtcaataaatgggatgcagtcgaaaaagatacctatacgatcgaagaatataacaagaaaatatcggcggacttagcgttcatgccgtatgcaaagcgcatctatatttcggcagcgacgggattgcgcgtcgacaagctgttcgatctcctgcacgaggcatatgagcacaatatcgcgcggataccgacaggggtgctgaacgattgcttgcaggacgcgatcacagcggtagaaccgccggcgaccaatgggcgcaggctgaagattttttatatgacgcaggtgagcgtaaagccgccgacgtttgtattgtttgtcaatgaagtgccgctgatgcatttctcttaccagcgttacttggagaattatttacgcaaaacgtttgactttagcggtacgccgattaaaataataattaggcaacgtaatgataccagggaggagtcgtagggatggaagtttgggtgcttgttctttgcgccgtaattgcatatttgctgggttcgatatcattttcatacatttttacaaaaaaaatcaggcacgaggatatccgtgaaaagggaagcggcaatgcaggcacgacgaatgtgctcaggaattatggctgggggcttggtattgcggtctttgcgggagatgtactaaaggcggtcgcggcggcgctgatcggtttatggctcgcgggctatgaaggactgtgcgttgcgggcgtatgcgcgattgtggggcataattattcttgctttctcaaatttaaaggcgggaaggggattgcttctacgataggggtcttgcttctgatccagccgatcccgacgttggtgatctttacgatctcaattattattgtggcgtgtacgaaaattatgagtattggctcgatcatcggccttattttaagcgcaatcgcagcatttacgtttgctcaggggaattggtaccagattatttcagtcttgattattgcagcactgggtgtgttcagccatcgcgaaaatatcagcaggctgatccacggaacagagcataaattgagcctttccaaaaaatgacaaagggcaaaaaaggcttgcataaagcggatttttgtggtattataaactacgttaataagatgctagcatcgaagagtgggattgacgcccactctttcgcattataaatacgaatttttggagtgaagatggcaaaaaacataaaatcggcagtagaagaaatcgtccgtccgattgtggagaatatggggcttatttatattgatacagagtatgcaaagcagggacaggactggatgcttaccgtttttatcgataaggacggcggcgtgcttctggatgactgtgagcaggtaagccgtgccatcgagacggtgcttgatgaaaaggatccaattgcggaaagctattgtttatgcgtttcttccccggggctcgaccgaccgcttaaaacagaaggagattttgtacggagcatgggaagggaaatagacatcaggctttacaaaccgttcgaaggctcaaagctctttaccggcatcctgacagcatatacggaaaatacagtgacgattgaaacagaagaaaacgagatcgtctttgaaagaaatgaaattgcaaaaatgaacttgcatttagacatttaaaggagattggctatgaatacggaatttatggaagccttaaacgatctggaacatgataaaggaattaaaaaagatattttgctggaagcaatcgaaaccgcgctgatttcggcatataaacggcattttggcacagaccagaacgcccgcgtggaaatcgacggcgatacaggggaaataaaagtatttgcgatcaaaaatgtcgcagaggaagtagaagacgaagaaacggaaataccgcttgaagaagcgcggaaaataaacgagaaatacgaggtcggcgacgtggtggaaacggaggtgactccgcgcgattttggacgtattgcagcgcagaccgcaaagcaggtcgtcgtacagcgtatacgcgaagcggagcgcggcatcatctacgaccaatatgcggaaaaagaaaatgaagtcctgactgcgatcgttcacaggatcgagcgcggcaacgtatatgtagagctgggacgtgcagaggggatcattcctgtcagcgaaacggtctataccgagcaatataatatcaacgaccggatcaaggtctatgtgctggaagtaaagaaaacgaacaaggggccgcagatcattgtttcccggacgcacccgtcccttataaagcgcctgtttgaacttgaagtacctgagatcaggcaaaatgttgttcagatcaagagtatcgcacgcgaagccggcggccgcactaaaatcgcggtatggagcgatgaaaaagacgtcgatccggtaggcgcatgcgttggacacaaaggaacgcgtatcgaaaaagttgtcgaagagttaggcggagagaaaatcgatgttgtgccgtggagctctgatgcaattgagtttattgcgaacgccctgcgcccggcaaaggtcgtcatggtacagatcaatgaagatgaaaaggctgcaaaagtaattgttccggattaccagttgtcgcttgccatcggtaaagaaggacaaaatgcgcgtttggcggctaaattgaccggctggaaaatagatatcaagagccagtcgcagatcgaacaggaagtattcggcgaagagtttgcaaatgcggacacctcgttatcggatgattttgatgctgtggacgaactgaatgaagaagaagctgtccttgacattgaagaagatattctggttgattctttggcagaggaaacaaaggaagaagacaaaaaataagttatggcagagaaccggcatttgcctgcgcgcatgtgtatcgcatgcaggcaaagcaaaccaaaacaggagttgttacgcatcgtaaggaatcaggatggacgctttgcggtagaccacaccggaaaaatgcagggaggccgcggcgcatatatttgtgcaaatgccgcctgtgtggaaaaagcgaaaaagatatttggcaaggcgatgcactgccaaatgagcgatgcgctgtatgaggatctgataaaggctgtgtgtgatcatggagcgaaataaatttctggattttctgggactggcggctagggccggaaaattggtctatggcgcagagggaacggataaggcgattaaaagcggcaaggcaaagctcgtcgttcttgatggaagcgcatcgccggctacaagaaaggcatttacagatgcctgccagtattacaaagcaaagatcatcgtattaaatgaatgcgatgtattgggcaaaagcctgaataaaccaaacaataaaattattggaatagtgtgtccggattttgcaaagcatgcatgggaaaaataccacactaattccgggggtgaaatcattgagcaagattaaaattttagaaacaaacaagaatctgttaagcaatgcgcagtctgtattcaatgcgattttggaaatgcagacggatgcggataatcaaatcaaggaaatcaaggctatagaatccaagatccttgatatagaaaagatgaaaaatgaaaaagcacgtgccgagaaagaggagcagcgcttaaaagaagagcgcgagcaggctcttgctgcgcaaaaagaacaggaagagaaaaaagcacagcaaacggatgaacccgaaaaagtgcaagagcaaccatctgcgccaaagtctgagccgaaagagactaaggagcctgtttcgaaatcccttgccgctaaagagcagcccaaaacagcagccgcaacccccgcggctccggcggctatgaaagcagcacagaatcatacgaagcaacagcccaaacgtccggtcaacgagcgtaatgagaggcagacagaccaaagaaaacctgcgccaagacgtgagaatgaggaacagcgcagaccacagcagcgtccccagactgcggcggcttccgaaacgcgttcggaaaagaaatttcctcctaaaaaatcaggtggcaattttgagcatggcaaaacaaaaaagcagatcgaagaggatcgcacaaagcgtcctaaaatcaaagagcgcgttttcaatatcgatgaggatgattttcccaaggggtccagaaagcgccacaaaaagcagcagcaacagcctaagatggtgattgaaccaatcaaaatcgagaaggcgacaattactgaagagacgatttcagtaaaacttttttcagagaagatcggaaagccggtatctgagatattaaagaagctgttgcttcttggaatgatgtctaccatcaattcgcagatcgattttgatacggcgcagcttattgcaggcgaatatgatatcgaactggaacagaagatcgcgcagactgccgaggatattttggtagaggaagcggaagatacagaggaccagctcatcaagcgtccgccgatcgttaccatcatgggtcatgtcgaccatggtaaaacgtcgcttcttgataagatcaggcttgccaaggtaacggaaagcgaagcgggcggcatcacgcagcatatcggtgcataccaggtcgaactgaacggcgagaagatcacatttatcgatacgccgggccatgaagcgtttacggcgatgcgtgcaaggggcgcgcaggtcacagatgtcgcgatcatcgtggttgcagcagacgacggcgttatgccgcagacggtcgaggcgatcaaccatgccaaatcggcggaggtgccgatcattgttgcgatcaacaagatcgaccgcgaaaatgcaaacccgcagaagatcatgcaggagttgacggaatacgaattgctgccggaagaatggggcggtgatacggtcgtcgtacctgtgtcggcaaaaacaggagaaggaatcgataagcttctggaaatgatcctgctggttgcggatgttgcggaactgaaagcaaatcccgaccgtcttgcaaagggaacgattgtagaagcacagcttgataaaggacgtggaccggtagcgaccgtacttgtgcagacaggtacgctcagggtaggagatacgattgttgcgggtactgcctatgggcgcgtacgtgcgatggtaaacgaccgtggacagatggtggaggaagccctgccgtcgcagcctgtggaagtcatcgggttttcagaagtgccggccgcaggggacatcctgcatgcggcgccggccgataagctgaccaaacaggttgcggaggaaagaaaagacaggcagaaagcagaaatgcttaagaagatgtcaaaggtttctctggatgacctgttcacgcagattgcggaagggcaaatcaaggacctcaatatcgtcatcaaagcagatgtgcaggggtctgtggaagcagtcaggcagtcgcttgaaaagctttcaaatgacgaagtacgcgtaagggcgatccattgcggcgtaggtgcgatcacggaaacagacgttatgctcgcttctgcggcgaacgccatcatcatcggcttcaacgtgcggccggataatatggcgacggctgcggcagagcgcgagaaggtggatgtccggttgtaccgcatcatctataaagcaatcgaggacatcactgcagccatgaagggtatgcttgagccggaatatgaagaagccattatcggccatgcggaagtgcgccagacgtttaaagtttcaagcgtcggtacgattgcaggatgttatgtgacggacggcattgtaaagcgcaattgccaggtgcgtttgctcagggacaatgtggttatatatgaaggagcactaagctctttgaagagattcaaagacgatgcaaaagaagtatctcaaggctatgaatgcggcctttccctggataactacaatgaccttaaggaaggcgacgttgtcgaatgttttgagatgcgcgaaatagaacggtaggtgtcttgaaatgtcaataaacagaatgcacaggatcgacgaagaagtgaaacgcgcacttgcggatattatccgcaatgacgtcaaggacgacaggctttccgccatgacgagtgtaacaagggtggaaatcacttccgatttaaagtttgcaaaggtatacatcagcgtatacgatacggacaaaaagcgtcatgcatctattgatgcgctcaatcatggggcatcttttattcggacgaagctggcgaaggcggtggatatccggcgcgttccgcagcttacgttcgtgcttgacgattctatagagtacagtatcaaaatttcaaaaattttggatgatgtaaacagtaaggacaacgaatgaaagaagtagttggatttattaaagagcataaaaattttgcaattttaacgcatctccatcccgatggggatgcgctcggaagtgcatatgctttggcgcagacgctaaataatcttggcaaaaaagctgaggttattttattgtccgagccgcccaaaaaattggtttttgcagagtttaaacatctttacaaactgcttgcggatacagacagctcagtgtatgatgcggcgatcagtgtggattgtgcaacgctgccccgccttgccgatgcgcaggaattgtttctgagcaaacccaactgcaatattgaccatcatatttccaataccaattatggaaaggtcaattatgttgaggaagcggcagcgacaggcgaactcatttttgaattgtcagaaaggttggagataccgcccgataaaacgattgcaatggcagtttatatggcgattgctacggatagcggaaactttacctattccaatacgactgaaaaaacgctgtcgaccttttccaggctgatggagtgcggatttccgcttgttaagatggctgaccagatctttaaccgacggtcccttggcgctacaaagctgattgcgcgttttattgaaaagatacgtttttatgaacagggcagattggctatttctgttattatgctttctgatcttgaggagacgggcgcgctcgtcgaagactgcgagatattgatcaattatgcaagggaagtggaaggcgttgaaattgcagtatttgttcgcgagatgagcaaggatacctataaggtaagttttcgttccaacgattatgtggatgttggatccatggcggcgcagtgtggcgggggtggccatataaaagctgcgggttgtatgatgaagggaaatatttatgatattctcgaacaaattaacaggtcggcaggaaaccatctgagatgaatggtgttttaaatattctaaagccgccggcaatgacgtcgagcgatgtcgttgcccgtttgcggcggatgctgaatgaacgcagggttggtcatacggggacgctggatccgggggcggcgggagtacttcccgtttgtatcggccgcgctaccaagattgcggattatattatgtcggcggataaagaatatatcgctgagatatgctttggtatcgagacagatactcaggatagctacggagaaatagtagccaaatcagacgggcatatatcgagacggcagttggaaggaatattgccgcgatttataggcaagatactgcaaacaccgccgatgtattcggcggtcaggcatgaggggaaaaaattatatcaatgggcgcgcaaagggatcgaaattaaaaagcctgcccgcgaggtaaacgttcatgctatcgatattcttgatgtggcgcaaaaccattttttgttaaaaataagctgctccaagggaacgtatattcgcagcctgtgcgctgatatcgggcatgccttgggtacatgcgcttatacttcctttttgatgcgcacaggaacaggcgggtaccggatcgaagacgcctatacgctcgacgaactggaacatttgtgtgaggaacagggaattggaaaggcgctcattcctatggagcaggcgctcagctttatgccaaaagttgtttgtggagactatttatatgatatactgacgaccggaacgccagtcgaccttgagagggcgggcaatattgaggtggatcacgatatcacatatgcggtatattgcagagatacattgattgggattggaaagcgcttgggagataagctgaaaattgccgttatgctcaagctgcgcgaggggtaagaatgaaaatactgacttcggacgatctgccgttgcaacgtaaaacagcaatcgccatagggctctttgacggcgtgcacgagggacatcagacgctgatcagggatatagaggcacaggatggattgttttcgctggtttttacctttgatggcaaacccaaccatgctgcttataaaaatatttacacattaaaagaaaaggaagaaatattttcctgcatgcaggtagacggattttatttgcaatgctttgaccaaacgttctcgcagcttacaaagcaggagtttttggagcgtcttgtatttgacttccatgcaaagcatatcacagtgggtttcgattttcgctttgggaagaatgcagaagggacgacggattatttgcaggcgcaaagcaaaaagtatgggtatacgctgcatgtgatgccacgtatcgaataccatggcgcgaaagtgagcagttcgtatattcgcgaattgatcttaaatggggatatggaagaagccacgaagcttctaagccgtttctattttgtagacggcctgatcgaaaaagggaatcatctggggtcaaaaattgggtttccgacagcgaatatctctacggataagcttttgccgcaatatggcgtgtatgcaacgatcgcgcagatcgacggaaagctatatcccgcggtaacgaacgtaggcacaaaaccaacagtaaaagacgatgatacgcctaatatcgagacatttatccttcattttacgggaaatgtatacaatgaagacatgcgcgtttatttcgtcagccagatccgcagggaaaaagcgtttgaaaatgtggaggaattaaagaaccagatcgcacgtgacgcacaggcggcaggcggtatgctggcgaatttagaggtttacaaagaatacataatatgttaaaataattctcgtgtacttttaccggatgctctgatgtgcgacactccgacgccatcatagtgttacggggttttaaacaaatggaggtaggaaaaatggataaagcagtaaagacagaaatcattcagaagtatgcccagaaggaaggggatacaggttcccctgaagtgcagattgcgcttcttacataccgaatcaaccacttaaatgaacatctgaaggtgttcagcaaggattcgcattcaaggcgcggcctgctgaagatggtcggtaaaagaagaggcttgctgaactatctgaaagagaaggacatcgagcgctacaggaacttgatcgaaagtctaaacttaagaaaataagcaattggagcgggattttctcgctctttttgatgtattaccgcatatgtcggcggctttataaggataaaggccggcactatgtgttttaagatgaatcaaattcaggaggaatttataaattatgcaacaaaaccatgtatatgaaatggaactgggcggccggactctcactgtggagagcggtaaatacgccttccaggcaggcggcgaagtcatcgtaagatgcggggatacggctgtactggttactgccacagcgtcaaaaacgcaaagggaaggaatcgatttttttccgcttagcgtagaattcgaagaaaaaatgtattctgttggtaaaatccccggtggttttatcaaacgtgaaggaaggccttccgaaaaagcgattttagcggcaaggcttatagaccgcccgatccgtccgcttttcccgaagggataccgcaatgacgtgcagatcattgcaacagttatgtctgtagatacggatattccgccggaagttttcgcgatgatcggatcttctgcggcactcagcatctccggtctgccttttgcagggccgacaggtacggttattgtggggctggtcgatggggaatatgtgatcaaccccgacagtgagcagcgcgaaaagagcaggcttcacttgacggtttccggtaccaaggatgctgttatgatggtggaagcaggggcaaacgaaatttcggaagacgaaatgttgggggcgatcctgtttggacatgaagaaattaaacgtatttgtgcgttcattgaagatatcaaaaatgatatcggcaagcctgccatcgaagtagacatccaccaggtgccggacgagctcaatgatgcagtacgcagctttgccgctgacaaagtagtgtggagcgttgacacgtttgacagaacggaacgtgaaacgcgtcaggatcaggtgaagcaggaagtacaggaacattttgcggaagagtatcctgatagtgccgccgatattgcagacgttctttattacatgacgaaagaagtgatccgcggtaagataatcaacgacggtatccgtccggatggccgtgggtacgaagatatccgtccgatctggtgtgaaacgggtatttttgcaagaacacatggtagtgcggtatttacgcgtgggctgacgcaggcaatgaacatcgtaacgctgggcgggatgcgcgaaggtcagaatctggatggtatttcagaggaagatttcaagcggtatatgcatcattacaacatgcctccgtattcaacgggcgaagcacgcatgatgcgttcgacctcgcggcgtgaaattgggcatggcgcacttgctgcaagggcattggaacctgtcctgccgtcggaagaagaattcccttatgcgatccgttccgtatccgaggtcatcagctcgaatggttcgacgtctcaggcaagcgtatgtgcaagctgtcttgcgctgatggacgcaggcgtaccgattaaagcgccggtcgcgggttgcgcaatggggctgatcaaagatgaagaaaacggcaagatcgttgtgctgaccgatatccagggactggaggacttcctcggggacatggactttaaggtagcgggtaccgcaaagggtatcacagctatccagatggacattaagatcaagggaatcgataaagagattttggaacgcgcattggcacaggcgcttcgcggcagactgttcatcctcgataagatgacggaagtcatgccggcgcccaaggatcatttgtcgccttatgcaccgaagattatccgttttacgatcgatccggataaaatccgcgaggtaatcggcagcggcggtaaggtgatcaacaagatcatcgaagacaccggtgtaaaaatcgacatcgaagacgacggaagcgtttgcatcctgacgccggacgatgaagcagccgcaaaagcgcgcaagattatcgaaacgattgtcaaagacgtcaaagttggcgaagtgttcaacggcaaggtaacgcgtatcatgaattttggtgcatttgtagaacttgcacccggaaaagaaggcatgtgcaggatatcgaatctttcaaatgaattcgtcaagaaggtagaagatgtatgcaacattggcgatgaactgcttgtgaaagtaattgagatcgataagcagggaagaatcaacttgacgcataagggcgtaaaggctgacgaccagaaataacaaacgattggttaaaaaaagccggtatgcaccggcttttttattacgatgctcagtattttatcctgcaggaaagtggaaaatataaactatgaatactacatttatcaaagaaaaacttcaaagcggcgtcaccttgatcgcagagcaattaccaaattttcattcggttacggtagggatttgggtgggagcaggatccattacggaaacaccggaagaaaacggtatttcccacctgatcgagcatatgcttttcaagggcacgaaaaagcgcagcgcaaaacagattgcggtggatgttgacaatatcggcgggcagattaatgcatttacctcaaaggaatgtacttgctattacatcaaagtgatcgatgagaaactggatgcgggtctggaaattttaacagaccttttttgcagcgcaacactcgacccgacggagctggaaaaagaaaaaggtgtggttctggaggaaatcgctatgagcaatgataatccggaagacgcggcaatggatctcatttccagtacttattttaacggatgctcgctcgcaaaaacgatcatcggtccgccggaaaatattaaaaaattcaccagggacgatcttgtttcttatatggaacggtattatactgcctctaatattgtcattgcggttgcgggaaattttgaggaacaaaagctgaaagcatctcttaacagctatcttgtagacatgaataaaaacaagctcattttaccggagttttcgcattgcggcggttttgcagcgcataggggctttgaagtcagcaagagagatatcgaacaagtccatttgtgtatggggctgccatgttataatttgcaaaacgataaacgttttgcactcaacatcttgaataatgttgttggcgggtccatgagttcccgcttgtttcagaaaatcagggaagaaatgggcatggcttattccgtctttacgtatccggcgctttaccgcgatacgggcatgtacggcgtatatgcgggtacgatggccggcaacacggaaaaagttgcggaaatgatccttgaagagttaagacgtgtgaagaaagatggaatcacaaaggatgagtttaatcaaagcaaggagcagctcaaagggagcatgattttatcgcttgagagtacatcgtctaagatgagcgcgatcggaaaagcattattgctcaccggcagcgtatattcggacgaggaagttctgcggatgatcgaagaagtaagctatgatgaaatcagggaagtcgcacagtattgtattgattttgacagcctgacagtcacgggagtgggaaatattaaaaacgcggaatcgctaaaaaatattgtgatgtaaaatcgaaggcaggtttgaaaaatcctgccttcaatgctataatatattagcaggtttttggctgtttacaggtgtggtaggtaatgtattcagcttaggataatttgaggggcaaacatggcgactcgcaagaaaaagaaaaaaaagaatactacaaaaaccggcgagatcattggtattgtagtcattggtctggcggtttttactgcgattaccatatatttcagcgttggaagtgtctttggcgatatgatcaaaggctttatttttggtttgtgcggtattattgggtatgtagtgccgattattttaggcgtgatcggagtgctttttattgccgcccgcaaaaaatatcccaatacgagcaaattggtattattggccttggcggtgttttttgtgttttccctgatacacctttccgcaattgaaactgtttaccagacaggaaatagttttctggactttataaaaagctcttatgatgcaggcgcggtaaatcttgttggcgcgggtgcgatcggcgcattgctttcctattggacatacagctttttgagccttgtggggagttatatcgtatttattacaggcatcgccgtatgtattattgcactcactaacctatctatcaaaaaagtgagcagtgatctcggcacggcagtaaagacgacatatgatgaatatcgtgcgcgtgcggaagaacgcagggagcaaaaacggctttacgtagagaggctgaacgccgcccaggaagaagccatgcaggaaataccggaaccggaagatgagttcaatatgcagatcgaaggatttgatgaccttcctgcaccggtcgaggaaacaatttatgaagaacctcccgtcgacgaattcgcggactataatccggaagaataccgcaaggttttcgaggatacggatatcacctttgacgacgatattccggccgaaacgcgcagcaggcggaaaatagatgttacgcagccgattcccacggtaaaaacaccggctacggccgggaaggcgacaaacctgatgacgccgcaaaagccgagcgcaccgaaatatgtaaaaccaccgcttaatttgctcacggttatgcaagggcaggggggacggacttcggcttctgatttgcgtaaaaatgttgaggtgttggaaaatacgcttgcaagttttcacgtcagtgcaaaagtagtgaatgtaagtcgaggtcctgtggttacgcgctatgaagtgcagccggctccggggatcaaggtcagcaaaattgtaaatctggcagatgatattgcgatgaacctcgccgcgagagatgtgcgtattgaagcgccagtgccggggaaaccggtggttggcatcgagataccgaacacggagacaagcgctgtggggctcagggaactggtcagttcggacgatttcaagaaattgaaaagcccgatcgcatttgcgctgggaaaagatattgcggggaccaatgtatacgcagatatcgggcgtatgcctcatcttttgattgcaggggcaaccggttcaggaaaaagcgtatgtatcaattcattgatcatcagtatgctgtaccatgcgtcgcctgaagatgtaaaaatgatcatgatcgaccctaaggtagttgagcttaatgtatttaacgacatcccgcatttgctgatccctgtagtaaccgatcctaaaaaagcagcatcggctattaactgggcggtaaacgaaatgacgatgcgctatcgtatgtttgcagccaagggtgcaaaggaccttaggaaatataatgagatcatgcttgcagaagaacaggaaaaactgccccatattcttgtgatcatcgacgagcttgcagacctgatgatggttgcgccgggtgaagtggaagacgctatctgtcggatcgcgcagctaggacgggcgagcggaatccatttggtgatcgcgacgcagcgtccgtcggtagatgttatcacaggtatcatcaaagcgaatattccgtcgcgcattgcttttgccgtatcttcgcaggtcgactctcgtaccatacttgatatggcgggcgcagaaaagttgttagggcaaggggatatgctattttacccgtccggcgcacccaaacccgtacgcctgcaggggtgttttatctcggataaagaagtagaagcggttacgaattttttgaaggagcggacgacggtcaactacgatacgcgcatgctggatggtatttccaaggaatcggcggcgccgatcgcgggacaggaacaaacggatgagctgttcataaaggcgcttgaaatcgtcatggaatatgatcaggcatcgacctcgatgttacagcgtcgtttgcgtatcggatatgcgcgcgcagcgcgtcttatcgatcaactcgaagaaaacggatatatttcacctatggatggcagcaaaccacggcaggtattgattacaaaagaagaatttgacagtcttgtatcccctcagggagaggaagaatagtatggcagtaaaaatcggcgtaatttcacttggatgtgcaaaaaacaggatcgatacggagttgatgctttcgcagctttcgtccgagtatgaatttgttcaggatattgcaaatgcggatatcatgctgattaatacctgtgcttttacggacgaggcaaaggaggaatccattaatacgattctggaagcggagcagcaaaagaagtttggaaacgtacgcgggattattgtaacaggatgtttgccgcaacggttcagggatgaactctctgagacattaccccgcgttgacgcctttttaggaacggcagcatataaagatatcaaagaggcgatggatgaggtggtgcatggcggacattttacccattatgcagatgtgaaattcgacgagaattatcatgaacgcgtcgtgacaacggttgcgccaacggcgtatgtgcgtatcgcggaaggctgcgataattgttgcagctattgcgtgattccatccattcgcggaagttaccagagcaggaagccgcaagcgatcctggatgagattagggaactgacgcagcagggcttttcggagatcattctgattgcacaggatacgacgaattacggcaatgatcttgaagaagatattaatttagcgaagctgatggatcaggcggctcaaattgaaggcgtaaaatggctgcgtgttttatacagctatccaaacggcattacggacgaactgctcgacgtgatgctcaaacatgacaatatcgtgaaatatatcgacattccggtgcagcatttggataatgcggtgctggggccgatgaaccgcagaaacacgcgggaatctacctgcgaagtggtagaaaagatccgtgccgcctcggatgattttgtgatacgttcgactgtgatcgtcgggtttccgggagagacaagggagaacgtgattcatctttacagtacgatgaagaagatgcagtttgacaggctgggggtgtttacctattcgcaggaagaacatacgcctgcggccgaaatgcccgatcaggttgacgaggaggaaaaggagttcaggaaagactcagtgctgaacgtacagtcgtcaatttcgcttgatctgaacaaaaagcgcattggtaagacgtatgaggttttgatcgaggggaaagacgatcatacaggtttgtattatggtcgctcttatgctgaagcaccggatgtagatggtaaaatttttgtagaagtgcagaaggacttagagacaggaaagtattataacgtaacaatcacaaaagcatacagctatgattgtataggagaattagcagaatgaaatggaatgcgccaaatatattgactttagtacgaatgatactgattccgttttttgtattattttatttcatagatgtacctgattggaacatctatgctgctataatatttattgtagcagctttcacggattggcttgacgggttccttgcccgcagaaacaaccaagtgtccgattttggaaagttgtgggatccgattgcggataagcttttggtgcttgcggcgcttttgttgctgatggattggggaaaggttggactaatccctgttttgattattgaagcaagggaactgatcatcggtgggtttcgctccctggccgcatccaagggaatcgtgattgcagcggataagtccggtaaactgaaaacggtcgtacaatttattgcaatcatattattacttttaaacgactggccatttatgtttgtaccggtttcggtaggtttgatcctgatttggatcagcgcagtactggctgtatattcgtgcatagaatatatggtaaaaaattcgcaggtactgaaagattaagtgaggaaaagaaaggaatctgaaagatggaaaaagataaagcattggacgtggcacttgcgcaaattgaaaaacaatttggaaaaggagccgttatgaagctcggcgacgccgcgaaaaatatgaatgtatctattgtgccgacgggatgtctggaactggatatcgcgcttggcatagggggcgtgccgcgcggcaggatcgttgaaatttatggaccggagtcgtccggtaagacgacggttgccctgcatatgatcgcagaggtgcaaaaacaaggcggggcggccgcatttatcgacgcagaacatgcgctcgatccggtttatgcgaagaatcttggcgttgatatcgacaatttgtatgtatcgcagcccagcacaggggaggaagcgctggagatcactgaagcgctcacgaggagcggtgcgatcgatattatcgtgatcgactctgtggcggcgctggtacccaaatctgaaatagaaggcttaatgggcgattcgcacgtaggcgcgcaggcaaggctgatgtcacaggcgcttcgtaaacttgcaggcgtgatcaatcgttccaatacaattgcggtatttatcaaccagcttcgagagaagatcggcgttatgttcggtagcccagaaaccacgacgggcggcaaggcgctcaagttctatgcgtccgtgcgccttgatgtacgcaggatcgagacgatcaaggtgggcgaccagatgatcggcaatcgtacgcggatcaaggtagtgaaaaacaaggtagcgccgccgttcaaaacggctgaattcgaaatatactatggcgagggcatcagcgagacagccagtattttaaacctggcgacgcagctaggtatcattgtaaaatccggctcctggttctcttataatggagagcaggttgggcaggggcgtgacaatgtgcgccagtacctggaagcgaatcccgagattgcggaagggatcaaacaagaaattctgaaggcatataagcttggagaatatgcagatatgccggacgaggaaacgccggaagaggcaaaaaaagaaaagaagtaacagtttatggtggtgcagtattctagtcggtactgccgatttcgaaggcgggcctaaaaatccgttaaagggcacatcgatgaagtttctggtgctggccgctgacgccccgtcgggggctggtgctgggagttaagaaagaagggcgatccataagggcatatgggcgttgacccagctttcgcggagacctgcttgggtggtgagactttttcattactgggcagggtgaacctgttatgcggtactaagctgtgtacagtgtagcctgtcttgcgttggcatggtggaaaagcaggaagaagattttttgtggattgcgtacggatcccagagaatcatgactgtaaaaaaccatgccggcaaaagagactagaaattggatttgtgctgtcgaggaaagctcctagactgtagttaaggcaataaggggattatagtgtggtttgaacaggcaatccggtcgtgcagagggaaacgctgcaccgcagactctaaggggaaaccactctttccggcgacggggagcaggctgcggggaaatcctaccggaccatatactgcaaggtctacccttattgtcaccaccataatttaaatgttggagatacgatgaaggtcatcaagcattgggctatcaaaatattttttattacattgtttatttccgcaggcgtttctgtcgctgcggaatattttatttcaaatctttccctgcttgcgtctgtgggcgtcgtcatcgctttgatcgccgtagggatactttttgatattgtcggtgtagcgtttgcgagctgcgaccagtcgccatttatagcaatgtcctcgcgcaagaatacaaaggcgtattatgcgcttaagatgctgaaaaatgcggatgtcgtttccaatttctgcaacgatgtaatcggagacatatgcggtatcgtcagcggcgcggcaggggcggccattgcattgaaagccattgtcttccagtttccgtttccggatatggtgatttccatagcggtatctgccttgatcgccgcactgacagtagcgggcaaagcatggggcaaagggattgcgctgaaaaagaataaggatatcgttatgacgatcggatcgatcgctcatttcttcagctttaaaaagggcaagggcaatgaaaaagagaattgacgtgttattaagtgaaaaagggcttgccaagagccgtgagaaggcaaaggcgttagtgattgcaggggaggttactgttgacggaaagcctgcgaaatcgccttccgacatgtttgaggaggacagcgaaattatcgttgggaaagacagttgcccgtatgtcagcaggggggggcttaagctggaacgtgcggttgcagagtttgggctcaatctgaagaataaaatatgcatggatattggtgcgtctacaggcgggtttacggattgtatgctgaaaaacggcgcatcctatgtttatgcggtagacgttggctatgggcagtttgactgggcgctcaggaacgataagcgggtcagcttgcaggaacgcaccaatgcgcgttatctggaagcacaggaaaaacctgtcgattttatcagcatcgacgtttcctttatttccctcaacctgatttttccagccgctatccgcgttggtacagacgatttacaggtggtggcgctgatcaagccgcaatttgaagcggggaaggagcatgtagggaaaaagggcgtcgtgcgcgatgcggccatacatgaagatgtgatatgcagcgtcatagagaaggcgcaaaaacacggattatatgccggggctctgacttattctccaatcaaagggccaaatggaaatattgaatatcttgctttgttcacaaggtgcgaagcagaacaccctatagacgaagaagtgatccatacgattgttgccctttcccacgaacgtttgtagttttataaatttgttcctgatttccttgtatatctattcattttcagtgtataataaaaatagtatatttaaaatgcaaacgaggtttttatgctgaaattcggcgtttatacaaatgaacaaaaagacccgggccttgtggccacgcgtatggtggtcgaagcactggaaaagcaagactgtacgatttgctatgatgaaaacacagctcaggcgcttgggattccggaatttcaggacgcaaaaaacgcggatatgctttttgtattggggggcgacgggacgattttgcgtgccgcccgtaagtatgtcgaatacgggatcaagctgatgggtatcaatatagggcatctgggttttatgagcgagatcaacatcggcgatatcgattatgcgattgggcaagtgatgaagggtgattatattattgacgaacgcatgatgctggaagcgaaggtttccggcagggggcagccgcttcttgcgctcaatgattttatcgtatccaaggtgaaccgcacacatatggtgaagctggatctttacatcaacggttcgctcgcggaactgtataatggggatgggctcattgtctccacgccgacgggttccacggcatattcactttcggcaggaggcccgatcgtcgcgccgaatgtgaactgtgttttgattacgccgatttgtccgcattccttatatgcgcgcagtatcattgctaaattcagcgatattgtaaaagtggcgccgtttagcggggaaaaagacgttacgctcaccgcagacggccaagaaatcgtaagaatccatgagatggatgaagtaacgatttgccgcagcggtctcgtaacccagtttatacgccttaaaaaggatcacttttttccgcagttaaaagataaattggctcagtggagcatcacaaagaagtaggagtaaggatatgaaatcaaaacggcagaacaaaattctggacctgattgaaagtagcgagatcgagacgcaggaggagttggtcacgcggctcaacgaatctggatttaaagtgacgcaggcaaccgtatcccgcgatatcaaggaattgcagttgattaaagtacaggcgaattccggcgcgtataaatatgcagagaacaaaaagcataagacaaacgatatggatatcatgatgcgcattttcaaagatacggttttgtcagtggatttcgcagagaatttgattgtaatcaaaacgctttcgggcagtgcgaacgcggctgcggaagtgatagatagtatgaattttaatgggattatggggacgctcgccggtgacaacacgatttttgtcgcaacgacatcacagcaatcctcggaagatattgtcgggaaactgatgaagattatcaataaataggaaaacggagcggttatgatacgtagccttacgatcaagaatattgctttgattgatgaactgcatattgaatttggaaaagggctcaacgtgctttccggtgaaacgggagcgggtaagtccattattgttgatgctatgaatctggtcttgggggaacgcgctgataaagagttgattcgtcatggccgtgaaaaggcatacgttgaagcggatttggaaatcgattcctcaaagctgacagaattatttgagcgcaatgaactggatgccgacgacgaattgattatctcgcgcgacctgtccgcggcaggtaaaaacgtatgccgtatcaatggcgtggtggtaagccttgcgacgttaaaagaatttacggaccgtatgatcgatcttcacgggcagcaccaacatcagtcgcttttggagcctcagagccatttgcggtttatagatatgtttgggaaaaaggagatcgtacccataaagcaaactgttagcgacctgtatgataggttaaaagctgcggaaaaaaaattggagtctatcggcggtgatgagagggaacgggcccagagcgcagatatgcttgcatttcaaattaaagagattgaggaagcggaccttaagctcggcgaagaggacgcgctgaaggaagaacgggaaaaaatgaaccatgcgcaaacaatcgcacaggcgctatcgtcaggctatgacgcgctttataccggaagtgaagaaagtgtaagcgtgctttccatgctacaggagatcgtatcacgtttagcggaaatatcgcgctatggcgaacaatatcaatccctgatggaacgtttgcaggaaaacacctatgctgtcgaagaatgcgcgcacgatatgcgcaacctttcggaaagcgtgctgtttgacgagcaacgacaggaagagatcgggctgcggcttgacctgatccattctttaaaacgtaaatacgggctggatgaagaagaaatcttaaaatatttatcagatgcacaggaaagactgttccaactgcagaatgcagagaaactggcggctgaattgacggctgaaatctcaggagtgaaaaggcagctatatgtgcaatataaaaggctgtcagacatgcggaaggtgacggcgcagcatctccagaagcttcttttgaaggaactcaatgacctcggaatgccgaatgcaaaatttgccgcgcgttttgaaccgctgaaaggtatggaagaggctcataattcgcgcaatggtatcgatgaaatggagttcctgatttcgacaaatgagggagagcctttaaagccactgagtaaaacggcctccggtggtgaaatatcgcgtatcatgcttgcatttaaaaatctttcggcagggatggatcagatttctacaatgatttttgatgaaatcgatacggggatcagcggcaggatggcgcttgtgattgctgagaagatggcttgtatttcaagggaacggcaggttatctgcgtttcgcaccttccgcagatcgcggctatggccgatgaaaattacttgatcagcaagcgtacgcaagaaggcgtgacaagtacggatgttacgcacctttcagaagcgcagaaggttattgaagtttcccggctttcaggcggaatcgagtctgaaaattctgaaaaatacgcacaggatatgatacggaatgcaatacggttcaaaaccgcattgcccaaaaactagtggaggtattccgtggcgagattcaaacgcaccttgatagtagaacaaagcagaaaatatgtcgcgcagatcaaagaaatgcttgaaggtgtatcggattcctttttatctacgacggacggcagcgaagcaattacgttttatgatcagtataatccggacttagtgctggttgaggcaatcatgccgggatatgatggctttgcgctcatggagcatatgttcggcgcagacattattaagatcgtcctgacgtccatgaaccaagaactgatcatcaaaaaagcgttcgaactgaaagcaaattatttgtttgtgaaaccttatatacgtgacatatttgtttcgcgtattttagaagcagccgactttcgcgatatgaacaggcaagccgaggtcggggtaaaccaattactttacagccaaatatccgttgcattaaagcgtctggggattccggctaatgtgcaaggatacaaactgctgcgtgatgcgctttacatggtatgcatggatttcgcaatcacgcaggcaatcagcaagaatatctatcaggttcttgctgaaaaatacggaacgcaaagttcctgcgtggagcggaatatccgacacgcaatagaaacggcggctacaaggggcgatcctgacgcattcaatgcttatttcggatataccgtaagctccgataaaggaaagccgacaaatggagaatttattgcgactttggctgataagctcaggttgcaggacgaatgaaaggaaagcgcatgaaagagaaattaaacattgcaaaaaactatattgaatcaaaaacggattttgtgccggaggtcgctatcgtattgggttccggactgggagattatgcggatacgctggacgaagtaattatggaatttgattatgcgtctattccgggctttccggtatcgacagcgcccggccatgcaggcaagctcactttcggttgcaagaaagataagtgtgttgctttgtttgctggacgtttccattgttatgaagggtatacggcggcagagacggtaataccgctgcgcacggttctgatgctgggtgcgaaatatgtcttgctcaccaatgccgcaggcgggattaatatggattttgcagcaggagacctgatggtgattgaagatcacatcaatttttcagcacataacgcacttaccggtccgaatatcgatgaactgggtccgcgctttcctgatatgtcttttgcctacgcaaaggaactgcgcgatttgatcgatgaaacagcgaaagaaaacggtatcaaactgcagcatggtatttatggttatatggttggtccatcctatgaaacgccggcagaaatccgcgcgctgcgtactttgggcgcggacgcggtaggcatgtcgacagtccacgaagtggttgcggcgtcgcatgccaaagccaagactgcggcaatatcctgtatcagcaatctggcggcgggtgttgccaagcatgcgcttacaatggaagaggtcatggaagcgggaaaaatggttgccgccaaaatgcgcgtgctgattgacggcgttgtcgaaaagctgtagtttgctttactggaatggagcagcgtgctaaaatgaacagaagacctgtcaggcataaggccaccaacagaaatgaaatgaggttttaattcatgtttacaaactttacaaatccatattattggatgatgcttttatatagtatacctgcagtgcttttggcgctttccgtccacgaagcgtcacacgcctatgctgcatataaatgtggggacccgacagcgcggaatttaggacggatgtcgatggacccgcttaagcatttggatccaatcggtacgatttgtcttttgctgttccggtttggctgggcaaaaccggtgccgatcaactcacggaacttcaaacatccgaaacgtgataacgtgcttgtctcactttcgggcattattgcaaatttcatcatgtcttttatagcgtatgctattttccatatcgtggtatttggttttaatatccagaatgagatttttatcaatattatttggaacgttattatactgaatataacgcttggtattttcaacctgattccgattccgccgctggatggtttccaggtgctaaacagctttctgccttataaggcgcaaggtgtcatcaacgtattacaacgctatgggttcattattttattgatattgatcataaccggtttgaccagtacaatccttgggacgttttcttcgtggctcatggggtgctatacgcagttgttcagcacgtttataccgatgacgcagaccgcagtatataatttttaccaagctttatcattcggcgcgttttaagaggaaagcatggaagaatatactgtcaggcttgcacaattcgaaggaccgcttgatttgttgcttcatttggttggaaaagcaaaaatcgatttgcaggatatttttgtttctgaaattacagaacaatacctcgtttatatggagcaaatcgaagaaatcgacatggatcgtgcaagcgagtttctgaatatggcggcaaccctgctttatatcaaatcgcgggcgttgttgccggcaaagcgcgaagagcttgaggacgaggattttatcgatcctgagacggaactgatcgaacggctgcgcgcatataagatgtataaggaacttggacagcggctttcaatgctcgaaaaagagtcaaatcaagtttattataaacttccggaagagattttcgacctttcgcaggaagttgtgattgagggtgcggatacggatgtgttgtaccttgcgtttctggaactcttgaagagcaggaaaaaagctgaagcagaagaaccgtacaagaaggttgagatcaagcaggataccttcagcatacgggtccaaaaaaagaagattttaagtcggctcaagcaggaaaagagagtttctttttcttccttgtttgagaaacaggcatcgcatatggaaattgccgttacttttattgccttgctggaattatggcatgtcagtaaaattgcgattcggcaaaagaaggcgtttgacgatatcatgctggaatatcaaaatggagggatggccagttgactaaaacggaaataaagggcgctattttttcaactttatttgtgtcgggggatgcaatcgagttatcggcgtttgcgcagttttggcagattgatatcgatgagttggatattgtggttcaagagatcatggaagattgtgaacggcgcgaagagggaatattgctcgtgaggattggggacaaggtgcagctttgtaccaacccgaaatatggggagaccgtaaaagaactattggcgcccgaagaacggacgtcgcttactgcttcaattatggagacgctgagtatcatcgcatacaagcagcctgttacgcgggcggaaatcgatgaaatcaggggagtgcgttctaattacgcagttgcaacgcttagtgaaaagggattggtgcgggtgatcggacgaaaggatactttgggccggccagcgcttctgggaacgacagatgagtttttaagacattttggtatttcgtcgttagatgaattgccgaaaattgattttgaagcgttggaagaaacaaacacagaaggaatggaagaggacagcctggctttctaggctgtctttttaaggagataaaatgagattacagaagtttttagcggaagcgggcatcgcttcccgccgtaaggcggaaaaatatatcgcggcgggcagggtcgaagtgaatggcgttaccgtacgcgaaatgggattcattgtgaatccggacaaagaccaggttaaatatatgaataagcctgtcaggatcaagcagcagaagatttatattatgttaaacaaacctgcgggctgcgtttccacgtgccatgatgaaaatggtcggccgactgtcatgcggtatgtcagcgatataaaagagcgcctttatccggtcggccgtcttgattttaccacggaaggcttgctgatcctgacaaatgacggggaaatgacaaataagctgacgcatccgaggcataatatgcaaaagaaatatcttgctgttgtggatgggcccgtaacggaagaggatatagagaagcttgcgaagggcgttgtactcgacgacggttacaaaactgcgcccgctgtttttaaaattctttcggcaacaccagcccgcagcgaggttctatgtgtgatcggagaaggaaaaaacaggcagatcaggcgtatgtttgcagcccttgaaaagaatgtatgttatttgaaaagggtagggatcggtgatattggtttgggcaatttgaaaaaaggaaaatatagatatttgacacaggatgagctgcaatatctgaaaaaagcattaaaactctgaaaattaatgcagggatgcaaggggaaaatgttgaatatatttaatatagggtgtttttgctttttcgcaaggaacaatccggtcatttttataaacaaatattattgatgtatgagtgtcatcacatttgtttgacgttttactaatatttatatggaggtatcataatgagcaagctggaagagcttaagaaaaaaaatgccgacgctcttttaggcggcggcgaaaagcaaattctcgctcagcacaatgcagggaaaaagactgcgcgcgagagaattaatgccttacttgatcagggaagttttgtagaaattgaaaaattcttaaagcggacatatataacccctggatttgaagcggtaagcgagactggcgaaggagtcgtttgtggttatggaacgatggatgaacggcctgtatttatttttgcacaggattacacggtgttgaaaggttcgttttcatcggcacatgcttcaaaaatactcaaaaccttagatatggcggtgaagaacggtgttccggtaatcgggatattggattcgggcggtgcgaggatttcggaagggatcgcggcggttggcgctgcgacggaagtgctcaagaaactgagcgatatttccggtgtgattcctaccatttcggttgtagcgggaccttgcatcggaacttccgcttatattgctgcgcttacagatttcactttgatgatcgaaggcgtttctgagcttgcgctatacgggccgcaggtctatgcttcgaaggaaggaaaggaacttgaaggaaccgtttccttcggtgcaaaaaaccataataaaaatacggggatttcgcaatttttatgcggcgatgaaatgcagtgtgctgcgacggtaaagaaattattgtccttcctgccgtccaataacttagacgatgcgccgtatgggttaaacgcagacgaccttaacaggcagctttcatttggcgaagaagatgtcgggatggacgtgttgatccgctccgttgcggataatggcgatgtcctcgaataccaggcggattttgctactgagattgttaccatgtttggacggataaacgggaatgtctgcggttttgtcgctaacaatacgccggaacttacacaaaaggcggcaagaaaggcagcgcgtttcttaggatttttagatgcttataatattcccgcgattacatttactaactgtgacagttcagttgtcgatttggagaaagagcagggaactttgattgccgacatggcgcgtcttttgggcgcatatgcgcaatcggggatgcctaaattgaatgtgatcaccggaagggcgattggagatggttttgcgatcatgtgtcccaaagcgcttggcgcagatatggtttatgcatggccgacggcccagatatctgcaatgcctgctgaaacgggcgcgcttttgctttatgaggatgaaatcgcaaaggctgaggatgggattgttgctaaacagcaaatgatcgcgaaatatctggatgaatatgcaaatccgtggcaggcggctgagcagggggctattgacgatgttatagaacctgcgcacacaagacagattttgatcgcttcacttgaaatggtgatttccaagcgtgaagaaaagttgcctaaaaaacacggcgttttgccactgtaagcggggtgagtaaagatggatagcggtatgactattgggcaggaccttgcagtgggcggacagacaattgctctgggattaatggttgtattcctttgcctggcgctgatcatcgtgattatggtcgtgatgtctgccctccttaaggaacgcaggaaggaaaccggcgaagcacttaagcctgcacctgtaaaagcaatgccggatgtacctacggtgacggtgcaggacgacgaattgcttgcggtactcacggcagcagtcgctgcggcgatggaaagccagcaaacaggagcaggctctacgccgttcgtgatccgttcctataaaaaggtgaatggaagagcggcatggggcagggctgggaaagagtcccagttaacaaattggtaaataatgattttttcggaggtaaaatgatatgcgtaagtttttgattcatgtaaatggaaatgcctataatgtggaagtagaagaactcagcggcaacgcacctgcggcggcaccgatacagcaagcagcacccgcgcctacgcccgttgcggctccggctcctgcggcggcgcccgtacagaaacaacctgcagcagcgcctgcggcggctccggcagacggggtcagcgtttccgcaccgatgccgggcacgatccttgacatcaacgtcacagttggacaaagtgtcaaggaaggtgatatattgttgattttggaagcaatgaagatggaaaatgagatcatgtcgcccagcacaggaacagtgaaatccgtttctgtgacaaaaggtgccagtgtcgaaacaggagaccttcttgtagtcatcggctaaaacgatcttacatcgaaaaggaggttgatttgttttgagtagctttggcgatactcttataaaatttgtgcaatcgaccggattttttaatgctaccgactggcaacagtgggtaatgataggtgtagcatgtttgctgatctatctggcgatcgtaaaaaagttcgagccgttgctgttgcttcccatcgcttttggtatgttattgaccaatttgccgatggcgggtatgtatcatgaggcattatttgcaggtggacatgttgactgggagaatttttccggtactgcaggtttgcttgactacctgtatttgggtgttaaactggggatctatccaccgctgatcttcctgggggtaggtgcgatgacggactttggcccgctgatcgcaaacccgaagagtctgtttatgggcgcggcggcgcagcttggtattttcgtggcatttatccttgcacttttagttgggtttgagcccaatgtcgctgcttcgatcggtattatcggcggggcagacggaccgacggcgatttatgtgacttcgcaattggcgccgactttcttagggccgattgccgtcgctgcctatacatatatggcgcttgtaccggtcatacaaccgccgttcatgaagttgtttaccaccaagaaagagcgcgcgatcaagatggaacagctgcggcatgtatccaagcgtgagaaaattatctttccgatcgcggttacgatctttgtatcgttgatcgtccctgcggcggctccgctcgtgggtatgctgatgctgggtaacctaatgcgtgagtcgggcgttgtggacaggctgtcaaatacggcgcagaatgaactgatgaatatcgtaacgatattcttaggcgtatctgtcggtgctacgacgatgggttcgactttcctgaaaggggagacgcttctcatcatcgggctgggcgttctggcattcatctgcggaacgatcggcggcgtgttacttggtaagctgatgtgtaagctgtccaaagggaagattaacccgctcatcggttcggcgggcgtttcggcagtcccgatggccgcgcgcgtgtcgcagaaagtgggacaggctgaaaatccgtctaacttcctgctcatgcatgcaatggggccgaacgtcgcaggcgttatcggcagtgcggtagcggcaggcgtgctcttgtccctgttcgcttagcaaaaggaggataaaaaatattatggcaaaagtaaatattatggatactatcatgcgtgatgcgcaccagtcgcaggctgctacgcgtatgacaacggaagagatgctcccgatcgcgccgctgatggacagtataggctattggtcgatcgagtgctggggcggcgcgacgtttgactcctgcctacggtttttgaatgaagacccgtgggagagattgcgcaaattgagaaaggcgatgccgaacagtaagcttcaaatgctgctgcgcggccagaacctgcttggttacaagcattatgcggatgatgttgttgatttttttgtcaagaaggcatgtgaaaacggaatcgacgtgattcgtatcttcgacgcgctgaatgatacaagaaacctaaggcaatcgatcgaaagtacaaaccgttacggcggttggccggaggttgctctttcgtatacgacaagtcccgtacatacgtttgattatttcgttgaactggggcaggaactggaaaagatgggcgcgaaatctatttgtattaaggatatggccaatctattgctgccgtatgaggcgtataaccttgtttcggcattgaaaaagcacatcaaggttccgattcatctgcatacgcataatacgagcggcgtgggagatatgacctatttaaaagcgattgaagcaggcgtggatatcgttgatactgcgttgtcgcctcttgcaaacggaacgtcgcagccggcgacagaatctcttgtagcaacgcttaagggtacggaatacgatacgggtctcgatcttggtaagctcacggaagcggctaagtatttcacaaaagttgcggaccgcttaaaggcagacggattccttgatcccaaggttttgggaatcgatatcaatacattgctgtatcaggtgccgggaggaatgctttcaaatctgatcagccagttaaaacagtcgggtgctgaggataagctgatggatgttcttgccgaggtgccccgcgtaagggaagattttggctatccgccgcttgttacgccatccagccagatcgttggcacacaggccgtccttaatgtcctttcaggggaacgatataagatggtaacgaaggaatccaaggcgatgctgcgcggagaatatggcaggctgcccgctccggtcaacgaagaggtacgcaaaaaatgtatcggggacgatgaagtcatcaccgtgcgtccggcggacctgctgccgcctgaaatggacaagtacagggaagaagtcaagggatggatggaacaggaagaggatatcgtaacgtatgcgatgttcccgcaggttgcgcccaagttttttgagttccgccgtgcgaatcagtataagctggactccaatatgctggataaggaaaatatgatccatccggtataaaatgaagtatgtttaagaagcagggaacgcatttccctgcttttttgctggaattttgttacatcgtatggtacgctgaaagacggtaaagcattttttgaaaggacaaaatttttcatgagaatattggttacaaatgacgatggcgtatatgcacctgggattattgcactcgcaaacgcatttgcgaaaaagaacgaggtaactgtagtcgcgcctaaccaggagcgcagcgcatgcagcaggtctatgaccatggatgcacccttggcgctcaagaaaatgaatattacggaatataagaattgcgaggtatacgccgcatccggaactcctacggattgtgtaaaactgggaacttacgagattatgaaacgggatgtggatttggtgctttccggtatcaatatcggcagtaatatcggaacggatatctcatactcagggacggtaaatgcggctgtggagggctgcgtcttagggtatccatccattgctttttcgcagaaaattacaggagcaaataccgaaaatgatatgctgtttgcggaagcggcaggatatgcactgcaaatggttgaccagatggatataaacgttttgcgcgactttatttacaatattaattttcctgcatgcatatccgaaaaaattgcaggaataaaggtttgcccgcaggggatgtgtaattacggagacgattatgaaaaacgtatcgatccttttggacgcagctattactggccagccggaagaatggccgaatgcccgtataatgatgaaaacaaaacggatatgcattggattgaacgaggctttatcactgttacgccacttacgtggaatgtaacggatggtgacaggatggatgatacgaaatgcaggatggacaaattaaaattgcatttttaaattacgtctgatacaatatattcatcatcctatttgctgtggaggcaattatgaataataatgttatggaccgtatcaaccatggttatgccaagatgtccaaagggcaaaagttgatagcagattatatattgaaggaatatgataaagctgcgtttatgacggcggcaaccttaagcagccttgttggtgtgagcgaatcgacagtggtgcgctttgcctatgcgcttggatatgacggctatccgaagctgcaaaaggacctgcaggaagttatccagacgaagctgacaacagcccagcggcttaacttgatggaaggactgacatcagaggaggtcatcaatgcatctttcaagacagatatcaataatttgcgcgttaccagggaacatattgatacggaaaatatcgagaaaattatcgatagtattgataaggcgcgtaagatttatattttgggaacacgttccagtggcccgcttgcggaatttttgcattattatatgaactacatgaacgagaacattaagctgatccgctttgacggcagcgatattttcaaccagattttgagcgcggatgaaaacgatgtagcgatcgccattagtttcccgcgttattctatgcgtacgatcgaaggtatgaattacctgaaaaacagcggatgtaaagtgattgcaatcacagataacgaggccgctccgccggcgcagattgccgattatacgctgactgcaaaaagttatatgaactcctttgttgattcctttgtggctcctctcgctgtgatcaatctgctgatcatcatgctcggtttacgcaagaaggatatactgttttccaattttaacaggcttgaggaactttggcggatgaatgacgtgtatgccacaaaagaactggatgcgcagattacggacgaggatatttatggcgaatgatctcattgtcataggcggcggggcggcgggaatgatagccgcatatgctgcggctatgcgaggcatcaaggtaaccttgatcgagaaaaacgaaaaagtcggcaaaaagcttttcattaccggaaaaggacgctgcaatatcaccaatgattgtgatatcagcgatttttttatgcatatttccagaaacagcaagtttatgatgagcgcaatttatgctttctccaatgaaaacctgattgcacttcttgcacagcagggcttacgtacaaaagtggagcgcggaggtcgtatcttccctgcgagcgacaaatcacaggatgttattcgcacgctggagaaaatgctgcgtgagtcgggtgtcaagcgtatgctgcatgcgacagtcgataaaattgaaaaaacgggggatgaatttcgtataatgttggatggtggggatatattgactgcctctgcagttattattgcaacaggtgggaaatcttatccgcttaccggatcaaccggagatggttacaaatttgctaagcaattcggccatacggtcgtgccgcctatgcctgcgctgatcccacttgaggatgcgcatggaatctgtcccaaaatgcagggactgacgctcaagaatatcaattttacattatttcaaaatcataaaaaaatttacgaagaacagggcgagatgctgtttacgcatttcggcatttcgggacctgtcgtgctttcggcaagcaactacattgactatagaaaacagccgcttgatttaagggctgaaattgatttcaaacctgcccttactgaagataagctggatgcacgcctgttacgcgaatttgaagcgaatcaaaataagcagcttaaaaatataatgtctaatttgctgccgcaaaaagcggtttatccttttttgagagaaacgcgtcttgatgaaaacaaggcggtcaattcgatcacaaaggcagagcgcgaacggctgtgttatggcttaaaacatttttccatcaagatagcggatacgcgtccggtcgaagaggggatcatcacggccggtgggatcgatgtcaaagagatcaatccgtcgaccatggaaagcaaaattgtcaaaaacctgtattttgcaggtgaaatcatcgatgttcacgcgcaaacaggcggattcaatctgcaaatcgctttttcaacgggattccttgccggcagcagcgtatttgattgacattcactgtaaataaagatacaatattattagggtaaatttgtggttttttgacgatttaccattgaaaacaaaaaatgaatgagaagaaatcagaaggacaggaggtgaatttgctaagtggaatggcttattcctatccttgtaggcgtaggcggactggtagtcggacttattattggttatttatacagacgtaatattgccgaatcaaaaatcggccgcgctgaggattccgttaagaagctgattgatgaagcgcaaaagcgcgcggaagttatcagaaaagaaacggtactcgaggctcaggaagaagttcacaaactgcgtagcgaatttgacaaagaatcacgggaaagacgtaatgaaattacaaagattgaaaaaagattagtacaaagagaagaactgttagacaaaaagctagaaagcattgaacaaaaagaagaacaggtaaacaagaagaacaaggaaattaccaaggccaaagacgatttggccgctctgcatgctcagcaactggaacaattggagcacatctcaggcatgacgatcgacgaagcaaagggattgttgcttgaaaaggttgagaacgaggcacggcacgatatggctgtcatgttgcgtgatattgagcaaaaggcgaaggacgaggctgataaaaaagcaagaaatattctttcgcttgcaatacaaaaatgtgccgccgaccatgttgcggaaagcacagtttccgttgtaaatcttcctaatgatgaaatgaagggaaggatcatcggacgtgaaggccgtaatattcgtacgcttgaaacggcgacggggatcgatctgatcatagacgacacacctgaagcagtcatcctttcgggttttgatccggtaaggcgtgaggttgccaggattgcactggagaaattgatcgtagacgggagaattcatcctgcgcgtatcgaggaaatggtgcataaagcacagaaggaagtggaagcacaaatcaaggaagccggtgaacaggctgtctttgatgtagggatccactcactgcatccggaactggtaaaacttttggggagactgaagtatcgtaccagttatggacagaacgtattgaaacattcgatcgaagtagcgcatttagcttctcttatggctgctgagattggtgcaaacgcaaagtttgccaagcgcgcgggattgctgcatgatatcggtaaagccgttgatcatgaggtagaaggaccgcatatccagatcggcgcggatcttgcaaagaaatataaggaaaatgcagatatcatcaatgcgattgctgcacatcatggcgacgtggaacccaagacagtggaagctgttctggtacaggctgccgatgcgatttctgctgcaaggccgggtgcgagaagggaatctttggaaaattatatcaaacgtcttgaaaatctcgaagaaattgcgaattcatttgcaggcgtcgacaggtcttatgcgatccaggctggcagagaaatcagaatcattgtaaagccggatgagatagacgacgcgggaacaactttaatagcgagagatatcgttaagaaaattgaatctgaacttgattatccagggcagataaaagtaaatgtcatcagggaaacaagaacaacagattacgcaaagtaacaaaccataaaggagcaggaaaacctgctcctttttctttcttgaaaacagttgcaaaaagctataaaataaggtgtattcaattttaatgcgggaaggcggtaaaaagatgagagacgtttatgaaaatcccttgatcacaagatatgccagcaaggaaatgtcgcatattttttcagacgatatgaaatttaaaacctggcgcaggttgtggattgcccttgcggaagcggagcacgagatgggactccctatcacaaaagagcaggtcgccgaactaaaagcacatgcggaagatatcaattacgacgtagcggaagcacgtgaaaaggaagtgcgtcatgacgttatgtcccatgtatatgcatacggcgttcagtgtccgaatgcaaaagggattatccaccttggcgctacaagctgttatgttggggataatactgatattattgtaatggaccacgcgatacaggcaatcgaattaaagctcgttaatgttattgcccgcctgaaagaattcgccttgcagtataaagacatgccgacgcttggttttacccattaccagccggcgcaactgacaacagtcggtaagcgtgcgaccctctggatgcaggacctcgtcatggattacgagcaattgcagtttgtaaaatcgcaaatcaaactgcgcggcgtaaaagggacgacgggcacgcaagccagttttcttactttatttgaaggcaacgccaagaaggtcgctgaattagaacagaaggttgcgaaaaaaatgggatacggtaaggtttttgccgtaacaggtcagacctatccgcgcaaattcgacagtcttgtcgttgacttgctatccagtatcgcgcaaagcgcttacaaatttgcaaatgacctgcgtttgctgcaaaatctgaaagaagtggaagagccgttcggtaaaaaacaaattggttcctctgcaatggcgtataagcgcaatccgatgcgctctgagcgtatttgctcgcttgcgaggtatattataagtcttgcgtccagccctgctataacagcctctacgcagtggtttgaaaggacgctggacgacagcgccaataagcgcctggtgatcccgcaagggttccttgctcttgacgcgatactgaatatctatctcaatgtttcgagcggtatggtggtctatccaaaggtgatcgaaaaacgcatcaatgaagaattgccctttatggcaacggaaacgatcttgatggatgcggtaaaacgaggcggagacaggcaggaactgcatgaaaaaatacgcgagtattctatgatggcgggaagaagggttaaagaggaaggaaaaagcaataatcttattgatcttattaaggaagatcctgcattccgtatgagcgcggaggaaatcgatgcgatcatggaccccaaaaactttataggacttgctgataaacaggtagatgattttatgaaaacggaaacagacccgattttggaatgtttcaaaggaaagctcgccatgcaaggggaagtaagcgtataaaaatgtttagtttgcagaggtttgtttaattatattaaaggttgtgacaacatattcaattctaggaggtatatgaattatgaaagatttaaaaggtacaaaaaccgagcagtgtttgcaggatgcgtttgcgggagaatccatggcgcacatgaagtatctgtattattcatcgcaggcaaaaaaggacggttacgtacaaatctccaatattttcgcggagacttcggcaaatgaaaaagagcatgcaaagctctggtttaagtggctccatcctgataacaagattccggacactatgaccaacttaaaagatgctgcagcaggcgagcattatgagacaacagaaatgtatccgacttttgcccaaattgcagaagaagaaggatttaccgatattgcaagggaattccgcggggctggtaaggtagaaagcgagcatgaagcaagatataaaaagctgctttcaaatatcgaagagggaatcgtgttcgaaagggacacggaggtcctttggcagtgttacaattgcggacatatccagaaatcgaaagctgcaccggaaaaatgtccggtttgccagcatccgagagcatatttccagttgaaggaagacaattattgatttggcaataaaacaaaaagggcttcggccctttttttatgcttctatttttatttgaatcgtgctaaattaaagaaaaggataatgtgaaaggaaaacgcatatgatagacgtcctgctcgccacctataacggtgagaaatacctgaaggaacaaatcgagtcgctgcttacgcaggacagacaggattttcgtatcctggcaagagacgacggttcctccgatgccacgcccaaaatacttgcagagtatgcgaagaaatatccgcaaaagtttttagtcattgaggacggcgagccaacggggagtgcgaaggaaaattttttttgtcttttaaagcattcggatgcggattacatcatgttctgtgaccaggacgatatttggcttaaggataaaatcagcctgacgctgcttacgttgcagggggcgcaaaaggacctcggtgtggggcccatgctgctgcattcagacctgacagtggtggatgaccagggaagcacactccatccgtcgctttttgccctgcaaaaactggatccggaaagattatatttgcaccagcttttaccgcaaaacaatattacaggctgcacgatgctttttaaccgcgcactcgcggatatcgtgcggacaagcgcagatgcgttgatgcatgattggtggatcggccttgttgcagcggccttcggaaatattattgtagcgcctaaccgtatccattaccgccagcacagcggcaatgaagtaggggctaaggatgtaaaaagcgcatcctatttcaagcagaaattggcgaatacgggcagtattcgccactcgatcctggatacctacaggcaggcgcaggcctttcttgacacatatggcgatttgctaagcaaagaacaaaaagaagtgatcgaaatatttatcagtctcgaaaaatgcagtaaatggaaacgtgcccgattgcttaaaaaatatggattgtataaaagtggtttttaccgtaaaatcggtcaaatcatttatggataaaatttttcaataaaggaagtgcaaaaatgaaagctgaaattttatgtgtaggaacggaactcctgcttggagacatcatcaatacgaacgcgccatatattgccaaagaattggctaatattgggatcgacgtctattaccagagcgtagtgggggataataacgaccgcttgaaaacaagcttgaatctggctttttcacgggctgatatcgtccttatgacaggcggacttggccctacctatgatgatctgacaaaagagacggttgcagaatatttccataaagaaatgcgtatggacgaaaagtctctggcaagcatcgaaacttttttcaaaaaaattgatcgcccaatgacggaaaataataaaaagcaggcgatgatgcctgtaggcgcaacgatttttccgaatgcgcatggtacggccccggggctggcactgtccgaaaacggaaaaacggcaattttactgcccggtcccccctcggaaatgaaaccgatgtttgacgaaagcgtgttgccgtatttgatgggcttttccgacaaagtcttggtttcgcataatctgcgcctgtttgggataggggaatcccaggtcgaggatatcctgtatgatttgatgaaaaacagtacgaacccgaccgtagcgccttatgcaaaaacggctgaagtcaccttgcgtatcactgccgcaggcgatacgaaggaagaatgtgaaaagttgatcgcgccagtactgcaacagattgaggacatccttggccagtatatctatggcatcgatgtagcaaacctgcaaacggctgttgtagaagcgcttaaggctaagcatttgacggttgcaacggcagaaagctgtactggcggcttgatttcacagaggattacgcaagtcgcaggcgcgagtgaagtattcggctgcggcgtttgttcttattccaacgacatcaaagagtcgatcctgcatgttgcgccggacaccttgcaaaaatacggtgcagtttccaagcagactgcacaggagatggcgcgcggcgcgcgggaaatttcaggcgcggatatcggcgtatcgacaacgggtattgccggccccggcgggggaagcgcagaaaaaccggttggccttgtatacgtcgctattgatagtgaaaaagttcaggatgtgatcaagctgaatcttcagcgcggtagggtagacgaccgtgagcatatccgccacatggcttcccaacatgttttccagatgatactgaatacactgaaggcttattgaggtaattgcagctttcttttgcggaaatcaatttccaggatcagtatagataccataatgatggttccgcctgcaatcagagaccaactaagaggttcgtaaccaattaaaacggagcaaatgctggcgaacatgccttcaagggacaaaatgagtgcgctgcgggccggcggaatatatttttgggcggtgcactccagccagtagggaattgcggtacatacgatcccaagatagattgtcaccagaatagagatgcccgcttgggagacgctgccaatcgctgtgcgttcaaagagcaggaaatacacgagcgcgactagtcccgtcaccgtgatttggatgaacgaaaaggatgccgcttccgattccttggcggcaaagccgatataggcgatctggcaggcataagcaacggcgcatagcaaggataaaatatctccaaagctgaaagcgatattggtttcaaatgcacgcgttaaaatggaaatacccagaaaaccgatcgctacggaaataaaggttttgagcggcggacgtgtcttcaaaagcaaccaactaataaagggaacgaaaataacgttggtcgtcgtaagaaacgcattattggaaacaagcgtatattgcatacccagcgtttgcagtaaaaatcccgtgcccatgaatagtccggcgatcacgccatgcctgacttggatccttgagagcgttttgatttggcgaaaggataccagtaaaataaagagcgcagcaaaaagcatgcgcagcattacgatcatggctgaggtcatgccgttttcctggacaaattttgtagcaataaaaccggtaccccagaatactgccacgataaacaacatcatgtcatattttatcgtagtatgccgcatagaaactcctttgttttaaagtgcaaacagcatttatggtaacacagttatcttgggagagcaatttatttatcaaaaaggggagcaaagtcatggataaaatacatatattgcaagggatggtcgatcaaagccaaagcattgttttttttggcggggcgggcgtatcaacagaaagcggtattccggattttcgcagcgtagacggcctgtatcaccagaaatacaggtatccgccggaaaccatactgagtcataatttcttttttgagcatacggaagaattttatgatttttaccgtgaaaaaatgttgaaattggatgctttgcccaatgccgcacataaaaaacttgcagacctcgaaaagcagggaaagctaaaagcggtcattacgcagaacatagacggattgcatcaaatggcagggtcgcaaaatatttttgagctacatggctctgtgcacaggaattattgcatggattgcggcaaaagctatacagcggaagaaatacaaaaaagcgaggggaccgcacgttgtgtatgcggcggcataatcaagcccgatgttgtcctctatggggaatcgcttttgaaccaaaccatagaaggagcggtcaaggcaatcgaacatgccgacatgctgattgtagggggaacttcgctggtggtctatccggctgcaggactggttgaatattatacgggaaacaaacttgtactgatcaatcaggattctacaagttacgattcccgtgcagaccttttgataaacgataaaatcggaaaagttttttcaagattaaaatgaggttgctatttgctaaaaacggttatataatatatttgtgggaattttcgaaaattaccatgtgtattaaaaagggggagaagatattttccttcttttttacaatattttattattttaagaaggtaaaaaacatgagaacaaaagcgaaagacaaaattgtggtaatcggttccggcaacgtaggcgttacaatcgcttatacgcttatgctaaaaaggttaagttcagacatcgtcctaatcgatgttgacgaaggacgggcagagggtaacgtccttgatatgaatcatggcattgcatttttccgccagctatctatcaagcgtggtacatatgaagactgcaaggatgcttccattgtaatcgttacggcaggaatcgcacgtaaacccgggcagacaaggcttgagctcgctcagacaaacgttaagatcatgtatgatattgccaaacagattacgcagtataacaaggacatgatcatcctcgtggtttcaaaccctgtggatgtgcttacatatgtagcacgcatggcatctgggcttccggcggcacaagttatcggttcggggacaatgcttgatacatcccgttttcgttaccttctcagtaagcactttgatacggatattcgcgatatcaacgcttatattcttggggagcacggcgattcgcaggtgccgatctggtcaagcattacgattgcaggcgaacggattgacgagtactgcaaggactttaacaaggttctcgaccggcaggagatatttgaaaagaccagggatgccggtgcggaagtcatcaatttaaagggtgcgacattctacggggtagcgatgtcggtcgcgcgcgtggtagcgtctattttggaagatgagcatacggttcttcctgtttctcatgttttggatgaaccttatcatggtatcagcgatgttgctatcagccttccatgtatcgtaacctatgaaggaatcaaacaggtcattgacctgcatatctcgccagaagagatggaagaattgaaacattctgcggaaaccatgaaaacatttttggataaagcaattaaaattctggaagaggaggcaaaataatggatattaaggaaaaagcgcttaaagcgcacgcggactgggaagggaagattgaagtaatcagcagggctcccctcaaagacaaggaagacctcgcgattgcctatacgcccggtgttgcggagccgtgtttgaaaatttcggaagatgttgacttgtcttacgaatatacacgccgccataatcttgtagcagttgtgacagacggtactgcagtactcgggcttggcgatatcggccctgaggccggaatgccggttatggaggggaagtgcgtattatttaaaacgtttggtgatgtagacgctttcccgctttgtattcggagtaaggaagtggatgatatcgtaaacacagtagcgcttcttgccggtagttttgggggcgtaaaccttgaagatatcagcgctccgcgttgttttgaaattgagcgtagattaaaagagatttgcgatatcccgattttccacgacgatcagcacggcactgcagtggttacgcttgcagcgctcatcaatgcgctgaaacttgtaggaaaggacatccatgatatcagtgttgtgacatcaggtgccggcgctgcaggtattgcgatcatcaagttattgatggcaatgggattggaagatgtcgttatgtgcgacaggcagggtgcgatttataagggcagagacgggctcaatgaagaaaaaaaggaaatggctgaaatttccaacctcaaaatgaaaaagggaagcctcgaggatgtgctcaagggagcagatgtgttcatcggtgtttcggcccctggtacggttacggaagaaatggtgaaatccatggccgaaaatccgattcttttcccgatggcgaacccgacgccggagatcatgcctgatctggcaaaagcagcaggagctgcgattattggaacaggacgcagcgattttccgaatcagatcaataatgtgctggcttttccgggcatctttagaggtgcgcttgatgttcgcgcaagcgatatcaatgacgagatgaaaattgcggcctcctacgcgattgcagatttaattgctgaggatgagctgaatgaagagtacatcattccttcgccgttcgacacccgtgttgcaccggcggttgctaaggcagtcgcgcaggcggcaagagaatccggcgtaaaccgcatctgaggtataattttaataaatagttaattcccctgtcttagttgttcaggggaatttttatgttccgataatttaaattatacattgatattctctgaagaaagttgtaaaatatattaaaatatataattttttgtagattacttacaaaaaataacaaaaggggtggattgttatgatgaagaaagtaatggctatttttgtcgcaatggttttggtaattacaccatttacatttgcattcgcggctgaaacaccacagacgcaggaaagtcctgtgccaactgaaacgccacaagcacaggaaagccctgtgccggctgaaacgccacaagcacaggaaagccctgtgccggctgaaacgccacaagcacaggaaagtcctgtgccggctgaaacgctacaagcacaggaaagtcctgtaccggctgaaacaccacagacgcaggaaagtcctgtgccgactgaaacgccacaagcacaggaaaacggctttggtagttatgcgtcgtatgatccacaggccgttatcaattatcctggggatggggatgcttattatacaggaagcgttataggtatcaattgtagtttttataatagcgtaggatattattgttcagtttttatatatgacatggtcaagaacgagcccgttgattgtttgatgtttacggagtttatcaatcctcttgcttcgggtttttatttggagtgggatacctccggtctgccggcaggagtatatacaatattagtaggcgtttgcgacgttaatggtaatcttaagggaaaagttggcggtgcagatatctatttggtagatgacaccacaggcccatcgatcggggaattcgatattggtgcaggagcgcaaacaacgatggattcgtttgcactggcaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaacaatacctggtggggcgatttctcgacagatatgtttggcggcaaggcaggaacatatgttttcaatgtcgctgcttatgataacaaggggaatctgaccaactcggacacgagatctgtccgtgttattggcgatgaaacaggcccatcgatcgggaaattcgatattggtgcaggagcgcaaacaacgatggattcgtttgcactggcaacatatgatatcgttgatccatcgggtataaaggacgtacagttctgggtataccgtcaggaagacggtccgggcagctatcgcatgatccagggccgtgatgtaggtaacaatacctggtggggcgatttctcgacagatatgtttggcggcaaggcaggaacatatgttttcaatgtcgctgcttatgataataaggggaatctgaccaattcggatacgagatctgtagctgttttgtaaaattgtagttatgtaaaaaattgaatagttaagaaagggcctgttatccttaattatctaaaggatacaggccctttaaattcattataattcgtctccattatcaaaaaaacaactagcaacaataaaaaaagcgttacatagaacgcgatttgttgtataattaaaaaataaacatttttaagaattgctgttggctatatctgttaccatagcaattgtatctccaaacacagggagtgtcaactatattttacgaaaaagaaggagggttttataatggtaaatagtcgtatttcagacattacgccggagatctatggcttgacagaaaaaattatgcacacaggagcgattaatccggaattatataccgaatatcaggtgaaacgcggattgcgtgatatcaatgggcagggcgttcttgccggacttacacgtatctcggacatacagtcctttataaggcaaggcgatgaattggttccatgcgaaggtaagttgttttatcgcggtatcaatatcaaggatattgtcaaaggattcatacaggaaaagcgttttggatttgaagaggttgtatatttgctcctgacgggagaaatgccggataaagagcagctagctgatttcaaaaagctgcttgcgcattaccgcacattgcctacgaattttgttcgtgacatcattatgaaggcgcccagtgctgatatgatgaatacgcttgcacgcagtgtcctaacgctctacgcatatgacgacaaagcaaacgatatctcgatccccaacgtattgcgccaatctttacagatgattgcgctattcccgcttttctccgtttacggttatcaggcataccggcactaccatgacgggcagagcctctttattcatgtgccggatccggagctctcgactgcggaaaatattctgcacctgcttcgccccgacagtaaatacacggagcttgaagcgcatatcctggatgtttcactggtgcttcatgcagagcatggcggcggtaacaactcgacttttacgacgcatgtcgtttcctcttcaggcacggatacctattcgtccgtggctgcttcgctgggatccttaaaaggacctaaacatggcggtgcgaatatcaaggttgtccagatgatcgaggatatgaaaaagaatctcaaggactggacgagtgaaagcgaagtcaaggattaccttgcaaagctgctcaacaagcaggcgtttgataaggcggggctcatctacggcatgggacatgcggtatattcgctttccgacccgcgtgcggatatcttcaagggcttcgtgcagaacctttccgaagagaaagggctctccaaagaattccagctctatacgctggtagaacgccttgcgcctgaggtcattgccaaggaaagaaagatatataagggtgttagtgcaaacgtagacttctacagcggcttcgtatacagcatgctgaaactgccgacagaattgtttacgccgatttttgcgatggcgcgtattgccggctggagcgcgcaccgtatcgaggaactttccaatgcaggaaagatcattcgtccggcatacaaaaatattcaggaagcaagggaatacataccgcttgataaaagataaatgagaacaatgggaaaggacaccgtttaggcggtgtcctttttgtttaaaatgctttgtatccgtttttaaacatgttatgatggaataaaacaggtggttaggagtaaacttttttgagtagtttcttttggaattatgaaatggatccggaattcccgctcagtatcctggattttgtaaccaagggtgatcacgagagtatacattggcacaactatttgcagatcgttttgtgtactggcggcaatggtaaatttatttttacgaacagggagtatgaagcacaatcaggggacatttttattgttagcgattttgaaaaccatgtagcgatttctgatcctgcggaacagacagattatatctttgtgattttcctgccggcactaatcgccgccccgggaagccgccagtttgattttgaatacctgtatcctttttattacaacaccaaaacctttgaaaacagaatttcccatgacgtccccgttgccagggagatcggaaaagagatccttgctctgcgcgaagtatggaataaaaaggaaagagcctacaggcatgagttggatgcgggactgcggaagatccttgcgcttttgatgaggcattatcagttaacttatgaagaatactatacgccggacagtgtgagacatgcgaaggcgtcggatgcagtcgcatatatcaatcagcatttcgacgaggcgattaccgtgcaggaggtagcgggggttttgcacatgagcgaatcgtctttccgcagcctctttaaagaagcgatgcggatgccctttaaagaatatattacctttttacgccttacaaaagcaaaaaaacttttgttgacaacagaggacagcatcaatacaattgccaatttatcgggttatacgaacatgaatcagttttataaggtattccacaaatttgttttcatgtcgcctgcagaataccgcaaggtgaatcaactgaaacacaaaaaatagcgatataaatgataatatttgcgacgggagtgttattgttttgatacgctccttttttgtataataaactatactaaataacactttatctatgacttttttgtattccgcttaatatacttgctttttcagaaaggaattgaatatggtagacggattaaaaaaatattttgatgatgatgccgaaggccttgacgtgcagggatatcttgaaagaatcggctacaaaggaccgctggatccgaatatggagaccttgaaaggcttgcaaaaggcacatgtctattccgtgccatatgaggatcttgatatccgtgccggaaaatatatttccgtcagtttgccggatatctatgacaagatagttaggcggagaaggggagggtattgctttgaattaaacggactctttgcctggctgctgcgaaaactggggttcgacatcgtagaatattatggacggtatcttgaaggagaaccgcttgaaatgcctatgagacgccacaggatcgctcgcgtggtccttgacgggaaaaggtatatctgtgacgtcggagtcggcgtacaggcgcctgtgtggcctattttgattgaagcagatacagtgcaaaacatcgatggcgaagaataccgcatgattcgccatccggctcttgggtggctggtgcaggggatgcacaagggcaagtggaacaggatatattcctttacggaggatccccagtttcccattgattttgaaatgccaaaccattggtgcgtaacgcatccggattcgatttttaagaatatcacaatggtttatatccgcacaaaagaaggcaggaacacaatgactgaagtagcagacgccagcggaaatcctgtaccggaattccgccgctttacacaggatggtgtgctcgcatgccggacaaatacaaaagaagagtatgacaaggccctgtatgatcactttgggatcgtactgtaaataagaaaggaaaaggaaatggaacatttcaagaatttatttcaaccgataacaatagggaatttcgaagtcccgaatcgcattgtgcatgtaccgacggatatcagctcgtccaacgcggacggctccgtgagcgaccgcgatattcatcatcacagcgagatcgcgaagggcgggacaggctttgtgattgtaggggccacgactccggattccaagacaggccgaccgacggtgacctgttttgtagccgatgcggataactacatcccggggcttacgcggcttgccgccagtatgcaccgttatggcgcaaaatgtgcagtgcaactgcagcatccaggtcgccaatgcgcaatcccgcgttataacacgatgtccaccaatgacatggtgatcaaattaccgtggtctgcaggacatgaaatcgtctatgaaaatgctgaggaaaagggtaagcctgtgcgcgcgatggcgacggaagaagtgctcgaaatggtagataagttttcggaggcggcatggcgtgtcaagcaggcaggttttgacgcagtcgagctgcatgctgcgcatggttacctgatctcgcagttcatgagcccgcttttgaaccgccgtatcgaccgctttggcggcagctttgaaaaccgcatgcgttttccgcttgcgatcatcgaccagatccataaaaagtgcggtcaggatttccctgtcctggtacgttattctgtggacgagtgggttcccggcggacgggaacttgacgaaagcctgctcgttgcgcaaacctttgagcaagccggcgttgcggcgcttgatctgagccaatgcgtacaggaaagcccgggagccggattcgatccgatgtattatccggaagggtggacgacttacgcctctgaagcaatcaagaaagtagtcaacatccctgtaatcaatagtcattccctgcgtaatcctgcgttttgcgataagttggttgcggagggcaaaacggatatggtaggcttgtcgcgccagattttagcggatccatattggccggtaaaggcatattatggtaagacaaaggaaatccgccgctgtatttcctgcctgaccggctgctggcaggaatccatgatggcaaaaaaagagatcggttgtgcaatcaatcccgcctgcggaaacgaaatctttgacgatatgaaaaaaacggatacgcctgcaaacattgcgatcgtaggcggaggtcctgccggcatggaagctgcacgtatcgctgcggtgcgcgggcataaggtaacgatctttgaaaagaccggagaactcggcggagcgattctcggctgctgcctggtgcccggtaaagagaaaatgaaatggtacgcggactggatcaggggccagatcaaggaactggatgtagaagtaaaactcaatacacagcctactgtggatacgttaaaggcttatgatatcgtgctcaatgcaacgggcgcctcgtcgtatgttccacaagtctttggaaaggctgaaaatgttttgggctttgaggaagtcattgcctgtcccaaagtgagctgtgaatttaacccggggaaccgcaaaaacaccaaaacaggggaaaaggttcttgtgtggggggatcattatgcggcggcggatacggcggcattcttagcgtcaatcggaaaacaggtgacgatcgtaacgccaaacaaagagtttggttcgagcgtagaagtcatacatatgtacgtcctgagaaaacgctttgcgcaggaggatgcggaggcgctggattccaaacccttcaaatatcctgtcaaggtgattgaaaattcgaacgtatatgaaattcgcgatggggaagtcgtgattgaggacagggattttaacaaaacgacgcttgcagtcgatacggtggtgagctgcaatacccgccccaatacagggctttttgaagaactcaaaaaggcagggatcaaggtgcttactgcgggcgacgcgatccgcccgcggaatttgaacgcggcagtgaccgaaggcgcggcgtttggaattaacgtagacggggaattgctcatgaatcccaaccatgcggtcatgaacgatatgccgatagacgttcttgggcaattgcgttaaaatggaaagggtacaacggatggaacgttttccgataggcgttatgctggattccttccggctggatttaaaccatgcgatcgaagcggcggcaagcctgtgcgtacaaggcgtgcaggcttatgctgtagaaggtgaaatgaagccttctaaccttaccgccgcacgtaaaagggatatccttgagcggatcacctcttacggcatggtgattgcggcgatctgcggcgatctgggcggccatggatttacgcgggcagaggataatcctgcaaaaatcgaggaatccaagcgaatccttgaactggccagggaactggattgcggcgtagtaacgacgcatatcggcgtcgtgccggaagatgattgctgtttgcgttacgagacgctcgcaaaggcgtgcaggacacttggtgagtttgcacagagtatgggtgctgcctttgcagttgaaacggggcctgaaagccctgcaacgctgcggcattttttggatgacatcggcaccaaagggttttgtgtcaattatgaccctgctaaccttgttatggttacgggctgcgatccggcagcgggcgtatatgaactgcgggattatatcgtgcatacgcacgctaaagatggcgtgatgctgaggcaaaccgatccggaggtgatatatgactatttcgcgcagggcggtatcgaagatatgaacctgaaagaatattttctggaaacgccgcttggcggcggtgatgtagattttgaagcataccttggggccctgcatgaaatcgggtataagggattcctcacgatcgagcgggaagtgggggacgagcctgcaaaagaccttgcacatgcagtacgctttttagcagaaaggcagaaataatatgtttcgtatcgttattcttggcactggatttatcggcagttcgcatgcgaaggcgatccgtaatatagagggcgtggagcttgcagccatcgttgaaatggacaagcaacgcggacagaaagcggcagaagaagccggatgcgcctggtatccgtcttttgagcaaatggttttaagcgaaacgccggatcttgtgattgttgcgctgcccacgtttttacatgaggaatatgtcgtaaaagcggcacaggcaaaaataaacgttctgtgcgaaaaaccggtcacgctttcccttgcgtcttttgaccgcatggcggatgcatgcaaaaccaacggtgtgtatttcatggtagcgcaggcggtacgttggtggccggaatttattaaggtcaggcaaatgctgcaggaaaataaaatcggtaagctgcgtatgatttatgaaacacgtttggcccagcatccgaattggtcctcttggcataccgatcccaataagagcggcgggggactgtatgatctcaatatccacgatatcgattatctatacagcctgtttggtatgccacagagcgtatatgccgttggcttccaaagcgaaagaggctgttggaaccatgtcgtttccaatatcaaatgggggaatgggctaaaagcggtgtgtgaagcgtcgatggatatgaagggcggtcatccgtttacaatagggctccgtgcatgcggggatgagggaacgcttgattatcggtttgtcgcaggatttaatatcaaggacggcaaccaaacggcagatttgatgtattatccggagggcggcgatccgcttaaggttgacgtaatacaatttgatccgtttgaacaggaagtcagggaatatgtcgaagcaatccggctgaaaaaagaagctccgattcctgtttgcgagtcaagggacgtcctggagattgtttccgcaattgaaaaatcactggaaacaggcaagattatcacattttaagtaagaaggtgtcaataaaaaatggatttattcaatcagaatgcgcaggttatggttcctgaccataccgatccgaaagatgcactggcccgtacgacaatgctgtgcgttgcggcgcaccaggacgacacggagattatggcataccatgcaattggcgagtgttacggaagacaggatgaatggtttaccagcataatcgctacggacggcgcaggttcaccgcgcagtggtttgtataatgaatataccaacgagcaaatgcgcgcgcttcgcgcaacggagcaaaacaatgccgcggtcgtcggcggttattccatgcaaatacagcttggatatacaagcggccaggtcaaggatcctgatcagcaggatttaacaggagatttgatcaagatcatatctgtatgcaaaccgaaagttgtattgacacataacctggcggatcgtcatgcgacgcatgtttccacggcgcttcgaacgatttttgcacttagaaatgtgccggaagaagccaggccggaaaaagtgtacgcgatggaagtctggcgcagtcttgactggctggaggatcaggataagcttatttttgatacgtcgatgcaccctaatatcgccaatgcagtgctgggcgtatttgattcacaaatatgcggcggaaagcgctatgatcttgccgccataggccgcaggcgcgccaatgccacatttctggcctcgcatggcgttgatagggtggaggaagctgcctatggaatggatatcactgaactgatgatttcggatgccgatccggcagagtttattgcaaaacgtatcgacgcatttaaaaacgatgtattaagtaagatcaaaaatcattggtaaagggtgtttttcgcttataaaagcattgacggaacttaagttttcatttataatttaatacgttgcttttgtaagtaggggtatgatgtaatggtaacattacggtctccaaaaccgtccttgagggttcgagtccttctacccctgccatgaaaaatcatcagctttggctggtgatttttttatttatgcattataatagaacgtatataatcatgatggaggcgagatgtatgggacagtttaagacaggtttcatcggttgcggaaatatggcgactgcaatcataaaggggatgcaaaaagcgggcgaaagcaatatattcgtttacgataaggatcaggataaagcaaaggccatcgaaaatgttacagtgtgcagtgatattgacgaacttgcggaagaagccgatattttatttatttgtgtgaagccaaatgtgattccgtccgttctgccggatatcaaggcaagcggcaaagcgttcgtttccatcgccgcaggcgttacggataccaaattgcgctcgctgcttaaagtagacgcgcgtattatgcgtatcatgccgaataccccgctattagcagggaagggggctatctgcatccagactccaaacgattttacgcaggaagaatcagattatatcatcaacatattccgttcgcttggaattgttgaatttgtagacggaagcctgatggacagcgtcacaggcgtttcgggaagcgggccggcatatgtttatatgtttatcgatgcattggcaaaagcgggcgtgaaacacggccttaaagaagatttggcgcttcgtttggcagtacagacctttgaaggcgcttgcgcgatgctgaggcaaaccggagacacgccatcgcagcttatacataacgtttgttctcccggcggcacgacgatcgaagctatgaaagtgtttgatttaaacgatacgcgtgggatcatcgaatgggcggtcgatgcatgcgtgaaaaaatcagaggaactctcaaaataagcaaaggaatttttttacatgctgaaagaagtgatcatctactgcgacggggcctgcagcggaaacccggggccgggcggttgggcgtgcgttcttgattataagggaaataaaaaggaactgtccggttatctgccggacacgacgaataaccgcatggagcttatggcggcgcttcaagggctcctggcgttgaaggaaaaatgcagcgtcaaggtacatactgacagcgcgtatatccataatgcgtttgataaaggctggatcatcgcatggcaaaataacggctggatcacagcgtcaaaaaagccggtggaaaatcaggatttatggaaacagcttttgaatgccgccaagggtcatgtcgtcaaatggtataaagtcaaaggccatgcggatgatgaaatgaacaacttatgtgataaactcgcgcgtcagcaaatcaaaaataacgcaaaataaaaacttgtgggaaggggtaccaaagtaggttactcctttttaagcgatattcaactattcgcaaaacacaagttttgcgaatagttattgctattgaaaacgagatgtgctataatatagttaaatcgcagtgtcatgcggaagttgtgaggtttttatatgggtggttctccgaattaccatcaggacttgaatcaaaagatgacgcttaagctacgcgagatcatgcgcgatctgccttcgtttactacgagcttttttattgcgatggaaaataattcgacgatcctgacgcgcgtgaattatgcggcggacctcaggatattttttcagtttctgataaaggaactcccgcgttttgcaaacaaaacgacttccagcgagattacgcaggacgatttaaaatctatcacagtcgacgacctgtatctttttctggattaccttaatttgtattcgtcatcagaggacgatgaaaaatttatttcaaatcatgagcgcggcaaagcaagaaaggttgcatgcctgcgttcgttctttaagcattattacaaaaaaggcgttttagaacaaaatgtctgtcagcttctggatacgcctaaattgcatgaaaaagcgatcatacgtttggaagcagatgaagttgccgatctgctggacgctgtggaaagcggcgcaaaacttactgaaaaacaaaaacaatatcataaaaaaaattctatacgtgatttagctattctgaccttgtttttaacgaccggtatccgcgtatcggaattggtttccctgaatatttcagatatcgatttcaaaaacggatgctttacagtgacgcgcaagggcggaaatcaagtgatgctgtattttgacgatgaaacagcgcaggccctaaacgcttatctggacgaacgcaagaccaaaggaaattacgacctcacttccccactcttcctgtctatgcagggaaatcgaatatccgtgagaagcgtcgaactgatggtaaaaaagtatgcgcgtatcgtaagccctttaaaaaaaatatcgccgcataaactgcgcagtacctacggaaccatgctttacgacgaaacaggcgatatttatctcgttgcagacgtactcgggcataaggatgtcaatacgacccgcaagcattacgccgccatgtctgaaaataaccgcaaacgcgcttccaaggcgatcaagctgcgcaaataggaatccttttttatagttggatattcatgctttgcagggcatataaaatgcctaattttgcgtgttcatatgtaagcgctccctgcaaataggcagcatatggctcacgcataggcgcatccgctgtaagctccacagaagcgccctggacaaatgtccccgcagccataatgactttatcttcatatccgggcatatcccatgcgtatggcacgacattgccgtcaatagccgaggcgcgctgtataccgcgcacaaaatctgtaagcggctcttcgctgccgaatatgatggattgcgtaatatcgccgcgcacagcgtcaaaagaaggctgtgaggcataacctaagcgctcgaacacgcgtgcggcaaggcagacgccctttaatgcctggcaaacggtgtggggcgccataaaaaagccctggtaaaactgctggtaaccaaaggcataagaaccgatttccgtgccgatccccggtgcggaaaagcatccggagatctgatctatcagcttttgcgttcccgcaatgtaaccgcccgtaggcgcgattccgccgcccgggttcttgatcagggaaccggctatgatatctgcgccgcgttcggtcggttcatccatgcatacaaattctccataacaattgtctaccatcacgattttatccggaaattcctgcttgatacgcccgattgcctgtgccagatagtctgtcgtaaaagcaggccgaatctcataacctgtggaacgctggaaataaacgaccttaaccgttttattttgccttattttttcaatcgcggtatttacgtcgatggtgccgtttttgtgcagagggacgctgtcaaaagcaatctcatattcagaaaggctcccgcttgcaccgcgcaaagtagaaagaagagtatcatacggctcccctgtgactgaaaaaagcgtatcgcccggacgtaagagcccaaacaatgccgtagaaatcgcatgtgtaccgctcatcagcatcggagaaacgatacaggcttgtgcgccgaatgcatctgaaaacacccggcatagcttttcccttccctcatcgccgtatccgtatccggtggatgcgaaaaaatgcctggacgatacgttatttttctggaatgcgtctattaccttaaattgattggcctgggcggtttgctcaaaaccatgaaaaacatgcgaaacatctctttcacaatcttctacaaaatcgaccagtggtccgtcgatcttaaaatgcgaacagatatattgctttaaatccataaaaactctcctaatcttatgttgcctgtctatgcacaactgcgcgtgcaatagcggcggcgctatgatcatactcggcagtgtcgtaccatacgatccgctcgtcacgtttaaaccacacccattgccgtttggcataatggcgcgaattacgcttgatctcgtataccgcttctgtaagcgtggtctccccttgcagatagcgaaccacttccttatagccaatcgcctgcatcgccgtaggagcgttcggatattgttgcgccagttttttcacttcgtccagaaggccgcgcgccatcatatcgtctacgcgacggtcaatacgttcatataatacgcttcggtccgtcgtcaggccggcgatcacgaagcggtaatcctcgtttggcttgcggaacacataatctttggttccttcatttttcaatatctccaagcggcgtacgatccttttcttgtcgttcggatggatgcgcgccgccgattcggcatccttctccaatagcatttcatgcaacattgcggaatcttttcgcatcaattcttccctgaaaacaggatcatgcgatgtgtctgtaaaatccaagtgatatgtcagggcattcaagtataggcccgttcctccaacaacaataggcgtctttccacgggcggaaatgtcacggatacacgtcaaagcggcttcctgaaacattgcgaccgaatacgcttcgtcgggctcgcagacatcaagaagataatgcggtatcccctgccgttcttccacggatggctttgccgtaccgatatccattcccttataaacctgcatggaatccgcggatatgatttcaccattcagttctttggccaactcgatggctactgccgttttacctgaggcggtaggcccgagaataatgtaaaccttttccttcatacgatccgtttgaatcctttttgcaaatcatttttggttagcactaccgcaattggccgtccatgcggacaatgcgggatcgcgctcagctccgtgatctccgccatcaattccgcaatctgctcgtctgaaagctggtatccggctttgatgctgtagcggcaggaagcgcgtatgatctgctcgcgcagcaaaaggatatccttccgcgaattgcgcagctcgcataaaatatcttctatcaatttatcggcatcgctgcggctgatctgcgcaggaaaggcattgaatttcagggtaagcgcgccaaattcttcaaaatcaaatcccagtccgtgcaataactcttcatctttactgaacatgtcgtaatcttcgggagaaaacgtaacgacatgcgggaccatcagtgtttgcgatgcgattgctccttgggaagcttcttttttcatacgttcaaaattaattcgttcatgagcagcatgctggtcgatcatataaaggctttgtccgctttcaatgatcaaaaaagtattccaggcctgcccaataatgtgataatcgcatagcttgcgtacatccgcaatttcaagctgttgctcctgcgtttcctcatggaacgattttacctcctcgatcaagcggtcaaattcttccgcttcatcatacttaataggcgtcacgctgtccggacgctgtgcagcgcctgcagaaggcttatggtacagcttttctgccggacgaaaagccggatattcagcccgcagcggagcctgtttgatatcctgtacgtttgccggactgagtgtgctttttatgttcgattcgacattattaaaattcagttccagggtcggcggcagcgtttcggatagagcgtcccgtatagcttgctccattgtatcaataacctgctgctcctcatacagcatgacctgcaatttattgggatggacattcacgtcggccttggaaaacggaataccaatgtgtaataccgcaaaaggataatgacctcgcagcaggcgctcaccgtatccgcgcatgattgcggcctgcaagccctgtgagcggaccagccgtccgttcacaaacaggcagatatgatgcgttgacttatacaggaaagagggctcggaaatataaccggaaatccgggcgtcctccgttgaatatttggcagaacggaccttgtgggcaatttctttgccataaacagtcatcagggcgtcctttaattcgccgttacccgggctgtgataaattagcttgccattgcttaaatacttaatggaaatatccggatgggaaaaaatcaatttggatacgacggaagtaacgtttgtcgtttcacgggccgtatttttcaaaaatttctggcgcgccggaatattataaaacaggttttcaacacggacggtcgtgccttccggcagccctgccgtgtgtatttcgggtgcattttcgccgcttacggtaagcaccgtgccttctgtgccgcctgccgcgcgcgtactgatcgaaaggcgcgcaacggccgccatgctggacaacgcctctccacggaacccaagcgtaccgatactgccgagatcgtggacattttgaatcttactggtcgcatgcttttgaatagcaagcggcacgtcctcgggcaagataccggaaccgttatctgtgacgcgtatcagcgtcttgccgccttcctggatttcaaccgtgatggaggatgcgcctgcgtcgatcgaattttccatcaattccttgaccacggccgcagggttgacgaccacctcccctgccgcgatccttgcatatacagttttatccaaaacgtgaattctattcgtcatgatcaagctcttttcttatcgtgtagaccagattaagcgcctcgatcggcgtcaatgtatctacattcatttcctttattttctgaacgccagccggcaatgctgcgtttaaagacaaattttcttcttgcacaggctgtagggatacatcacctgcaatggacaattcgtaattttgcaattgattcaaaaaggtccccgcacgaataataacctgctgtggaagccccgccagtttggcaacctcgatgccaaaactccggtccgtacctccttcgacaatcttatgcaggaaaataatatcgtttccaagctcttttacagcaaccgaataatttttgatgccggaaaacatattttccagttccacaagctcatggtaatgcgtcgcgaacaatgtttttgcatgtaacttttgcaaaacgtattctacgctcgcccatgcaatcgaaagcccgtccgttgtgctggttcccctgccgatctcgtctaaaataagcaggctgttttgcgtcgcgttattcaggatattcgccagttcattcatttcgaccataaacgtgctctggccggaggcaaggtcgtccgacgcgccgacgcgcgtaaagacgcggtccacaaggcaaattttcgcctcatccgcaggcacaaaacttcccatatgcgccatcaaaacgatcaagccgacctggcgcatatatgtgcttttccctgccatattcgggccggtaataagcagcatgttgttcttatcatggtcaagtaatgcgtcgttgggtacgaactcctgctttaggatactttccacaacaggatgcctgccatttttgatatgaagaataccgtcgtccgtcatttgcggacggatatagttgttttcataagcaacggatgctaaagactgcagggcatcgagaagtgcaatacgctccgcgcagccctgcatacgcgctacctcctgtgccaaccggtcgcggagttcaagaaaaacctggtattccaaggcattgcgcttttcttccgcaccaaggatggtatcttccatctcctttaattcttccgtgatatagcgttcacagtttgccagcgtctgcttgcgcatataacggtatggaacctgcgaaagataggatttcgtgacctcgatataataaccaaacactttgttatatcttattttcaggtttttgataccggtttcttcgcgctcttttgcttccagctccacaagccaattttttccatttaccgacgcttcgatcagcttgtcgatctcttcatggtacccgcgctttatgatattgccgtccatgatcccgaccggcgcttcttcgttgacagcgcgctccagcaacgcatgcaaatccgtaaggtcatcgaggttttcatagatatcttgtaataaagggcttgaaacatcctgcaaaatcccttttaaatatggcaatacggcgattgaagacttgagggaaagacaatccttcgcatcaatcgtcccataggatatccgtgttatgatacgttccagatcgtaaataccgttgagataatcggtcagggaattacgtaaatacaaatcttctttgatctcgcttaccgcatcaagccgcgcattaatttcatcgagtttttttaatggctgcaaaatgaattttttgagcaggcgcgctcccatagcggtttttgtctggtccaaaagccacaacagggaaccttttttagagccttccatcaatgtttgcgtcaattccaaattgcgccgtgtattcgggtcaagaaccatataagcggtttccttgagcgctttgatgtgcgtgatatgcaacagcgtatttttctgcgtatcctttaaatattgcatcaatgcaccggccgcgcatacggcttcgtccattccgctgcacccaaagccatttaaagattttacattgaaatgcttcagcaatgcttgttgggccgtctgctcctcaaaagcccagtcaaaatatggattcacaaatgcatgcttaaagcgcgatttttccgtcagtttcaaaagccgtcctacctgggaatcagaggcgatgatctcctgcggattcagccgcgtcatttcgttcatcagtgcggcatcgtcttccgtttgcaaaacaacaaattcgccggtggatacgtcgcaatagcaaaggccgacttccttttcactgaagaaaacgctcagaatatagctgttttcattttcctgcagcatggacgtttcgacgaccgtacccggcgtaacgacacgggtaatcccccgcttgacgatacccttggcggtacgcggatcctcaagttggtcgcaaattgccactttatggccattagcaaccaattttgcgatataagcgtctaccgcatggtgaggaaccccgcacatgggcgcgcgttcgggaaggccgcaatcacggccggtaaggacgagctccaattccctggagaccaaaacagcatcgtcaaagaacatttcgtaaaagtctcctaaacgaaacatcaggatacaatctgcatattcttccttaagatctaaatattgttgcatcattggcgtcaactgtgccataattttttactactcctgcgtaatgcgcccaaataatgttgtttttttgccttgcgtgatctctacatcgtaaaatttaccgatcatattctgatctcctgcaaaattcaccatttttccactgctgctccgcccgcatacatgatttggatcgcgcgtactcaatccttcaaccaacaccgaaacaattttgccttcatattccctgtttttttcttcggttatcctgttttgcagggccaccagcttcataatacgttctttttgcgtttgctcatccactttcccgggcatcacggcagccttggttccattccgctttgaatacacaaaggtaaaagcagaatcataacgaacttgctctaaaagagacatggtatcctcaaaatcctggtccgtttcgccaggaaaaccaacgatgatatccgttgtcaaagcaatatttggaatcttggcaacgattttttctgttagttcaaggtactgctgccgtgtatagcgccgattcattgcttttagtattgcgctgcttcctgattgcacaggcaggtgtatatgccgacaaatccgcggctctgccgccattacatcaagcaatttatccgagagatctttgggatgggaggtcatgaaacgaatccgtggaatgatcgtctcttgacatatcagccgcaaaagctcggaaaaatcagtattgccgccatcatatgaattcacgttttgccccaaaagcatgatctcttggtatccatccttctcaagcacctttatttcctgcaaaatttcctctgcgctgcgcgacttttcgcgtccgcgcacatacggaacaatgcaataagtacaaaaattattgcagccatacataatattcacggcggcaagcggccatgaatgccgttttaccggtacgttttcatggatagcacggtcgtcatccgcaactgcaaaaacgcgttgcttttttagtaagcagtcccctaccatatttccaagcatatgaaggttatgcgtaccaaaaataatatctacaaacgaaaaagtttgcttcaattttctggcgacttcttcttgctgcatcatgcagccgcatacggcgaccatcaaattggggttttcgtcctttaattttcggattgcgccaacgttgccaaaggtcttatgctctgcgttttcgcgtacgcagcaggtattaaataaaacaaagtcagcattttccttccgcgttgctgcttcaaagcccaatttttccagaatgcccgaaattttttcggattcatgctcgttcatctggcagccataggtaataacgtaatatgtaagtcccctgccagatatatattcttttaacaactcattctccatgtttataattataatgcaaaacggcaccaaaatccatagaaaaaggggcagctaccctgcccctttctgcactcttttactgaatcagccgcattttgagtatccgcatgagcggcagatattgcagccaccctcaaagtccagcggtttgccgcattcagggcatttcgtatcgtccggctgctctctttcatcctgcataagcggggcgattttggcgtcctgcatcttggcaacagtctgcaacaccctgccgatggcatctggacaagaaagcactttgacgtctccgcctttcctgagtgtagaatggcaacggatcccgcgcagttgctctacaatggaatccacatccatacccgagcgaagggccgtagagatcaagcggctggttgcctcagactgcgaagggcatccgcccgcgcgtccaagattcgtaaatacttcgcaaataccgttttcatcatagtttacggtgatatacagattgccacagccgatttttaccttttgtgtgataccctgcgtcacctcaggccggtcgcgaggcgcgactgcattgccaacgttttcttccgaaacaatatcgctgccatcatcttttttattcaccttgccgatattcaatacctgtgcatcacgcgaaccgtcacggtagatcgtaacgcccttaagtcccaattcatatgcgaggtcataaaccttcctgacatcttcctgcgtcgcttcgcgtgggaaattgactgtctttgatacggcgttatccgtatatttctggaaagccgcttgcatacgtacatgcgattcagggctgatatcgtgtgctgtcacaaagatatccttgatgtcctgcggaatttcatcgatatgggcaatcgtaccctccgaagcaatctttgacatcagttctttggaataaaagccgcgttccttcatcacttcttcaaaatatggatgtacctccagcagctcgtcgttatccatgacgttacggatataagacaagccaaacaccggctcgatgcccgaagatgcattacaaataattgaaatcgtaccggtaggagcgattgtcgttacggttgcattgcgctgcacaagcccctgacctttgaaaatgctctcgtcatatgtcgggaaggtgccgcggatttttgccagttcgcaggacatttcacgcgcattgtcacgcaagaacttcataactttttccgccaaatcgatagccgcctgggaattataaggaatcttcaatttataaaggatgtccgcaaatcccataaggccaagaccgattttgcgggtggaaagcgtcatatcccgaatctgctgcaagggataattgtttacggtaatgacattatccagaaaatgtaccgcatcccgcgttgtttggcggaagagatcgtaatccagttcatatttatcacctttttttaccatgagtgcatttaagttaatggaacccagattacagctttcgtaaggcagtaagggctgctcgccgcagggattcgtgctttctacttcaccaagttcagggacgggattgtccctgttgatacggtcgagaaacacaatgcccggctcaccgttcgtccatgccattttaacgatcaaggcataaacgtccggcgcataaagcttctttacttccttctttgtatgcgggtcaacaagagaataatcccgtttttcgcgtacagccttcatgaattcctcggtaatccctacgctgatgttgaaattggtgatttccattgtgttttttttgcattgtataaaatcaataatatcggggtgatcgatacgcaggatacccatattcgcgccacggcgcgtcccgccctgcttcacggcttccgtcgcagcgttgaataccttcataaagcttaccgggccgctggcaacgccccccgtcgaattgacagaagcccccgccccgcgcaggcgggtaaaggaaaaaccagtgccgccgccgctcttgtggatcagcgcagcgtttttaacagcgtcaaaaatatcttccatgctgtcggcaaccggcaggacaaaacatgcggaaagctgccccagttcacggccggcattcatcagcgtcggggaattcggcataaagcgtaaatctgccatcatgcggtaaaatacgtcctgcgtttccctgatgttggcgtcaacatcaaattcctgatccgcttccgcgatcgcatgggccacacgtttcaataaatcatccggtttttcgatcggcttaccatccttgtccttctttagataacgtctttcaagaacggtttccgcatttttgctaaacataggaaaaaaccctccgtataaatatatttagtattaggataaacccagaacactatatatagtacaccgagggcaacgaaaatactagtcctttttgttgcttttttgaaatattttaaagcatagtaagaaaacgcctgtatatagaggttaactcctcactgcccgatgtaaaaaattcaaccgaaccattttcgttttcaggctggagcaatttttccttattgagaacatgttcaatatgttttgcggttccgtacctgccgtcatagacaccacaacttggtttaaaacatttgatcgcgacatctttgatcttatctgctacaaaagaataatgcgtacaaccaatcacgataccgtcgatatcctgaccatggtagggaaacaatttgtcatgaagatacgctttgatatgcggatcatcaagatttcccttctcgatcattccggcaagctcggcgcattccacattgatcacgatttcttgcgcgtccaatgtgttcaggagcgtccggtaacgcttctgctgcaaagtagcaggcgtagcaagtacgataatccttccctgtctgcgcgcttccatagcaggcttaactgcaggttcaatgctgatgatcggtatattataccgttcgcgcatcgtctggaccacgatactagtcgcggtattacaggcaattacgatcatcttgaccccttgattaaaaagaaattcgccacatttcaaggaaaggtccttgatttcgtcttctgtcttggttccataaggagcatgggcgctgtcgccatagtaaataaaatgttcgtgcggcaaaaggcgggctgcctcgcaaagcacgcttacgccgcctacgcccgaatcatatatgccaattggtaattcattttgcctcatattgtcatcccaaaaatttgtttgttaatcatttaatccattatttattataatacaatgtagaaatatagtaaagatgcgataaaagtacaaaaattgcttgcaacggccgcctaaatgtgataatatatcacttgttgaatttagaaaatatgggggtgaatgaattgcctaatatcaaatctgctaaaaaacgcgtaaaggttatcgcaacaaaaacgttgcgtaacaagatgattaaatctgctcttaagacggatcttaaaaagtttgacgctgcagtagttgcttcagatgcgaatgcaaaagagctttatacaaacgctgtcagcgcagtcgacaaggctgctttaaaaggtacgatccataaaaacaaagcaaatcgcgtaaaagcacaattggcaaaaaaattaaacagccaagctgagtaattttgataccccatttgaataggaagcgcaaaaaccgatctcacccatcggttttttattttatcaaaaattatgcttggtaaatatcgactaaaagagcaaataaatcggtcttcaatactatgatcccctgctttgcatcaaaatccatttgcgcaaatttctggatcgccgaccgtatcttttttgcactgaatgacttgcaattttcaagtgcccgccgtgctgcgaattcgcgcgcgcctgtcgcctccatgatatgtgaaattgttttatgatccggaaatttagcatcacggcatgcgcgcgctaccagcatctggcgaaaattatttgaaagcagcgtaataaacccaatcgggttattatcctcttcgagcattttattgatgagcaaatatgcctgctgcgggtgtccgcctaccatcaggtcatgtatcttatatacattatattgcatggacttgatggcatatttttcaatatctgatgtcgaaatctccccttggcatacgcaggacagcttatccacctcgtttgcaatggtacttaaatccccgcccgccagttcgtttatgatctgcgcatttttaggggataccaaaagacctttctgcttcgcgcggttcttaataaaggtacatatgtcctggtcgttcatggtattgcattcaatgaacattccctgtttgatcacaaattttacaaaggctttacgcttgtccgcattgccctgcgtccatatcaaaaagaaattgcttttgggcatcttgctttccatatacggcgcactgaagtcccccgaggcctgcgatgacaagacatcggtgcttttcaatacagttatacgcttctcgctcatgaatggcagggtctccatagcgcataatactgttttgggatcaggtcgttcttcaaaagttgacaggttaagctccggcatatcgattttcaggatatccatgatgttctgaaacatatactgcttcatatagtggtcttcgccgctcaggatgataaagtttttctcttgtccgctttttagttgtttcagcgcttcgcttggtgtcatattttcctcttataactaatatttttctgccgttatatcaatgccgccatccgctccgcatagaatcgtaactgctccggagtctgatgtgatccaggttttcacttggtttttttcaagcaaggccagcatatcttgatcgggcaaccccttgctatcgttctttttcacggatatcaccgcatgatccggttgccatgccgtaagcgcatctacatcgattgcgccgccttccccgccctgtttaagctttacgaccggaatacggccatcgtagcgcacgtcatctgcagaagtttgcgcaaacaagcagatcggctgaccgcaatagtaaagcatcagggaaaaatgtttgccatcatcccctaccgcctgcaaaaaagcatcgtccgatagttttattttatcatataacgcataagattgcatttgcaaatcttcatcataatccttggcaatataattttcaggtatatgcaggttataaattttaccatcttcgattaaatccttaagatttttggtcctgtcgtttgttataatcgtatcgtcaaaaataaggcggttcttttccgcataacgattgatttgcgaatactgcaggttcccgccgttatcaatcaggtaatccttatgatcgactgaaatgtgtattgcgtcccctgttccgacatccagaattacagcctttagctgtcccttttcctgcatgaccgcatatgctccgccaaagacggtcagcgataccaatatgctgatgataactgtctttattttccttgtgaataagatataatccgaacataaaaaccaaatagtaaagattgcgattccagcccaaacaggaaaagaatagatttcaaggaatccaaatgaagtatttgcaagccagccatttagccacgtaagagcctgcaagccaagctctgcgggaaaagcaagtgcatgtcccagcggcaatgaaaaaagcgcaagaaatgctcccattcctgtaaaagcgacgatgacccctgcaagaggaatcgtaaaaagattagcgatcggcgctgccagggctatattattaaaatagtaggcagaaagaggaaaaacggatgcagtagcacctatcgaggttgcaagcggcgttgccaatttaaccttatttagctttagtttggtacacaaacgtatcagcggaggcgtcaggcacagcaaaccgaacatcacgccatatgacatcaaaaatcctgctgtaaagagctgcggcgcattataaagtaaagtgaaaagcagagctgcggcaaggaacgtcagcgtatcccgctttgcaaacatccagcgtcctacgatcaaaaaaatcatcatgataacggccctgacgatagaaggggcgaaccctgtcaaaagtgcataaaacagcaaaacggcaacattaacgctgaaacgaacctttcgctttacccgcaaccttttgagcagccagtcaaaagcataagaaacgattgtaacatgaagaccggatactgccaagatatgcgcaatacctgtttttgaaaaatcctcgcgggtctcaggcgtaatatcatcttttacacccaaaaacatggctttcgctataggagccatttcctgcgaaaatatctgatcgattttttcagcaagcgtttcgcgcaaaagaagcggcaagcgataccatccctgtttgagaccaatcgactcaatttcataggaaaaacaactgaagccgactcctttgcttgcaaggtacatgcgttcatccatgccgccgggatttctggctatatccggtggttcaattttgctgtgaaaagtcacgatatcaccataatccaggacctccggagagtataaaagtacttttttatcaaatttatgagagactcccttctcatctattatggtcacttgatcaagcgtataactgcggtaatcagacgtcattccagaccgatcggatacacagccgttgatatcgtattcctgtccttccgttatgattgaaaagtcagttgtaaattgcaattgaaaaatgatgccgccaattgaaaaaatgattaggtaaagtgcgattaatacatgcttttgtttgacaaaaaacatccaaagaaaagcggcgattccaatacataacagaaaaataaaaagcgatataggaatttgcagataataggacacggcgatcccgatgatcagaaaaaacgccaaaaaaacgacaggtctttggttcaatatgcgcttcatgaatgctccgtcaaataatatattctgttttttcctgaacgatcaatacattttggaaaatcacgttcgcttcgcgaataaggtcctcttcattgtacgcaggattgatatgtgtcaacaagaggcgttttgcatttgcatcttttgccgtctgggcagcttgtgataccgtcatatgcggcaagattttccccggctgatcctcgtcaaggaatccgctgtcgagcaatactacatctgcgccacggcaaaatgcagtcaggtgttcgctgtatctggaatcacctgaaaaaataaaggtcatgccttcggcctcgatttttaccgcatagcattccaccggatgaagtgtcttacagaaagaaatcacaatgtccttagccggaaaaacaagctgcaagctctccgtaatctgtttacatgcaaaccggtctgatgccgcgaggatagaatattccgtatccggtgtagccggaagatagacaggaacaggatgttttagcatagcgtaacgcaatataaacatgtctgcgcagtgatcggaatgcaagtgcgtgagaatgaccatatcaaggtcgtccaaagaacaatattcctgcaggcgcgataagcttccgcttcccgcatccagcaaaatcctttttccgcaacaatttatgagatatgaagtcgtcgccccgccctttttgggatatgggccatattttccgagtactgtaagtttcatacttcttgcccttgccttttcttctttctgtgttatgtaaggcgtatgatccctgggtttttaatcagcggatcgataacgcatagcaagtttccgctgcctaaatattcaacccgctctccatctaccagaaattgtacgcgtttgatatcgttgatattggtaagtgtattgacaatggagtatatcataatgaattcgttcttttcggatatccctgctgttttttcacgtatactctccttaaaatctacaactgcggtatccccggcaaggtaaacatcgttcacgtcgtccatcgtaataccggaaataaatgccggttgcacctcgctgctgtcaagggcggaaggccccttcataagctctcttaacaattcttccggatatcccgccttctcttgtgccaccatacggttcacgctgctgagtaaggtatatgtgctgttcggaagataaaggacaatattgttaccaagcaaagatgaaaattcagatgccgtgaaaatagttgaatccggctggagcaaagcatccttggaatttacggtgatctgtattccgtcgatatcaggaataaatcctgtgattgccgttacaagagcggccgccgtgatctgtcccccgtcctggtatgtatgcgtttgtgcaaatggcattttgttgaaatccagctttgcgatattgcggttttgatcatcctggacgatactgacggagtttaactgcgcatcctgtaccaacttgtctacaacgggagtatgattatacgtatcgtcaggtccgctcataatttcctgcacgatcacgttgatcatagcttctttttgggtgctttcaaaacttagagtgcgtacttccggcaaaaggtattgctcggatgcatccagaaagtagagcgtaacattgagcgcagctgtctgcgcgcttgcttcgcgctcatatttgtccaaatcttccgataaggtattttttgatttttgcaaagtgccggaaggcaaatttttgaaggcggtttggctgccgttgatatagacattgacgtaggtaatgccggaaaaatcaaataaagtcgccgcaattgccagctttgcagtgagaatttgcttctctgttttattttcgacatccagattcagatatacgttgataacatccggcagcaattcgatagcttccagggaaaaaccgcttactacgggttttaaggtatcagaagacggtccctcgatcatagcatttataatctgggtctccgcacgttcgttttgcggaacggaaagcgtacgcgtttccgcggaaagcttattccctgtttcatctaaaaaatacaaaacagggcttatagaaatcgaaggcgtaagatcgacttcctgcataagctgcgaggtctggtattcattactttgatttgggtcatcttccttgactatggaacatccgctgaaaaaaatcagcgatgcaagcaagaccaacattacttttttcatgcttttccttttatcaggtcaggaaatttttcttgaagactgtatatgatatcttccagatgctgttttcctgaatgagtttaatcggtatattggttaaagtcttagcctcttcgtcacgcagttttaaaacatagtccaccatcacgatttcagatgtgccatcgttcccgatcacggagtctttgattgccgtatccgaaatcgtgagtttgcttgaaatgacttcagttttaaagtcatccaaagaaggtttatcctgtccgtacaaattcttataagcaatataattatacagtgtttcccattctttattttcgatcgctttcatgatctcgcgcatcgtattgctgccattgagcacgatttcgccgttccgttcaagcgcttcgaccgccccttcaccgtcaaggcctgcttcagaaagcgtcagcggccgtcctgtacccattccgtcatcatcaatcaaaatttgtacgcgggaatatgtcccctgttctatgagcgtatccacaatagagtagaccgcgagcatccggcgatttttttcgtatgcggcatcgctgctggctttttcatctaccggttttaaaaagtcgctgctcaaggtgacaaacaaggactgcccttctgaccgtacgctgacgagcgacgtttttggattaatcacagcctttaaatctgtccgtgtagaaagcggcccttttatgagctcgcgaataatcgaattttctatactttcattgataggcacgtcaaatgaatgggattcacccaccaggaaaggctggtccataaacccaaaataaagtctggcgctgctcttatctttactgatcgcttccggcaggggattgatttgcacagccgtgcttggggatgcgctaggctcatcctccattggcgcgcatgccgcaaaagccagacagaaaacaaccgtcaatcctatacaaattatttttctacatttattttccatactcatatattcctattcttcccgtttctgcatgacaggcaggatcaaggtaaacttggatccctttccttcaatactttctacttccaccctgccgttgtgcatgagcgcaatacgccgcacaatgtgaaggcccaagccggtacctcccgtttcacgtgaccgcgctttatcgacgcggtaaaagcgctcaaaaatatgctgcaaatgctctttgctcatgccgatcccatcatcctcgatctgtattgcaacctcactgccatgacgtttactgcttacactgacatgtccgtcgtcttgggtatacttgattgcgttctcgatcaggttgttaagtgcctgccgtaatttaagcgggtcgcactcgacctcaaggtcgctttccagatttgttgttattttgatattgcgcatttgtgcaattgggcgcaatgctgatacgcatttattgaccagcgatgaaaggttaaccgtttccaagttgatcgccataatatcactgtccattttagaaagcaataataagtctgttatcaggctgtttaaacggtcgatctcgccgttgatatcggataaaaagtccttgtatacctcttccggtacattatcctgataaagcagggattccaccaagattttcatggatgcaagcggcgtttttagttcgtgtgacgcatcagatacaaactcgctcctctgcttatcaaggttttgtatcttatcacacatcatgtcaaacgtctgtcccagctcagcaatctcgcctttgcccttgatctttgcccgctgtgacaaatcacccgcagaaattttaacggcaacctccgttagtttattgatcgggtttgtgatccaatttgtcgagagcatactggatatgatgatcactccgcaagcgagaatgaaaataataagagtctgggattgcagtaggctggtcgccttgacaacatctttgatgctagaggagtataggacgacgccaatgatatcgccgttgtggatgatcgaagaggtataataaacagaccaaaaactttcgtctgtggtactgtcatcgatcagatgaaaaccgtaagacgacgagttttggccatacaaaacgtcattgacttcacgttcgtttaatttgactccattcaaggacgaaaaactgtcgatttgtacaatacccgaactgttgagtaccaacaaccgtccgcccatatcgtttccgttgctgacaacaatattgtacatactgtttgcatcggaatcgcttaaataaggggcgatctgtactgccgtgctgttggcgctgttttcggcgtccttcaaatattgctttacaaggtagttttctaccatggaagaaaccgcgaccgataccagtccgaaaatgatccctaccaatatcagataaatgatcacaaaacgccaacggatcgagtacattaatttacttattcgtaaaataatattcagctccccaatcttgaaaattcttccgaaaatccattactatagcggcttttcgagctttttttttcatttttataccttgtcttttcataatcacatgcttcccctgtcccggatgctgtttttcgttttaggtaattgcctatatatttgtattcatattttccaatccaatacttgtcgctctttcgctggcagagcgaactatccccttcattagttaccatctaattctttcttcagataaaaaaaggatgggattagccatagctgttaaattattatactctgaaacggatgaaaactcaatattatctctgttacatttatatgaataatagcgagatgaaaaggagcgcggtacggctctaatcttaattgcaaacacaaaacggacatcgttttgaaaactttgtccgctacataattcaatggctcttttaattcgcaaaattcagattcactttttattagggttcactttgccttatccttttgatgatattagagttgtcgtggaacaatgcctttacggatacgcttttaagacaatattccaagtttctctggattacattgaaataacgaatgatgtcaccttccccctcaaatttttttaatccccttggttttttatagaaagatatattcccttcaacggcacaaaccacatcataaatgggaatatcatccaagtccctcaacatcctatatccaccattgcaaccttgctcggaagtgattaaattacccttcatcaattttgcgaagaccttaagtaagtaattatatgaaatcccaagtgcctcggatatctccattccattcactacctgtttttcattttcatctataaagtatagggttctaagcgcatagcccaatgtaagttgaaatggcttcatttgtatcctcctttgctgaaccatttaaaagggtaatccagtcgctgtattatttttgtttccacggcagatgaaaacgtccttcatttaactcccaaaacaattcgaacctcgccacatcgacaggtttcataaaatagtatccttgtacaagatcaacacccaaattcctcaccatctccaactgctcgattgtctctatcccttcgcaaacgattgtcatattcagtttcttcgccatttcaatgaggctgctcaaaacgatgatagttctttctctttttgcttcatcggacaaatagatcacaaagcttcggtcaagcttaagttcgtcaaagttaatgttaagcaaaagatcctccgatgaatatccagagccataatcgtctattgatatccgaaaaccttcctgtcgcaattctttcgaggcttctattgccctgtcataagagtcaaaaaaaatattttcagtcaactcaaatacgagaagagatggatcgatcctgtattgtttagtgagcttgcatattttctccaccaattcgtcgtgctgcatatgaacacgcgacaaattaagtgaaattggaaccacaggttttccttcgtcgagcatagtacgaagataccggcataccttctcatatatttgaaagtccatgtcgacgatactgccattacgctccattaatgtcaaaaattcgccagggccggatgcgaataccgaaccttttttcggcagcctgcaaagagcttccgctgatacgatcttacctgtgttcagatcaacctgaggctgtagaaaaaattcaaactcgtcattttgcagaaatatctttaatttagaaacaagttgtgcttcccgcatttgttttttttgcatgtggtcgtcataaagcagaaacttagtactataatctgcccgtgcgatcttgcgcgctatatttgcatgatcgagcgcatcgttcatccctttgtaagtatcaagggcaatcagactgattccgccgacaatctcaatcttgcactttgggtgataggagcgctgttgccttaaaaatatttccgcctgcttgtttaaatttaggatcgtttcttcgagcgtctcatcttttcccagtgtaaaaccaatgacgaagaaatctgaaaggatacgagagccggtgaaaacatttagattctgccgaaagaaatctgccagtgccaatagttgcctgtctccttcggaaaaactatagtaatcattcagtgtcttaaaattcaagatgtccgtatatagaatcgctaggtcttgaagtccggttttctggatcaatgaaaccctgtcgttcatcgctttttgcagggaactgaaggtcggaaaatgtgtaaccggatcatattccacattatattccctgcccgcgggagacaacgcacggatcgttttcagcggttcaataaatgcgcaattctgttttgccgtatttaatatcttttcaaacggctgatacgcccccctatggtactctttaacactgtagcgcatctgcaaaaatatgttttttgtatttgttctttttagagccccgtgactttttttgatccgcaaagttgccacgttatcggaatagtttttcaaaagaacaataaactcacatctaccgattcgacaaatgtacccgtcagcctgaaagctttcctttaggctgcgggctacatcaataacaaattgatcaacatccttgttttcaagttcatcaaggcggtcaaagcctatgtaacaaacagtaaacttatccgcgttcttaacatacttttctattgtgctctcacaaaaatcacgattgcaaactcctgtgagggaatcatacatgctaaatgattcttcatccaaatcctttgctatactgcttttgtcaatcagatatgcgtaggcttctttgtttttccaaatgatctcaaattggcaaatattataaaacttatcattcccaatagcgatctttgcggttgtcttggattgtatagctgaaagcttagcgtacaatttttttgtttctttcggccgttctttttcttccagttccgacatggaattctggtaaagaatgcgtccgttccgatccatgataacgacaggatcggaaaatcggttcatcaaatattggataaacgtattgagttcctcgcataaacgcatcgcttctctagcgcgctggttttcgagctccacattgcattcacgttgtttcagttgttctgtcatcaggttaaatgcgtcggaaaactcgcccatccactcgacatgctgctggtaatctccttgcgtgatctgcctgacctgccatgtcaaatgcgcaaggttggagcataacgttttaagcggccaacacaatgggttatccttattcggatgggaaacaataaaatctccatttgcaattcctgccgcatattcccgcgcttcggctacgcattggctcagaaaattgagcccctcgccgaaatcgcgaaaatcttccgacaatgcggagacatccatggttggctgactgttcgtggtgtaaaggatatccttcaaaaactggaacaatatttgtgcgtcgttacttggcatgcttcgttccttgctccatcttattgtatgtgggcttcaaaccggcaaaccctgtctccggttgcccagcaatcgatctcggttactatataattttttccggtatattctttcagtattcctgcaataaaaccctcgtcatagttgcaaactgtttcacccataattggaaggcctgaacagtctaaatcttccgataccgtcagtacggctttgccggttattgcatcaaatttttcgatccgcagaatccctatcttgttttgtgaaagggctgtctgtagttcgctgataaatccgtcaaaatccaatccgtgattgagatgtgcctgataaaaactgccgcctgctttttcgcccgcttttcgaaaaagatcaatcattttttccttgcccaattcatttgcaaggacgtcgcgcatcgtgtactgaaatagacggtaaacctcaacaggcatttgctcacccagattcgcgcgcccgtccttaatatcaccgagctcgattttcatcggaccatcattgccttttttggaaatattagtcatagataaaatccccctatatttgattcatttcatggatatccaaaaaatcgatagtgttttgtcttttaaagacggatcattctttttctttggttattgcatgctcttttaagtcggcaagcttttccagattaaagttcatctgtgcagccgcctggttttcagtaacgatcttttttagagtttcatatcgaagtactcttaaggtttgaggagcttcaatcccgattttcacacgatcggaatcggtcgtaagcacagtaatcttgatatcttctccgatcataatcgattcattcgcttttctcgtcagaaccagcatctgctcctacctctccttcttttttataatatgtaatcaatgcgtcaaagataggttcgctgaccggaaggggcctataatccatcataatctgcataccgaccatatccttgatattgactaaaagcggcgccatgaggttgattgtcattttcttaagatcagccggtattaccataatgcataaaacaactaggtcttcttcctggcgcgtttgaatcaaatcaagctcagaatcatcgatctctacctcataatctggttttagcaaaaatggattgatgattggcagcgatacctcctgatgatcgatactttgcagccactggatcggctcagtctgatcgcagcgcacaattgcaaaatctctcattccttcgagcccgggaatgccactttgaaacgatataatactttggtcatttatttcaattgtcccaaaacgtgccgattgtatcttcactctctgtccccctgtttgttatttatacctttctgtcaatatttctaccgctccttttgggtagattatcttcatttacggttattttgacctcgctgtggtttcccagccgtatttcgaccgagtgtggcgtcacggtaatgtccggcataaaatcatcggtccagataatttcaacgtcacccggcgaccattcgattttcattgtaccttctgtccactcaacctctggtgacggaatagctgaagacatcgccatttctggaatatttcctgtcatatcgttgtaggccgcttcgcctacaggattctgcgatgtgccaaaataagtctcgagtgcgcccagcgcgtcgccgttttcaaccatgatctgaacggcttcgttcgttagcttccttgcaagctgcatcgtgtattgccggaaatattccggagaacggatccccctatcggcccatacttttttccagttcaccttcatctgtggagtttggtgtatcacttccatttgaggccgcgtcgttctcacctgaaacctacggcgcacatgattttgtatttcaagctgggcatgcgtcgaagaaatctccagggttgctctgcttgagttgatactgagcgctttcatcgcaaacctctcctttcgccaatatatatggttccggttaccgcaaaaagtccattaatgtcggctggataatctgtgcgccgcttgccagcgcctgtttaaagatggcctcgctgtatttataattcatgatagtctgggcctgatcgatgtcctcgatattggagcgaatcgcctcataattgatcgcatcaagagagtacctgtttaccatggcgtccagcttggttgtcctggtccccgtaccaacgatgcatgtcaggagtctgtcctgaattcctgacagcgaacttaagtatttagaaatttcgtcattcggagcgccgttctgcaaatcatttttcaggttgatcaggatattgaacatattgtcgtctccggtgccaacaacatcaattcccgtaaacgatacatcaaacatcatgttgtatccaatttcaaactggatatcctgtgaggcttcttcccctaatttggttgttacagaaccagccgaagaaaccatctgggcaatcgccttttccattgtatcaatcgccggatcatgcgggtctgtagccggatcggtcatccatgaaatcacgccgaacccctctgcggaaaggtctatttccttgatcgccgtttccgccgcactcactgtatgcgtatattccacactgccgtatgaattaataaaccggatttggttgccatcggcctgaagcgtgtatttctgcatttcgtcgcccatccttccgctccaggaaaggccattattattaacaaccgcctgcgcctccggtcccatgatcggatcggcatacccgtttgcgattgagcgcgtcgtaaccgtattcgcagatgcaatcgcgccggctatctcatctgcagtagggagggttgctccatttgtccacgaaacagtgccgaaactcttacccgcggcatcctttaattcgattttggattctttgcccgcttcccagcccgtcgggtcaaccgtcaagatggaggcattacctctggagtctataaaggtcacctgatctcccactgcggtaatcgtatagttttccggatcggatagcatccccgtccacttaaacccagtggcattggcagtatcggtgatctgttgatccggttgcacattcttccctgctttagaaagatcaatcccgttatacaaaacaccgatcaagtttccggtttcatccctctgcacggtgaagggagcgttcgtcgtattaaagcccgcaaacacataacgatcgccgttgaccgaattacatgcttccagcaactgttccgttagttctgcgatttgctttccataaatcttcttatcgtcatcggttttcacaccggacgcagcagtaacaagctctttcatgttgatgacaacctgttccatctcgtttagggcagtttctgtttgcgtcacccagccccgcgaagacgttacattgttttggtactgctgtaggcgccgtatttgctgccttgcgttgaggctgctcaatacccctatcggatcatcagagagtttcacgatttttcggttactagccagttgatcgctgtatttcccaacacgccgcaatccggaatttaaattgctcagcaagttatctatcatcattgagtttgtgattctcatactttatcctccaaccaaattttttatctgcccacaagtcccatcttattgatcaacgtatcaagttgctcgtcgatcgccgagatgacccgcgaagcagcgctgtatgcatgcccgaagcgaaccacattggtcatttcctcatccagggaaacgccactgaccgatttacgctgctgctctaaatgcgctttcatgaccgattgtccgtccgttgtatcgtgtatatgcttcatctccgtactaatatcgctcatcagcgccttgtatacactatcgatattatccggattaccttcctcatttttctttgtgatcaattccgccatcgcgatcgcgatctttgcgtttcccttttgttcgtttgtatcgcctgttttggatacaggcatatcggatgcggctatattaaatacatccttcatgatatcgtcgctgagcttgaaattttgggcagtaatctggccgtaatcctttttggccggatcatcggggtcagagggaacatcaaaaaagctgattcccgttttgctttcccctcccgcttcattcgggatcgtatatcccgtttcatggacagagttgatatcggatgcaattttttgacacagcttattgagctgctgcacgatatacgggatacccaccgcatcctttgaatttccatcgcggatgtccatatagccgcgcaaggctccattggtgatattgacttcatttgccgtcgcatttccctgccggtccgcccaataaatgccataaagctgtgtttgcccgccgtccagtgggttgggaatgttttgttccgcggcaaactgttggtattgagtatgccttacaaggtttttcccatcgacttcgactaccagttgtccgttcacatcctcgtatgaatttgtatttataaggccggacagcgtatcaagcaatgtatttctctggtcacgaagatcatttgccttcgcgccggataattcgtaaccaaaaatttgatcattgagccgtgcgatttgtgaagcaatatcgtttacttcattgaccgtgatcctgacactttcattgagcgtatcctgctgctctaccaaccgatcataataagaattcatggtttgtgtcattttaatggcgttttgctgtacattatcacgaatactccgcgactccggcgacttttcaagctcataaagggaattgtaaaaactcgagaatattgccgatacgcctgtagatacaaccatatcgtcaagttcgtcgttaaaaagggcttcagcgtactcgaaatactgttctttggtctgccatttagccgttgtcgtattttctttcctgtactgataatccagaaaggaattgcggacctgctccacatataccgtctcaacgccgcgtcccgaggttcccttgatgtccgttccgataaaaccttttccgcccgccggcggaagagctgcagtatcaagcctctggcgtgtgtatccctttgtatcaacattggaaatattatgccctgtgatatcaagctggttctggctggtaaaaagccctgttttcgcaatttccagaccgtaaaaagtcgatctcatagattactctccttatatactactgtcgataatcccacggttatcaaaatgttcttcctcaacctctcctgagttgctgtaaatattactggtctgtggttctttataaaaaacgttgatcatataatccgtatagtccaaatgcagtccgatcagcgcctgattctccatgttcattttcttttgttcggcaatcagcttcttaagttcttccgccgcatcatttaccgcttccgcttcttcaggagaacaccatttcaagagatccataagtcttaagtccttcacctcttcaattgttttttcatcggcgatctcccgcattatttggagtcttctctcctcaataagggctattctgccaaggagttcccattcagcctttgcactctcccccacacgctcgacgttatttgaaacaattgctgccttcttttgaacggatagctcaaggacttcgcggtataggtcaataaatgaatgtaagatttcaacaagattttctatcatcacatcaccttcatacaaacttcaaaatggaatcggcgattttcttcggatcaacagtatatgcccctgatgtgatctcatcccgtatttggtttataacgtcgcttttattctctggcttttgaagttccagttttgcagcgccgagcaattttgcaaacgataccgcttcgcctgagatgtcggcatggtcctcccgctgcttttcaatcccccgggatgcagtcctgttttcaatgtagcgataacgctgtgctgcatatacgggcgacattgcattaattttcattttgctcacttccttttactctctgccgtggatgtccacatgcaatttatcctgttttatcttgccgatactttgcttgcttttttggctttcttccggttgttttggaagtacgcttcccagagcatgtgaaagcgtttccgagcactttttacataaacgtccagatgtgatcggacttccgcacttctcacataaaagcgaaccgtctgcggctaccatttcgagccttccttcccgcaggaaatgcagtatcagcttctcgtcaatttccgtattttttgcgacctcatctaccgaagcgcggggatgctggtacaggtattccttaattatcttgaattgctcttccattttccgcaggcattccggacagatatcgttgtttgtcgtttggaatatgcgcccacaatacttgcaggtcttaaaacttagcgccatatcagactccttcttttaacgtctggtggatattgccgtaccatccatttcatccgcggttgaaagcgcccgtgacgcaagctgtaaggctcggctcgcacgaatcagtttggagaactcgtcagccaaattgacatttgagccctccaatactttttgaattacttcagcttcagatgcgaccggctggcctgaggctgctgaaactgcgtaacggttgtttgaaatcgcgctaaggccttccttgttcggaaatgttacgattcccagccgtgcgtactctggggctcctccgccctgcgaaagcccgccttccggtgaaatttcaagattggtcccctcaaggcggattttctgcccgttttggtcgaggacataatatccgtcggccgttacaagatattcgccgtcagcttggttgcttttcgcaaaactgccgtcgcgtgtgtaataggtttcgcctgttggagattgcaccacaaaaaagccgtctccgtcgatataacaatccaattccctgcccgtttccaggtattgtccttccgtaaaaatacggttcgttccggaaactaatgttccgtggcccttgcgcatattaagcccgtcctgcgatccggcggcgcgctgcatattttggtacaacgcatctttgaaatccagcctgctcgccttaaaccccgtcgtatttgaatttgccaggttattggcaatcgtatcgatacgtttttgctgggaagcgattcctgtggcagccgtataagtaccctgcatcatattacatttcctccgttaaaatttcgcaatatcattgaccgttcgtccgagtgattcatcgatcatccttagtatccgttgattgctttcatacaccctgtttgtcgtgagcatctctgccatttcgcggccaagatcaagattcgatccttcgagcatcccttgggccactgtcggattctgcataatggcgggctgctgtccgttgtatggataataaagattgtcgcctgcttttctcagaatgccggtatcggcaaactgggcaatccgcagtttacctgcttgcgtattgccaacgaaaatgctcccgtcgctttttactgaaaaatctccggtaccgacattgatcatgccgccgttttcaccgagcacataatagccatcctgcgttaatagcgtaccgttcgcatccacctggaaattaccgtcccttgtataccgtactccttccggtgtttgaatacagaaaaaaccgtcgccggtgatcgcaagatcggtctgcatacctgtttcttccattggcccctgtgtaaaatccgtgaccaactcgtctacataaataccggtattttggccgccgacaccggtattacggttcaggatcgacggatcattaagcctgtcaagcagcatgtcgtcaaacgaccgtgtcatgacctgatcttttttatatcctgtggtgtcaacgttcgtgatgttgttgatgataacgtccatcttcgagcgttgtgaaagcatgccggttgtggcgatataaaagctcctaagcattttgtatcctcctatcacttttcaaaatagtcatcgaaattttttgtcaataacttaaatctggtacagcttacttttgaagcgactcaattttcaatacgaatttgactttgtttcttgaaactttaagtttttctgcgatctcctgttcgctcatcccatttttatggagttgtacaatttcataaccgaccggttcaaatacgtttattcgttcctgatccgttgttatttgaggtagcgcctcacctttgtttttcgattcaccgggcagggcggttttcgtatgtactttcacttcgtcatattgctgccgcttgatccattctgaaacattttttatatctttttcaaaggcttcgatcatgtcctgtacttcaaagtaaagagtcatcagtttctttttcttgtcctcccactccgtttcctccgctctttggcaacgtctttttccgctaaagaacagaaagaaaacgatcaacaccataccgaacagcatcaatgcaaataaaaaatactccaaccccatctcttcttctcctatctgcctttatacgttgatatcgattgaatcgccgagtcctgtcggccctgatttgatatccgaggtttcttccctgtcgacttcctcttcttctgaggattcctgctcggagtccgcttcatcaggttgaccgccgccgtttttctctctctgtatccgttcgtcctgcgtcctttcggtttcggttacagatcgatcgctttggctgatccgcgctttttccatctcatttatgaaatcctgtccctgctgcacattattcatttgatcagccgcctgctttgcatattcagtagacttattgatcatgatcctgccatcgattccctgtatcattttctacacccccagctctgtgcccagtcggtaacgtagtcattctctttttcttggctattttcattcctttacatatctgcatgattctgtctggatgtcatcatcttttctggaatacgtagcatattcattgtcatagggtactgtgtaggcgtctttgccaaaatagagcctgaccccttggtatattttccccagtacatgaaccgtaccggtttttgcgcgtctgatttcgtcgtccagcagttctttttctttcgtcaggtttgatttttccgatttcaatttaagcgaggcgatcacgaggtcatgttttgccttgtcttttgcatcagtggattgctttttcaaagcgagttccagcctgctgatatttgcatcgagggctacgagttcttttactagctccgccacacgcagccgcttttgtgccaaggcgccaatcatgatttttgtgggggcactggcatccgaaccgatcgtttttgcaaccacatacttccccgcgcttacgttgccgccaaccaatgtcccgcgaccttgcgatacgtcgatatatccttcgcaggtcacatggcagttcacaagcattccggttacgatattttctcctgctgttatgactgtgcgctcaataaatggtgcgctcacgctgccgcccgctgtaatcgttcctttgtcggcgccttttacgccgccttgtatggtaatatttccatctgcttgtatagacgccgcctcaaacgagcctgaaacaaggatgttacccgttcctgttactgtaaatcccgggtttacatttccggagattacaatatccccgtcaaaatcaacattgccaactgataaatcgatatccccgtcaattttaatatgaggaaacacacatacttttcccgctttcagggaagctttgcctttgatcagtgaacgaagttctttacggtcctctgaaatccggacgtttttcccctgttttggaaacagtgcttcctttcctttttgggcagcaatccgtttcccaagtacgtcagtcccgtccgttccgggcgtagcaaattctcggctcaccagtaattgaccttcatccacgcgctcaaacttcgagacgttcctgtaatcgacttttccctgttcattgcttaagaattctcctgatttatcattccttgcaaaatagtaggaaacactgccttctttcccctcttcaggcgcccgccccgttgcgatcagtattttttcttcatacggccgctccttgcacactgtttcaagctgagcttcatcaattccaaagctgacatgatatcgctccttcaataatctttcaatttccgcatcttccagcttttggccgttttcatcaggtgggtacaggatgatgtatgcctgcatacggtcttcagaaatctcaaccgctgcctcttcattaagtttatattcctcttgggcttctgctattttttcctcggcaggctgtatgcttgcaatcatagaactgatgatatcaagcctcggatgatctatctttttccgctttattgcatcgatcattttaagtttatcgatggtctgtccgccgtcttttgccgggcgcacctttaagtagaccccatcattcttataacagagccaaaacgcaccatctatttcctcaccgcttttcgacttgcggtctgctgtctcgatttccccgccttcaggcattttggcggtttctgttatcatgttatcttttctcatcttcctgcccttccgaatactttgcagatagtttttcgattgcacatttgtgtatttgcgatatgcgtgcttctgtgtatcccatagccactccgatttcccttaaagtaagctcttttgtataatatagatcgagaacaagctgctcattttttgatagttcccctatatatcctgcgagtgtgtcacgcgcttcttgttctaaaagtgtattgccgggcatccactcggtatgctcttctacaaatgggtgtatatccccctcttcaatcctggtctggaaagtgattcctctgacgatatcttcaaaatggactatataatattgacgatcgttccaaagcattttttccacttttgaaaccggcatattgaggcgctccgcgatctcttcgtatagtggactgcgattcaattcgcaagccatttcttcatatgtcttttttacaagtttcatttcatgacgcattttatatggaagccaatcttggcggcgcatatagtcatgcacttctccgttgattcgtttgtgggcataattttcaaacttatctacctgtttcggatcacatttctggattgcatccatgagaccaaatatcccgctgctgataaggtcgtcatagtctctgaatactgtcctgtaataaggtgacatcagtagtacaacttttttaaccaaatacaggtaatgttcgatcaagcggttacaattttcaagattcggatcgtcaaaataagtgtcccataacattgcgacatctaatttctcttcatccgtcaaagctttttcacccattgccattgatttttaacctcttactcatttgattcctttttcattcttttacgccgtacagtctgttgcaaatagatgtaacggcggatgctcttacggatattatcgcctgcgcgaagaaacaccgcgccaatgtgatatactttttcttggtcgtcccgcgtttgtctgatcacacgtacaatttttgctgacaagtgatatcttgtctcgtcaagtgtgaatctgcattcgatgatttctccaaattgaaaccactgcgttgaagcaaaaccgattcccgtgtcggaaatatcgagaccctggcatgcaattgacgacctttcagcatggtcaccatatttccttgaaacggacaaatcaaataacttataaagccgataagcctctcttcggttatcgtctgttgcctccgtgactgctatgagcttggtcatgcttatatcatttatggtttctataccggcaaggactgctttaaaagaataattcctaagtcctctggccatataaaccacaaaaaacatcccccgcatcttcggatgttggtcagtgtccaataattctgcaatccataggtatctgccttctgccatgcgaacctttgccttgaaatttttaccatcaggcaataggacttgaatggtctcgcccggctttacaatagattttttggtttttccatccatatgtctcacctttttgctaaccgcctaaagaaactgtggatactgttctcccgtttttcgaggcacatttttgtcaccttgttcgcaatgctttggaattgcaccgccgccatactcgacggatactgtttgagatacggcaccatcgcattaattgactgggtgatcttcttatcggttgggataaaccccagcattgaaagcatatatccaagatttttgtcagcaacatttgcaaggctttggtaggttacatcagcttctttttcacctgtagttttattgatcacaacgctcatagccggtcgatgagaaagtcgcgctgtagttttgattacgacataaccatccaatatagacgttggttccggcgtcgttaccagcaccgtctggtcgcttgcctcgatcatccgcaggatattgtcgttgataccggctccggtgtcgaagatgatataatccatctgttgttccagcgagcttaattgatttatcatccgttccatctggtcaccgcgcaaacgcagtagatccgatacgcctgaaccaccggaaatataccatacgccagggtaggattcctccatgacttccggcaggcttttttcaccgcgtaccacctgttccagcgaatattttgcgttttttcccagcataacgttcacgttagaaaatccaaaatcgccgtcaaatatcacagttttttttccacagttcgcaagggcaagcgcaaagttcactgaaaaactcgttttgccaacgccgccttttccgctggttacgcaaaatgtcaacgccttgcttccctcaggcatttgtgcagtttttacccgttcacgtaataattgcgtttgatccttcatatcatttctccagaattgatcccgctatttcagtggggtcaacgagtttaatatcatctggaacattttgacctgtcgtcatataccgaagcggccttccgctgatttcagcaagggagagaaacacgccgcgttcgggcgcttcgtccgttttcgttatgataatgctgcattttttcaggaagctataattcttaagggtcgatcggagtacacgttctgaagtcgctgccgaaagcgtaatgcatatgtcgtcaatcttgccgatgtttacaagcttagcgatatccatcagatattgattgtcgtccgaaatctttccagatgtgtcgatcaggatcacgtccttatcagcaaaagctgccatcgcatcttttagctcctctggtttgtagatcgtgaccatgtctgtcttcaggatttcgcaatacgcctcaatatgctcctttgctgcaatacggaatgaatcggcattgacgatcccaatattcagattttcctgatacaccaacatataagcgagcttaatgagtgttgttgttttccccactcccggcggtcctatcaacatgactgccttctgacgatattttgtcgtttcgatcggacagggttttcccagggagttctttactaagctgaatacgacttcttccgcgtccgcatccctgctgtccacgattttttcagcatcagagcaaattttctctgcgaccatttcttctacgccgtttttgatcatccgctgacatattcgcgtgatttcacttgaaaaatacttttgcgtctgactctcgggtgatgatacgcgttcgcttaagcgctcaatcattcccttcagttcttccatatcctgctttatttcatggttatcgcgcggcacattcggcggcgcggcctcggcttttacaggatagcggttataaatttcattcgttgctgtttccggctgtagtggttttgcatcttcctgctcttcaaacccaacccgcacctcatattcttttttaccgaaaagtccccatagcccttttctttttcttacctgcttgctgctcatgatcactgcgtccggcccgatctcgtccttgatgatttgcatggcttgcgacatattatctgcacggaatgttttcagtttcatttcgttgtctcccttcgttctcttttttactacaagccgattacttcatcggaatatacttctacatcagtctcgagttcgttataagacagcacgatcagatccggtaccagcgaacgggtaatactcttgaattgacgacgcacgagcggcgaagtcaagacaaccggcgtgattcccatctggttcattttctcaactgattttctcaaatgactataaatcctttgtatttcttcttgcgaaagcgccacataggtcccctgctccgtttgttttgttttctccgcaatcaggttttcaagggatggatcaagcgtaatcacccttgcattcccgtccggtacaaaccgcttcgaaattgcccgaaacaggctttttcgcacatattccgtcagtaaatccgtatcgcgtactgtcgcgccgtaatctgcgagtgtttccaggatcgaccccatgtccctgatcggtatattttcctcaagcaggtttcccagtaccttttgcagttcgccaagtgagaataattttgggactgtctcttccacaagcgctggctgagatgtcttgagattgtcagcgagcgtttgtacctgctgacgggtcaagagctccgatgcatggcgcttgatcgtttctgtcaggtgcgttgcaatgacggaaggggcgtcaaccgtcgtatatccgagcagttccgccttctcacgttcgctttcagtgatccagaccgccggcagcccgaatgtcggttccattgtctcgatcccctgtatttttcctttcacatcatttgtgctgagtgcaagcacatgatccagcataacctcgccttttgccacctcgacgcctttgatctttatgacatattcatttgtactgagttggatgttgtccctgatacggatcactggtacaatgatcccaaggtcgatcgcgcattgtctgcggatcatgacgacgcgttccagcaaatctccgccctgggtggtatcgacgagcgggaccagtccgtaaccaagttcgatcccgatgagctcaacctgcaaaagcgacgtcacattctctggtttgcgtttttccttggcagccgcaagcgctttgtcttcctcaactgtcggtttttccggtttcttattcgcccgcagcagtacgatccctatcacgaagatcagtgctgcaatgatatagatcggaacctttggcagtcccggaatcagactgatcacaaccagcatcactcctaggatcaggaacacatagggctggttggtgagttgcgtaaaaagatcccgtccaaagttttcctttgatgctgcacgggtgacaatgatgcctgtcgcagtcgacaccatgagcgccggtatttggcttaccagaccgtcgcctatggtcgcgatcgtataaatctgcgcaatttcgctgaattccatccctgcgccggacgtcatgccgatgataatacctccgacaatgttgatgactgtgatcaatattccgacgatcgcgtcgccttttacaaatttgctggagccgtccattgccccataaaaatcggcttcgctcgaaatcttctcgcgccgttcctttgcctgctgctcgttgatcaaaccagaattcaggtccgcatcgatcgccatttgcttgcccggcatcgcgtccagcgtaaaccgtgcggaaacctcggctacgcgttccgcgccctttgtgatcacgacaaactggatcacaacaataatcaggaagataatgattcctactataaggttaccgcctgtagcaaaactaccgaacgcttcgatcacattacccgcatcgccgccgtttccaaggatcaggcgcgtggacgcgatattgagccctaagcgaaatagcgtgaggatcaatagcagtgtcggaaatgctgcgaattccagcgcctcgcgtacataaagcgtcattagtagcactagcagcgacgtcgaaatattcaagaccagaaacacatccagcatagccggcggaatcggcagtatgatgagcagcactaccagtaggataacacctgctatcgccgcatctttgatcttcatccgttacctctttatcatcaaaataagttctatttttgtttctgttttttatagacccgggcgagtatctccgccacgatctggtacatctcaactggaatttgctcgccgatttcgcacatgacatacaaactgcgcgcaagcggtttgttttctaccagttctatttcatgttcagccgcgatctccctgattttcgcagcaatcgcatctttacctttcgcgatcacaaccggcgcgctgcccttttgatcgtcatactgaagcgccaccgcatattgcgttgggttggtgatgatgacgtcggcattagggacctcctgcatcatgcgcatcattgccatctggcgctgcttctggcgtatttttcccttgatctgtggatcgccttcctgctgtttcatctccatacggacttcatacttagtcatcatcaggtccttttcaaactttttgcgttggaacatataatccaaaaccgcaataatcgcgagaaaaagcaatattttgaatccggcgctgaatatcatttcggcaacctgaagaatcgacgtttgtaagcttgggccaagcatcatcgaaaacgcaggcagcgccgctttgatttcggtatagatcacgacgccgatcactacaattttcaggatcgattttaatagttcaaacacggtccgtcctgaaaaaagccttttgaatccttccacaatattgagtctgttcatcttaggttccagagcttttgtgctgaacaaaaaaccagtctgcaccacattgacaagaaccgcggcgatcactgccaccgcaaggatcggcagcatgatctgtagaaatccgtagatcatttgctgcatgaccggcccaatattgtccatacccagttttttatccggcaggtactgcaccgacaggaaagtgcccgtgaaatccatgatcccttgcgcgatcatgggagtgaggaatttcaatgccgcaaacatgatcagaagacagcccgtcataacgagctcattgcttttcaggacctgtccgcgttctcgcgcgtcctggcgtcgtttgggggtggcgctttcggttttttcgccggtactgttgttgtcagccatcgctttcctatcctgtgagagttgcgaacatccgttccaaccccgcaaacatttgatcaaacacctgggacataaaagcgacatacacaggtatgaccgcaaacaatacgaggaatcccaggattattttgatcggaataccaatcgaaaaagcattcatttgcggaaccatgcgcatcatgatcccaaaacatgcttcgcccagtaatcccgaggcgacaattggcatcgcgacgatcgccgccagtaaaaacgcctggatgaagagctccaaagcgacccagccaatctgcggattgaaaacgactccgccaattgggatcttttcgatcgataacgccatgatgcggatcaggtaatcatagccccgtaccgagaaaaacaccatcagcatcagcaaattcaaaaaatttccgatcatcgggatgctcaggttgctttgcacatcgaatacgttgaccatgccaaagcccatctgcatgtcgatcatttgccctgccgtaaaggcaatcagctggaagaacaaattgagtacaaagctcagtaccaaaccaaaaagcagttctttgacgcaaagaaggataaacagtaaaatatccccgccgtaatcgaatgccgccatttgcgctgcgatctggtccgcagacatgaaaaacaataccgcgatacaggcacaatacccgatttttacgacgtttgggatgttgctccttccgaaaatcggcgatgcaaagatgagacctgatacccgcaggaacagcagcaaaaagaactcccagtttgaaaaaaacgctccaaagaaatccgtcatgtttaaaccgctcatcagctgactgttacagcgtactcataaattcgggtcgtaaattcggtcaggttgttcagcatcattcctccaaaaatcagcagggccaccaggatcgcaatgatcttcggcacaaatgtcaacgtttgttcattgatttgtgtcgctgcctgaaaaatcgaaatgattatcccgactaccaatccaatcaggattggtggtaatgccactgttaaaacagtgctgatcgcgtcctgcataattgtgataatcgttgcctggtctatcctaaccacttccctatcttagttttttgcacgctcaacttccccaaaccaaactcacattatgttgctacgtgaatgtgttgaaggtcgaaagcagagtttgcatcgtcagcgaccagccgtcgactaaaataaacagcaataccttaaacggcagcgagatcacgatcggcggcagcatcatcatgcccattgccataagggtactagatacgaccatgtcgatcacaatgaacggtatatagatgaaaaaaccgatcataaatccgcgtttcagctcgctggtaataaaagccggtatgatcgtcgtgatcggtacttcttccaattcctgcgtatctgtatcgccggaaaagtccaaaaacaggttgaggtcgtctttatatgtctgcatcagcataaattcacgaatcggttgttctgttgcttcgacagcttcgtcaaacgttatctcctgtgcaacgtatggatcgactgcctctgttttgatttggctgaatacgggcgccattacaaaaaacgtcaggaacagcgccaaggctaccaaaacctggttcggcggcatctgctgtaggccaagcgcgtttctggtgaacgacagcacgatcacgatccgggtaaagccggtgaccatcagcaggatcgacggcgcgatcgcaaggatcgtcagtagtccgacaagctgcaggctggcagaccggctgcccataagctgcgcaagcggacctgcaccctcgtcggcgccttgtgccccgctccctgtcgcatctgtcggcaggctcgcacaacccgtaaagacaatcaggatcgtaagaacggaaatgatcaatagtaccagttttaatactgttttctttttcaaagtgccgtaccccttaccaaatctaacttattgatcctttcctgtcttatcgctgtctgcatcaatcttttccttgaactgttcttcaaacgtaccgttattcttatttttactgcctggcagatagcttcttattacgataaaaaagcattttttgaaccgcttccaaaaagtgtcctgtgctgcgggtacgaggtctttcccattctgttgcttttcctccggcacatcggattcccgttcttcagcttccttaggaatgtcgactttatcgatttgctcaaaaccctgtgcggtcgtacccaaaaggtaatatttcccctggaactctatcacaactatcgttttttcgcggtcaatcgaaatcctgtcggcgactgataccatatgcccgaattcattttttttcgatccggcgaatccgccgcccgctttgggcttcatcccttttctaagagaacgcttagcaacatattttgttaaaaagtatgccgccgccacgatcaataccagataaaggataatgaccaatacgttggtcacgtcaactcccggcgcaagctgcaatgcattttcctctgccatggattccctttcgtcctacaggttcatgcgcatgatctcgttgtatgcgtccaacactttattgcggacctgtatgaccatgttgagtgataaatctgctttcgtgctgtcgatcattacctttgcaatatcgtcaacctcgcccgaaagaagggcttgcgttccttcctgcgaagttgtttgcaggtcatccgcctgtgctaccgctttggaaagtatactgccaaaatccgcccctacgggagccgcttcgtttccttcctttaccggtagtttatttactgcgtataactctgccggtgatgtgaccggtgtaatactgctcattgccttttcctccttttatttcccaatttcaagtgcgttcatcgccatgcttttcgttgaattcattaccgtaatattcgcttcatatgacctcgttgccgacatcatatccgccatttcacgtgcaagttcaacgtttggcatccttacataaccgaattcatcggcgtcaggatgcgttggattgtagtcgagcttgaattcagatggatcctccgcgatttccgtgacgcgcacaccgctgcccgcgcttcctgcaagtgaattattcagcgtttccgaaaagctcgcgccgtctctttgctggaatatcacatatctcctccggtaaggttgtccgccggccgttcgcgtcgtgttgatgttggccacgttttccgctacgacatccatgcggagcctctgtgctgtaagagcagaacccgaaatgtccaaagatgataaaaatgccactttatttccctccttactgtcccttgatcgccgtgcgaagctggttgaattgtccgtttatctttcgcagcaacgtattgtagtaaattacattcttggcatagtccgtcatttcctgatcaatatcgacattattgccatccatgcggtagtttgtcgaagatttcatagaaacgatgcctttcacgtcgcttccatccgaactgccgccaatgggcatgtgcgtcgcccttgtctgcttgaactggaatccatcttctttttccagcgcttccttgtacaacgtttcaaactcgacgcccgacgcgctatagtctggcgtatcattgttcgctatgttgttgagaatcgtctcatttcgaagccacgaagcttcaagaccgttttcaaggccttttattccatcgaacattcccatattgcattcctcctcttattcccctggcaattggaacgatgattgctccagtaagtggtcgacgacagtcaccaatcgtccaatttcaggtttggagagctgttcgtccgctccaacttcctttcctttgatacgcatctcgtcattgatcagagaagaaaatacaatgaccgggatttttttcagcgctctgtcgtccttgatcagcttagttaaatgatgtccgtccattttcggcatttcgatgtccgtaatgatgcaggatgttttatcattgacaggaattctcgcatcactgcattcttttttaagctccgccaaataatcccaagcttcttgtccgttatccttttttaccgtatttgtatatccggccttgtgcagcgcttgaaggatcattgcggaaagcagtatcgagtcctcaaccactaaaattgggctgtcgttttgctcccgttcgcccagttcgtcaatttcagataactgtatccccgtttcaggggcgatatccgcaacaattttctcaaagtccaggactgtgatcagccggccttcaaactgggctaaccctgtcacaatcccatcctttccgccataaattgttttatccggtttttcaatatccgtccatgaaatcctgtcgatcccctccacggtatccacgcgaaaagcaatgtgcatattattgaaattggcaacaatgagcaaatcttttgattcgtcatgttcactttccatatccagatatttaggcaggttgatcacagtgatcaatatgtcccgcggcttaaatacgccctctacggcgcgatgcacatggggcatgcgttttacatccatgggattcatgatctccctgatttttgctacattgatgccaaacgtattttgcgaaatcgtaaattccatgatttctatttcatttgtacctgattccaacagaatctcttgtttgtttttctgattcatgctttctcctttatgacgttcagcgatttgacatccagacttttagattcccctctgttttaagtatgctcccaatttcgcatcttcacgtttgatatggtttaaaagccacattccaacctttttgttgatttctccaacaagcacaagggatgttccttctttttcgtattcatctatcatgtctttcacgctggccttaaagttctcatgatacgacttgtgctgcactcgttccggataaccgttttccctctggagtttttcttcatcgctgaaatgccttatgatataatcgctcaggaatttcaacgttttaccgatctcgtccctgccttgtccctgagcgcacgcatcagacagatggttcatcgcatcaaataattctctgtgttgtgtgtctattaaagcaacgccggtttccaaatcctttgtaaatacatacgccattataaatgtctcctttttactcttttactgaaaatcactaaaacgctacattttagaattcacttcaatcaggctgtcccatgtttcgttgaccatatccacacattcgaaatacttttgggatattacatggaccgggattccaagtgcttcggcattgttggacatccctacccaattgccctgttcataaaacaataccaggttatacaggattcctgcccgtccttcttgcgtcaaaagtgcctgcaccacatattcggaaatgctgagttcgcttaaagcttcttccagggtcacatctagcagagacccaagtgtggaaaacatgcccatcaaataggcttccggttttgttatcggcatatcctccgcaagcggctgaagctcagaacaaaagttggcccgcataaacgatattttgataaattcggatggaatttccgaatcggactggaagctcagcaagtatatccattgcctaagctgtccgagtcccagaaccaccaatgcctggtgcacggactctacattattccgcaaagcaaaatacgaagaattaaccagcttcaagagcgcataggtaagcgtaacgtcgcgcgtaatcaattcttctatttcatcgaaatccgcatcgtctttcgtgactgcaactacaagctggaagaagttactttgcaggtgctccacccgttgtaccttttcaggcagcatggtaccaatgtacgtaccttgcatatagtccacaccaatatccagcgccgcttgataagttgtttcatcgtcgatattgaaggcgacgatatcctttccaagccccttggcaatttccgctatactgtcttttgagacagtctccagtttaaaattaattttgatcatatcaacgcaatcgatcgctgaaagatacctgctgttaaattcaaaacctttcaatgcaattttgtagccctgtttccgatatttcttagcgagcttcattgcaagcgggtttaagagaacgtcctcgtcaatctgaatgacaagcttatccgcatcgaaggtttggggaacgttcctgaggagcagccccggcgtaaaattcacgaaagcgatcttgtcctctaaaaagccctcgctttgaaactgcattaacagcgtttcaatcgcattggcggcggcagcgtctcctgatggaacgccaaggttttcatcctccacataaagaatctcatatgcgtataattcgttgtccctgctgtggattggttgcttgacaatatatggttgtgtctgcattctttttctcctttatttttactgcccgagtcctgcataccgcaaaaccctatctgcataatccctaaccgactgcggtatcgttaggtattcagggctgttgctgctggtgacattgcgtttagcaacgttgcccgggcccgtgttatacgccgcaagcgcgagcttaatatcgccgttataggttttcaggtgccttgcgatttcatcaacgccgcagaagatgttctgccttgggtcgaatacgtcggtcacaccatattccgccgcattttcaggcatgatctgcatcaggccttttgcgcccgcgcctgaaacgcattgtgggttgaaatccgattcggcttttatgacgcccatgatcaggttgaccggcaccccgtagaccgatgacgcttcttcgatgatatccatatatggctcggctttttgaagcataccgtctgcggtgtctactgctccggtatattgcgcgtatgtgctcgagatttccggcatcccgcatttgctgcaatatcgtccggtggataccatattgttttgcagcgtattagaatcggcagtcgtctgcgttgtcggagaattgtcacgaagtttgtcactgtataaggtctgaaaatccaaaccgaccctggcagttttttgctcgatcctgctctggatttctccgatacgcgtttgtacgctttcaatacccaatcgtttttcctactttctttttttatagatcgacggttgtacatattcaaagccggcttcgcttttgatcagtgtttccgacaagccgatgaaaagatatccgcccggcaggatcgtgtcgaaaaacttccgcgccagttttcgtcttgtcggttcatcgaagtagatcatcacattccggcaaaatacgacatggaattttcttttgaagctgaattccggttccatcaggttgaacttgcggtagatcacttcttttttgatctgatggcttacctcgtattccccatccctgatcttgctaaaatacttccgttgccatgcctgcggcatcttgctcatatgttctccgcgatagatgccgctgcgtgcgatccccaaaactttatcggagatatctgttgccaaaaccctggtgtcaagcccgcgcttatcaccattgaagtaatcatgcagaaacatcgcgattgtataaggctcctcccccgacgaacatccggcgctccagatattgaggttcccatctttgatgttcggcgcaatttccggcatggccacattgcgcaaaaaatcaaaatgttgttcctctcggtaaaaatatgtgaaatttgtcgtcagccttgtgacaacaagggaaatatcctctcctgattgatccgattccatatggctgataaaatccgcaaagcttttgaatccacgtctctcaagaacgtttcccaaccgtccttcaatcaattggcgtttttggctcaggttgacgccaaacctctgatacataaaatcgcgtaatttataaaattcattggtatccagcttcattgattaccgcctttacaaatacatatcgacaagcaggcctctgatgtcatcaatgtcgtttaataaatctatattgtctttttcttccgcaagtactttttttgtcaatgaatcgagtttttcgttgatcttgctgatcatggcaaatattttgctgcgtccgttcacgccgatctttctttccttgtgaaacgcaaagccgttacttactgtttcattgattagctttgtgatcatttccctgtacttctgcatttctcccatatccgcccgttttgatagccgtttcccctgctcttcgatccggccgacaagttcctcaatgtggcggatatatacagaattcgattcttcggacagcttactggaaaaagtcagttcaactccgtgtgaacctgccgtgtcaaaatcagctcttgacatggactcaaccggtatattgttgatgttttgtactttcatgttaatatctcttcttccatcacttcgttctgttgatcatcgtcccttcctgggcactatcatgcatctgcttgctgtaagcaccgatcgtatcgcgactctgtttattcgtacgcatccgctcgcttactccgttcatgagcattgttatcgtatcaatattttctgtttcaatctcttggatctgcagtagcagttctttgcacagccatttatgtttttcttcctcttccggtagctttatctcgattgaagaactctggtcatttagctgcgtaaccatttttatgattttacttctctcgtcgatcagagccgcgatctcttcgacgcgctctgtggcactcagggatacgagcaaatccgatatttttttcgtcagcttcaaaaactcctgcagcaaaactactctctctttccatttggcttccgtgtgttccattattcctgcccctgctcgctttcctgcgtatatacgccgccctcgacccgagcttttacttcgctccatgcttcggatagtgatgtcagcatttcaatcacgggttcggcgcggtcggtatctttcgtaaggtccgcctgcacgatctcatctaccatgaactggtacagctccaaaaggttttccgagatcggtatgctgaggttcaggctgcgtaccaattcgaggatgatttcctccgctttttcgtagcatacagatacctgggcaagttccttgttctccatatggatttttgcgagttttaaatgcttgatgcatccttcgtacaacataacgaccaagtcgaccgggcttgcggtcgtcacataatcctgcctgtattggtcttgcggattcgcggtagcataaaaagtcatgttgatgctccttcctattgactgcgtcagcccagcgctgagatttgctgcgatagccatgtgctttgcgactgatattgtgacagcagcgtttccatccgcgaaaactgactgtacaggcgttcctgctcctcgtacatctttttgatcataagctccatggaatcgttcatgtcgtctatcatatcgtttgtgtttttcaggtcaacgccccggatatgtgttctgaactcggatatttggtcgaaaaattttgtgatgaggccggactgcgccttttctgttgcatggttcgtcgacgttgagacgttcgccataacacgcgaaaccgcatccggatcctttttcatcgcatcgcgaaacttatcctcgtcaaaagaaatttggccaccgtattctcccttggagtatttcgatgtgttaaaaccaagatcatacggagaaagccccgtgccttctactgttttgaatatatccatccgaagggatgataacagatccttgatcgtgttatcattgcgcaggatgccttttttcgcctcagcgtcccacttttcaatgtccttatcggacattttgtcgtcttcgcgctgggtttgcgtcagcggggaataatcgtaatctatctcttccgttactttggaatacaatgcttgtgtcagggtattgtagtctttcacaaacgcctttaccttgtctacgaccttatcgatgtcctgatcgacggaaaagtttgccggtccgagatcctccgagttgttctccgcatcgaaatcgactttgagcgtaaattgcaatccgtcaagcgtaaatacgttggaggactgcgtaatggtttcgccgtcgattacgatggtcgcatccgtaccctttgcttccgattccacggctccaaagaaagaattcgccccgccaaaggcgttagcgccgccggagttctcaacagagacagatgaatttcgccctgtcgcgctgctcgtaaacacgaaagaatccgtaatctggctgtaggtaagccttgcctttgcgtccttatcgccattgaccgcattgatcatcttttccagcgtatccgttgtatcaaaggaaaatttaacgtcgttcacaataaaactgaattttcctttctcgtcaagctgaaggtccacgcccatttttgcggccgctgtcgcgatcgtgtcgctctggcggttgatcgtttgatacccttccgtttcatcttctgcgatgccggtgagcccgccttctccgaaaaagtccgttccctgcaggttttcagttttgatctgcgttccgctgccttgcaggtcgctgcgtagcataaaacggtcgcgctcctgatcgtaggtaagagttgcctttgcatccggatcatcgttcaccgtatcgattatgtcttttatctttgtatcaccgtcaaaatgaaaaacctttccgttgacgctgaattcaataaaatcttgtccgctgtcacccagcgttttccccgtcgctgctgtcatttcattcagggtcatgttttcattaatcaggctcttaggctcggttacaagatcttcgatcccgaatgcgccgtctttcccaaatacggccggccctgcgacattgccaaagacaagtgctgttttctcgcctttgaccgtgcttgaaaacgaaatatatccatccggtgtgatagacatttttgcttttgcggcaggcgacgcacttacatcattaatcacttcattgagtttctggtcctggttgaacgtaaatgtttgtccgttgaccgagaatgaaactttgtcagttgaactgctgaattggaacaccttagttccgtcctcatatttcagatcacgtaattccgtcgtatcagagccgctggtcagttttttattcccaattgcggatgccagtgaatttgcgtgttctgttcccgaaatccccgcggcgcgattccggtactgttcacctttaatggttgcatagtccgcaagcgttgttttggtgatctgatgccgggaaatcgacgctgtaggcgtacctgcaatatcaaaatatgccccgtatttatcggaaaggcttattttgaatgctttatacacgctcgacgaaaacacattgtcgttgcttaactggctcatgtatttgtcgctgaactccgtgatcagtttgttgatatccgtgtaagcgtcccgcttccattccatcttcgttttgttctggtacaaacggtcgagcttagcctgttgggtagacatcgccttttcgatcagggcgtccgtatccagtcctgaattaagtccggttatccttgtcgtgctatacccgctgattgtattgatcgccataattgacacatcctttcctgtttgacggtctactgaaagacctttaatccttatcagtcaaaatcactgcaagattcatgtgcagtttcttattgcaactacgtttatatatgtacgaagtattccacctcggtaagcctttgcgcactgtaagcgcagcttgcataatcatagtttttaagctgccgtccagcttgggcgatcgcaacgccccgccctgcatcatatgtcccgtccgccgatggactcacgacttgaaggtgcccgtgcccactgccgtttttccacgacgttatggcgggcatgcccatatttgcgtaattttgcgcttcctccggtgtgacttttctccatccgtaaaccgagccatatgtgttcagccagtcgtttacgccgttcgcatcgagctctcttgcgtcttcttcaccggaagaagcaggtgcaccggatgcgtcgatgtaatgcggtacttctgctcccattgcgcgcgtgacgtcccatgcaaaaacattgcaataggtgtcacccgttccgtttttattaacgcggtagcgttcattggtttccacatggaactggtcgattaccgagcgataagctgccgcgcttcgttccccaacatggtttgtgagcatcggattcgcttccagccatgattggctcggaatcccttgtgaggctgttttggcataaggatcaatataattgtgctggcaatactgtgactgtgccgtattgctgcttcccgtcaagagactgcccagagaactgccctgctgctgtcccatcaaaaggagcaataaaagcatagtaaacatatctcctgatccgccgcccattccaagcatggaagaggtcccccccattcccatcatcccgtccatataggaagacccgcctccatcgctatcgaagctgccgattgagcttgcggacatcgacatataactgctcagtaattgggcaaacggattcgcagtattggatgaagctacgacgttgccggtcgtatttggcgtgcttgtctggtttgttgaacctatcgaaccaatcggcattttaatactctcctttatatctgtatatcaagtcccgtaatcctgatctctttttcgttctctagtacctttcgtacgttgagcggagtgatacgttcgttcatttcagtcacaaatatccggctgagcggaaactcgtcatcccgtaactgcgcggcaagctcttctgtactttgtgcaaggaactgcttcacccggctgtcctcaacgcgaaattccacagaaaggtcattcgcttgtgagcgaagcaccgtctcaacacggcccatgttctgcgtatcaagaccaatcagtacggtgatattcgtttcctcttccgccgctttagtatggggacgctcaaatacatacaggtccgctgttcctttctgctcgtgcatctcgaatgggatctggcaataataaaactgatccatttggtttcccagtcgtacctgcgcgtttaagtcgttcgtcttttgcgctgcgacgcttgcttcccccatcagctttgcaatcccgtacttcaacgattcagcgagatttggctggcgttggatcgtctcctgaagctgctgcgcatcggcaggaatattaagtcccttaatgcgggcaaaaaaatggctgatcagtgcaagcacttcttctcttcccgtcgtgggcccactacgtaccgcctgtgcgtcggattgggcagcttgtgcaggctgctgtttgagtattggcgcctctttgctttcaatattggcgacaaatagcttctggcctgtatcggttgaagccttaaccacattttctgtgctgacatccgcttcctttgcgacttgaaagctcttcatcagcactgtttcaagcgcctctcgctctcccttcgggagctgcacctgatccaaaaagccatgaattgcggagtatactttcgtatcgttctgatttgaagtgcccagttgcaccgccagcttttcaaattccgttccacctagtatctttacctgttctggggtcaactgccgcaaaaccgtatcattaaaaaatttggcgaacttctccgaatatgtctgttcaagcaagtttccaatttccgttacgtttttccccagtgcggcagcctctgccccccatttcatcaggatttgtgcattttgctgcgtgggcggtattttgttcgttaccatcatcgcagccagaaaagccggtaactcaggcaggttctcagctacttgaaacagattagatagattctcagccgtaggctcgacatggtaatgcagtaatagctgcattgcaacctcgtttaccttggatggcggtattcccatttccatcaggtaaacctgcaattggtttgactcaaggttgactgtctgtccgttgacagatgtcagtttgagatatacaattcccgaatcatgccctgtcatagtaagctcaacggtatcgccggcgcttattgcgatgccctttggaaactgcgcatggatttccctgccatccgccgttttcagcgtcgcttcccttccagtaacttcaatcacctctgcgtttacctgatcccctgcactaagcccagaaaaggacgcagcattagaatcggtttgtattccgtttcccgattctgtcgtccgtatattgatcgagcccgtaatctgctgcatttctttttcctttccctgttcctattgcctgacgcttttgccatggtatataatagaatcaaatcactaaaaccagatggagcgtattatgaaacaagatcctaaccgccgccctcttcaggccgcggccttaaaatatgacccattatccggcgatgcccctattattgccgctcttggcatggggcacgtcgccaaaaaaatcatcgaagcggctgaggaacatcatgtgccggtcgttgaggataagcccctctcggacattcttgcaagcctttcggttggcgacgtcattccgccaaagctatatgaagcggttgcccgcatcctcgtgttcgtcagccataaagacgcggagtttcgcgagaaacttcccttttgaatcattgtttcggctgcgcggtcaggtgcttcatcaaggcgtccgctatctggtcgagcggtgcttgcagggtgactgcgcccattttttttgcaaccatcggcataccataaacaacgcagctcgtctcgtcttgcccgatcgtatatgcgcccttttttttcatttccaataggccctgtgcaccgtcagctcccattcctgtcaatagtattccgatcgtattccggtccgccagcttggcagcggactgaaacatgacatctaccgacggacagtgaccgtttactttatcgccctgccacaggcggatcaccctgccagccccctgatttacgacctgcaagtgtttgtcgcccggcgcgatatatacgtgccccgctttgatgacgtcgttttcttcagcctctttaacggaaaccgcacattccttatcaaggcgctgtgcatacattttcgtaaaaaccggcggcatatgttgtgtcacgaccattcccggaatatttgcgggaagctgccgtaaaataacgcttgtggcttccgttccgccggttgacgctccaagcgcaataaggccgctccttgaaaaaatccccggcgccgttgccggtttgttatgcgtcctagagactaacgatgcccgttttgccttgacatccacacccgatgcgactaaaactttttcttcaatctcgcgagaaaaactcgtcatcttgcctccggatgtgcttgaaggcttctcaacgaaatccactgcaccggcgcgcatcgcatcaaatactacaccgtcaagggaacttaccacaaccaccggcagaggatattgcggcatcaggatttttaaaaactctatcccgttcatccttggcatttccacatcaagcgtcataacgtccggtttcagtgcaaggagtttatcccgcgcttcgtacggatcttttgcaacgccgacgatcctcacttttggatgatttgcaaacgaatcagcgattgctgtcctgaaaaatgcagaatcatctacaataagcagtttaattttttgattattcatcatttcctgttagtccaatcgcttacttataagagttcctgcgcgttcggcatgttgatctccgtgatgcgcacgccatagttatcatcaatgacaacaacttcgcctttaccaatgcacttcccatttaccaggatatctaccgtttcacccgcagccctgtctagaacaacgaccgctccggtattgaaatccagtatatctttgatttttttctttacacggccaagttctaccgtcacgctcatcggaacatccaatatcatttcgatgttctcgagcgaaggaaccccgacattcccgctcacatcgttgaaattttgaaattgcggctgccggacgcgtatattctgttgttcgcggatcacctgttgctgctgtgctccgccgcttttcgcaacgtgagcaggcatacggccctgttcgcttgctgcaggaatatctggttgcgcagtaggttgctgttgggcagacggctgcgcctttgtttctgtgggctgtacctgccccgcatccatgtgtggttcgttcgtttctatgccgatatcggcctgcatttgctgccacacctggcgcgccatatccttggcaaaatccactgtcagcacctgcataatttcgctcatgagcaagtcttcgatttccatatggaaattgatgcggacaaagagttctttttggctcgaaaaaaactccgaaaggctttcatcctggatggaaatacgctttgtaaccggtgttgaaatatccaccattcgatgcagcatatcggcaagcgctgttgcggacgatccaaccatttggttcatgatctccccaatcgcgctcatatggatttccgtcaggtcaatattgtccggatcgacctcttcttcgtcgccgagcatgaggtttgtaattttggcaacgtctaattctttcaggatcaaaagattatttccttcgagaccgcttgtatacttaatttccgatacaacaagcggagccggatactcatttctcagggatcctacggtatgaactgttatctccggtgttgtaattgttgttttcctgccaagcaacgtcgacattgtggtagcggacgtacccatgcagatattcccgatttcgccgagcagatcctgttcgtcttttgttaggtaatcgtcaacaatcagcccttccgcaggttcttcctgcgcgggcgcatccgtatcggaaagcattttttcaatctcttcctgggataaaacttcgttactcaatgttctcattctccttgattatctttgctacttgaaccgcatatttatggtgatctgttccaatcacgcccttaaatttagggatcgattccacgctcaggttaatgcattcattgattggatggttcaggtatatgacatctccgatctgcatcctcaaaatttcgcccaactgtgtttctgtctcgttaaacgtcgcttcaatcgttacgtacgtattatgcagttggtcttccatattcttttcctgattcgtgcctttgttttgtttctgcgtttcagcaagggtccagttgaccgtacttaactgcctggcgaccggctggattgagtaatgcgggatgcaaagtgcaataattccttcgatctcgtctatttttgcgttcatcgtaacgatggccgccggttcgttcattgccgcaatttgggtaaactgtgaactgttttctatggttttgatcacagggtcaacactcacaattttgccccaagcatctttcatgactcccatcatttgatgcataatattttccacaagcgacatttcgatctctgtaaaagatttttcgttctgcgaataatccgcttctccgccgaacaggcggctgatcagtgcatagaccagcgatgcagacaactccatcaacagcgatccctggaaagggtccatatcgatcaccccaaggatgaccggtgacggcagtgaattgttgaattcaccaaagctctgttcttctaccgatatcacttcaacactgcatacagtgtgtaaaagtccggtcagtttattgctaagaaggtacgagaaactatcaaagacaacgtttaatgtacgcatctgctccctatagaacttgtttgctgtcctgaagtcataaatgcgcgcagcagaagactgcatatccggcttttcttcagggacatcttctcccgcattcagggcatttagcagcgcgtcaatttcgttttgcgataaaacctccgacaactggcttcctcctaacctttcatttcactctcaagctactgtattacaaaatcactgatgtaaacggtataaagctcttctgactggagcgccgttttcagagattctgtcatttcgccttccagcatgttgattgcctgcggcgtccgtaattcgtcttctgtatggttaatcagtacttttataacagcattgcggatcacagcgttattcgtttcaaggaatgccgtctgatcgcttcctgtaaacgcaagcgatacgctcgttttacatagcgcgctgctctcttctatattggtgacaaaatattcgcctggcgtataataatacatgtcctccagtttagctgcttcagttgcgccatcttcttccggagtttgcctaaaaacaaagtagtagacgcaaaatgcggcgatgactgcgatgattacaatgatgattggtacgatttttttctttttcatacgatttccctctactgcccttgaataggcgcattcttgctttccaaaataaactctaccctgcggttttgctgcttgccttccgccgtctcgtttgacacgaccggctttgtctcgccccagccaaccgtctggacagaaccaatgtcagggataccgctgttttcattcatgaaccgtaaaacttcatttgcccgttcgcttgaaagactgcggttgtccttgaactgcgccgttttgatcggatcggtatccgtatgcccctcgattttcagcatattcacactgtcccacgattccatcatcatgttcccaagatcggttagaatcgtttccgccgtctcgtcgcggacatctgcctttcccgactcgaacaaaataccttcgagtatcgtgatataaatgtattgcccgtccttttgcacgacgatggtcgatccgaggttatgctcttcaatgtattgcgtcagtttaccgtaaagatcattgaacatcgcctcgaccttatagtcgtactccattttctcttcgctgtcgtcttccgcctttttatcctctttgtcccgcggggtcactttcgggatatagtcagacggtgcaaacccggccgtcggattcaatggatcgataggttccacgaccgcgcccgtcggttcccccgtaaaggactgcacgatccggatccatttcgattcgttcatctgggaagaagcaaacagcattacgaaaaaggtgagaagcagcgttaccatgtctccataggtgtccatccaataggcgcccttactttcgcgcttcttcttttgtcttttgtcagccattctgcacttctccttcaggctccgcatccgcagtcggctcatcggcttcttttttgccgttatcgatgtccgaagccgcgacgaacgcctttagcttatcctcgatcacacgcgggttttcaccgtcctgtatggacaagatgccctcgatgatgatgtccttgcacaaaagctcctccgtatttcgcgcgcttagctgctttgcgatcgggttgaagatcaggttcgcaaaaataacgccatagaacgtcgtgatcaaggccagcgacatcgccggtccaatcgtatccatatcgcccgtcaggtttttaagcatattgatcaggccgatcaaagtcccgatcataccaaaggcaggggcgcaactcgaggcagtctcaaacatggaaatcagctttgaatgtcgttcgtccgtaaaatacgactgcgtttccagcatgcttttcacaagttccggatccgtaccgtccatgatcagcataatcccgtttttaacgaacgggtccttgatatcctcaagacggtcttctaaggccaagatcccgtttttccgggcaatgttcgccatttcaacgatttccctgacttgctccatataattgctgtcgcttttgcggagcgccagcttgataagcttgggtattttcttcaggtcttccatcggataagaggcgactactgcgccgatcgtgccgccaagcacgatcgcaagcgatccaacgtctatgaaattcatgatcgtgccgttttgcaggatgccgaaaacagtcattccgaaaccgaccgcaatcccaagtaatattgatatgttcaaacgaaatcacctctaccttttgttgtctgcatcaataatcattccaaagaccttgctaccgtttgaggaaggcccagatagattttttgcttatacgcaatcactttctcaacgatctcggacggtttatccatgactattatttttttgccggatgcaagcacaatcaacgtatccggaatcgtttcgatcatgtcgatcgcttccgcgtttacaataaatgtctcgccaccgagcttggaaacttcaatcatctggcgcctccctttcacggtcttatactaccgtttcagattgatcagttcttctagcatggagtctgtggttgtaatgatccgcgaattcgcctggaatcctctttgcgttgtgatcatgctcactatctcttctgaaagatcgacattggacatttcaagggatgacggcgtgatcgcgcctgtaccgcccgaacccgcgaggttatatgtcacccttcctgagttcgccgtcgccgcataaaggtttgtcgccatcttctccagcccttcggtattggtaaagttcgcaagcgccagatatccgaggattaccttttcaccctttgccatctcgatgccgccggtcacgccaggcggcgttccctgcgtctttaactgtccgataaccgcgccctcttcgttgatcgtaatattctcataagcgtcctggtcgatcacgatgtcgttgatcgtgttccccgcagagaatgcgtcgttgtttgaaatagttactgtggcgttctgcatcagcgtattgagattgctgatcgccgtaccaaaaccggctgttccttccgttggaggcccggtgaccgtaaagccggcattaccaaacagcccattaagattagtaagcggcccgttttccgttgcagtaaagcttactgttcccaggttggagtttatcgtatatgtgtttcctgccacgagtgccgtaactggcgtattcgttgccgtatcgataatgtcgatccctgcctgcaccagcgttccatcccgatacatctccacttggttgccgttcagcctgtatgtatagctgcctttatcggcgttcgcgaccgctgtcgtatccggcgcgaaagtaaaatcttctatgcctgtatccgtcgcattgttgaatcccgtctgtgagtttacggaatgtgcgctcgtcgtaaacgtaagattgcccaaattcgtttcgacgatataattcgtattgcggttaaaggaattcgtgaccagcgtgccatccgtcatgctgatgtccaggttctcctcgatcaggataccgttcttatacatattgaccttgttgtttgcgttgatttcaaacgtataggttcctgagccggcagtcgtgaccgcattattgttcggcgtaaatgtaaaggtgttaaaaccggttgccgtcgcattactgattccggttgaccctgaaatctttcccgcgtcgccttgtttatacagtgcgttaaagccctgcacaaagtaaccgctcggcgttacgagactcccgttgctcgataccgaaagattgcccgcgcgcgtatagcgttcgccgtctcccgtacgtaccgtgaaaaagccgtcgccgctgattgctaaatcaagcacgttgcctgtatattgcgctgcgccgggagaatgtttgatcacgatcgcgttgcaggtgaccccgagaccgatctgccgggcgttcacgccgccttggtttgctgtcggcgcggaagctggggctaccgtttcgctgtacaaatccgaaaaatttgctacgcttttcttaaagcccagcgtgtttacgtttgagatgttgttaccaattacgtccattcgggtttggtgtgtcctaagacctgtcacgcccgaaaaaagtgctctcatcataatgagttgcctcctgatatttcatcaatttgtccaattgttgttaccatcattatctgagctgcagtctttgcaaaataatgtgggaacttcctgcttaatcacttagctatccttagctgattttagtgatatacgatacagggacttccttgcccttctgtgtgtccgtgtccttgagttttgcatagaccacgccatttttaaccagaatcgcttcaacctcgccttcgaccttcaccttctttgtgacggtctctcccgtggtatcgtccttaacgtcttccggaaccatagcttccacagtctttccaactaaatttgcggcctgggatatcatgctgtccaaatcgatgcctgtatcgtaaatttccgtgaccgcatcgaggggcagataatactcgcccacctgtaaatagtccgtgcctccctgccggactacacccgttaccctgccgagaatctgggctttggaaccatccgccgcctgtacttcgccaatcacatttttaccaatcagcgaatatgcctgagaagtactgaaagatacattcaattgctgcatctgctgcagggaattgaattgtgccatttgcgcgatgaaatccgtatcttccatcggctgcagcgggtcctggttcgcgagttgcaccgccaggatctgcaaaaattcttcttcgccgagttcctgtttcggtactcttgtctttgtttctgttgccgaagagattcctccggttgttggtgtcaccatacctgttgccatttttctaattcctttctgtgttgttccgacttctttttcaagcgctgaattccacagaacctccttgctctgcaagtacatcgtaataagacagattgtcatagaatgccgccgcatcctctgtactatcgcctgttcctccatgaacgtggctgaaggtgttttcttgtcccctgctctcttccctgttgtcacgggcagtgaatccggcgttctggttgtagatcacctccatatgtacaacattgattcccttttccctgagcgctgcctgcaactggttcaagtcgctttgcaaaacctgctggacatcgtggttagaagtcatcagcttcgctgcaaccccctttccatccgcggataacaggatcgataatccgcccaggtgctctggttttagctgcaggaaaaactcggtcttttcattggcgaccgtgcttttcacctgatcgatcacccgcgtcagcatactttctttatgcgaaaccggctctaattgatcaagctgtgttcttgaaagctgaaattccaccttcccgtcgctccttaatggcgcagtaaccggtgtctgtttctcacccgcatacttaccggattcctctgcacctttgttcttgtctctttcactcattccggatttttcatccgctggcagtgcggttgctttcggcgcatcctcagtggtcatgttttcctgcggcgcatcagccgtcaatacagcttttggatgcggattctcttccgagtcaatactttttccgagcatcgcatttgcttcgttaagcgcttgcttggcaaaagataccgcttcagcatcctccggtgttttcgctgcttcctcaaccggtaaattcagggattgcgttttcggtttcgcgtttacttccagtccctgctgctgcaattcgggagctacctgcagcgccttctcaggcagtgtttgctcaccggtattttccggtgccgcaggcacgatcgcattcggaagaatgaccggcggtgttgccaaaagcatttctgatttctcagttttttcattctccggcatttccggttgatcttcgttgcctgacggtgggattttcatttcatcctcttcgccctttgcatcctgcggcacaccatcttctaaaggcttctcattttgactagtctggactgccttattcatctcctgtgcgaaatctccggaacaatccggactctccgtttttgcagcaggcattgccaatatgtctgccacgcagtttactttcatcatttcgtttcacctccttccctcaaagttttatttttatcatgcgcattttcgtacatgtaaaaatcaggacattaattgtgatactgcggacgctttcgccggatccatcgcgccgaggatctccgccgcttttttctcgtcgatcgaacttagtatctcagcgatccacgaatcgcttgtcgtattgttgaatatctccgcggcagcgcttttatccatttgttcaaacacaggcgctatcgccgccgcgcttttggaaccgcctcctgttccgcttgccaacgttttctcctgctcggcttccgcttcgcttaccttcgcttcccgttgtttcagggattcttccttttcggcaagttcctgatgcttttgttcatactcttcctttttttcgttatatcccgcgatcgctgtctggtaagcgggatcctgctccttaaaaaaatcgactatatgggttttgaatcccaacagattgaagtagtaaaacgcgcacacaccagcaatcaatatgacgatcacgattgcggcgatcgcttttccgctgatccgcttttttccctgcggtgcgtcgtttcccttatccgcattcaatttttgagcagcctgcttttcgtccaatttcttttctccgcttcctttttcccattaagcgtttttttaataccttgcctgcataaaatcctcgatcatcctgtcgtcgcttttctgcacttctttttgataatcgctatactgctccccgcgcatccggtctaagacgtgctgctcgttgatcagctttatcagggctgccctgcactcctcaatgcttttcttgcagcttgcgataacgtttttctgcctgcgcatttctttttccagaaattgcaggtaatccccatactgcctgacctcaagcatttccataccctctttgcacttctccagataggcacggttttgcttgtcgaaaatggtgcggttcgcctggagctgcatcgcataatttcgaaggctgtgatttaactcctttagctgtgcctttttctttttttcctcagaccgctttatgtcgtaaagcttttgcagggtaaattcaaaccgtttcatcccgtatgctccatatcctttgtaatgacgccgagcatattcagcatctggtcaaatcccgcttcttcgccgatgtcctgcttaagcatcttgaggatcgggtcgcgaaggtttaccgccatgtctgttttaaggttgttcccttgcttatacgcgccaatggaaatcaggtccttcacgctttcatattccatcatcatattccgcacgtaattcgccatcttccagtgttcccccgtgacgatatccggcatcagtctgctcacgcttgcaagaacgtcgatcgccggatattggttgctgttggccagctttcttgaaaggacgaaatgcccgtccaatattccgcgcaccgtatccgaaatcggttcgttcatgtcgtcgccctccacaagcacagtatagatgcccgtgatgcttcctttcttcgacgtccccgaacgttccaagagttttggaagcatcgaatacaccgaaggcggaaatcccctggaaacggggggttcgccgaccgtcatgccgatctcacgctgcgccattgcaaaccgcgtaagggaatccatcatcagcatgacgttatacccctggtcgcggaaatattcggcgatcgccgtaccgaccatagcagatttcaaccgcagcaatgccggctgatccgaggttgccaccaccaaaatggattttcgcagtccttcctctttcaggtctttctcgataaaatcgagaacttcccttccacgttcgcccaccagcgtaatgacgttgatgtccgcgcttgcgcgccgcgcaatcattccaagcaatgtgctttttccaacgccgcttccggcgaaaatcccgatcctctggcctttccccacggttaaaagcgaatcgatcgcacgtactcccagtgggagcgtttctttgatccgtgtcctttcaagcgggttaggcggttcgttttcaatcgggtaatacatctccggctcgattgacccgccgtcgtccatcggcttgccgagcgcatcgagtatccggcctttcaggccgtttccgaccccgactttatactcctcgcctgtcgccattaccttgttgcccgcgccaatgcctgtcacattgccaaacggcatcaacagtacgctctgttccctgaatccgacgacttccgctaatacgggaatgccgcccgcatgcggatatattttacagatatcgcccattttgaccatcgggcctttggactcaatcgtgatgcccacaacatttttgaccgttccgctcatttccgtgaactgtccggtctcaagaacgcctttatattttgagatcctgctactaaggctcatgctccgtctgcctcgtacagtgcatcggtaatgcgctcatgctgcatcctgatgcccgatcgtatcgcgccaaaatctgtttcgatcacacattccccgctttccaccgatatgtcctgctttacccgaattcccgagctcttgagcaatgccgtgaattcatcgctgtcatcggcaaaaaagagttcaaattcctttttacttaccttgagtacaatattgctttgttctctcacgcttgaaagcgtatccatcacaatattcaggaatactttgtcattccggtcgagcgtttccttaacaactttttctgcgatgcacagggacaggtctaaaacgctatcttccatctgcttaagcatttcatcctttgctgcgatgagttcccttttcagtccgaaaaattccgcttgctcacgttcgatctcttttttgagctcggcctgcgccttttcaatgccagcgatataaccggtatccttcgcttcctttacgattccatctgctttgctttgcgcgtccgcgatcatttgcgcagcctgctctttcacctcttcaacctgtcgttccaaccgatttaactccgcttttttcgcgtcgatcggatcttcctgcttcgcatccctgacctttggctgttctttttccgttctttggtcttccgtcagttcgtgaaaccccgggataacaaccattcctgccgtctcaatttcgctgctgtgtatggaatttcggtcgatcctaaacaatgagttcatcttcggcgcctcccctcgaaatctcgatttcacccgcatcctcgagcttgcgaatcacgtttacaattgtctgctgtgcctgctccacgtcgcgcacgcggaccggtcccatgtattccatattttcaacgatcaggtcatgcaggcgtttgctgatgtttgcataaatcttttcagcaatttcatccgctgcgcctttgagggcgatcgtaaggacatcattgtcgatttctttcagtactttctgcagttcagcattgccaagctttacgatatcttcaaatacgaacatgcgtttgtgaatctcatcggccaaatcagggttatcctcttcaaccgtatccatgatgtgtttttccgtatttcggtcagtcgcggcgagcatttcaacgaccatatcgaccccgccgaccgtcgtgctttcttcctggcccatgctgctgatcttatactctaaaatccgctccgcttccctgatatattccatggaaacaacgcccatatctgccacgcgctccacgacccttgcctgtagttcttccggcaatgtggcaaggatatttgccgattgctcaggccgcaggtaagaaaggatcagggcgatcgtctgtggatgctcgttttggatcaaattactgatctgcgccgcatctgccttgcgtacaaaatcaaacgggcgtacctgcagcgctgccgacaatttcccgatcagttcgtccgctttgtcgtcgcctacggctttcacgagaacgtcccgcgcataatctataccgccctcagatatatatttttgtgccacgcacagatcgtaaaactcagcaataactccatctcgtgtttctttgtcaaaggatctaagacctgttatgccaagcgtcagttgttcaatctcttcctcgctcaaatgcttataaattttggaggacacgtcttttccaagtacaaccatcaaaatagctgccttttcttttggcaaaagattatcaaccaccgtcatcgccccccaatatcgtccgttagccaattgcgcagtaattgtgcgataccattaggatccctgtctacaagctggcgtacctggctgaccatattatcgtttttctcctgtagcaactcttctacgtcaagctcctcatctgctacaatgtcaatgccaggctgttgttctgtactatttagctgcatttcttcccaactgggcatgccttcctgccctacattgttttcgcgcttcttcttgatcgtccgcataataagcaacaacacaatgatgatgatgccaatgaccccaagcggtaatacgatatttttgatcgtattggtaagctgctgtgcttgaatttcttcctgctgctgctccattgcctgcgcatacagcgtgttttgctcaaaaggcattgccgataccgtgattttgtcttccggcacgccgattgctgtggcaatctgctggcgcacttcgggcagaatgtccgtcagattatcgtcgccgtttatgatcagcgttgcggataagtccgatatatctccctgcgcttcctcgatctgctggttgatttcgttcacttccgcattcacttccgtgacgatattataatatgtgctgtcctgtgcagcttcgtcgatttcctgataggacagcgttccgccgttgggatccacgcctggttcgccttccggcatcgtccccgcattttgcaaacgttccgtcgtttgcttcatgcttgtgataatgcccatgttttccgcgtcgttcgttggcggggagagcgtcagggaattcgttgtgctcttgtcaaaatcaagaatcacattgatacttgcggataggttttccggtccaaacaccggtgagagcaggttcagtatctgctgctccaattcatcggacacttttttctggagttgtatctgtgaatccacctgcgtcgttccgccgctttcctctgtagcggttccatatagccgcatattttggtcgacaatcgagatgttgtctttcgcaagtgccggtaccgcatttgatacaatcgccctgatcgcgtcgacgtcactttgggaaagctgatcgttccccgcatttagcgtcaccattacagaagcgctcgacacttgcccatcgtccttagacaaaacataatcactgtccttggcgagagccagtagcacagtgctgtttttgatcttgtccatcttattgatggtctgggcaatgttttgctgtagctgcgcctgattatagtacgccttgtctttatctgtagccccaaagctccccgcgttttccgaatacagggtataatcgaggttatcgccgccggggatgccatctgcctgcaatttctggcgcaattcatatacctggtcattgggcactaacaacgtcccattgggtccggatttgaattctacgccttcttctttcagcgcagcctgcactttccctgcctgctcgtccgaaagaccgctccacagttcaccgtactcgacctggttcgtcatgttcaaaacgacgctgagggctatgatcgtcaggatgactaccgcaataatcagtcccttttgcgatttttttgtgtttttccatgctgttgcaatcttcttgccagcatcggtgaagccattctgagccagagagagtcactccttttgtcgcttttcggacgtatagcccaaataaaattcgggctatacgcagggtttattaacattggttagcagacctggatcagtatttctcgcctgacaagtcaaactgatccgttcctccaaggccgctgtttgcgtcataatccatatcaatcgtactttcgcttccattcttgagcttgaatcgaccgaccaattgtttcatcatgtccgcctggccggatagctcttcgcttgcagcagcgctctcttccgctgttgcggagttcgtctgcaccaccatggaaatttgctcgacgccctggttgatttccgcaacggaacgcgcctgttcgtcggatgcgtcgccgatctcaccgatcagatcattgattttctctgcgttctcaacgaccgacttcaatacgccggcagtctcgaccgccttattattcccgatttcaactttctgcaaagagccttcgatcaatgcggaggtttcctttgctgcttccgcgctcttcgtcgcaagatttcttacctcgtcggcgaccactgcaaagccctgccctgccgtacctgcgcgtgccgcttctacggcagcgttcagtgcaaggatattcgtctggaacgaaatatcgtcgatcaccttgatgatcttggagatttcctgagagctctggttgatatcgttcatggattcgagcatatcgctcatgtgtccgttgcaggtctccaccaagccagcggttgtattgatcagctctttcgtctgttttacgctctcggcatttagctggatctggtcgttgacatgtgcgatagaagcggaaagttcctgcacggaactggattgctccgtagcgccttgcgctaacgcctgtgctcctctcgatacttcatttgaaccgatcgagacctgtccggcagattggtccatgctttcaaatgtggtattcaaagaggaaatgattttatccatggacgatccgatcaacttgaaattccccatatagtcttcttgtgattcgacgttcaggttcccggttgaaatttcatgcagtatattcgatatctcaccaatataattcttcagcgtagaaatcatcgaacgcacgtttcctgcaaggataccgatctcatccggagcttcataggtaacatcaatttcaagattcccctgagcgacttgcgttgtcgcctcaacgcattcagcaacaggctttttcacgcttcgggtaatcttcaccgcgagcagcatacccacaataatttccgccgcaagcaaagcaacgatcaggataagctggttgcgcgccgtagtctccgcttccgtcatgaatgcttgcgcctcaagctgcgtattctctttcaaagaggaaattttttcgaccgcctggtcaaggagcggcgtaaattcattttcaagaatcggtccaaccgtcgcggtgttgtcagtggttgcagttacactacccataatctcttcaaggatcggtcccccgctctcgatgatcgactcgaattcgtcgatggaatccgaataggcagggtatattcttttcaactcagcagatgccgccatgatctcttcattgcgctgctgaaccttatttttaagatcgtcgatcttttcctgggatgtggaaagcatcatctggtacaaatcgcgtgcaaccttttctacatcagtttcgatgatcgccatttgttcagcagcagcatatggctgattgtacaggccattgagctgactgctcatcgtgttgaatccaaatatggataccaaccccagcgcgacagtgagtatgatggcaatcaggaaaccaaacaggatccgcgttccaactttcatcttctttaacatttcaagttcctcccaaaattcactctttatttattcgctttcataaattctcaaatacatcatcgccaatgattttttcacatgacatcagcaagaccagtttatccggctggacggccaaaccgcttacaaaacggtctgcctcccctgacgcactgtggggcggcgggttgatatccgcgcaattgatatccatgacttcgtctactgcgtcaacgatgaggcctatttcaatgtccgcaacgtttacaacgattatgcaggtcttactcgtgtactcctgctcctcataccctacgcgcagattcaggtcaaggattggcacaataagcccccgcaggttaatgatcccttttgcataatatgggaactcaggaactgcagctattttctgcatcccgataatttccattaccaatgaaatcggcaatccgcagcattggccattgataaaaaacgtcaggtatttttcagattcgctctgtacgttttccaaagccatatcattttcttccaaagagcattcctccccgcagcacaaattttttatgacaaaagattattgatatccaggatcagggcgatctcgccgtcccccataatcgtacatccgctgatccccttgatccgcccaattgttttggtgacgtataagggcataggtttcacaaccgcttgttgttcacccagcagtttatcagcaaacaagcaggcttctccggcttcgctgtcaactaggaccataattcctgtcttcaggttatcttccccctcctgcacattgaacatttgatgcagacgtacgattgggtagcatactccgcgtatgatgatcatttcatttccatttggttctgtaatgatttcatgaagccgcggctccaaggattcacggatagaaagcgtgggaataatgtacgtagatttccccacggtcaccttcataccgtccataatcgcaagcgtcagcggtatatgcatggtaatcgttgtacctttcccttgttcgctgtcaacaacgatacttccaccaatgttttccaggtttttgtgcactacgtccattccgacgccgcatcccgagtattcagtgacagcgtcgtttgtagaaaatcccggcagcagtgtgaagccgtatgcttctttatccgtaatttcgatctccggttttgcagtgaggcctttttcataagcctttttgataatctttgagcggtccataccggcgccgtcatccatgactcggacaataatatcaccgctcgtactattcgcttcgagcgtgatcctgccccttggattctttccggcagcgatacgctcatccgccgtctcgattccatggtccattgcattacgtatcaggtgcattaaaggatctgaaagattgtcaatgatatttttatcgacttccgtatcctctccaataatcataagttccgcttctttgttcgtctttttcccgatatctcttacgatacgctgcattttatggaaagttgccgcaacaggcaccatgcggatggacattacgatatcctgtaattcgtccgtcagtttgcgaagctggcgtgcctgcttttcaaaattttctaaatgcatatccgcaagatcagagtttttagtcaccatagattccgttgtcacgatctccccgacaaggttcatcaacttatcgatcttgctgacgttcacgttaataaaactctgcttgaccgccttgtcttcttttccctgttttctttctttgccatcggcagcagggctctgtgcaggtagagctgcttgttgaactccttgtttctgtgatatgtttttttctagctctttttcctgtgcatccgctgctgtgttaggcaccgctgtattttcttcctcctcaccaaataacgtgctttcaaccagcatagtttcttctactttctgcttgatcatctcttcatattcttccggtgtggaaaatgccatccaaaatcctttttctacaatagccgagtcatgttccgtttcaaggtcttccggccatgtcgccatgctggaatacaaatccttaacggccatcttgatgctgtctgcccgaattgtttccatttggcagtccttttcaaacaatatttttacccagaattttctgtcgcccggcatcggctttaagtttccgagaagcaggcgggcgatattatttccattttccgtttgtgcatcattctcagcagcatccgcgttttttgccggttctgcttcttcaccttccaagcgctttctcaattcttcaagttccatacagagctcttttgggttgcctgacggtttgctaccctcttggattttttcgatttcctccttgaaaaagtcaattgattccaggacaatatcaaaaatacgctcccattccgattccggcggattcgtttcccgtattttagaaaacaggtcctctacggcatgtgcgagcgtcgcaacatcgttatattccatcatggccgacgagcctttaatggtatgcattacacgaaaggtttcatcaatctgttctttggatagcccttcgtttttttctccaccaagcaatagttcttcaagatgctccagcaactggctgttctcaagcacatacatggaaaccatcgaatccatttcgctcatttgtgtttccccccgacttacaaaatgatattatcgtaccatgtctcaactcgttacttgaatttactgagtgctgcgacgataatatcttctttaaaaggtttgacgacaaatccctttgctcctagcattacggcctctttgaccatcccttcctgccccagtgccgataccatgacgacgtttgtctgcggccgggctttcatgatttccctgagggcatcaatacccgacatttccggcattgttatatccagcgtcatgatgtctggcgccaattcattgcatttctggattgcctgtgcaccgttttcggcttctcccacaacttcaaaaccgttctttgagagcatattctttattgtgagtctcataaatgcggcgtcgtctacaaccaaaacctttttcatgtttttcctcctaaatatctatcttgtgtaatcattttccaggttccgtatgatccccgtaaaaagcgtatcggtcaattatatctctacaaagttttaactccttttccaacggtttttaccataagcagcccattttccggatccagctcgatcgtcctcccatagctgcctcccatgtcttccgcaataatcggaattctcaggcgcaataccgccattttgctgttaaaagcgtttctgtcgccaaccttcagcgcatcgctttttccgagccctccgaacatatgtgcgccacctgcgagctttgctacaacagctctctggtttgcacctgccttgagcatctgcgacagcagctcgtccacccctgtatcggcgaatttagcccgtatcacgttcggtctttttccgctgtccggcataacgatatgtaccataccgccaattttgttgattttatcgtagagcacgacgccaatacacgagccaagtccaagtgtcgcaacatgctgcggcgcttttacgacagcaagctctgccatgccgatgattaccgttttcataagctccctgtcagcgctttcttcaaagtctcaagggattcaatcgttggcatcatgaagaaattcccttgaatgctctttgcgtctcctccaaattttgtgcgtaaaaaaagaacggattccagatcgccgtaaacaaaaaccggaacgttcataattgccattgccatgtcgatcgtcatttcaggaacactgggaattatagtaagctgcatcatcgaggcgattgccgacagatatgtgctgaccatgatattgcatacctcacgcatgggttcatatactgccacatccacatcctgctccggtatgccttgcccgagtaagatttgtatcgtattgcgcgcgtcatccagttcctgtgccaaaagtatatagccgtcaatattgccgctcatctggacgagcatccccaaaattacattatcagcaccgcccatccgctccgctatttctgtataaccgatcatctcgcagcttggaacgctaatatcaacagtctggccagtcatctctgaaagtgctgaggccgcattccctgcgccgatatttgctatttctttcagcatatccagatcgatttcatttatttccatttctgctccttcatcgctgtaaagcacgacaaatttttgttttttataatcgttgacttgtctggtatagtataaggctattaaaattccgtcaatacgctatttttaactgattagtgggcacaattatggtatatttatatttgtatgggcctttctgttttattacaaaaatattgcacaaaatccggcaaaacgcctgtctttatgttgtggatattaccgacttcattacaaaacattcgctgttctatcctaaattttcataattttatacaaattcgcaatatactttatactatgaacaagctcacaaacgcctacctcatgcagttcgtttcatatgcgtgacggctgttcgacggcgcaaaaatttttttgacacgattgactgtagtcgtttgatcgatgcttctttgtgttcccaagtacaatgtgcataatacttccatgtaatatcaggagagcaatgccctaaaaaatcacatattatctcgatcccaatattttcttccaggcatcgggtagcaaacgagtgccgcagcgtatgcatatgaacatcggccaggccaactttatcagtaatactagacagccttttctgcagagtacgcggatccgtcataaatccgtttctgccaggaaaaacatatccgtcttggctgccgcttcgctcaaaacgtgcaaccaacctatccatcaaaaatcgcgtaatcggtatttcacgattcgatgattcactttttgtcccgctgacaataagctttgtttttggacccgttaaattatttgttttaatccgttttgcggagtgctctatgcgcagcgtaccattcttgaaatcaatatcgcgccattgaagcgcacatatctcccccagacgaatacctgtatacaggctcaataagaactcatcacaatcctgtttatatatttctttttccagattacgttgctcgaaccgagtaaggacgcgcggactcttgatccgttttttcggttttttaatcagtttaaaatcaatttgcgcgagcaattcttttctgattgcccttacaagaagcgatttcaacaaacgataaatcccacagattgtgctgtcggctaagctgccttttagctgggatatgaattgattgatcttttcatggcacatttcgatcaatggcatatctccaaaatacggtttaatgtgaagatgcagcaagtttttatagctttcgtatgtcgtttcgcacacgtcaggttttgcaatggtttcaagccagtattccgcccaaacagcaaatgtccatacaccaggtttggcggtaccattcgacattgattgtattttagcttttgctacacagagcatctctttcacctccgaatattttgagccataaacatacccgaacttcgtattgccattcggttgttttcctttaataaagcgcccttcccagcgcccatcttttcttaaatagatattttctccacgtttagacataacatttagtactccttttttataaaataaattgacggtctttctgacggcttaatcacaaagaccattgcaaagcggtttctgcacacgcaaaggcatccgtgagcactatattttacttgacaggtattaaatcttttgctaccatatctcttgtaatgaaaggcaaaactagggtaattcgcgatataaagtatattgcgaatttttttactgcatttagcataatacttttcgagaatgaaagaattaaaaaattacattaaaatttacgatatatacaattttatgcatatttttaacgaaaatatgttgttacaagcatatcacccgacaataatattgtgaaatttatgctcgatcgctatgtcacgacgcaaaatatcaatatcgggatttttgtaagtcaataaagctgtaaggaatctgccgtaatgcataggaatccgcacagctttgttgctgttctgaaaaacagctttcaaaaagattttttcataaatttaagttttcaattttttgcaacgaagattgttttaggaaagtaaaatgccatttcattgcttcgtttaagggacgtcacttagacaaagtgaagagatatgttcgctttccaaaggttcttgcatagaatgcaatcaaaaggaacctgatgccgtatggacaatcgaattctatccagacggtaaatcaaacaaatacatggaggtatttatcatgagaattcagaacaacattatggcgctgaatacacaccgccagtacactattaacaatgacaacgtagccaagagcgctgaaaagctttcgtccggttacaaaatcaaccgtgcgggcgacgacgctgccggactcgcgatttccgaaaaaatgcgcagccagatccgcggcctgaacatggcgaccaagaactcgcaggacgcgatttcgctggtacagacggctgaaggcgcgctgcaggaaacgcacacgatgctgcagaggatgaacgaactggcaaaccagtccgcgacaggcaccaatcaggagcttgaccgaaacgcacttgccaaggagttcgatcagttgaagcgtgagatcaacgacgttgcggaacagactacgttcaacaacatgaagatcctcgacggttccctctcatatcagggaccgcagagaagtgccgcgacggccggcatcaacgtcaatgagactgtggacccggcgaacaacactgctatcacacatcaaacgacgaccaaaggcgtagaggctgtgactgccgcggcgggtgtgtatgatatgacgatcgctgacgcagacctcaccgcactcactgacggcaccgcttacgagatcgaaatcgcgggtgcgaaggtcactttcacggcgggcgcaaatgcaggtgccagccgcacggctatggttgccgcgctcaacgcttctaccgacccgattctcagcacgtacaccttcgcgacgcagggcgctactggcctgcgcttaacgcaggatacctcggtcacagacccgaacaggtccgcggtcatgggcggcttaacgttaaacgggactagttatgcggttagtgaaactacaaagggcgagacggcggttacggcggttgctggtgtaacgaccgcaaatgtgaatgtggctgaccttaaaatcggcgatacgctcacagtcggcggacgtacgttcgaactgatcgcagacggcgatactgccgcaacaggtaatgttgggatccagtgggatagcaccaagacgaccgccgatctgataactgcgctgcaggcaggccttcccggtggcatcgcagttgcggcaactgtggatggcaacggcttcaccgtaacacaggctgtaggcggcgttggcgacaacagcgtttcctttaaggctgctgctgcggtacagtccacgattgagatggatgtcgtcaagctcaaagcgggcgataccatcagcgtgaagctgaacggcacagaatacacgtatgaattccagcaaggcgattctttcacgaacatcgctcagggtctgagagacgctgccggcaatgtgctggaagcggatcagaagggttccgccctcattgtcaaaggccgcgtggacgtaatgagtgggttccagccggtcgaagcagaaggctacgacgcgatccgcatccaggttggtgcgcttgagggcgaacagctttccgtatccattgattccatgaacaccaaaggccttggccttgacgccgtatccatctacacgcaggatacggccggcaaagcgatcacagcgacgcgcagcgcgatcgatcaggtttccgaccagcgcgcagcgcttggcgcgatgcagaataggttggatcataagatcgcaaacctgaaagtatcgtctgaaaacctgacagctgctgaaagccgtatccgcgacgtggatatcgcttccgagatgacttcgttcacaaagagcaatatccttgcgcaggctgcgactgcgatgcttgcacaggcaaattctttaccgcagaacgttctgtctcttctgagatagtcgttttaagccggtataggcagaagaggattggtatggggaaagtctattttaggctttcccctgccttgttttcctggatcacatataggagtatatttatttatggatatactatttgaaaataggtatctcgtaacggaggatggcgccaacaaataccatgtttccaaggaaaatagcgtccccgccttttccgatcgaaagcctgtaatgggcagcggcgctatgcgcattgttggcctcgcaatttctgtctttattattgttgtttctattatactcagtgaaaacataattttattgatcggattggctcttgcagccgtttacgtatatcgaattttctatttcgtacgcaaggatcattcaactcccccgcccccgacgacagctccccagcatattagtctcaaatggcagcgtatcgttcgttttggggaagaaatagtggtaagtgacccgcgttatgccgcgacttattcttacaataacctgatgcgtattacagaagacagtgtatattttacgctttggtttaccgaccatgcaaccctgcgtgttttcaaaaacggattcacatgtggcagttgcgaagaattccaatcctttatcgaacctattattgagagaaaccaaaaaattctacaggaaaatggttaaaccaaaatgagtattttttcaaaaaaaccaacaaacccgaaggatgatacggaagtggttgctacaccaattgacaatgaaattcctgttgattccacggcaacaacggtcgttcacgtctatgacgaagagggctacgatgaacgcggctttgacagcagcggttattcgcggaacggatataacgtaaagggatatttccgtgacattgaccagcccttagacaataactgcaaactcgaagatgatattttgaaataccgccgtatcgacggttattacgaatatgaaatggcagtatacgccaattacccggatttgaaagataatttcgaggcaaaccatgaaaacgttgcagaactgatcaataatttgtttttgatcgatgaaaattatgctcttcgtttgtggaaatggcttctgtctacctttgaaagcacgttatccgagccggcgaacgcttaccgactgtcaagcgggatattgcattcgcttgggcttagcgatgattttccccgccgattgcttccctatcttcaaaatgacaaccagctatgcaaattgcttttcacagaatcatcttatgttgatcgctctcatgctgctattttagcagcctgcgttatttacaacaactttgatttgtttcaaatattaatggataatttgctcgtcaatccctatattggtcgtgaggattcgccttcgactgataaaatcattaaaacgatcattgaggagatcccatcgtatgtcatgacgcacgatggatatgatttattggcgaagtatatcaagaaatccgttaaaatgatgatgcggaaagtcctttttaagttgctcgatgaaaagatggaataccttttgaagaaggaaaaacgggaacaggccgaagcggaacgcgccgcacgtctcctggaacagaagctccgtttggaggaagagcgtcaagagcaacaaaaagaaaccggcgtacgccagcaattacgatcgacaaagaaaaagtacgtcacattgaaatccgcagtgatttcgttgcggaaaaaggagcctttctgggaggatggacgttttattgatttccaacagcttgaaggcacgatgcttgctttaaaggaacatcctgagattcctgaacaactgctccccggcgacagtcttgagatgaagcgtgaaccgtattatctacaggatcccatggctatcgcagtagccgatcaggagggcataaaaataggatatattccgaatcattccaatactttcctggcgcttcttatggacgcaggctatgaaatgtcttgcaggctttattcgttaagcagtgacgacaaagactcactgcaaatatgcgttgaactctttatcaagaactgaagcattcatccttgtactacaacctggttttttccattggcttttccgagcttccaaaattgtaaacggaagggatcaaaaatcccaaaaatgcaaagataaagatatatgatccatgcgcaagtaaagcgagtaaaacaatattccgatatgtttttttgaggtaccgttccccatcgtttcttcgcggaacactttctcctgccattttttgcacctcttcacccctgtgtttactatatgtagtccaccttttcattttttaatgatgcggatttgtttccacaaccttgatccctcttacaatcgctgcgacgatatcagcgattccctgcgtcgtttgtgcatcatgtcttaccattgcttctccaatttccgatgcaacatagtgaggtgggagatgattcagggcaaaagccctgatgtcggcgcgacaacgttgacagttgcatgtcccgtagctttcgatacaatggtctaaatgctgatctacaaaatcttccgtcagattctttatgataattttaacttcgttatccatactatccctcacacattgttatctttacaaggtcagtgcttcaaacgcatagaggggcatcggttttgaaaatagaaaaccaattccatagttacagcgcacttttttcaaaatttctacatgtttttctgtctcgatgccctctgctataattagcatccccaactcatgtgccatttgtacgatatttttagtacaataacgtttttctctagcctttcgcctttcaaaaatccacggtcgagtttgatgaggttgaccggcatatcgcttagcagccttaaagacgaatatcctgatccgaaattatcgattgaaagctggaatccctcttctcttaatatcatcatgtgttccaataaataacggctgttattgaaagccgctgactcgttgatctccaactcaatcaggcacggcggcgtatcgtgcttacgcacggtctcgatgatccggtcagtaaaatcttttttgaaaatattcacaggttttcatgctttcctgacatccgaagggtcccgccgcaggatatgtctgctctcatgattacgtcagtgataatatcgctttctatcttgactcgcgcgttttcaatgaagtagctgcgcagcgcgccttttgcttcaatgctgctgctgcccgtcacccctttgcaaataattatatttccattggaaatcaagtatgaattttgcacactccctcttacgataatatccccttgcgctttgatagtactgccattcacaacattcccttctaccaaaatcgtcccgtcggcagtcagatcctgattatcgagttcctgttcagtttgagaaggatacacgctgaccttgttgtcttttatgctgaccagaccgtcgcatgttgcataaagggcgttgttaaactgcatcgtattgtctccaggtacttcagcaaggtttttcccttcatttcccgcaagcgactttccctggatgttccatccattgcgcgcaggcgtggccgctttgatttcgcatagaatgtctcccgattttacaacatcatattctatctgcgcataatcttctgcattacgaaaagaagccactccctctgttttcttgaagtgataaatgagctttgcgtcttctccatcaatgggctgcatcccttgtgcaattttgaatgttcggttatatactgtgtgattggcaagccgataaacatattcaaatttgattcccttgatgatccgcttttctcggagtttctccagaatatcgtcttccgttatcgtccgcccgcccatctgcggcggcgtaatgcgaatgcgggccgacatcaggtcaggagctacctctattgtcactttcgcgtcgacgctcctgctggtatctggtatgatcgcaggactgttctttccgactgcattgctatcctctataccttcactttgtttgagtatcctaatgacgttaaatcgttagcgatctgtgttgcaacgtcttctttgctgatagggtctactgcttttcccgctccttggatgtcttttagtatttcatcgatgatattctgttttggaacaaaatcccctggcatgtttttcatatcactccacctttatcttcaaaatcctttatattcgttactctctaccaaaatagttttcgaagaaaatcaaggaaaacttaaaaaagagcagtgcatttacctgtcctgaaaagtgttgatactgggaaattgctatttgagaaatattgtcgagctgaaaatggaatcgatatttgtgaagcaaaaaaagattgaaaaataaatatccagaagaggtcttgatactgattggatggcacgggttttttaatcctgtggttatggatgtcatttatcctatctttttgatcaaaacaaaaaggataggccggaacccccggtctatccccttcacgaaacccgctctacaaaggcttttcaggggtgtttctactacttatttgtaaagtaatacccgacgccccattttgttaagatatattcaggttttgcaggattttgttcgattttttcacgcagccgcctgatgtgtacgtccacggtacgtaaatcgccctgatgtttccataccatttcaagtagtgtattcctgtcaaatacctttcctttattcgttataaaaagattcaaaaggtcaaattctttcgcagtcagattaatatccttacctttgatttcaacactacggttaatgaggttaaccttcatatccttgacctggatcgtctgcgcatcgccggcaggcttttgtgaccctgcccgcctgaagatcgttttgatccgtgccttgagttccagcatattaaatggtttcgtcatataatcatctgccccaaattcgagacccatgatcttatccatatcttcgcctttggctgtcagcataataataggtacatcggaagtactgcgtattttctggcatacctccataccgtccatcttgggaagcatcaggtctaacaaaataagatcatgcttcgccgggtcaaaaacagcaagtgcctcctcgccgtcataggcaacatcgatatcatagccttcctgctgctctaaattaaaacggagtcctttgaccaaagttggttcatcatctacaattaatatgttttttgccataatgacaactccctcatactgacgtttcaattattataacatatatgtatcctatttgtaacatttatttgcaaccatttaaaaagcgctttcatgaagaaaacgctttttgtcccgtacaatagagataccttattttctcgaataattaggaatgattcccaatgcttcactttccgttacgcctgcatttatcaggaaaaacgcgcttacgaaaaccattgccgcatatagtatttttttcaatgcaatcactcctctcttatactatatttattatat

SEQ ID NO: 7 - DNA, 182383 bp, Christensenella sp.
atctataatatatctattgacaaataaaacaaaatataatacagtataaatagaacgtgtttaacacgtgttaacaaaaataacgcgttctttgtatgctgtaggaaaaggggaatcatgaggaagacgcacaggatgtctttggaagagatatcgaaaaaaatcaacatttccaggaccacgttatacaaagtaatcaataacaaaggatatgtgaaggattctacgaaaaagattgtggaagacgcgttaaaaaaatataactatgtcccaaatctgaatgcacgggatttggcgcgtcactgccgccatacaattggttatattggaatggaatatagtgcttcttacttcttcacgatgatgcagtggggcctaaaacgcgcagtggatgaattcggagacaacggtcttgatatcgtcatttcgggagccagccatttgaaaccggaaaagcaggtagaggatatcgacaagatgctcggtgaaggcgtacgggactttattatctcggttgccgatgcggacgttttgaaggacaaaatagaagaactgcgtaagatgggatgtaatatcgtttaccttagtcggtatgcagaagaaaaaagccgtgtattcgtaggggtggactattaccagagcggtgttttggctgcggaaatgatgggaaaaatgctgccgaacggcgggaaggtccaaatcatggtcagcaatacgcttgcgcatgacgtttatgtcagaatgcgttacgatggatttatggacaaaataaaaaagtacgaaaatattgaagtcctccccgtaaagcaggagatcaatacggaacaggaaaccggcgagcatacaaatcatatattgaaacagtataaggatctgaaagggatttttgatattacgtatcggacggataccgtggcggatatattgatccaaaatggcaagcaggataaaatcagggtcgtgggtttcgacttatatgaaaaaatcgctccttatatcaggaattcggcggtagatgtgatgatatcccaggacctcccggggcaggcatatttagcggcgaagctattgtttaattatgtatgttacaaccgcgcatttgaaaagaataactactattccagactggatgtaattgttgcctcaaaccttgaatattttgagtattaaaatgcctgtctaaaagagatttgagttttggcattgagatagatatgtcgcagaaagcccctacccgtgtgtgccttcgtaaaaggtgcgcggaatttctggcggcttatctatattttattacgcttttgggtacacgtgtaaaataataacatatcatataaaggagaaggaatcatgaaagatttaatgcagcagtgtcttacgttacttgatgacaaaattgaattgacaccgcgtgtaaaagatttaagggaaatctttttttcgcgcgacctatcggtatgtccggaaagagcggtgcttatcacacagtcctatcaggaaacggaaggacagccgatggtactgcgccgcgcaaaggcgctcgacaaaatcctgtcggaaatgacgatctacgtcaaagacggagaccttttggttggcaatatggcatccgtcccgcgcgcagcgccggtctttccggagtttgcggtggattgggtcgaaaatgaactgaatggcgatccgtatttctttgacaagcgaccgggcgacgcataccagatcacggaagaagcgagggaaattttattgcgcgatgtgatcccctactggaagggcaaaacgcatgaggaccgcgtaaaatctttattgcctgaagaaacaagggtggcctgcaaggaagtaaaggcgatcgaagaagactgggtcatggtgagtggagacgggcataccattcccgactaccagaaagtcattcgaatagggatcaacggcgtgatcgccgaggcgcagcaaaagctggattccctggacatttctgatccggatgacctgcagaaacggccgtttttggaagcggtcatcatcgcgaataaagcggtgcttaaatttgcagcacgttacgctgaaaaactgtatgaaatggccggtgctgaaaaagacgcacagcgcaaagcggagctcaatgaaatggcgcgcatttgcgaaacggttcctgcacagccggcttccacgttctatgaagcggtgcagtccatgttctttgtcaatattccggttcaggtggagagcaacggccactcgatctcgttcggacgcgtggaccagtatttgtaccccttcttcagcaaagatatacaggaaggccgcataacggtcgaaaaagcgtacgagatcatgtgctgcatgtggcttaaggtaacggaattttccaagctgcgtccgtgggcggatacggttgcgttcgtaggcaatccgctgttccaaaacctgactatcggcgggcagacttttaccggacaggatgcggttaacgagctttcctacctcgcgcttgcctgcacaaagaagctgtcgatgattcaaccgtccctgacggtacgcgtattcaatggtacgccagaccgcttcatccgcgaggctgtaaaagtggtacgcaaggtcgggagcctgccggcgtttttcaatgatgaagtcatcattccgtccatgctgaatatcggctactcgtatgaggacgccgtggattacggcatggtaggctgcgtggaacaggcgccgcaaggcaagatcggcgggcgcttcggcgcaggattccccaattttgccaagtgggtggaactggcccttaacggaggcaaagacccgcgcaccggtatcacctgctgtccgcaggataaggaccttacttcctttgaatcctttgacgagttgatggacgcgttttacgcacagctcagatatttcttgaaacaccatgtgacggcagggaacgtggtggacctttcttggggtgcgatgacgcccaatccgtttctgtcctctatgatcgagggctgcatcgagcgcggcaaagagatcaaggaaggcggcgcgaaatacgacttcacaggcgggcagaacgtaggcatggtgtctgcggccaatgcgctggcaacggtcaaaaagatggtgtttgacgagaaactcctgagcgcgcaacagctaaagcacgcccttgatacaaattttgaggaccagacgacggagccgtcgggcgaagtcatccgccagatgctgctcaatgcggacagtaagtttggcaacgataatgacgagccggatgcgatcgcggcggagatcatgaaatatttctcggagcacgagatgaaatataaaaatacaaggtacggaaaaggcccgatcggcggcttcttcatcccgtctaccgcgacggtatcggcgcatgtcggcgcgggcgaattcgtcggcgcgacggcggacggacgcaaggcgggcgagcctgttacggaaggtacgtcggcataccgttccacggaccgcaaaggcccgacggcgctgatgaactcctattccaagctccccagcgtactgatgccaggcggccagctctttaacctgaagatcaccccgacctcggtacagacagaggaaggcctggaccattgggttgcgctcatccgtacattgttcgaaaagaaggggatgcagatacagttcaacatcgtttctgccgacaccttgcatcaggcgcagaacgcgccggacaattacaaagacctgatcgtgcgcgtcgccggattcagcagctattttgtaagcctgtgcccgcaggtgcaggaagatatcattgcaaggacggaacacgtactgtaaaaacacaggaggaaaagcggcgcttcgttagccttggcaccgcttttttaaagtgatatgagtaatcagacaaaagtatttaacatacagcgtttcagcacgcacgacgggccgggcatccgcacggtcgtgtttttaaagggctgccccctgcgctgtgaatggtgctccaatccggagtcgcagccgcttgagacaagtattttcttccatgaagaccggtgcatcggatgcggacggtgcgtagcggcgtgcccaaaaggtatcgaagttggcatgcaggggcgcgacgacaggtgcctgcattgtgggttgtgtgcaaaggcgtgtccggcgcaggcgctcgagctgatgggggaagagatgagcatttccgagatcatgaaggagatcgacagtgacgcaagctattaccgcaattcgggcggcggcgttaccgtttccggcggggaagcgctcatgcatcctgattttgtatgcgagttggcagatgcggtaaaagatgcgggctatcatctcgcactggaaacgaccggttttgccaactggttcgtggcgaacagggtatttgcgaaatttgatttgctgctttacgatatcaagcatatgaatgatgaaaagcataaacaatatacgggcgtttccaataaactgatccttgaaaacgcgcggctggcggcaaaagcgggatacaagatgattttccgtgtaccgcttttgggcggggtcaacgccgacgaggaaaatatcatggcgcttcgggattttgctttagaatgcggggtaaaagaagtgcatttcctgccctatcacgccctgggcgaatccaagtacaggcagcttggcggagactatacctgcgcggcatacaggccggagcaggaggacattgaaaggcttgccggcatattgaaagacggcgggatatccgtcaatgtaggcggctgaacaagaaaaaatacgaaagcaaaagggagcgggtatccgctcccttttgctttccattaggtacctctatagcgtaagcaggacgatacccatgacacagaggatcgaacctgccacaataaggagccagccaacgatcttactcagcaaggttccaaattttgcatttttttcaaaaaacatgatcagtgtgaaaagtcccatccaaaagaggttcatcatgccgagcggaaaaagcacgaccataagcgcccagcagcagccaatacattccatgccgtgcttcatgcccatagcaagggcgcccgggccgcccgccttccagttgtgcagcacaaacgcgagaggatgctggcagccgcgcatacaagcgtttttgagcgggcttagctgatagacgcccgcaaccaggaagatgacggccacgccgatcagggtatgcgtccagctcgtgaaataatcgccgatcagggcgatgatcccttcgccggccagccagcaaataacgccgaacagcgcccacaaaagaacgtatcccaggataaacaagtacgtgggcgagttgccgaagccctgcacacggcggcgtttgctgatcgtgtcgaaggcaaagatcatagggaccgcagtaggaagcatcatgccgatgcacatcacgatccacataggtacgaacatggaaaacggcggcatcgtaggggaataagcggcggatgcaagacgctccgccatctgcgcgtccatttcggggtcggccgcgcccgtcatatccatcgacatgccgtccatgccgctcgagccggcgtttacggccgtatagatccatgcgcatacggtcaacgcgataataacgaccaggacgatgacctgctgtttattgagatgaaatttttttgtctgttccatgaaagatccttttcttatgtgattttgcaggacgcgcttaggcgatgatccgcagccggttaccggcgcttattttgcgaacgcctgcagcgaatcctcggtgaggcgcccgccggacatgcggaatacccgattgccgtagcctacgttgtcgaggtcatgcgtggacatcaggatggtggtgccctccgcacggatttccgtgaaaagctccatgacttcgcgtgttgtttcttcgtcgatatcgcctgtaggctcgtctgcaagcagcaaaaatggttcgttcatcagcgcgcgcgcaatggcgacacgcttcatttcgccgcccgacagttgaaaggggtagctgccgccgcggcccttgagcccgaccttcgtgagaagcatttccgcacggctgacgccgtcgccttcgcgtttatgcaaaaagtaaggcagccgtacattatccagggcggtcaggtttgaaagaaggctcagtccctgcgggatatatccaaggctggagttacggacgtatgccatgtgcttttcgtcctcggcccaaaactcccggtcatttagtaagatccggccggaagtgggacgcaatagtccggcgatcatattcagcagcgtggattttccactgccggacttgccgatgatactgataaagtcgcctgcctcaatggaaaaatcagctttgtttactgcagtgaaaaaattcttttccccacggctgtattttctggttacttgctcacaacttagtaacatcattcattctcccttattgtgaaatacgtatccgttttgctcaggcggactgccgaatgcaggcaggaaagcggcccgatcaggatagagatccctgcgctcaaaagtatgtttatcagaatggactgcgcgtctggcgtcaggtagggaagccccatggatgttgcgatgagcgtctggaacggaaacaggatgagacaggccgcaagaaggccgcatgcagtgccgatcgctgtcgtgatcagcgattcacaaaggatgatgcccgcgatcttgcccctggttgcgccaagggcgcttaaaagtgcaaattcttttttgcgctcattaaatgtaatagaaaacacaaagagcaaaacaagtacggcgacgatccataatagaatggcaatggcaagcgtaaggccgcttgtattcgaaagctcgcccgcaatattgcgcatgaaatcatccgaaatcacaacgtctgtatggggatagcggtcgatgatttcgtccgcaagcaactgcgcgtctgcatccgcatccaggcggataagtacggacgacacaagcccctctccactgcctgcgggatgcacggctttttcaccggacaaatcgatcatatgctgcgcggtgttcgtcgtcataaaaatcgaagaatcgaagcccatacccgtttccgccagcttggcggcaaccttgaaaggctgcccgtagaaaaatacctcgtcacccggctcggctagcacaaggctgccaacgacgacctctccgtcgccgagcagcttagacatggcgtttgttatccacggcgtgatcgtaaaatcggtatcgggatcgtacccgatcaactggacggggacagtacagcatgcggcgtttaaggaagcgataaaaagctggggcgaggtctgtgctacgccgtccatggaggaaagcccatccaaaatatcgtcttccagataaaatgtgctgggttcgctgcgcaaaagggaattctgcaaatcgctgccggccccgcgcggcacgaccatcaggtctgcaccgatgcgcccggacatgctctcaattcctgttttcaggctttgtgtgagcatggtgccgcaaaaaagggcgaacgcaaaaacagccacaatgatcgcaagccccgcagtacgcatgggcttacgccggacgttcaaaaaggccagtgcaggggaagtaagctgttttaccttcatttattgatcctctcccctgcttgtttttatgccggttattagctgaacaatgccgcatacgataatcagggcacaaagtacgatcacggccggctgcgtacccatatggcagggcatcgtagcgtttttacatacgccgatgagagccgttgataccagcagcgtcgcaaacgcgagcgcgacagttccaaagcccaaagcaatccaagtctgcgctttccgcaacaaaatagaaagcaagccgtaaaaagcgatcaggatacccgccacagtggcaaacaatcccgtatagtggcaggccatgggaaccgcgtttccgtttgcaagttcaagcatttttgaacagacaggcaggataaactgcggaacaagggcgagcaatgcgcccaggaccagtataatgattccgattatcgtgttttttttcatgatgaatacctcgggtttcaatgattcacggtaccgccgcaaggatgcacgccctgcccgccgagcctgcgcgctatgcttgcaaaggcatcggcgacaggtcgtacattcctgcgccggaatctgcgtgtccggcacgacgccggatgcgaaacgaatataagtttgcaggcaggtttgccgttccaaactgtttatttctcgtaacggtcgtatttgatgccgatgggggactcgggcacccacacgtagcggccgtaaaaagcgttgcggccggtgttgttcatgaccttcatgttgtcggtataacgcacgtccgtaccgtatgattgcgtgacgacataagcgatatcgctggcgttttcataaacgataggcatattgtcgtgctgcccgattttagccttgatctttaccttcatgatgccgggaatttccgcctcgcgtccatagatatccggacgctcatagctgatgtcaacaagcttgacgccgtaattttcttccgtatggtccgccatacctgccgtggggccgccgacctgtcctgtgacgatcttggtaagcgcggcctgctgctggggcgtctttgcatcgatgtaataagcggtcgtccagtttttcaggcacatctcgcggggggtggaaaatgcgacgacaaatttacagccgtctagtgtaacgtcctcatagtgacccttgtcgataataaagctgagaataacgtcgcaggggagatagtcgggcaggatcgtattgtgcggttgtgcgcttacgaggcagggacagcttacatcgcagctacagctctcgatgtattcgccgtccagcttccagtccggccattgtgtgttagttttttctttactcatttttggttctcctttcgatagtgcatatccatttcacgatataattttccgcccgcataaagcgtgcggtatatgacgtaggataaaaaatcaattaatctgataatctgaattttttgttgcattttatcctattctttggtagaatacacctatacacgtgtaaaataatttttaacacgtgtatagcaaaggatgaaaacgataccccatttatcaccgcaacgcatggatcttgaaacgttgctactaaacgaatatgattgaaaacttccaaagataaggggattaacgaaaaacctatgatgcctttgctacataacgcttaacgaccataaggccgtgcgttactcttatactagcatcgcaacaaacttgtgtcaacgggtaactggaacaattgggagctctccgatgtataagaatttagtgaaatgcccataaacaagggattttttaaagaaatgcgatgcaaaagaaaaatgtcatttgacaaaattattaaaattattgacaaatgtttttttcggcgttatgatagctgtaaagctaacagaaccaagacatccatttttgaggattcaatctaatcgtaagaaaccagaggagaaatttaagacggcctaatgttattcagatgagaagtgcatgtgagcggtccgttatcgaaaaataagtacacgtgtaaaataacgtaatatggcggtttgttgtctccgttaaaacaggctttcagggcggcggcaacttgcaaaacataaaaagtttccaagaaaagggtaccaaaaaaaaagaaaaggagtgttgtgagtgagcagtcaagggcatttactggagatgaagaatatctgcaaatcgttcccgggcgtgaaagcgcttgatagcgtttccttcgaactggaggaaggggaagtacacgcgttgatgggagagaatggtgcaggaaagtccacactgatgaagatcctcaccggaacctataaacaggacgtcggcgacgttgtttataagggtgaggtgctcgaaaaacgtgatgaaaggtttacgctttcaaagggtattgcaatcattcatcaggaactttcttacgtcccttatctgacgattgccgaaaacatgtttctcggcagggaaatcgtccggcatggcgttctgcagcaaaaggaaatgaatgttaaagcggcggaatggctcaaaaatgtgggcgtagacttaaaccccaagcgtaccatgaacagcttgatggtgtccgagcagcaaatggtggaaattgcgaaagcggtttcctacgatgcaagcatcatcgtcatggacgaacctacctcggcaatcacggacagggaagtggaaaaccttttccgcgtgatcaacgagcttaaggcaaagggcgttgcaatcatttatatttcacacaaaatggacgagatacttcgtatcagcgaccgcgtgaccgtattccgcgacggctgcctggtggatacgttcaatgcatgtgacgtggatatcgaccagatcatcattgcgatggtaggccgtaagctgacggatgtatttccggtcagggaatgcaacccgggggaagaaatgctgcgagtggaaggactcagccgtgggggtgtgttcgaggacgtatcctttaccgtgcgccgcggcgaggtagtaggctttgccggcctcatgggcgcaggcaggacggaaacgatgcgctgcatttacggtcttgataagctggatgcaggaaagatattcatacagggaaaggaagttgcgatccgtacccccaaggacgcgatcgcaaacgggatcggccttgtaaatgaagaccgaaagggcgttggcctggtactgcccctttccgtgaagcacaacctgacgctttccaacgttaataagtatttcaaatctcctatcatcaaccaacaaagggaaaacgaattggcggataaggagatcgaagatctttccatcaaaacacccagcaggaaccaggcggtggggaatctttccggagggaaccagcagaaagtcgttttgggcaaaatcctgctcgacgaatcggatatcctcattatggacgaaccgacgaggggtattgatatcggtgcgaaagcggagatttaccaactgatcagcgagcttgcaaaacagggcaaggcggtgatcgtggtttcatcagaaatgcctgaactgatcggtctttccgaccgcgttgtggtcatgcatgaagggaagatcaggggagagatcaaccacaaagaagaaatcaaacaggaaaaaattatggagtatgtatttgctcaataaactgggggaggaaaaaagagatggttaataaaagcaattcgctggaatcaggcagggggatgtcaacgggagaaattttcaggaaatatggtattgtattagcgctcgtcattttgatcatagcgctctcggtcgcgacgaataaattttttacgccgaataacctggtcacgatcctgacacaaacgtctattaacgcgctgcttgcgatcggtgtgacgttcgttatcctgaccggcggcatcgacctttcagtcggatctgtgcttgcggtatccggcgtggtatttgcgatgtttgcacaggtggacgacaacggcgtaatgatgttcccgcctgtggtcgcggtggtgatgggaatcctggtaggccttgcgttcggcgtattcaacggcgtcatcgtagcgaaagcaaaggtcgccccgttcatcgtaacgctgggcacgctcacgattgcccgcggtacagcgctccttttgtcaaacggacggcccgtatcgaatatggctccgacattcaaagcgtttggcagcggaacgctgggcggtatcccgtacctggtcatcgtcatgatcattgtagcggtcatcgccatgttcgtcctatccaagactaagttcggccgttacgtgtacgcggtcggcggcaacgaagaagcggctcgcgcttccggtattccggcttccaacattaaaatgacaacttatataatctccggcctggtctgcggtatcgcaggcgtgctccaatcctgtcgtatcgtggtcggacagccgaacattggacaaggatatgaactggatgcgatctccgcagtcgtcatcggcggaacggctctttcgggaggcgttggtaaaatgtggggaacgatcgtcggcgcgttcatcatcggcgtgctcaataacggacttgaccttttgggcgtatcctcttattggcagcaggtaatcagcggcgcaatcatcatcgcggcagtacttttagaccgcaccgacaaaaaataagatatatcattatatgtttataaagttgcggggcgtaaacgcttcgcgatgttaatgaataagtaataaaaaaacaagggtatttaggaggaaaacatgaaaaaagtattagtagtagtactggcactcgtgctcgcagtgaccgctttcgcaggttgcacagcgacaccggcagaatcttcggcaccggcagagtcttcggcaccggcagaatccgccagcgcagaagcatcggacgcagtagaatccgcagcggcagcagcaggcaaagatcccagcgaaatgtcgtttgggtatcttgttcagacacagacgacggaattcatgctcagcattgctgaaggcatccagacccgttgcgacgaactcggcatctccctgacggtaaatgacgcggacggcgacccgtccacgcagatctcgcagtgcgaatccatgatcgcccagcagatggatgcgatcatcgtaacacccgttgacgcgcaggcttgcgtgccgatcattgaaaagtgcaatgctgccggcattccggttatcggcgtttgcacaacgtttgaaggagatctccagcctgacgcattcgttggttctgacgacaatcagtctgctgaactcgcagtaacagctctggctgatgcgatcggcggaaaaggcaaaatcggtatgatccgcggtattgctggtcagtcttccgaagttatccgcggcgatgctgcaaagaaactgctggaagaaaaatatccggacattgaaattattgttgaggatatcggaaactggtcccgtgacgaagcaatgacgatcatggaaaactggatcaattcctacggtgaagaactgaatggcgtgtttgcccagaacgatgaaatggcaatcggcgtatgcaatgcgctcgaaaatgcaggcatgacaggcaaaatccaggtaacgggtatcgaccttgttgccgatgcaaaagaatatctggctgacggcagactggctgcagacgtattccaggatggttatggccagggataccagtcggttgacgttgccctcgcactgatcaacggcgaacaggttgaaaaggaaacatggattccgttcgagctcgttacgaaggagaacatggacgaatatttcaactgagaacaagtagtagaataagactttaagaaactgaaaaaactgttttattacttagagttaacatgaaaagaagacaatccattaatatatccttatattaagggaagcttttgattgtggttgtatccggccgccgcaaaggcggccggatacaataataattgaacaaagaacactccaggcaagaaacggtcataagcggccagtcagaaaaattcccaaacgggaaaaagaaactctcagaaacaacattgaaaaagatgataaccggtaaaaggaagcggcaacaaaggtgcaaccttgtatttttatacataaaaatgccggaacgtatataagtttcaaataatcagcaaacaaaaaaggagaaggaaagatggaaacagtaaaagttggcgtagtagggtgcggtaatatttcggacatctatttcgaaaacattgccaaatttgaaaacatcgaggtatatgcatgcgcagacctgatgcttgacagggcaaaagaacgcggagaacagtatggctgcaaagcgatgagcgtggacgaaatcatgatggatccggaggttgaagtgattcttaacctgacgattccggcggcacatcatgctgtagacatgcaggcgcttaacgccggaaagcatgtatacagcgaaaaaccactcgcgatcacgcgtgaacagggacaggagattcttgaaaccgcaaagaaaaagggacttttagtaggctgcgcgccggatacgttcttaggcggccgtctgcagaccatgagcaagctcttagacgacggctggatcggaaaaccgattgccgcgacggcgttcatgacgacctttggccatgaaacatggcatccaagtccggagttttattacaaggaaggcgcaggcccgctgtttgacatgggaccgtactatttgacggcgctggttgcccttttgggacctgcaaaacgcatcagcggtgctacggcaatgacgtataagcaaagaatgatcacaagccagcctttggcgggcaagatcattgacgtagaagtacccacgcatgtaagcggcacgatcgaatttgaaaacggcgcgatcgccacgatgatcatgagctttgatatgtgggataataacctgccgcgttttgaaatttacggtacggaaggcacgatgagccagacggatcctgatccgcttgccggaccggacattttccacggggaaaccaagctgcgcaggaaagatgcttccgattgggtggatacgcctgttccgcttccgagactcgaagaagcaacgccgtggtcggtcattccgccctgctttgactatatggaaaacagtcgtggtcttgggctctccgatatggcgcgcgcgatccgcaaaggcggggatttccgtgcaaacggcgaaatggcataccatgtgcttgaaatgatgcacggtttctacgattccgctgattccggaacctattatgaaatgaagagcacgtgcaagcggccgtcaacgatgcctgtaaatctgcctaaatggtcgatgggcgactgattgacgtaaaaaggatgggaacgggtcccttcggaggggacccgtttttcaaaaagaagggtttttgttatttgccagaaattgaaaaacagaaattgtcatatgacaattaaaatttaaaaaatagcaattgacataagccgcgttcggtgttatgataggcgtagagacaaaggaaatactttcatattttggttacacgtgttaaataatctgccggacggactctcgacggatctctcgacaaattttgcaaacgaactgaataaaaaagattatcacaacggtttattataaaaattattcacaggaggaatggagcatgaagtattatgaagagcaagggcagacagtcacaaagcacgaatttttgggacgtcccgtcgtgcgcagcaagagaatcaacgacctgcgcgacatgttgattgatgcaacgccgcagatatgctcggacagggcaaagcttttgacgcaggcatatcagacgtataaatctgaaccgactgttttgaagcgcgcaaaggcattcaaacatattctcgaaaacatgcagatcagcatactgccgggagaacttatcgtaggaagccttggcgttaagctgagatgcgcgcctatctttccggaatttggtatggattgggtcattgaagagcttgacgggaatccggtgcggccggaagaacgcccgggagaccgttacctgatcgacgcggaagatgaaaaggtgctgcgtgaaatccacagcttctggcatggaaacgaccatgaatcgcgctgcaaagcgatgcttcccaaggaaacggaaattggcaagaagatcggcgttacggattcttactggctgatgatcggcggcgacggacatctgacggtagacctcaaaagcgttgcggataaggggcttaaagatgtcattgcacgtgcgcagaaacgtcttgcggaacttgatctttcggaaccggaggcgatcgaacagaaaccgttcctggaatccgtgatcatcacctgtgaagcggtcataggttttgcacaccgctatgcgcagcttgcggttgaaatggcaaaaacggaaaaagacgcgcagcgtaaaaaggaattgatgaagatcgcggaagtgtgccagaacgtaccggaaaatccggcaagggatttccatgaagcggcgcagtcgctgtggttcatcaacctgacgttgcagatcgaaaacaacggacactccatctcgttcggccgttacgaccagacgatgatcgatatctacaaaaaggacgtggaagctggcaacattgaatatgacgatgcgctggagatcatcgaatgcgtattcctgaaaatgttccagctccagaaaatcacctgctgggataatacgaaagcattcagcgggtaccaattattccaaaactttacagtcggcggccaggaccttaatgggaaagacagcacgaacgaaatatcgttcctcgtgctcaacgcacaggcggcgatcgcgctcaatacgccgtccatctccctgcgttaccacaacaggataagcgacaggctgctgtacgcatcctttgacgttgtacgcatcggcggcggacagccggccatgtatagcgacgaggtttacattccggcgctcgtaaacaggggaattccgtgggaggacgccgtcaattattccatcgtaggttgtgtggaagcgatcatcgaaggaaaacagacgggccgcccgaacggcgcaggctttatcaaccttggcaagatcatggaactggcgttatacaacgggaaagacccgaatacggacatctgcatgtgtgaaggcacaggaaagctggctgatttcaaaaactacgacgagttgtatgaagcgtttaaaacacaggcaagatattactttaagcagcagatcatgacggataatatcatagaccagtgcacggagcttggcattgccgatccgtacgtttcctcactggtacacgattgtatcgaacgcggcaaggtaatgaaagcaggcggtgcgatctacgattactgcggaccgctttatgtaggcgttgcgaacgtaggcaactcgcttgcggccatcaagaaagtcgtattcgacgataagaagatcacgacagagcagcttgcacacgcgcttgaaacaaactacgaagatatgacgacgaagcccacgggcgcagaaatccagaaaatgatgctggatgcacctaagtacgggaatgacgatgattacgtggatgacatcatggtggattatttccgctttatctgtgaagagacggcgaaataccacacaacaagatatggccgcggcccgatcggcgggacatggcagccatccacaagttcagtttcctccaacgtaccgttcggttcctttgtgggagcgacaccggatggaagaaaagcgggcgacgcgcttgcggatacttcctcaccgatgcacggtacggatacgaacgggatcacgtcttccctaaaatcggtgggcaagctcccgacgatcctcgtatccggcgggcagcttttaaatgtaaaggtcatgccggcgtccttagagcccggcccgaacctcaaaaaactggtagacgttgtgcgtacatatttcagcgactacaaaggcatgcacgtacagatcaactgcgtatctgcagacacgcttaaggcggcgcaggacagcccgtccgaatacaaagacctgatggtccgcgtggccggatacagcgcattatttacgccgctcgacaaggctttgcaggacgacatcatcgagcgtacagagcacgcggtctgattgactgaaaaccaaggaagtgtgcgggccgcattttgcggtccccacctttcaggaacatgaacattttggtatgaacaaaaaaaattagggcaaggtatagcaacatgttttggagcgacaaaatagaacaggaaacagtgggaaacgtttttaacgtggaacattatcatatcaatgatggtgaagggattcggacaaacgtctttttaaagggctgcaacctttggtgcccctggtgctgcaaccccgaatcccaaatctgtacgccgcaattggtaatccataataacctttgcacaaaatgcggttactgctgcgtgacactgtgtccgcaggatgcaatcacgcagaaagaagacggtaccattgtcatcgacaaggaaaaatgcacgttgtgcggtaaatgcgtggagatgtgtcccaattccgcacgcgagctgtacggcaaggaaatgagcgttgcggacgtcatcaaggaagtagagaaggacagcgcgtattacaaaaattccggcggaggcatgacgatttccggcggcgaaccgtgtatgcagccaaagtttgcgagcgaactcgcacaggcggcgcggcggcggtatatcgacgttgccatggaaacggcgggggctgttccgtttgaaacgctgtggcaggtagcgcagtatgtggatgaaatcctgatggacgtaaagttcacaaacgaagagcaattcaaaacgatctcgaatgtaccgctttccgtgataaaggaaaacctgcggcagctacgccggaatggcaaatatgtaaagatgcgctgcccgatcataccgacactcaacgataccgacgagcatattgggaacctgatcgagtgggcaaaggagctggatatacagcatgtagaccttcttccgttccaccagcttggaaaatacaaatatgattcgctggactatgattatgcattgggcgaattcaaggacatggacaaaaaaatcgtagaaaaaatgaaagaccgcatggtagctgcgggcgtcaacgcctgcgtaggcggctgatgcaccggagaagacagatgggcaaaagcgaatgtgtactcggaatcgatatggggacaagcagcgtcaaagtcggcctgtttgatctaaaaggacagccgcttgcgtttgcggacgctacctatccgctctatacgccaaaatccggctgggcggagcaaaagacggacgaatggtggatcgcgatttgcgcggcgacgaaagaagtcgtggaaaaaagcggcgttgcggcggaccgcatcattgggatgagcgtggataccacgtgctgcaccgtgctcatggctgataaggaaatgaatatccttgctccggctatcctatggatggatatgcgcgcatcggcgcaggcaaaaaaaataacggcaacaaaaaacgatgcgctcaaatataacggctatggcaatgcttcggcagagtccatgccggcaaaggcgctgtggctgaaggaaaatgagccggagctttacaacaaggcggagcacgtttttgaatgtgtagactggctgatgtatcagctcacaggacagcttaccgcaagcattgacaccacgtcgccccgctggtattacaaccggacggaaggcggatggccggtatcgctttacgaagagatcggcctgaaggatgttcttaagaaatttccggataccgtccttgatatgggcgtcacagtaggcggccttaccaaaaaagcggcacaggaactgaatcttcgcgagggaatacccgttggcgagggcggcgcggatgcgttcgtcggtatgcttggactaaacgtggtagcgcccggcagtatcgcaatgatcaccggcacttcgcaccttcatttggggctgacagaccatgagatgcatgccacgggcatgtggggatcttatccggatgcagtcattccgggactgcaattgatcgaaggcgggcaaacgtccaccggagcgatcgtcaactggttcaagacaaattactgcggcgatattgcccgtatggcaaaggaccagggaaaaagtgtttacgatctcttgaacgaggaagcctctaaactgccgataggcgcggaagggcttttggcgctcgattacttccagggaaaccgtacgccatatgcggatccggatgtgcggggaatgttctatggcctctccttaaagcatacgccctaccatttatacagggcgattctggaatccatttgttttggaacggaagtgatcatggaaacgttccgcaagggcggcatgaaaccggagggaatctatatctccggcggcgcggtcaaaagtgagctgtggacgcagatgcatgcggacgtatgtaacctgccgatttatattccgaaagtaacggaaggcccgtgccttgggtcggcgatccttggagcggtcgcggcaggcgtatatgacagtattgagacagcggctcaaaatatggtaacgattgaaaagaaaatcgagccagaccaggaaaggcatgaagattacgtattttattatgataaatacgtggagttttacgaattgacgaagggatggatgcatagcttgacaatgcacatttgattgtaatatatttaatgatagaatttttgtagaatttgtgcaaaaattactattatatgtcaaaggtgcaaaagttgtggatacagagtatataaatgctatggtaaaagcgcagaaatcgattgcgcagcgcaggctgatggttcgaatcgcaaaaatgtattattacgacaatatgtctcagcaaagcatcgcagatgttttggagatatcgagatccaacgtatcgcgcttgctgcgtatgtcacgtgaaatggatattgtagatatcaggatcaacgacgcttcactgaaatccattgagatcagtgaaaagctgaaggatatgttccagctcaagcaaatgattgtcgtgccttcgaaccatgatccgaacatcaatctttccaacattggggttacggcggcgcggtatttggaaaaacaattaagggatgacatgaaggtaggggtgtcgtggggcctgagcgtataccagacgattttccattttacaccggtagtacgcgcaaacatcgacgtcatgcagcttatggggggaacggcctgggacgactcctatatgtacggcgtgcaattgattttaagctttgcggataaagttggcggaagcgccaagatgctgcattccccgctgacggtgaagaccaggcaggtgcacgacctgctgatacaggaggacgacatcaagcggcattttgaagcgacaaagaacctcgatatcgcagtcatcgggatcggaagcaactttgcggacgtcagcacgatggtacattcgaactatattaccaagaaagagtctgaacagctttggaacagcggcatcaagtgccatatctgtggcaggcacatcgatatggacggcaagcaggcggatatagaatataatgagagagtcatcggtatcgaacttgaggatctaaagaaaatcgaaaacgtcatcgcgattgcggggggaaagcataaggttgccccgatcgcagtcgctttacgcggtgggtacatagatacgctggttacagatgaagaaacggcgattcttgtggaacgggaggtggcggagcagcaataaccagacaaaagcgaaaggagaggacagctttgtcaatactgtctgcatcaattttaggctgtaacgcaatgtttttggggaaaaatgtggaagaggccgaaaaggccggcgctgattttgtccatgtggatatcatggatggggtatatgtcaaaaatatcgcgtttggaccgaaaacagtgaaagatatcaaaagtttttccgatacgaaggtggaagtgcacttagagctttacaatccggaaaactatgtggaaatgttcgatcaggccggagcggatgcgctcatattccaattggggaccacgacgaacccgatccgcctgttaaaagagatacatgcaaggggcatgctggcaggcatcgccctgaatccggcagacccgtgggaaaatttaaagcatctggccggctatgcggattatattatgatgatgagcgtggagcccggctttggaaaccaggtttttgaagacagcgtttaccagaaggtcagggagcttaaggaatttcttgcttccaatggaaaggatatccccatcggagtggatgggtctgtaaatttggagcgtgcgcacaagctgaaaaaccttggcgccgactggttcgtggtaggctctgcaatcttcagttccggcagcagcaaagaccaaatcgccaaatttaaaacaattataggctaaggaaagtattcaaaaagtaaatttaagcaaaggaaaggtggaaatgatgagtaaaatgaaagccagtgtattttatgaaccctttaagatgcaaatggaggaagtagatattccccaaatcgctgccaacgaggttctcgttaaggtaaaggcagtgggtatctgcggttcggatctcgagtattattatggcgggagcccgcttacgacaccggatggcaaagggccgttgatccttggtcatgaaacggctggtatcgtggaagatccaggcgaaatcggcgcttccatgggccttaagaaaggggataaggtcgttgtaaatccggtcgccccatgcttcgcatgcaaaccatgcctgcatggacattacaatgaatgcgataacgtcaaggtgtacggagtaggcgagaacggtgcgtttgcggagtatgtgaagtctgcggcgactaacgtttacaagattccggaaggcatgtccctcgaaatgggcgcgcttgcagagcctatggcctgcgcgagctacgggatcaaaaagctcgacatccagcagggcgatacggctatcgtattcggttgcggcacgattggtctccttgacgtccagctcgcgcacatgaacggcgcaggacaggtaatcgcggtcgacgtagtggattataaccttgaaaaagcgttggaactgggtgcgttgcatgcgtttaatacgcttgataaggattcccaatattacacggaggacctcgcggaaagcatccgcaagatcaacaacggccgccttgcagacaaggcaattctgcctacaggcgcgatgagcgcatggcagcaagcgctggaagtaacggctccgtgctctacgatcgtatattttgggctgccttccaaggcggacgcagtgctgcaggttccggccttagacgcgatctacaacgacaggaacatcaaattctcatggctggcgccgctcgtttgggacaatgtatttaccgcccttgccaacggccgcgtcaaactggattcgctgatcacgcaccgttttgcgcttgacgatatcgaagaaggtatcaagttcatgcgtgaatccaaggaaaagaagatcaaaggcatcatggtaatcgactaattacaggatcaaaaaacaccgctttcttttgggaaggcggtgtttttgcatatcagagcgtttcatcctcatcttcggacacaaatcgcctttcaaaaaacggatcgtccttcaaggcgtgcagatcctctttgctgatcagggtgttggtaccaaggcacgcgctgcagcgcgcgctgcacgcagggcatatacagcccatcttcatatcttccgcgtgcgccatgtacgtaccacacacagaacattcacaccgcatagagattctccttatctataaaagtaacgtatagtattatagtaatcaagtagagtggggatgtcaaatcgtgcgcggcaatgggtatggttttcggttattcctgttgaaaaaggtgttatataaagaattataagcccaaacaaacaggaggaatatcaacatggagaatacatacgattatattgtcgtcggttaaggaccgtctggcaggcggcggatcgtcggtcaacggagagatgtatgtgcggccgacgccgtatgtcctgcggcaataggaaaaagttggcggcccgcaatggtcgcttgaaaatgcgactcaaaactttattgaactggaaaattatgatggaacatcggacgatatgtcggtacatggaaaagacggcttgctgtatatccgccaaacatatcaaaaaattccggcatttgcccgtaaactggtagcggcggtgtaagaagcgacaggtttcaaaacggtggaggactacaacaatccccaaacggccaggaacaaaccgcttatgccggaaagcaggtcgtggtcagcgcggggattcatagcgtacaattgcttatgctctcgggcatcgggccggaagatattctgaaaaaagcaaatgttccggtagtatatcataatccgcatgtgggaaagaaccttgcaggcgatgcgtatgtaggggccgcatttgcggtcaatgcggaagacgtacgggaattgcaggaagccgaccctaatggaaaattcgcgggtggcgcgtttttgccgttgccaggcggatcgcaggagcaacgcgcgatccagtttattccgtcgcaggtagccggaaacatgctttatatgagcgtgttgtgcgtcaacccaaaaagcaggggatcgctgcaaatccagagcagcgacccgctcaggatcatgctgggggattttggatttttgacagaccctgaggatatcaaacccctacggaaggcgctcagggaatatatcctgcccatgggcaggattctttcaaaagaggatgccgcatacaagctggcaggccccgcgcccgatgtccttgaagacgatgaaaaactggaacaatacatcaggggatcgtttatccatacttaccacgaccaaagttcgctttcgatgggtgaagaaaaagacggaggcgccgtggatggatttggtacggtgtgaagaatttgacggtcgcggacgcatccatcatcccgtaccatatggatggcaatacatccgcatcggcgtacttgattggctatacggtcgccaagtatttgttacaaagcagctaaaaagattcagatgctaaaaagcgctccgcaaagggtgctttttgtgttaagcttatcgtatatagagataaagaaagaaggagccggcaatgatactcagcgtgagcaggcgtacggatatcccgcgtttttatttcgactggtttttaaaccggatcaaagaaggatactgtatggtcaggaatcccatgaatttcaggcaggtgagcaaaatcaatttgtctccggaaatcgtggattgtattgttttttggacgaaagaccctggccccatgttagggcggcttttggaactggagccgtatccctattatatacagtttaccatcaactcatacggaacggatgtggaatcaaatctgcctgatttgaaagaacgggtggatacgttccggcggctttcagggcaactcggtccgcagcgcgtggtgtggcgctatagtccggtgctgctcaacgaaatatatacggaagaataccatattgagcatttcacgcggcttgtccgcgcattaaaaggctgcaccgaacagtgtaagctgagtttcatcgatctatatgccaagatcaggaaacgcatgggcggtatgggcatcgttaatatagacgaagaaataaagaaccgtttggcgcaaatcttttttgagatcgccgcaaacgaaggcattcacgtttcagcatgcggaaacatcgaccttgccgcggcggggatacctcctgccaaatgcatcgacgacgaactggtttcgcgcatcacagggtaccggtatcaactgccaaaagacccgggtcagaggatggattgttattgcgtaaaaagtatagatattggcgcatacgatacgtgcctgaatggctgccagtattgctatgcaaatgtatccatggaatgtgcgaagcgcaatatgaagggatatgacccggattcgccgcttttgtgcagcgtgcccgagccgcaggacaaggtgagcgagcgtgctgcagcatccgacaggcaggcgcagatgaagctgttctgagcggtcggggctgcgcataagattatggaattggtttatatataaggcataagaaaaatacattttacggaggcttttatgctgaactatgtgaacagtaaacagatggggcgcgggatacatggatggcttgacagccattttcatttttcctttgcagagtattacaatccggaaaatatccagtttggtgtattgcgcgtcgtaaacgacgatatcgtgcagccggaaaccggatttgatacgcatccgcaccaaaatatggaaatattatcgtatgttgtggaaggcgagctgacgcatgcggacagcatgggcaacgagcaaacactgacacgcgggcaggtacaatatatgagtgcaggaacgggcgtactgcatagcgaatataacaatggcaacggtttgctgcgttttttgcagatatggattttgccggacaaggctggatatcggccaaattacggggattatcgttttaaactggaagacaggaacggtcggtggctgccgcttgcgacaggcgccgaaaacaaggaatcagtagcgcccatccatatccaccaggatatcaacgcatatgcgacgattctttccaagggagaaagtatcgatttccatgtaggaaaagaccgccaggcatatatggtattggcagaaggccgcgcgcaggtggaaggaatcgctctggataagcgcgacgcggtggagatcatagagcaggatgtggctgtccgtgcaggcgagggcgcgcatattgtcgttattgaaatggccaaagcataaaattatttggggggtaaaaagtacgatgcgttcacagatcacatatcttgataatagcggctttgcagtaaagacggagaaccattttctgatctttgactgctggaacatgcagccggagcagggcaagacaggccttggcgggggcgcgatcaatccttcggaaattgcgggcgaaaacgtctttgtttttgtatcccacgggcatggggatcactatagtgcaggcatctttaaatgggcaaagcagatcgaaaacatccattatatcctttcggacgatattcgaggagagcggcaggcgctttatgcagcaccggatatggaatacaggctggaggatatcgatatcaggacgctgcaatcgacagatgaaggcgttgccttcctgatccgtgtagacggactctgtatctaccatgccggggacctcaactggtggcactgggagggcgaagacccggactggaatatgcagatgggggacgattaccgtttgcagataggtcggctcagcaaagaagcgatcgatatcgcttttgttccggtagacccgcggcttggaaacgatatgctgcgcggcattgaatattttatggaggtaacaggcgcaacactcgtgattcctatgcactacggcagggatggggaaacggcggcgcgcgcgatcaaaagttctgatatccgtcatgtggagcgcattgcgcagcctatgaaacgagggcaaacgatactgtttaatggttaagcgggaaagataaaaatacggacgcatttgtccgtatttttattgacagcgtaacattgttatgttatattacgaatgatagaacataacaatgttacggaaaggaagcagcataattgaaccttatatcaaaaaaagacctgttgatcaagacagggatatcatacggccagctttacaggtggaaacggcaaaggctgatccctgacgaatggttcatcaagcaatcgtcgtatacagggcaggaaaccttcttcccgcgcgagcaggtattgagccgcgtacaatccattctcgagcttaaagaccaatactctatggaggaacttgcgaaaatgttttctccggaaaccgccggaggaatgatcatagcccctgatgcggcggaaatggaagagatcgacggagagttgatccgaattttgcaggaggattataaccaagaaagctacgaattttcggaggcggtgctgctggcagttctttcacaggccatgaatgagacggcaatacccgcagaaaaagcagctaagctgtttacacggggaatatcggcgatcggattcaaaaagatatccggtatgacgtgtattgtgttcgtgtcagggaagaaataccgtatcgcgttttcgcagggcagcgtcatattcgacgaaagcgtggaagtcataggagcgtggcctttgggcgatctggcgggaaagatcaaagtaaaatacagcgataaatggaaataaggagaaagaatatgaatggattttcaatcagcggcacaggaaaaatggacggcggggtattcggcgacgtaaggatagatgggatcggtaagtgcacgggggatattgaagcggagagcattaatgttgacggagccttcaaatgcgaaggaaacgtgaaggccggtattttggattgcgacggtacggcgaagatcggcgggaatatagaagcgaaaaaaattgacgttgacggcatgcttactgtgaaaaacggaaagatcgaagcagaagagatcgactgcgacggcatgatcgacgcaggcggggaggtatcggcagatattattgaagcaaacggctttatccatgcaaaagagatcgtgggagacagggtatcgatcaagtcgcgtatcattggattggttaaagttttcggcaaggcaagcacggttaacacgatcgaagctaccaccatccacctggaaggcgtgaaggcagaaacagtaaacggccgcgacgtcacgatcggtccgaaatgtgagatcaaggctgtggactgcaatggtacgctttatatccacgaaacggcaaaggtcgattccatcacaggagactacaccttacgcaaatagcaaacatgcgcctatcacaaaaccgtccctcggaaggggcggttttttattaaaatacatgggatgtccctgttttggcagcgccgtatgttatactggaaaaacaaagacgggagaaggcgcggcatggatatttttggaaaacttgagatactggcggattctgcgaaatacgatgttgcatgtacgtcgagcggcgtagaccgtaaagcgggcccgggcgggatcggcagttccgtttcgtgcgggatatgccatagcttcgcggcggacggaaggtgtatatcgctgcttaaagtcctcatgacgaatatgtgcgtatatgattgcaagtattgcgtaaaccgtgtttcaaacgacgtaccgcgcgcgctgttttcaccgcgcgagcttgccgaccttacgatccatttttacaagaggaattatatcgaagggttgttcttaagctcgggcgtagtaaaaaacgccgattatacctgtgagctgatgataaagacgttgcgtatcctgcgcgaggagtataaattttacggatatatccatgcaaaagcgatccccggcgcatcgagcgcgcttctggatcagttgggtatgctcgcggacaggatgagcgtcaatatcgaaatgccttcgtcgggcagcctgaagctgcttgcacccaataaaacaaaggaagcggtgctcaggccgatggagtttatccgcaaccgaaagcgcgaaaatacgcaggaactgacactctataagcacgcgcccaaattcgctccggcggggcagagcacgcaaatgatcatcggcgcaacgcccgaaacggatttccagatattgaaccttgcggaggggctttataaaaaataccagttaaagcgcgtgtttttttcggcatatataccggtggtcgaaaattcgctgctgccgtccctcgataccaagccgccgcttttaagggaacacaggctttaccaggcagattggctgctgcgcttttatgagttttcggcaagcgaaatactggacgaaaaaaatccgaatttcaatccttttatcgatccgaagtgcaactgggcgcttcataacatggaccgttttccgatcgaggtcaaccgcgcgccgtatgaagaactgctgcgggtaccgggcatcggcgtacgcagcgcaaaacgcatactctacgcaaggcgggcctgtccgcttaattttgacggactcaaaaagctgggcgtcgtcttaaagcgcgcaaaatactttgttacatgcggcggaaaaatgcaggatggaacacgttttacacgggaagacgtcctgatttccatgatgtccaaaaaaacgcttgcgcaatataaactgagtccgtattgcccaaatggaagcaaacagctttcgctgtttgaacaaaacggccttctgggagaggagatgagaaaatgcctgacgggagaactgtaaattaccggtatgacggcagcttcgacggccttttgtgctgtgtcttcgaaagcttcgaaaaaaaggaaataccgcaggaaataaacggaccggacgaggggcagatgagcctctttacggaaaaagagatcgcgacggacgaagaaaaggcacgccgcgtgctggcgtctgtcccaaggaagatcggtccggatgcgctcagcttcattcgccgcgcataccttacgtgcctgccgcaaaaggaaaaatatatcctgcttttcctgcgcaaaggatacgaggcgggcgcaaaggtgatgcgccttttgggcgatacggtcgtgagtactcttttcaaagcagtgcagcagcttgggaacgaatcgcacctgttaaaggaatttatccgcttttccgtatatgataacgtgctcgcggcgcagatcacgcccaaaaattttgtccttccgtttttggggcagcattttgcggaccgctttccaaacgaagtatttttgatctacgatacgacgcaccgcatggcgctcacatatgaaaaaggcgatttgcagatcaggccggtcgagcatttcagtatgcccgcgcccagcgaagaggaaaagcaattccgcagaatgtggaaaatgttttatcaaacgatcgccatcaaggaacggtacaacccgcgctgccgcatgtccatgatgcccaaacgctattgggtcaatatgacggaatttgccacagaaacagataaaaatgtgttattgcctatcaaaatttaaaaaccgcttgactctcacgttacgtcatagtgtatgataaaaccatcaaaggaggtggcggcatgaaaacggtacatgaggttgcagggcaaacagggatcagcgtgcgcacgctgcattattacgacgaaatcgcccttttgccgcccagcaaggtgacgaaagcaggctatcggctgtatgacgatacggccataaaacgtttgcagcaaatcatgttctaccgcgaacttggctttgccctaaaggatatcaaggccatactcgacagccgctcctttgacgaaagcgaggcgcttgaaaagcacagggagctgcttcttttgaaaagggagcggattgacgcgctgatcagccttgtggaccgtacattgaaaggagaggatatcatgagttttcgcgaatttgacgaaaaacagatagagcaggtgcgcaaaaaatatgcacaggaagcgcgtgaacgctggggcgaaacggaggcttttgtgcaaagccggcaaaaaacggcgaagtatggcaaagaacagtggaaaatgatcgacgatactgcgcagcagatctacggaaagttcgttgcgcatatgggcgaaggaccgaaaagcgcaggggcgcagtcagccgtccgtgagtggcaggagcatatcacccaatatttttatacctgcacggatgaaatacttgccggactgggcgcaatgtatgttgcggacgaacgtttcaaaaacaatctggacgcatatgcgtcgggacttgcgcagtttatgagcgaggcaattcaaatctattgttcttaatgcaaatcaaaaaagccgactgcttttgtggccggcttttttaatttgtattaaccgtattctgttcagttgatctttcgtttgttcttccagatgcttgcgaaaagaaatatgcaggcgattgccccaagcagcaggaaggataaaaccagaggggtgaaatcatagctgccgccctgccaaaagcctgcgaaatcgctgctgatataagtcatgggcagacccttggcaacgatttgcaacccttccggcaaacggtccacgctcacccccatcatgccgcaaatcaccatgaagccaaaatacaaggtcatggtgataccataggtcgggccaaattttccgctgagggacgcgatcgcgtgcgccaggacgaacaaaatgacggcgagcacgtaaagcgcggcaatcaggaggagcgcggaagaaagctgcgggacctggatatcgagcagcaggtaatccgcaaccgtatagatcgcaagcgcaatggtcatgaagatcaggtttgcgatcattttcgcggtgagcatactccgttcatggaagccaaacaggcgaaaacgcagcgggacctcattttcaagctcctgcgaatagttggccgcataaccgatcagcagcgtggccaatgggatgatcaggctcatcgtgataaaaacgcctgtatttgccgcagggatcgcttcggcagggatctcaccgacaaaaacatttgcaataagcagggacatgaggatcggaaaggcaataccaaaaaagatggtgaaccagttccccgccgtattgagcaactcgtatttgatgagccgcaggctcaatttctttgccttcatgcaactccccccttgtttgcctcataaaagcgttttatggcgttggtaaaaatactttcaatatcctggttgcttcgtttatagttgacattatgccggatcaaaagggcggaaagcttttcctccgcagcggcatcaggacaggaaaatgagagcaggtggcgcggggcctcgatcgtgagaaaccccttggtgatctcacgattatccggcgtatttgcgaccgtgatgatcgcttttccgcaatatttgagaaataattcacccgtgcttccaaaatctacgataaaaccgttttcgaggatcagcagcttatccgcgatacgttccagttcatcataataatgtgaaacgatacagagcgcggtggttttatccgcataccagtctgttagcgtatccataagtttttggcgtgtttcaaaatcaagaccggatgttacctcgtcaaaaaaggtaagcggtgcatcctgcatgaggacaaggatgatggtgaaacgctgtttttgtccgcctgaaagcacttggaaacgtttgttaaggcagccgccaaagtcgaaaaaaccgatcagctcctgtaatttcttgtttgacctgatctccgtgccgagtatggtttccatgatgtggcgcacaggcattgtttttacataattgttctgctgcatatgcgcggcgatttcctcggggcgcaggcgggtgctgatatgaccggaataatgtacaagcccgagtatggatttcacaagcgttgtctttccggcaccgttcgaaccgatgataccgatccggtcgcttgcatggattgtgaggggatgcgtgatctcgagtgccgtctgttttttatagacgacctgtaaattttcaatggtaagcatacgatagttcctttccggcagggttttggatattgaaaactgcgcttttgcaggatgttttcctaatcccagtataaacggcagaaaggtaaggtcaacgcattttcagcaagctgcgccagaagcggtgtaagttgcatttccggactgctattttaacaggtatcctttgccccggaagcggtaacttttaaaaaaccactgtatacattcgaaaagtcctgttttataataaaatcaggatcttgcatgggggggaatcatggatatgaaagggaaaataatcacaggcattttactttgctgcatttttctgtgcacagcgtgcatgggcgggggcggagcgcctgaaacggcgatgccgacgaacatgacttcgtccggcgatacgctggtcacgccgacgtcggcgccggaagcgaccccaacgcctcagccgcttgaaacggttacggggacggtcatagacgcaacgatgtccacgttgtttttggaagcggaggatggcagcgaatatacgttcgccatctcaggcgcgcaaacggagcttggggaaaacgggcttgccatcggttcggtgatcgacgtggaatacgaaaaaggcgcggaaggagagatacctgttgcgcaaaaacttacgctcaggcacgaagcgccggccctcacatttttcctgtatgaggatcgtgccaacgagatactcgagggtatgacccttgaggaaaaagtggggcaaatgttcttcgcgcgttgtccgcaggaggatgcggcggaaacggaagaggccttgcagcttggcgggtatatcctgtttggcagggattttgaaggcaagtcgaaaacggatgtaaaaagcgcggtcaaaagttaccaggatgcagcaaaaataccgatgctgatcggcgtggatgaagaaggcggaaaagttgtgcgtttaagcaaatatgaagcgttccgcgacgaaccctttttatccccgcaggtgctttatgagcggggcgggtttgatcttatcaggagcgatacgcaggaaaaagcagagctgctgaaaagcctgggaatcaatgtaaacctggcgcccgtatgcgacgtcagcacagatcctgacgatttcatcttttcgcgtgcgtttggcggagacgcggagcaaacatccgaatatgcggtgactgtcgtttcggaaatgaatgcggacgggatcggcgctgtgctcaagcactatccgggctatggctccaattccgacacgcatacaggggtcgcgcatgatacgcgcagcttggataccttcatgcagagtgattttaagccgtttattgcggcgatcgaagcgggcgcgccgagtatccttgtaaatcacaacattgtgcagtgtatggataacgggaatcccgcttcgctttcttccaaggtgcatgagatattgcgcagcgagcaagggtttgcgggcattattatgacggatgatttatatatggatgcgatcagggaagaatacggtacaggacaagcggccgtcatggcggtacaggcgggaaacgatatgctggtgtcatcgcagccggaagagcagcttgcggcagtggtcaaagcggcacaggacggcgccatcagcgaagataccatcgatgcggcggtcacgcgtatcctttgctggaagctttcccttgggctgatggaataaagggcaagatcgatatgtaatcataaaaaaggctgccggattaattccggcagccttttgcagtataatcgattattttttgaggacttcctttgccttggcaacgaccgcttccttggtaaagccgaacttttcgaacaatacctttgccggcgcggatgcaccaaaatggtcgatcgtcacatatccgccgtccaggccgacatatttggcccagccgtaggaagtagcggcttccacagcgactcttgcgcgaacgctgtttggcaggacgctttccttataagccgcatcctgctcctcgaacagctccatacacggcatggatacgacgcgcgcggaaatgttttccttcgcaagctcttcggcagcgcccatgcacagttcgacttcgctgcccgtaccgatcaggatcacgtcaggctccttgctgccgtcctttaagacgtaagcgccacgaagagcgtctttgcctgtctccttgaactggggcaggggctggcgcgaaagcgcgatcgccgtcggggcttttattgtcatagcagctttatatgctgcggcagtttcatggccgtccgccggacgccacatataaacgccgggggtcgcgcgcagtgcggacaggtgctcgatcggctcgtgtgtcgcaccgtcttcgccaacgccgatggaatcgtgcgtcaggacgtatgtaacaggaagttccatcaaagcagacatacggatcgcgcccttcatatagtcgctgaatacaaggaacgtagcgcagtaaggcacgataccgccatgcagcgccataccattgcaaatagccgccattgcaaattcgcggataccgaagtggatattggaccctgtcctgttttcaggcgagaagaattcacgttccttcatcagcgagttgttcgccggagcaaggtccgcgctgccgcccatcaggttcgggatgcgctttgcaagtttattgatgatatcgccggaggactgccttgtcgcgacagccttgtcgtccgccgcccagtaatcttcgtcgaaaaccgattcggaaacaggattcatgtaagcctggtattttgccgccagttcaggataagccttgctgtacttgtcaaacatatccttccactggttttcttccgcttcaaatacttcattaagctcggcaatgtgtttttttacttcgtccggaacaaagaacggattctcgtattcccagccgaagtttttcttcatggcatcgatgttttcctggccgagcggggaaccgtggctcgcttcgcttccctgcttcgggctgccgtaagcgatcgccgtttttacgatgatcagcgacggtttttctttttccgcttttgcttcatcgagcgccgcagagatggatttcatatcctcattaccgtcttcgacctcgagaacctgccagccataggctttgtaacgctttttcacgtcttcatcaaaagcggtatcgatgttgccttcgatggtaatatcgttcttatcgtaaagcacgatcagtttgccgagtttcagcgttcccgcaagagagcttgcttcgccggacacgccttcctgcaggcagccatcgcccgaaaggacataggtataatggtcgacaacattgaattttggtttgttgaattctgccgcgaggtgcgcctccgccatggcaaaccctaccgccatcgcgataccctgtccgagcgggccggacgtcgcttctacgccgtccgtcaggccatgctccggatgacctggagtcagggaaccatactggcggaagtttttgatatcttccatggttactttatagccaaacatatggagcagggagtaaagcagcatggacgcatgccctgcgctcaaaataaagcggtcgcggttgtcccatttggagtccttggggttgtgcttcaaatgcttggaccacagcgtatacgcgagcggcgctgagccgatcggcaggcccgggtgaccactgtttgctttttgaatcgcttccgcagacaaaacgcgaatcgtgttcacagcaagtttatcaattttactcatagaatcgtatcctcctgatattttttaaaaatttccacgaatacagtatagtacattattgattttcttgcaatgaaatcataaaaaggaaaaaggcattatgccaagcgccgcacaacgaaaaagagacgcgatcgcgtctcttttttactgttacgctttttttacgcccagcgtcaccttttccccgttgatgttccattccttttcgtatcctgaggagcttccatagtgcacgccgagtgcgagcacttcctttaggatctggtcctcattgttttgcataatatcggtgatcgtctcattatcctttgcaaaaagctcgatcttatccgtcacttcaaaacccgcttccttgcgcatggtctggatcttgctgatcagctcgcgcacgttgccctcttcgatcagctccggcgttagagtcgtgtcgatgatcaccgcgaaatcaccgctcgtttccgcaacaaagccttcgcgctgtgcgggctcgatgaggatatcttcttccatgagtgagacaggcatgttatccaccttaaattcgtaggccttgcccgcacgtaccgtacttacaacaagcatgccgtccgcctgcgcaaggtgcgtgcggataccgtttagaagcttgccgtatttcggccctaaggtacgcatctgcggctttaggttgtacgtgatatattcttcagcagcagcgccaagctccacttccttgacgttgagctccccgcggatgacatcgaggaacgtttctgcgagatggtcgataccgctcacatagatcttgccgatgggctggcggtttttgatgttcgcagtgttgcggcatgcgcgtcctaaatttacgacgctttgcaccgcgtccatgccgcgctcgagttgtgcgtccaccattgccatgtccgcttccggccacctgcacaggtgcacggactgcggcgcgtttttatcgttcgtgcgcacgaggttctggtaaatgctttccgtcatgaacggcgtaaacggcgcaagcagccttgctatcgtttcgagcactgtataaagcgtcataaacgcatcgattttatcctgccccatcccgcttccccagaaacggtcgcggcagcggcgcacataccagttggaaagctcgtctacgaatttattaagctcgcgcgacggctccacgatacggtaattgtcaagatcttccgttactgccttcaccagggaattaagacgcgacagcacccatttatccatgatgttggtgggcttgagctcatatttcgtcgggtcgaagctgtcgatatccgcatacaggatataaaatgcatatgtattccacagagtgcccatgaatttgcgctgcatctcgctcaccgcttcgtcgtaaaagcgcgaaggcagccacggcgcgctcgccgaatagaaataccaccgtaccgcgtccgcgccctgcttatcaagaacgctccacgggtcgacgacgtttcctttgtgcttactcattttctgcccgtccttatcctgcacgtgtccgagcacgatacagttttcaaacggagccttgtcaaaaatcagcgtaccgatcgcaagcagggtatagaaccaaccgcgcgtctggtcgaccgcttcgctgatgaagtttgcagggaagtggctttcgaactgctccttgttttcaaagggatagtgccactgcgcaaacggcatggagccactgtcgtaccagcagtcgatgacctcgggcacgcggtgcatactgcccccgcacgcgggacattttaatgtgatcggatcgaggaaaggcttatgaagctcgatatcctcgcctacatcctgctccgccatttcgcgcagttcggcccgcgagccgaccacgtggatttccccgcagtcgcacacccacaccggaagaggcgtaccccagtaacgctcgcgggagattccccagtcgatgacgttttcaagaaagttgcccatgcgtccgtcgcggatgttttcaggcagccagttgacgccggcgttatttttcaaaagattgtccttaagctcggtcatcttgatgaaccatgtgctgcgcgcgtaatagataagcggtgtatcacaccgccagcagaacggatagctgtgctcgtaaggcaattccgcaaacagcaggccgcgcccccttaaatcttcgatgatcagcttgtccgcttttttcacgaatacgcccggccacttggtctcctcgctcattgtgccgtccggcttcacaagctgcacgaacggcaggccgtatttccgcccgacgttcgcgtcgtcctcgccgaacgcgggtgcgatgtgtacgatgccgctgccgtccgtcagggtaacgtacgtgtcgcacgtgatataccatgcttttttgtctgtttccacaaaatcaaaaagcggttcatattccttgtattccagttccttgcccgtaaatttgctgacgatgtgcgcgtcctcgcccaaaagtttctcgcaaagagcctttgcaaggtaatactggtcgccgtttttatcctgtgcgagcacgtattcctcattcggattcacgcacaacgcgacgttcgagggcagcgtccacggcgtcgttgtccacgcgaggaaataagcgtcctcgcccttgaccttgaagcgcacgaagatagacgtttccttcacgtccttatagccctgcgccacctcatgtgaggaaagcgccgtgccgcagcgcgggcaatagggcacgatcttgtgccccttatataacaatcctttgtctgcaatctcttttaaggaccaccacacagattcgatgtagttattgtcataggtgatgtaggggtcttccatatccgcccagtaacctacgcggtcggacatcttttcccactcgcccttgtatttccacacggattccttgcatttctggatgaacggctccacgccgtattcctcgatctgctcttttccgtcgagaccgagcattttttccacctcgagctccacaggtagcccgtgcgtgtcccagcccgccttgcgcagcacgttatagccctgcatagtcttatagcgcgggatcaggtccttgatacagcgcgtgaggatatgcccgatgtgcggcttgccgtttgccgtcggcggcccgtcgtagaaggtaaactccggttttcctttgttttccttcatgctcttttcaaagattttgttctcgtgccagaagtcaaggacttccagctcgcgttcgccaaacttcagatcggttgaaacttttttatacataatcaaacctcacaaataataatcaaataaaaaagcctccatcctatatcaggacgaaagctcgcggtaccacctgaattccccacgcacaaattgtgctatagggcactcatttccgctgtaacgcgcggaacgcgcaagaccttttgaacgcgtgataatccaaaaaagcgttgccgcggggctcccaccctctcccgctcgctctgtgggccacttttaaagacgtttgtcggttcagcctcgaaacgatattttaaagtcttccttattatatggcattgggaatgctttgtaaagggggaactgcaagaacaaaggcatccggcagcctatttttccaacctgcgggcaatttccagcctcaactcgtggttgccccaggaaagcagcttttccctgatctcataagtaataccgcggagatcacagccattgtggattacaaattggtcgtggtttagcttgcgttctgtgcatccggggcatggagattcctgtccgcgcagcgcgcggtagcatttctggtttttatattcatttgccttccagccatattcttcacacaatgtctggttgcagtaaagcaagctgtaatccttttggttgataatataaatcaggccttccatttcatcgagaagggttgaatcaatattaaaatatatatggttatccggttcgtcgccgctgtagacagcatatgtattttttccggccccctttgcctggtaaagcgcaatgtcggccatctggtaaagtttcatgagatcggtttcatcaatttgagcacgcccctcctcatgcaaagttgccagcacattgtgtataaatacaatacctgccgatgtggtgacaggagctttctcatccccctccattccgctaagctgttcaaggaaactttccacacgattgcagatatcgctttcataaggcatatccgtaataatgagagcaaattcatctccgccaaagcgtccggccacgatgttttcgccgaatgcatcgcgcatggtccgcccgatttgccgtaaaatcttatcgccgtggatatggcccaaagtgtcgttcacctgcttgaagttatccacatcgagtaaaaccatagcggttaccgtgcagttatccttaagcacgtccaaaacggcgagcgtttttgcctcaaaggttttgcggttataaaggcccgtcagggaatcccgctgggagtctttcaaaagcaggttatactgacgctccttttctttctcattctggatattttccgaaatgccgagcatacgcacgggtttcccgtccttttgctggatcactgtgcatgtcaggcggaaccaacggtatttttcatccttgcataaggccatcatttcacacacgctttgctgggcgccttcttcgatttcacggatcgcgcggcggacgtcgtctgcggtctgcgggtggatccatccgcactcgataaggcattccggcgcccctggtattttttccgcaccttttacccacgtatcctccggatcaaagcgtataattgttttggaagggatatcgtattcccagatatccgcatgcgtaagctgcattgcgatccgaaagcggttatccgaaagccgcagcatctcttcggcctgctgctgttcggagaggtcaatgcatacgctgatgatagcaagccgcccgtcctcggcctccacgacgcgccctttatcaagtgtccagaacgaactcccgtcctttttgagcgtgcggtattttacaatgtattcctggccctcgtagtattcgtttccaagctcgcgtgccacgcgcggcaagtcttcagggtatatggtattccctataaaaccgcccgtatgttcaagaaaatcctcgtgggactcgtaacccatcagtttgagcattttttcattgataaagtaaagggggaaattatcttcgcagtagcccccgaccaacccgcaaagcgccatatcgttcaggagggagatcgcggtcgtctggttttccgcctttaggtcggaaagctgcttctccccttggcgcagccggttttcaagttcatgctcgcgcgtaatatcttcgagtacgccaaacgcctttattggagcgccgaactggtcgaagatggtcgtcatggacgcgcgcttccagcagtaggaaccatcttttaagcggacgcacgcttcctgcgtagaaacgggattcccattgatcacatcataaaaaaagtcatgcaaacgctgctcgtgctcgggagccacaagacccgcttcaatcatgcattccggtacgcgggctgcatatttctccgagccgtaaagcgtttgtttgttttcgccgaaggatacgctccttttttcaacgtcgaacatgaacgggagccggtttgtggaaaccattgccgtacggtacaattcctccgactgccgcagttgcgcttcagcttcctttcgttccgtgatatcgttgatagacgcataatagatttcccgaccattgttttcagacagaaaaaacaggcgcatatgcatccacatcaggtctccgcatagcctgcggcggcggaactggatatctacgacctgcgtggggtcttcttttgcccgcttcagcgcggaacgtacgatgggcttatcttccttggggacgcggtctaagatgtgacgtcctttgatacgcagcatctccggattgcaaccggtaatgccgtaatatccatcgtttacacggataatggaaaggttgtcgttatagtattgatagagcgccacgccgccgatgatattatttaggagtttttttgacatcatccccgattggaacaggtcctcaaaggtcggctcccgcatatcgggaggcacgattccgttatgatcaacgttatctttctgcagcagcagcgcctcgaattttttgctgggcatgggacggtaaaaataataaccttgcgcgtaacggcagtttgcgcttgaaaggaaatcggcttgttctgccgtttctacgccttccgcaatgacgctcagcttcagccacttcgccatgcggatcacggattcgagaatgttttcgcttctgtggcttccctcgtcgaaccgttccaaaaagcgcaggtcgattttgagaatatctacattgatatccttgagcatgttaagcgaggaatatccgctcccgaaatcatccatcaggatcgtaaagcccaccgcccgaagcttattgatgacgtcaagtatttgttcaaggctatccgtgtacgcgctttccgtgatctccaattcaagaaggtgcgggtcgatccggtatttttttataagatcgatcaaaaagtcataaaatccggagccgtaaaggcttttgcgggatacgttcacggagataggaatagccgtatggcccgcatctatccaactgcgcagcagccggcatacctcttcccatacatatgcatccagcttcatgataaacccgcttttttcaaaggagggaataaaggcgtcaggagaaagcatccctttttcgggacgcacccagcgcacaagcgcttccgcaccaacgattttcccgcttacgatatcgcatttcggctggatgtagatttggaattcctttcgttgaagcgcctgctccgccgtattgaaaatatcctgttcctgcatgatggaacgcatcaagccggtatggtatactgccgtgtgcactaggtaattgcctttgacagatttgctggcaaggatcgcacggtcgcacatctggctcacgggaaaagtccgcccgctcacatggtagataccgatcgccggtatgatctccattttgagcggatactccttcagccaaccgagcacattattttcaatgtcctgcgtaagatttggtccggcaataacgcatgcggcgaatacgtccgccatgatacggccggctgtttccgctttttcggcggtcgtttccctgatccttgcacccaggtaagcaaggagcttatcgccttccgcgctgccgtgcaggtcgttgatgagtttgaaccgctcgatatcgatgcacacaaaagcatactcccgggacggattttctcttaagaccttttccgctttggcgtagaaagtttccttgttgtaaagtccggtcagggaatcgtattcctgatattcttttatctctttcctcagagcttcgatcgtctggagcaaatctttttcagacctgccttcaagtgatttcaaaacaatgcctccaaaacgttattcacatgctgtatgggctaaaattgagcacaatcttattgtggtaacatttttatatgattggttaaatgaataacaataccaaactttactggtatctatttttataataggtaatttaggcaaaaaaatcaacggcgcatctattcgttttttttctcttttccggtaaaccgccggtattcgtgcaccttctgttcatatccctgcatggacggacggtagaaaacagaatttttcagttcgtccggcaagtattgctgctctacataatgcctggggtattcgtgcacgtatttataatccttgccctttttttcgtgctttgccttttcaaagttggtatcctgcaaatgtgcgggaacatcttgcctggacgcttcgcgcgccgcccgtgccgcgctgtccaccgccaaaagaacgctgttgcttttgggtgattcacatagatagatgatcgcttgcgcgatattgaggcgcgcttcgggcatgccgttgaaatcgagcgcctgcatggccgccacgcattgattgagcacgctggggtttgcaaggccgacatcctcagatgcatgcgcgatcatgcggcgtacggggacgcgcggatcgacccccgcatagatcatacgcgcgaaccagaaaagcgccgcgtcgctgtcactgccgcgtaaggatttgcagaaagcggacagcatatcgtaatattcgttatcgtccatgcgcaccgcgcgctgctggatggattgctccgcaatctccagcgtgatatggatccggccctttttatccggcttggtcgtgaggactgcaagctccagtgcgttaagcgcgctgcggatatcgccgttggaaacggacgcccagtgcatggcagcgtcatcgtccaaagtaatatccatatttccaaagccgcgctctttatcctctgtcgcgcggtaaatcgcctttttgacgtcctctacggtaagcgcgtaaaattcaaacaaacggcagcgcgaaacaatagcgctcgtcattgccgccatcggattttccgtggtggaaccgatcagcttgatgatcccgctttccatggcgggaaggacgctgtccgactgggatttggaccacctgtggcactcgtccaaaagcaaaaagctttcccgcccatacatcttcaaattggcttctgcctggtctatcacctcgcgtacgtccttgacgccgcttgttaccgcgttcaatttgtaaaaatcactgcccgtcgtttgcgcgatgatagcagcgagcgtgctttttccgcacccgggcgggccccagaagatacacgaaccgagcttatccgcctcgatggcgcggcgaagaagcgtgctcttgccaacgatatgctcctgtcccaaaaattcgtccaaagtcctgggacgcatacggtctgcaagcggcgcgcttttttctaaattgccgctggcggagaataaatcagtcatatgctattcctttccctaatgcaatcgctgccttgctgcgttcgtcagaaacaaccgctccatattattatataccatttcatctccgaattcagtctgttttggcgaatttttaatgtgacggctccggcgcggggaatatgattgaaaatcctcggttcccgtattataatggtatttgtattcttatacggtttttaggaggatttaagatggaaagagtgtacaacttctcggcgggtcctgcgtgcctgccattagaagtgctcgaaaaggcgcagaaggagtttatttcgtatgacgggacaggcatgaacgtgatggaaatgagccaccgttccaaggaatatcaggatattatcgacacagcggaagcggatttccgcgagctgctcaatattcctgacaattacgacgtgctgtttttgcagggcggcgcatccatgcagtttgccatggtgcccttaaacctgatgaccaagtacaaaaaagtgcatgcggtcaatacgggtatgtggtccaaaaaggcgatcgcggaagcgaagaaattcggagaggtcaatatcgtcgcttcgtccgaggataaaacgttttcgtatattccggagctttccgcttcgatgtttacgccggatgtggactatgtccatataacgtcgaacaacacgatctatggaacgaaatataataaggttccggatgtaggcacgctgccgctggtttccgatatgtcctcctgtattctttccgaggaaatcaatgttgcggactacggcctgatctatgcgggcgcgcagaaaaacatcgggcctgccggcgtgacgatcgtcgttgtacgcaaggatttggtggaaaatgcgccggaagatatcccgacgatgctcaaatataagacgcatgcagacaacggttccatgttcaataccccgccgacctacgcgatctatattgcgggactggtattcaagcacttaaagaagctgggcggcgtacaggagatggagaagatcaataaggaaaaagccgcaatgctgtatgactttttggacaattcgaccatgtttaacgctacggtggagccaaaataccgctcgatcatgaatgtgccgtttgtaacaggcgatgacgagctggataaaaagtttgtagcggaatcgaaaaaagcggggcttgtcaacttaaaaggccaccgcagcgtaggcggtatgcgcgcaagcatttacaatgcgatgccggaagacggcgtacgctcgcttattgcattcatggctgaatttgaagcgcacaacagataaggagcagacaatgtataatatcaaaaagctgaataaaatatcgcccgtagtttacgattatctttccaaggataattacaacgttacgtcccatctggaagacgacgaaagcgaagcgttcctcgtgcgcagcgcggattgccacgggatggagttttcggacaatacgctcgcgatcgcacgtgcgggcgcaggtacgaacaatattcccatcgacaaatgtacggagcaggggatcgttgtgttcaatacgccgggcgcaaatgccaacggggtaaaagagctcgtcctcggatgcatgatcgccgcatcgcgcaaccttccggaagcgtgcgactgggcaaagaccttaaaaggcaggggggatgaagtcccaaaacttgtggaacagggcaaaagccagtttgtgggcggagagctcaaaggcaagacattaggcgtgatcggccttggagccatcggcatcatggtggcaaacgcggcatccgcgatcggcatgaacgtcatcggctacgatccgttcttatcggtggataaggcgtggaccatttccatgtatacgcacaaggcggaaaagctggacgaactgctggaaaaatcggatttcatcaccatccatatcccgcagacggataagacaaagggatttttgagcacgccggagttttccaagatgaaggacggcgtgatcgtgctgaattttgcgcgcggcggccttgtcaagacgacgtccatgtttgacgcgatcgaaagcggcaaagtgaaaaaatatgtgacggattttccggacgacagcctgatcggtcatccgagcgtgcttgtgaccccgcatcttggggcttccacgccggagagcgaggagaactgcgcagtgatggcggcacagcaattgaaggatttcctggaaacggggtccatccataattccgtcaacatgccggaatgtgtcgtcccgccgtccgatacggtgcggcttacgatcctgcacaagaacacgccgaatatggtggggcagatcacgaacaagatcgcgggctataatttgaacattgcggatatggcgaacaaatcccgcggggagatcgcctacacggtgctcaacttggatcacgacgttacgccggaagcagaggcggagctggcggagatcgaaggggtaatcaaggtccgcgtgatttgacggagcggctgttatgaatgaaaaaaaatggggcattacgctgatcgtcacgagcgcggtgctcatcacggcaatttcgctcctgttttttacgctgaaagcgccggatatgagcgaaggcgtaaagtgggcgttccgtatctttgcgattgcggcatgcgcggcgcagtttattgtgttcgtgatgtttgcaaaagcgtataagaaaaataaaaagtggtaaaaccacagcatgaccagtttgcaaaaacgtcgcggccgctatcgccgcggcgttttttatatatgcatcgcagcttattttgttttttcaagggatcgcgccgcacgaataaaataaggcagctttttgaaatcttattttataatatcggcggtttgcgcgtggatcagggatagcaggtcatggggcgcgagctccacttgcaggccgatctttcctgcgctcaccaatatggacgggatatccatacacgacaggtggaccacggtgcgaaactgttttttcatgcccacgggggagcacccgccccgaatgtaacctgtcacacggtttaaatctttcacatggatcatttccacattcttctcgccaacggcgcgcgccgcttttttgagatcgagttcttccgctacgggcaccacaaacacaaagtattcgcggtccaagccttgcgtcaccagcgttttaaaaacctgctgtgcgggaatgccgagcttttgcgcgacggaaacgccgtcgatcacaccgtccttgctctcgtaggaatgtgtttggtattcgatatgcgcgctttctaagatgcgcatggcatttgtcttggattgtgccatcgtccttctcctgctgttttttaattattatatgcaattgcagtccgaaaaacaactgcgggaaaagcaaaaaccgcacatttatcatgcgcggtctttgcaggggagttttatgtttagatgaagaagattgctattttgatgtcttgcgctgcacgttgttgtgggcctttgtttccgcttcgtgtaccttgttcgaagccttgcctacagtctcttttgttttgtctttggccttttcaaaggtttcgcctactttttttcctgctttctcaaaagcttctccaaccttttttcctgctttttcagccgtgttcatttttattcacctcttattacttactttattcatatcatataaattttacctaggttgttgtgctattaagatacactgtttgaaaaaaagcaaacattaaaattaaagatgaatttctgattgtttttcgctataatagttgtgggaagggaatattacatcggagggatatgatggaaaaattaccacaaggaaagacaaagcacaatattctcttgttctggctgatgggcgcatttgtcgtttatgcgatctacgtcgtattgtttggaacactctcaacgaccatgatggatttttacaccatcaacacgggcgcgcagggagtattcaccatggtaagcagtatcggcggaatcgcggccgcgctgttctgtgcgctggcgggagagcggttctccaagctgtgggcgattatgatcggtacgctcctgttgggagcggcaacactcggcattggccttgccccgccgtatttgctggtatgcctgttctcgctgttgtgcggagtaggatatacggtgatcgatgtgatgggaaattcggccatcacggaatattttccaaaccgtacaaaaacgctgctgcctatggtgcagatcatttttgggatcggtacgatggtcgggccgtttttggcgacaagtcttttgataccgaatgcttcacattcctttgcgtacccgtttttattggtgggcggcctaagcgttatcatcgtgattttttattcgatctttttaaaacgtgctacgccttctctgccaaaggtggatttaaaaggcatggcggcatcggcaaggcaaaatcctggtgaaatttttcgttcgtggaaatcgtggattattttgctcgcctgcagcctgttctgtgcgtttaatatgacgatcgtcgcttggtatccaacgtttttcagcctttacaggggaatggatacagagggcgcggcgctcatgcttacgcttttttatgtggggatactcgtgatgcgcatcatcagcccgcttatttttaaaaagatacagccgcaaaaggtattcgtatttttcagtttgattagtattgcgctcatgctggtggcgatcaatacgccgtctatacccatggccatggtgttcactgtccttggcggcgcatttcagtccctaaacatcgtatgcgtgatcatgatcgcgacagagctgtttccgtcgcgtaaagcttcagccagttcgctggcggtgttttccaataacatcggaggcatgatcgcgccggctttggtggggctcgcggcagagacgatgggtctgcagctaccgctcagtattttatgcggggtctttgcctgcggcgtggctgtgatggctgtactgagcaagaagtgcaaaacggaactgcaaaacatttgattttgcatcgcgtgtaatgacagcggcaagtattcagacaacagacgcgctgcgcgcctcgcgtaaacacttgaccgcagccatggatgaaaaacaatataaaataaaaagcgcggaggacattttgcccttcgcgctttgtttgttttggcgttattcgaatacaacgatcgcatcctgccgcttgatacgcgggaggacggtctcgagtacgcgcatatggtggttgaggtcaaccagttccaaatatgcagtcgtcatatcaataccgaccacaaggtccatatattgcggttcgcagcagacgagaactgcttttttcgctcccagtaccggcgcgcggaatatgcggccgtccaccatcctgccaacgcggtcgatttccatcaaacctgtgcccggctggatacgctgcaaatcgagatacaagtcggggctcaagatgagcgcatatcttccgatataccctttttcatccagagcgctgatacccttggcaatgtccgcgaaggcgttttcgcccgcagaccaatcgccgcgtttgattttgtttgcgcccggcgcgttcaaaaggccgcttactccaagggtttgattgccaaagaaaataagcttgtcttcacggcgcgagagggattccgctgctgccattgccgaggtaacgtccaccggataaccggatttgtcgctggcctcgatgtccctccacagcatgaagaaatcgtcatagacctgcggaatctccgcatattggcggcccctggtcgtaacgataccgtcttcagacgcttccgctttcttttcgctgtcgatattgatgccctgcgcacccgcgccaagcggtccgaaaatcgtcaggaaccggcggcctacgagaatcctgcgcgcagaatctacaactgcttcgtcaattttgttccataagtcgtcagaaaacggcgcgctttctcttgatagataatccataccattttcctccttacttccacaagctgccaacagtagtgccgggggcagcctgttcgtcctgatcggggtttagccccagttcttccatcatctcgcgtacttcctggacgcccgaagcaaagtgctcggcttcctgcggatcgaggtggcgcaaaagcgtcatcaactccccgatatgggctttttcttcgtcgcggacgtccgcgagcacggttttggcaacctcgtcgtccgttgcgtgaacatgtgcgtcatataaataaatcgcttccagttctcccgcaatgtcaaggcgaattgcctggatcaattcgtctttggttaattttctttcaacatttcctgcaaaaggatctccaaaacttggcataacaatcaactccttattttttaatgttcttgaaggtgttaataaacacaagtttttgaaagcaaacaactattcctgatttttgacgcgtatctttgggaggaccagactaattaccatgcagataaaacccgccgccgccgtgatgatccagccgactgtccaactggtcatgcccgcaatatacggaaccaggatgggggacaaaataccgccgattcccgcgacgaggatcaccacaccgttggccgcgcctgctgcctcgctgccaaaaatatctgagggaagcgagagaatggggctgttcgcggcagggcagccccatccggaaatcagggcggtcaaaatggcaagtccgatgtttatgggtgccagaaggggaatgagcaggcagccgattgcgccgacaagcgcgcctgaaaaggcaattgcgtaggcgcgtgcacgaacgacattgcctgtttttttgatgagccggtccgaaaggaaaccgccaaacggtgtggatgcaacggcaaccagcccgttaaataaaacgatcaggccggtctgtacgaccgaatatccgagcgtctgcatatagctggcgagataagcatacagtccgtatacgttaaaaaagacgaacagcagggacaaggcaaacaaccataatgccggttgtttgtagatattgccacggaaggcatgtccggcaggagaagcgtccggcttgtcctgttttgggggatccttgactatgagtaagaatacggccatgccaatgaccgtaacgaccgctaaaataagaaaaatattctgccatgagaaaaggtcggtcagcgctccggtcacgaagccgccaagggccgttccgaggccgatgcagccgagcaatacgcctaccgcaagaccgcgctgggagagggggaaccagttgctgacaataaaagtcgtaatattaacgataagtccaaaccccatcaaaaaacgcaagaaaacgataacgggataacttgttacgaaaggaatcaggagcgagccggccaaaaaaaggcacatcgcgaaaagaaaggtttttctccagccccagcgcaaaaggagcctgccttccacaaaactgccgacagcgtaccccgcgatcagcgcggcattccctagttgtatcatgatatcgttcaattgaaaagtctcggatagggatggaattgcaagtccccacgaggaaagcgacatatatgcgatcgtcaatacgaaactgcacccaaaaagcgcaagaaatttcttgccggaaattcgattcatttgttctcctccttaacggtaaaagaggagattatctgcacaacaaaatggaatactttttaaacggcgtacaccttcacgccgcaactctcgattttttctttttgctctgtcgtgatcttgctgtctgtgatcaagatatcgatatcgctgatcggagcatattgaagataccaggatttatcgattttggaagaatccgcaagcaggatgatctggtcgctgacagacatcagcgtccgccgtacagcgacctcgaaattctcggcgcaggaaatcccgtaggtggaacttacgccgaccgcgcccaaaaacagcttgttaaaatgcgcctttttgatcgtttccagtacatccggactttcaaacatcttgaggtcgttgtggtaaagtccgccaaaacagaataaacggatgttattggaagcaagcgctaccgccttggataacacttccatggaataagtataaagaatacaatctgaacttttcataaaatccaggatataacggcaggtcgtcccgttatcgatgcagattgcgtcaaacggttctataaaagaggcggcgaattcgccgatccttttcttttcagcaagacgctcacgatcctcgcggttaaaaagatacggtgtgtttttcaagctgacggacgtaatgttttggttcttattaagggaaacgccaccgtgaaagacagaaacataattattgtcttccaaaaaactgatatcacgccggacagtcatttcggatacgttaagagcctgcgcgaggttcttgatggaatctgagcccgctaaatttaagatattcagtatttcctgtatacgtgcctgtttgtttgccaagtcagatcgccccactcgtgaaaaattaagggaattatataacatttctgtaattatataatacagtttgcgaatattgattgtcaagcacataataaaattaatgttaatttaagttaaattaacaaaatataacacaatggaataatgattataaaataaacggattaccataaaagtaaaaaaaatccatttgaaacatacaaaataaataaaataggcaaaaaaagaaaggcatgcaaatcaagctgaaacaaaggaaaagcggttaaataaagcgaaaaaaatataaagagcatgcttctggaaataaaaaacgaatgaaataaattccatatttcaaaaaaacgaaaaattaatttcacacaaaaggcattgacatcaacaaaaatattttgttaaaataagttaaaacaacaaactaacaaaacaattgacactctgctaacaccacaaacaagtttatttcgaaaaagcgaacgcaatatttcactgaatcattgattttgcctcatcctttataagaagcttccgggatgaggcgatgatccgattaaatattctgatccgttttttcggaataattataaaaatatatagaaggagaaaagtatgaaaaaattattggtaattcttttggtatgcgtcatggcagtggggatgttcgcatgtacgggaagtccggccgcgccaagtacggcagcgggagacggagatgcgcaggtaacgcaggcgggcggcgacggcggtacagttgccgctgcgggcaaagacctgactttcgttatcgttccgaaggttgtgcatgagtggtttgacgcggtgaactcgggcgcgcagcagcaggctgaagtgatgagccagcagctcggaatcaatgtgcaggtagattaccgcgcgccatctacggcggatatcacggcacaaaacacagtgctggaacaggctgcggctaccaaccctgacggcattgcgattgacccgatcgactatgaaggaagcaaacaggtcatcgaagagatccaggcaaaagggattccggttattctgtttgacgcacgtgtaccgggttccggattgacggcaatcggcaacgattttgcagagcaggctactttggaagcggaacgtcttgcggaattgcttggcgaaaagggtaaggttgcccttatgcacggcgtaacaacagctccgaaccattccgagcgttacgagacgttcaaagaagtacttgcgaagtacccgggaatcgaagtgattgacggcggcatctctcaggataacatcgaaaccgcacagcagcaggctgcggcgaccatcgctgcaaatcctgaccttgcaggttacttgtgcgtagacgctgctgcaccgatcggcatttcggcagcgatcgaagaagcgggaaaacaggatcagattacattcgtaggcgcagagaatcttctgcagatcctcgaatatgtaaagagcggcacgatggttgaatcttactccacgaaaccgcagatgcagggcgcgctttccatcctcatgctgttcgacgcgcatatgggcatggagcttccgcagttcgttgatacaggcatcctgcacatcacgaaagacaacgtagatgaaatgatcgagattgcaaaggcaggttccacggcagaataagataaagatatattggttccaaagcacttagaaagggtttggcggggggggggggggggcgccccccccgcgccgcagggcgcgtcggacaccaatgcggaaggaaagatcgcgttgtcggtcgatcattttgtggcggtcaagggcgacggtagggtgagcgctgtcggttcgaataaggacggacaatgcgccgtcggttggtggacggacatctgtcaggtagcagtaggcgcatggcatacggtcggattgaaaaaggatggtacggtcgtggcaacgggaagaaacagtttcggacagtgcgatgtggaggactggaagaacgtcaagcagattgtagcggcaggggatattacggcggccttgatggaggacggtacggttgttgccacaaactatgtaggggatgcaggtaactgggaaagcgttttaggctggcgggacatggaatctattgctctcagcgcaagtgatggagtcatcattgggctaaaaaaagacgggacagtcgagatggcgggtccggcagacgatccgcgtatggaggcgtgcgattgggaaaatattgcaaaggtatatggaagtaccaataatgttgcggggataaagaaaaatgggataccggaagcggcgggatataatttttggggagaatgtaatgtgattgggtggacggatatcgtttcgctcagcgtaggcggagactggacgatcggcgtaaaaaaggacggtacagtcgtacgcacacaggacgaggaaggcgaccggtataacattgatgtatcccaatgggatcacattgtgtatgtggtgcagaccgataatatcgcgatcgggttgaaaaaggacggtacgcttcttatcgcaggggaacaggatgacgatatcggcaacgacgccattttactggcaaaggattgggacggcatctgcggatggacgatgtaaacagaataaggtcagggtaccctccgcacgaagcggagggctgttttttgatttaaaaacaattcacaaaaagtttttcgaaaaaaccatatctatatattgcctaatgacatgaaatcatatacaataaaaccgtgtgttaattatttaacaatataccgcaggttttgcggaaaaacaggaggagtaacacgtggatcttgaaatgaaacaaaagcttgatacgatccttaccgagcacaacaaacagtcggagatcattccgatcctgcaggatatccagaaggattaccgttacctgcccaaagaagcgctttcgtatgttgcgaaggcgctgaatgtcggcgaagcaaaggtttattccatcgccactttctatgagaacttttcattggagcccaagggcaaatacgtgatcaagatctgcgacggcacggcatgccatgtgcgcaagtccataccgatcctggatgcgctccgcaaaaaactgcatttatcagataaaaagaagacgacggaagacatgatgtatacggtggagacggtctcgtgcctcggtgcgtgcggtttagcaccggtgctgaccgttaacgacaaggtatatccggccatgacgccagaatcggcgtgtgacttgctggatacgctgaaataaaccgctttaggggagaatataacggtatgatacaaaatgtgacagaactgaatcaaacgaaagagcaatataaaaaatcgcttgatgcacagtataaaaaggtgctggtatgcgcgggcacgggctgtgtggcgggcggatcgctggaaatttatgaacgtcttaaagagcttgcggaagaaaaggggctgccggtatcggtccagctcaaggcggagcctcacaaggagatcgcttttaaaaaaagcggttgccacggcttttgcgaaatggggccgctgctgcgtatcgagccgcatggttggctgtatgtcaaagtaaaaccggaggattgtgaagaaatcctcgaaaagagcattgtgggcagcgagccggtggagcgtttactgttcacgcaggacggcaaggcgtacgcggcgcaggaggatattcccttttacagcaagcagacgcgtatggtgctctcaaactgtgggcatacggacacggaatccctgatggaatacatcgcgcgcggcggctatgaggctgtcgcaaaggctcttttcgatatgcagcccgaaggcatcgtacaggagattttgaactgcgggctccgcgggcgcgggggcggcggctttccgacgggaaggaagctacagcaggtggcacggcaggctgaacctgtaaaatacgtggtgtgcaacggcgacgagggcgatcctggcgcgttcatggacaggagcatcatggaaggcgattcgcaccgcatgatcgaaggtatgatgatcgcgggcatcgcgacgggtgcgcacgaaggttatatctatgtacgcgcggagtatccgcttgcggtcaaacgcctgcaaacggcgatcgccgccgcgcgtgaacaagggctgctgggggagaatatccttgggagcgggttcgcgtttgaccttaaaatcaaccagggcgcgggcgcgttcgtgtgcggtgaaggcagcgcgctgacggcttctatcgaaggaaatcggggtatgccgagggtaaaacccccgcgcacggtagagcaggggctttttggtaagcctactgtgctttccaacgtggaaacgtacgcgaacatcccgatggtcatcctcaatggctcgggatggtaccgcaagatgggtacggaaaaaagtccgggtacaaaggcgttcgcccttacgggaaacgtcaataacacagggctcatcgaagtaccgatgggcacgacgctgcgggagatcatctttgacatcggcggcggcgtgaaaaacggcaaggagtttaaggcggtacagatcggcgggccttcgggcggctgcctcacaaaggaacaccttgatttgccgctggattttgattcgctcaaaaaagtgggggcgatgatcggctcgggcggccttgtggtgatggacgaggatacctgtatggttgaagtggcgcgtttctttatgaacttcacgcaaaatgagtcgtgcggaaaatgcgtaccgtgccgcgagggcacgctgcgtatgttagagatattggaacgtattgtcgcgggcaagggcgagaaggaagacctcgatatgctgcgcgagctggcggacacgatatccaaaaccgcgttgtgcggccttgggaaaacggcgccctcgccggtgatcagcacgctcaaatattttgaagatgaatatttggcacatgttgtggataaaaaatgtccggcgaagaactgccaggcgatgaagcaattcgtgatcgtgcgtgagcagtgcaagggatgcagcaaatgcgcgcgccagtgtcctgtaggagcgatcagcggagagatcaagcatccctatacgattgaccaggcaaagtgtattaaatgcggcgcatgcgtagacgcttgcagttttggcgctgttgtcgagcagttttaacggaggattattatgactgataaaaagcatatgattatagatggacagatcgtcaattacgacaatgaaaagaacattttagcggtcatccgcaaggcaggcatcgaactgcctacgttctgttattattccgacctgtccatttacggcgcgtgccgtatgtgcgtggtggaggatgaatggggcggtatcatcgcctcgtgctccacgccgccgcgtgataaaatgaagatcaagacgaatacgccgcaattgcaccgccaccgcaagatgattttggaactgcttttggcaagtcactgccgcgactgcacgacgtgccccaaaaacgggaaatgccgtttgcaggagctcgcgcttcgctttggtatcgacagcgtgcgctttgaaaatacgaagaaggaagcacaggtagacgattcggcgctgtctatcatccgcgacgaatccaaatgtatcctttgcggcgactgtgtgcgcatgtgctctgagatacagaacgtgggagcgatcgacttcgcgcaccgcggctccaacatgacggtatcgaccgcatggggaaagccgcttgcggaaaccaactgcgtcaactgcggacagtgcgcgtcggtatgtccgacgggcgcgatcgtcatccgcaactgtacccagaaattctgggatgcgctatacgacgacagcaagcgtgtggtggtgcagtttgcgcctgcggtacgcgtcgcgctgggcgacgaattcggattggagccgggcaccaacgttgccggtaagatcgtgggcgcgctcaggaagatgggtgtggacgaagtatacgatacgacgatgggcgcagacctcacggtcatggaggaatccaaggagtttttgaaaaagtataaagaaggggcgcagatgccgctgtttacatcctgctgtcccgcgtgggtcaaatacgcggaaaatacccaccccgagctgatggggcaggtttcaacatgcaaatcccccatgcagatattctcggctgtgatcaaggaacattttgagcaggtgagggaggtggacggcaaggagacggtggtgttcgccatcatgccgtgtaccgccaaaaaagacgaacaggtgcggccggagtttatccacaaggacggttcgcgcgatacggacggcgtcatcacgacgcaggagttcgccagcatcttaaagcaggcgggcatcgtgtttgaagatatcgagccggaagcggcggacatgccgtttggtatcacctccggcgcgggcgtgatcttcggcgttacgggcggtgtcgcagaggcggtcatccgccgggtggtggatgacaagagtaacaatatgctgcacaacatcgcttatacgggtgtacgcgggcttgacggtacaaaagaggcgaatatcccgcttggggaagaaaaacgtgtgaagatcgcggtggtgaacggccttgccaatgcggaaaagttgattcaaaagattgaaagcggcgaagcgcaatacgattttgtagaagtcatggcatgtccgggcggctgcattgcgggcgcgggacagccgtttgcacgcaaggaaggaaaagaggaacgctcgaagggcttatacgacgcggacaagctgtgccaggtcaagcgttcggaagaaaatccggtgatgatgtcgctttacagtgggattttgaaaaataaggtgcacgaattgctgcacgtacattacacaaaaggggagggaacagaattatgatgacgatcagcgtatgtatcggaagcgcatgccacctgaaagggagctacaacgtggtgagcgagctgcaggagatgatcgaggaaaagggactgggagacaaggtggagcttacgggcgtattttgcctcgggcactgcacggacgcggtgtccgtacaggtcggcgaagaaattttctccgtcaatacaagcaacgtcggcgactttttcagggatcaggtgcttgcaaaggtgtgacgcggcgcttcctataagcatttttaccgcagtcttagatggctattcgcgtcccgagcctgcgcgctgcgcttacaaaggcgtcggaagcaaacaccgcaccacggctgcggatcgatcgcgcacggtatatgggtcatgccgccagcaagtatggaggcggcgtccgtcatgtaatgccagcctacttgctcagacacccaactgcgctgtgcgccgttaaactcgcatacgtctggcatcacgatgccggatgctagtcctcgatccggcgcagggatgtgcgaactgacgccgacacctttgcatgcgcacacacgcccaaaacaatcaaagaggtaaaccatgggaatcattcaattcaaagaagcgaattgtaaaaactgttataaatgtatcaggagctgccaggtgaaatccatcgccttcaaaaacgaacaggcggagatcacagagaaggagtgtattttgtgcggtcattgtttccttgcgtgtccgcagaacgcaaaatccatcaattccagccttgatattgtaaaaggatatatcaaaaacggagaaaaggtgtatgtctccgtcgcgccgtccttcgcgagctgctataaggacgcgacgtttccgaagatttccgccgcattgaaaaagctgggctttacaggcgtggaggaaacttccatcggcgcggcgcaggtatcccgcagctttgaagaactgatgcaagagcataaaatggggaacatcatcacgacctgctgccccacgctcgtgctgcttgtggagaaatattatccggagcttatcaagtacttagcgcctgtagccgcccctatgacggcgcacggcaagatgatgaaggaagtgtacggaaaccgtatcaagaccgtattcatcgggccgtgtatctccaaaatacacgaggcacaggaagaaaaaggcggcggtgcgatcgacgcggtgctgctttttgacgaggtcatgaactggctgaaggacgaggacatagacttagagtcagaggacggcgacgtacgcgagatgaaagccaccatcaaccgtctgtacccaatccccggcggtatcatccagacgatcgacaagaaggcgcgcgcaaactataagtgcgttgcgattgacgggatcgaccgttgtgtggaaatattggattccttgaaggacggggagatcacgaattatttcctggagatgaacgcatgcccggggagctgtcttggcggcccgggccttaaggaatgcgctccggcatatttgctgtccaaagacaacacgctcaaatatgtcaaaaaccgtaaggctgtgcaggcgcctgtttcagaagacacgcggctcgacttttcgtggcagtatgaaaaccgcgttcccaggcggcatgaaccgacggaagaacagatacagcaggtgtttttgcgcatgggcaagacgagcgacgataagatactcaattgcggcggctgcggctattcgacatgccgcgacaaggcgatcgccgtattgcagggcaaggcggatatgcgtatgtgtctgccgttcatgcgtgaaaaagcggaaagtatttccaacgttgtcatggacaacacacccaacgcgatcgtgattttggacggggacttcaacctgatggaatacaacagcgcggcagcggagcttttccgcttaaacgagaaaaattatgtaggccgtccgatctccatgatcatcgactgcgacgatatcgacgaagtgagggaaacgggcgaaaatatttttgaccgtaaggtgtattataaggacctcgatatcacggtggaacagtccaccatcttcatcaaggagaattcgatttacctgctgctcatcaaggacatcacagaggacgagcaccagcagcagaaaatgaatgaaatgcgtgcggagacggtagaggtcacgcaaaaggtcattgataagcaaatgcgcgtggcacaggagatcgcgagcctgctgggtgaaacgacggcggaaacgaagatcgcgctcacgaacctgaaaaaatatatccaggagagcgaagatgagcgtatttattgaaacaagcaatgacagcctgttcaaatacggggaagagctgtgcggcgacaaggtggagattatccgtaagggcgacgtggttacaatcgtgctcgcggacggcctcgggagcggggtcaaggcgaacatcctttccacgctcacctcaaagatcgcggcgaccatgctcgcggacggcgcggatatttacgagacggtggaaacggtcgcgtctacgcttcccgtgtgcagtgtgcgcgggcttgcatattgcacgttcaccattttgcgcgtcaataaacaggggcaggcgcaccttgtggagttcgataatccgcaggtgatcctcgtgcggggcggcaaggaagtcgtgatcgacaaggaagagattgagatcggcgataaaaaggtgctcgaaagccgctttgaaatgaaggaaggcgatatgtgcatcgcgttttcggacggcgcgatccacgccggcgtaggccagctcctgaatttcggctggcagcgtgataatatcgtggaatacgcgtgccgcgcgtataaaaaagatatgcctgcacgcgcaatgaccaagctgctgctcgccgcgtgcgattcgctctacgatgaaaaaccgggcgacgatacgacgttcgtcaccacgaaaatccgcaaatcgcgccccgcgcatatcatggtagggccgccggtcgatgggcagcgcgacgaagagatcgtaaaccgcctgcttagcgtagatggcatgaaggtcgtgtgcggcggtacaacgtcgcagatcgtaagccgcgtttcgggcagggaccttaaggtaaagatcgattacaaggatcccggcgtaccgccggtgggtatcatcgacggcatagacctcgtgacggaaggcgtggtaacgctggctaagacgatggagatcatgcaaaagtacatgtcgtctaaaagtgatatggacgatattttcaatttgtataaggacgacggcgcttccaggctggctaagatcctgcttgaggattgcacccgcgcacactttatcgtaggcagggcgcttaatcccgcgcaccagaaccccgacctgcccattgacctgagcctaaagctgcggctggtaaaagatatcgcgcaaatcatgcgcaaaatgggaaaagatgtggagatcgagtactgctgaatggtaatcaagacgatcgcattaaaactgcacaagccgacggctgcaaaaaggctgatattgggccgtgcgttagatcgctacaacgacgcgatagggtacctgcttgaccatacgaaggataatattccggaaatcgaaagcgagatgcacagcggcgggagctttctgacgcgcaggatcacctcgcttcttaacaaggatctgatggacgcgcttaacgtattcggcgtgcagcccttcaaggattctttaaagctggattatgcaatgacaatggtggcgtaccttgcactcaaacggatgcagaaaaatgcaggctatccgcaggtcatacgcggcggcaagaggtttgacgacgtgttttatgcgttgcttgcggcatacggggaaggggaagtaagccgtcgcatgctcagcgtgcaaacgaaaaagctgtatgaaggtcttcatataaggaagcccatcctgtttgggcggtatgcgcaaaacagggattattgtctgctttatgacgagcaacgcggcaggtattatgccaagctgtacctgatgagcgtaaaggacgacatgcggcgcggcgggatcgtgcgctcaggccgccggctttcctatatcacgaaggacgggggatacctggcgggggataacaggcacgaacggtatttggtaacgcccctttcattcggcaaaaagcaaaaagaaatcctcgagcagggaaggcgggatccgtccatcttcaagacggcgcgcctgcaggaaaaaaacggggattactatcttcttgtgaacgtggcggtaaagacgcaggaagaagcgtcgagcgaaaccacacttggggtagtgcggggaatcttgagcgccgcgcgctgcaccgtcacaaacgaagcgggcgacgttcttttggagcagcagatcagcatgccgggcgctccgtcaaaaaatgatttccatattgcggccaagagcattgtaggaattgcacagaggtataggagcaagatcgtcagttatcacttaggcggcctgggagaccagctttcaagggataattgtcttgcggcgctgacggcagggcagtttaataaactgatcacgatgacggcgtataaggcggagcttgcaggccttgcgcggctggtcgcggtaagccccagaggacttttttatacgtgtccgcgctgtgggctgcatacgctgaaaaaccgttttatgcaggataaattcatgtgtatccgctgcggatatgcaggggagctggaacgcgtgggcgcgctcaacgcggcgcagcggctcaaaaaatacggcggatcgctgctgcccttcaaggcggacgtcaggcacggccggatcacgcttacaaacgagatgctcgacatccgctacgaaacggattatacgcgcgaagcgatcgacggcttctatgaatatatcggagagctggtggagaagtggaaggcttcgggatatgtgccgcttaaggcgggcgcaaaaaagatcagctattataaaaagtttattggcatcacgaacccgcgtgaagaaatcgcgatcgtggatatgcggtaaagccatatacggcgcattttgctgccgcgccgtcacactgggaaacagccttcggacatttcccgggtggatatccgccgagcggagcgcctgaggcgcaaaagtgcagctatctgagaaaaaggcgcgtatttatgacgcgccttttgattggaaaaaataaattggtgttatatcatgccaaagtttgtttataatatataaatgtgactgaacaaggaatatataaaagcctgtatataggcgtttttgcaacaatttgttttttttatttcagtggatacaacaggaaaaaggcatgcggatatcgaatatatacatagcaatatttttatatttcccggaatatttttttggtgttcggcatatagtataagtaggggcatgttatgggaaacaagaaaagatggaagcttaggaatatcaataaaattcttatagtgaccgtctttattatttctgtcggggttgccgctttcacgggcatgacgatcataaataccgataacctggcccggtacgcaaatgaaatatatcaggaaccgtatgccgtaaacgaagccgcgtggaaaatgcgcctgcagatattgtatgcgcgaaacacgatgctcaacatgctgacggatgacgattaccgtcaaaaccagagagagaacctggaacagatgtacgaattccgcaaaacgcagacggaaattgagcgtgtgctccaggagcaataccacggcgatccccaggtggccgcaacgctgatcgctgattttgataagctgcgatccctgcatgactattgcatcgagttgatcaaccaggggaagacagacgaggcgcaaacggttctttatgaagaagcatatcccgtctaccaggaagcggacagtatcatcgcgcaggtgctcgaggagtcacaagagcacatcgcggattatgtggacaagacgacacagcttaacgagtataccaatttgatggcggtggtatggggcagcacgctgattttccttacggtcctgatttccgcagtgagcgtgcgtacgatctccaaaagaaacgaagatatttatcataacgatatgctgttccagatcatttcggaaaacgtggacgatgtatttatgatctacgactgcgtggacgagcgggtagaatacctaagcaacaataccgagcgtatcctgaaattgccggcagaagatttcaagcataatatgtggatcgcgcgttcgtacctcagcgacgaggaattcgataagatatgcacggcgctgaaccttacggaaacaagggagatcgtcgagtgcgattttgtcatgcgcaaccccaagacgggcgaagaacgggaaatgcgtagcaaggtatatccaatcatcgataatggccgcattgtaaagaaggtgttcgtgacgagcgatctgacggtggaaaaagcatcgcaaaaaatgttgcagtcggccgtcgatgcggcacagaacgcaaatgaagcaaagcggcagtttttatcgcggatgagccacgaaatacgtacgccgttaaatacgatcatcgggcttgtggaggtcatgagaaacgggcaggacagcccaaagaagagcaaggaagatctaaagaagatcaatattgccgcccagcacctcctggagttgatcaacgaccttttggatatgtccaagatcgaaagcggaaagatggattttgtgcagaaggaattcagcttgaatgtgatgctttccgagatatccatgatcatgggtccgaaggccgaagaaaaaaaccagatatttgacgtgatgctcagggaggtcacgtgtgaccgttttatcggtgcggaactgcgaatccgtcaggtgttgctgaactttttgtccaatgccgtgaagtttacgccggagggcggaaaaatcaagctggcgatccgccagatggcgcagcgcggcaatgcggcttgcctgaatttttccgtgacggacaacggcattggtatgaatcgggaatttatggaacggatctttgaaccgtttgaacaggcaaacgcatccatttcgcgcaggttcggcggatcgggcctgggcatggcgctttccaagtcctttgtagaaacgatgggcggcaatatctgcgtggagagcgtggaagggaaagggagcaagttttcttttgacctttggcttgcgcttgcggatgcgccccgggaggtgccggataagttcaaaagcctgcgcgcgctgcttgtagatgatgaagttgaaatgcgcgagcatttaaaactattgtgcgaacagcttggcattgaggcggtcagcgcgtcgtcgggggcggaggccgttcatatcctgcggaattcacaggagctgtttgacattgcgttcgtagacctgtatatgtcggatgtagacggtatccgcacaacggaatggatcaggagcgaagcgaaaaacgacatttctgtggtgctgatgtcggcgtatgagtataagcgcgtggaacaggaagcgcgggctgccggcgtgaagagtttcttgaaaaagcctgtgctgcgcgaggacgtctacagggtattgggagagcttgaaggcgcgtatgaggacgaggacgatacagaacagtttgactttgcggggaaacggatgctgatggtggacgacagcgatatcaaccgtgagatcgggcaggcgttaagcgagcatgttggctttgacgtagagacggcagcggacggtcagcaggcgctcgacatgtatttaaaggcgccggagggatattacgatgtcattatgatggatgtgcaaatgcccgtgatggacggatacgaagcgacgcgcgccatccgcgcgagcggaaagaaggacgcgaaggatattgtgatcgtggctatgacggcgaacggttttcgggaggatgtggcggactccatcaaaaacggcatgaacgcgcatgttgcaaagcccatcgacgcgaaagtgatttttgcagtattgagggactttttggaataagacaactagaccaaagaacggaaagggaaatgatatgacgattagcgaagcgggacggaaatatccggaggatatagaagtaaagagcgcgcttgaaagaatgtgcgggaatgaggcgctgtatgtaaagtttttgcgcaggtttttggaggacacgcattaccaggaattttgcagagcgtttaagcaaggcgacagggaagaggcgatgcacagcgcacacgcgcttaaaggacttgcgggaaacctggggcttatggctttatttgaacaaagcgcgcgggtggtggaccaattaaggcgcgaagagcgggacattgataccgatggattccatgaggcttaccggaaagcggcctcgatcattgaacaattgagttaaggggggatagaatggcgagtacgatcttgttggttgacgatatctcgatcaatcgcgacatgttaagggaactgctaaaagatgagtacggactgctggatgctgacggcggcaagcaggcgatcgatcttttggaagcacgccgtgatgaaatatcgatggtacttctggacgttatcatgccggaagtaagtgggtatgatgtgctggaatatatgggtttccacgatctgctgcgggatatccccgttatcctgatcacagccgcaggctctgacgagatggaagagaaaggacttgagcttggcgcggtggattatatccgcaagccgtttgcgccgggtatcgtcaaacgccgcgtgcgcacgctcatcgacctgtataaataccagaacaacctggaagaagccatcgaagaaaaaacggaagtgctttcggatatcaatgaaatgatcgtggcggtcttaacatctgtcatggaaaccaagacgatggagacaaaggagcatatccagcgtatccgcctgtataccaaggagatacttaagtatatctacgaatattatgacgacaattacaatttgacgccgcagacgatagaaatgatggggatggccgcgatcctgcacgacgtaggggagttgatgctgcctgaagcgatcgtcaataaacgcaaccatctgtctgcggaggaagaagagatattcatgacgcatacgatcaaaggttgcaagctcatcgagccgctgaaaaatttggaaaacgaattgtatgcgaattattgctacaatatttgccgttaccatcatgagcggtgggatggaagcggatatccggataagctttcaggagacaatattccaatttgtgcgcaggccgtggcgctttcgcaccaatatgacgagctgatgtgtaaatatggcggcaaccacgaacaatcggtgcataacctcatgtcggcggaatcacaaaagttttctccggtcatgacggagacgctcaagctggtgggcgaaagctgccggatcatttacgaaaacaacaaggaaaagtcatagaaaatacggaatcaggaaaggccctgcatgcttgatgcacggccttttttatatgttttcaagttcctgattaaaaaaatatttttatgcttcccatttttcttgaaatggtctattatagaaacaataagcatgaaaaatagcatgtccatcatagcttgtggttcggacagaaccgggaaggatttctttgcagaatgtgttattggacctgctcgaccagatgctggaactggtgtacgttgcggacgtagagacgcacgacctattatacatcaactcggccggacagaaaaaatttgggatcagcgactttaaaggcgcaaaatgttataaggtgttgcaggggtttgatgagccctgccctttttgtacaaacggaaaattaacgtttgaaaacgtttattcgtggcagttcacaaataagatattagacaggcatttccttttgaaggataagcttgtggaatggaatggccgaaaggcgcgcatcgagatcgcgacggacatcacgcacggcgaaaaggaaaaaatcgcgctgaaaaatgcgctggacgctgaaatagtcatcaaggactgtgtgcgccggctttacgagacggaggacatgaatgaggcgatccgttttgtactggagaagatcggtgtgtttttggatgcggacagggcgtatgtatttgagatacgcggcgataagatgtacaatacttatgaatggtgcgcgccgcatatcacgccggaaatggaaaacttgcagggactcgacctctcggcgatcgaccggtggcgtgagcagtttgatcgatgcgaatgcgtggtcgtggaggatattgagcagatccgggagaccagcaggggggaatatgatattctcagtatgcaggggatcaaaagccttgtgaccgcgccgcttgagcaggatggaaagctgatcggttattttggtgtggataacccgccggttgaaaaagtgcgaaatattgtgccgcttttccatacgctgcgttatttcctgatgtccaccatccgcaggatagaggacgaacggctgcttacgcggctgagctttgaggatatgctgacgggcttttataaccgtaaccgctatattcaggaccttgccggatttgccggatcaaagcgggtagggatcgtgtatgtcgatgtgaacgggcttaagaagctgaatgatgaatttggacattcctatggggacgaggttctgatcgaatgtacgcatatcatcgaaaaggttttcgaggaaggcgatttttacaggcttggcggggacgaattcgtggtcctatgcaaggatatttccaaagagcatttttaccaggacgtccgtgagctcaaaaaccaatttgcagtcagcgacaagtgtcatgcggcgatcggttaccaatgggcgcagaatgcaggcgacatacagcgccttatctatacggcggacgcgatgatgtatgaggataaaaagcagttttaccgcaagaacctctccagcgaccgctaccggcattataacgacgacgtgttggggctcacgaggcatggcaagctgaaacaattactggaagaagggcgttttaaagtatatttgcagcccaaggtgtcctttgcggaccgctcgctgatcggcgcggaagcgctggtgcgttaccaggtggaaagtgacgtcctgctcgcgccggggcagttcctgccggttttggaggacgcgaagatcatcgggcttttggatttcttcgtattcgattatacatgcggcaaaattgcgcagtggaagcgggagggcaggaaggtcgttccggtatccgttaatttctcgcgctatacgcttgcggagaaggattttcttccaaagctgaaggatatatgcggaaaatacgatatcgataaaaaaatggtggagatagagatcacggaaagcgtcaagggcacggaaggcattgatatgatccgtttgatcgataagatcaaggaagagggatttgcgatatccatcgatgatttcggcgtcaattacgcgaatctttccctgttcacgtccgtcaatttcgatgtgctgaagatcgataagagcctcgcggaaaatatccaggataaccgtaaggcacagatggtcatcgagtccatcgcaggcatctgccaaaaaatggatattcgcatggtcgtggagggcgtagagacggaggaccagtttgagatattgagcaagatcggctgtgaacaggcgcagggatacctgttcagccgcccgatacccgtagaggaatacgaaaagaaatatatctgaaccaatcaaagaaacacaaaagccggctggttagggtcggctttttattatcattgcatctgatcctttcatggtattaattcaaacagctcccgcttggaatgaatccccaacttggaatacaggtttttccgataccccttttgtgtattgatcgtaatgttcatgatccttgcaatcgatgattccgtatgtccggcgaggatcagaaacgcgagattacgctcctgctcggataatgtctcgaatggatggccggaggggatagcgtgattttcccatgccttcggataaccggctttcgcaggaagcgcagcggcgtccttccggctccacggataggaaaaatatggctcgaggaaatagtataccagcatcaggatgcccgcgcatccggcataaatcccatagagcagcggaaggttatcgcgcagaccttcgatcatgcccgcgtgcagcatgatcactccaaagccgatccccgtaccgatcgccccaataaagcgtgtcggatagatttggaaggcttttgccataaagaatatccacagattggcgacaacaaaggtgaagcccatcagaacacacgcaagcaaacgccattgcggatattgcagggaaatgagggcgatcaaaaagccaaataccgcgagcataaaaaacgcgctgtatgctttgacggagcgttgccccatttttttgcgcaggcaatacaggaggaacgcaaaaaccgccgccgcgatatagaccgcgctgatcccattcggcacgctttccgcaaaagacgtcgcaaagcatacgagcagcgtggaaaatgcgatcagcagccagataccgaaaaataactgtttggaaatgggaaccttgttcgcacggctggcatatggcgcggtgattttggcgggaatgctgtaaaaaaatacggtcagcgccccgatcagcaatgcggacacgatggtaaaaacggtaaaattgactttaaacaggtcgttttgcagtaccgcgattacgcagccggagaggatcatgccgaaaatgccgtcacgccatgccgtctcgacagcgaattgctgcgcggcaaacgaagccatgccgccgatcgaaaacacacagacaaatgcggcgatataaaacaataccgtaatcacatccggcgaaaacgggaaaagcatcaggatcgttgcggcgagcgcgatcggaaagaggacgcgctgcatccatgcggttttgcggggaagcgcgcaaatagcgatgatcgatatgatgtagccaagcgcgatcagtaaaatggtgtcttcttccaccagcggaatgggcgtgctgccaaacagcgacagcgttgtgccgcaaaagtaaataatacccatctgccatacgacaaaagggcctgtaaacaaaacgatcagcctgcttcggatatccagtttcccatcgatataccgatatgcttttggttcgttcttcaacgctttatcttcctgttcatgtgtatgtatccggatatattttattgtatcgcatcgattttataaaaacaatacgcgatcgggcgaataagcctggaaaaatgcaaaacccacccgaatcgggggtaggcattctgctttttggtgtggtatgttttgttcagataccaatatatcgaaaggagcgtcacaggaaatgttgcctccggtcactcgaaaattcaaagacctttccaccgaaagatactatcagtttgctttttattgcgacgcatgcggcgcggtttggacgagcgaaagatatccgttttgcgggcagcgtgaaacgccgatgggcgcagaagaacaaaaagcaatggatctcctttggaaaaccgaccatacggccgcttatgagcgtgcaaaccaggaggccatgctccatttcaataaatgtccactgtgcggcaagcgcgtttgcgacgactgtttttcagagcttgcgcttagctgccggtactgccacgaaagcgagggtgaaattgatggcgacatataaacaaccctgcatccactgcaatacgctggttgatcgcgacgcgcggttttgcccggcctgcggcagccacagtccatttggctaccagtgcccaacatgcctgcgcgacatacgaaaagatcaaaatatatgcgccggatgcggaagaccgctgtatgttccctgcccattctgcggggagcaaacctttgttcaggagacatgcgaagcctgcggcgaaagcctcatgaaaatatgtaataacaaacggtgcgaagtgcagcaatttttcgagaacacgaaatgcaccgcgtgcggaaaaaaactaaaaaaattcaaggtgaagaggtgatgaattttgttgaaatcatttacaaggaactatgaggacaactctactgaagcgggattccagttcacgttttattgcgataactgccaggatggatacaagagcagttttatcgaatcagcgacctacaaaaaaggcaaacgtacacggggcttggcacaaggcgccggtattctgggaagcctgcttggcggcagggccagcagtatcgggtattcggcggagcgcgcaggaaatgtattatcggaacggtttgaagaccgttcgcccgagtggcagaaagagcatgaacaggcttttgaaagggcgcaaaacgaggccaagcagcattttcaccgctgccattcctgttttacttatgtatgcgacgcttgctataacgatgaagaggggttgtgcgtagtatgtgcacccaatgaaaatatactggttgcgaaaacccgggcggacgcgatgaggcgaaatattgaggaagcaggcgaaaccgcaactgtgtggaaaggtgaactcgaaagcaaaacaacgatctgcccggtttgcggtaagcctgcgggaagcggcaagttctgtaatagctgcggcgcgccgatgtctgtgcacgaatgtcccaagtgtggggcgaaggtttcgctgggagtaaagttttgcagcgaatgcggaacgctaataagcagccccaaaccttcgggcaagtgccctggctgcggggcgcagaatgaacccggaacgaagttctgcggggagtgcgggacgaaactaccataaataatatgatcttagggggaaaaggacaatgaagaagattttggctattgtgacggcgatgatactggcctgtatgttggcgggatgcggcgctgggcccaaagaagcatcgcctgatttggctggcggcaacgctgtgagcggtgaggaaaaatcgccggacgggaaggaagattcttccaatgcatcggattcaggcggttccggttcaacaggaaagacggatttcaacaattggcctgacctgtttaaagagtaccaggtacggttcttagacaatacaacggcattttcggaggatgaagagacctatttgctgatgctgactttaatggcgggcgatattgaaattgcgtttaccagcgcgttctttggcccggacgcggaaaccgctacggccatggtgtttgaaatgttcggcggagagaatattacatactccgaatcgggcaacacagcggctgcggaagcggattttgatggtacgcgggaaaagtacgaggtgcagtatgacggcggcaatacggcggtgatgaagcaatatatggatggtgaacttatctcagagctatccttgtgtgtgacgaaagaatacgctgccaaaatgtataaacgctatacgccggatgcggagcagaccgtatgcgccatcgtaaatcccaaaggggatatctggctgggcgtagaccaggctgtgctggacggtacgctctaccagaacgccgcggctgctgccgataccaaattcgcgaccaacctgccggagacccacacctacatagacggcgaatattccggatgatgatatggtgaaaggtggttatattatgaaacggattggcctgattatactggttatcgtgttgctggccggagtatgcgcatgtgacggacaggaaatagctgacgcagtacaggcggaatcatcgcaggggcagaccaacgtatcagaagaatcggttccgccgccgtcgcccgaaccggaggaatatatctggacgatcacgatagatgaggaacaaaacgaggtggtcgacgcggaagttggcgcatctatgtattcccggctgaagctctccatgtccaaaaccggtggcgagacaccctttggcgtgtaccgcggtgaaatcgattattcctacgaaatggatatgggaagtattctctctgcttttttggatgccgcggatacggacggctggggaaaaaacgattccttcgagatcgagctcttgccttatgatgaaattgattttgaagcgttcgaagccggcgtggcagcggtcttcgaaacgggcgatgagaccggcggggaagaaggagcattgtctccgtcccttgccccacttgtgagtgaacaaccggaagacacagaagaggcggatacggaacctgaaccaagcggggatccttcccttgctccgctccaaaactattatgcgatgtattgtggcgaagacctggtatttacggaggaagatttctccactagtgtgtctatgccggaagggttactggattttcagggcgatggtgattacgcgtcgggcagcataaacctcggaccgttgggctcctattccgacgcgggtgaagtcatgatgccttactctattatgttgatccgtccagcggaattggaggttcagtttacgctatatggtaaccataactatgtttaccggggaacgatcgataaagtgccgctttccgacacgattgaggttcaggaataacaatacgtaataatccattgaaaatataaaaatcacaggaggtgaaaaattatggctgacaacccgctcggaggactgggtaatttatttgggggcgggctcggggggatgctgtctgggcttgtgccgcaggacacgccggaaggcaagctgatgaaagcgaccaccgacctttccggcctgcaaaaacaggaaagcgaactgctcgcccaaatcggcaggcaggcgtttgagcaaaacccggatgcgtggccgcaaaaggacaagctgctgttgatccggagcaatatcaccgaggcacagaaaacattgaacgaggcaaaaaaggctcaagaggaggctgatgcggcgaaagcggcggacgacgcaaacggccgctgcccctcgtgcggacaccgcaatcccgaaggcgtgaagttctgccaggaatgtggcagtaagctgggcgaatcgttttgcaaaagctgcggcgcggcgcttccaccaggtacgcgcttctgcggggagtgcggcgccagtcaggaaacctagcctttttcggaggacttccctgcatggcacaatttccttgggcttacaattcacgatgtgataggaggtgaaagaatgcgccggaacatcctatatatattctttttcatttgtatattcgtttttagtggctgtacagcaaaattaacaacggtacgccctgccgagatcagtgagctgcgggtagagcgcatggcggacggcgtgacggtaacgctgccatccacggagcatagcgccgatttgaaaaacaggcttatttttcagttggaagaaccctacaacgaaaccggcgattgcacggaagcggacggccatctttatcgtgtacggctctatattgtcgacgagctggacaccgaggttatcatcaatgaggacagttcagtgtgcaggcgcggcaaactgcatatcccctccggcaaggcggattctcccgtgaatatcgaggactggaacgcactgtttgcagaggacgatacaagcaaagaagtaaattcatctgcggaaccggcagaatcgcccgcgcaatccacacagccgtccacagttcctgccgaagcaaccataaccgtcccaacctctttcgagggcaatttggaaatcgtcacaagtcagggagatgcaaagcccctgccgcccggcgcggaagttttgcaatctattccggctgtcgatgttctgccatggagctattatatcagcgatgttcgttatgacggacaggatttcgtcatgatgtggcgggatacccccaaaggagatgatgcccagtggctgtgcagcgtggcgcagactacagaggacaccgccctgcggcacagcatcgaatatgtggaagaaagctacgagcgcagcggcgaaaagtatctgtattttacgattctggatgcaagcaacttccaccgcagcttgtggtgttttgatccggagaccacttatttcagccgtgtgctggacgccccctgcagcaacatgattttgctggaatacgaaccccatgaggcgcagggcatcggctggattgtatatgaccactaccttaccgccgtggatctggcttccgaaagcatcgacgaggggctgacgattgatttggacgaatacatagacgaccacctgttctacggaatcggcgcattcggcacacacaagtttgtcaccctgtccgatttagggaactatgctctgcaaattgaaggcattacggcggaaccggaaaccagcgcaccggagctgcggacgatctatcaactggatttgttgtcacataagtttatatcaatcacgaactaactgtatgcggcacatatgtggcggtggaaaatatcgcatatcgtacaggaacctactacaaatattaagaaatgagaggaaaaaaagatggcagtatgtaagaattgtggaaaccgcgtaccggacaggcagagggtttgtccttcatgcgggggtgaagtcgtggaggaacacggcgacagaatgtatggcagccggaatagtgcatctcccggacgcgatgctgagaaaaacaagaattggggtatcctcgcgtacatattctttttgataccccttctgggaggaccgaaggattcaaagtttacccggtaccataccaaccaggggcttgtcttctttatcttctggctggcgctctgcatcatattgaatattatacaggcgatcgtgattgctgcgtccttcaatagtctggaaggtttgctttacggttttggcggcggtttcttggcctttacgtttatttggctcatctacgcggttgtggagatcgtattcctgatactcggcattatgcacgccgtgaggggcgagatgaagccgcttccgttgatcggcaggtttacaatccttaaataacggtaattgtattgggtatgaaaaaaatattgagctgtatccttgtattgctgctggcgctctcgctgattgcctgcgggacgggcggcgaaacaaacgcgccgtccgaagaaagcggtaaaatcgacgcggaagccgttgcggaaaaagcggccgaggatgcgatagtcgcggattcgttcagcgaggctgcggccgcggcgttcataactggaaaattctttcatgccgggatgggcgtataaaaaagacggcagcataatggctgtatatatcggcgaagaatataacagcgacaaggaaagcgaaatcgggcgcgacctgtattattatgcggtaagcattgacatcgacgccggattgcagaaaagttttgacgagacgatggaagacaccgagcagtatatggaagaacacaaggacgaaatagagcaagcgtgggaagattacctgaattaacggttagaatacgggaaagatgatgcagggtgatggaaggattgaaaattcagggcgatccaagatacaagaaagacggaggcgcatccggcatgggatatatctacaaagggctggtagactcgcccgccatatccggcgaagtgcagcttacaacgacagaagaaggcctgctgataagctcgttgtttgagcgtgtattgcttccgtatgcggacatcgactcgtttgtcctgcaggattacgcggtccgcctccggacggcggacggctgctataccgtcacacgtctgggaaaagcctgcggctggttttaccgcgaactgtacggggcgtatgacaaatgcacgttgaaagcctttgctgtggagggcgctcccgtcatggaaacgcgcggcgtatttgaaacgtgcgaaccatccggtaatgtttccacgcaggcggatatccggctttacaaagactgcctgtgcgccatgacgcccgacatccatgcgcggcgcattccattgctgtttatcaatggaatggacaaggccgattattcccttacggtttccctttccacaggagagcagtatacgtttgccaggctcggccatgatacggagccgtttgaacagcgcatcgccgcccagatcaccgctttcagggaaaaggccgcagcgttggtcatggagcagaaccccacccttgactcctgcgaggtttcgcgggccgcccaattatgccccaacggtactgccgcgccgctcgcgcagctatattccacgctgccatgctatgcgaaagcagttgagcagcatatcaggggcagtaagatcgcagggacctacgagctgttgaaatcggttggagacgcctcaaagttttgcgtaggcgcaaaatttattcccgtttcggaggaaagcgggccgatcgtatgggcaatcgctttcaatggaaagggagatgccgcagcagtcgagcttgcactacagggtgaggaatcggcggcaacttatctttaccatacgggcggcaacaacgccggattcttagctatgcttaacagggcgctggaagcgaccggatttcgaagggaagcgattttattgccgaaggaagaactcggcagggataaatatgcgttacagcgaatattgcttgcgcgtacgccctggcttggacaattaaggaaggcttttgcaggcagggtgatacattcgtctgcggagggctggaaaaaagggatcctgaaatattttggatgaactgaccatatgagcgggtcaacgcattcaaaaaacggcgaaaaagcgaaaagcttttcgccgttttatttataattgcgtcttacctgcgctttcaggattgcgccattcttttttgcggaatttgtatatcagcagggggatcgccgtcaaaacgatcgcgccgatgatgataaagagaatgtagcctgtgctggaggccgcgtccgtccgcagcgaagcgggcgggatgaagctggtgaagatcacgaaggcgatcccgatcaggccgatgatggaaaagatccacatgcccgccatgccgccggggatcttgaatgcgtgtgaatcgcgggggtgcctgcggcgaaaaatgatacccgataaaataatcaggatatatacgatgcaataaaggacgaccgccatcgtgaggatggtgttgaacacgccgtttgtgccggggatgaatacgaagatcagggcgacgcccgtaacgatgacggcctgcaggatcatgatcgaaacaggaatatcatgcttgttgaccttctggaaaacaggcggcaggttgccggcgtttgcgcaccgcagcatgctgcgcgagggaccggaggtccaggcggagatttcggtgacgcacgaaagcgcgatcatgaccgcgatgatcgtggtgacccagccgaccccccagtggtcgaacatgacggagaaggcctgcgcagggtccgcaagggctacgcccgactgcttgacgatcgcgtcggtgacgattccggcataagtaaagagcacggccacgaagcccgtcgccaaaatgatggcgcgcggataatttttgcgcggattgtcgatgcggtttgcaaagctggaggcttgctccataccggcgaacaaaaagatgatgcccgaaaggcgggacagggtatcgaaatccgaagcattgggaatgatctgggaaacgggcggcggcgtaaacgcgctcgcgtcgtttgtagccgcgaacaccgtgccgaatatcaggagcacggcaagcgggacaaaaagtccgaaaatcgtcccgtatgtactgatcgccgtaatgggcacgcccttgatgatcagaagggtgatcagccagaaaacggcgatcacgacgatgccgatgaaaatattgttgctcaaaagctccttagcgccgaacatggtcgccagcatatccgcaaacgccgcgcctacggtgaccatgccaaagcacatctgtatccataccagccatgccgctacgaacccccagcgcggggcaagcgccttgctgatccatacgggaaggccgccgtccacgggcatggccgtggcaagctccgccgaaacaaaggaaacgggtatcacgaacatgatgatcgcaaagatcataaaggaaacggattcccatcccgcataagcgatgttgggaacgcgccggatcgaagcgaaaaacgccatcgtcaaaaacatcaattgtaaaaagccgatttttttcatgccgcttaatatcctttattcctatttgaaaggccatggtttgccgcaatatagataaacaaaaaccgaaaagatatgcaaaaaagaattgtgtttttgcataaagtatttcaggctgggtataattaggggtataacaggcttttttcatgggggtaaaaaatggaatacagcggaaaaggatacgcggaaacaacgcacatcgtgatgtcggaaaacatcaaccaactggggaacctgcacggcggtacgctcatgcagtgggtagatatcatcggcgcagtcgcggcgacgcggcattgccgcagcatcgtcacgaccgcagtgctcgacagtatggatttcaaacatccggtgcccttggggggcatcgttacgctcaaggcatgcgtgacatggacgggacggacctccctcgaggtgcgcgtggacgtggacagcgaaaaatgcaacacggatgagaaagtgcgtacaaacacagcctacctggtatttgtagcgctggggtacgacgggaaaccgcgcgtggtaccgccttttgttccaaagacggaaaacgagaaaacagaatttgagcgcgccagccggcgcagggaagagcgtttgcgcaaaagggacttgagcaaagcgtaaataaagcaaggcagggatacgcgccgcatctttggaatctcgtgaaaaaacagcgttttggaattttgttcacaagtgcgtaacaccatttcatatgtgtttcgtttattccaaaacataccgtatatatggactttaggcatttctgccactatcatgaaattgttcggaaaacaattttatgaaaaacggcatctcggctgtaacagacgttagaccaccgaagatatttcggtcacataaacaattcacttttcaaggaggatgctaattatggctcgtatcaaagattttatcgacacaaccgattttaccaagaaagaactggtggagatcatagacctggggatcgcgatcaagaaatgcatcaagctggggtattatccgcagctcatgaaacataaagtactggggatgatctttgagcagtcctccacgcgtacgcgcgtttcttttgaaacggcgatggcgcagatgggcggccatgcgcagtatttagcgccagggcagatacagatgggcaagcatgaatccgtaagcgacacggtgcgcgtgctttcccgccttgtggatatcctcatggcgcgcgtggaacgccaccagacggtcgttgaaatggcgaagagcgcttccattccggtcatcaacggcatgagcgactacaaccatccgacgcaggaaatgggcgacgcgatcacgatgaaggagcaccttccggaaggcaaaaagatggaggactgcaaggtcgtgttcgtaggcgacgcaacacaggtgtgcgcttcgcttggcatgctgacgacaaagctcggcatgaaattcgtacaattcggaccaaaagggttccagctcaaagagaatttccagaaaatttttgaagaaaactgcaaggtttccggcggttcctacctgatcacggaagacgaagacgcagcgatcaaggacgcggacttcatttacacggacgtttggtacggcctttacgaagcggagctttccaaggaagaccgcatgcgtatcttctatcctaaataccaggtagatatggatatgatcaaaaaggcgtcgcctacggtcaagttcatgcactgcctgcctgcttcgcgcggcgaggaagtgacggacgaggtcatcgattcggcgtattccatcgtcattgacgaagcggaaaaccgcctgagcgccatgcgcagtctgctcgtatatttcatgtatccggaaaaaccggtggatatcgtaggcaaagacgcttccaaggccggccttgaagcctatatgaaagaaatcaagctgatctgacaatccattcttgaaaccggggaacgggaagggagcacaccccttcccgcccataaataaaggttccaaaacgccggaatgctcaggcattattcgattgttgctcttttatttctccggcggagtatgacgcggcatgtgccgcaaataaaaatgtgcggttggtacgttcgggcgagtgtaacgagcgcaactaagaaggagggatttggtagatgatggctacaaagaaaaaatttaaactttttgacgcggtgcttgcggcagtctgtatcgtactcgttgtggaagcagtcgcgcctgcggcggcgattggcccatggcaatacatttggtgggcgatcatgctcattgcgttcttcctgccgtacggcatgatcagcgcagagctgggcacgacgtacgacgacgaaggcggactttacgactgggtaaagcgcgcgttcggacggcgcaacggttcgcgtgtcgcatggtattattgggtgaacttcccgctgtggatggcgtccctcgcggtattgttcacagacatcctgatggcggcggcagggatcgagatcaattggattttgacgctcgtgatacagcttgtctttatttgggtggtaatcctcatcagcaactaccgtgtcagccagagtaaatggctgatcaatatcggcaccatcgtcaaggtcatattgatcgtagcgatgggcggactcggcatctacggcgcggtggtgaacggctttgcaaactccggctccttagcggacatctcgccgctcatgggcatctcgtttatctcgatcatcctcttcaactttatgggatttgaggtcgtgaccacgttcgcgggcgatatgcagaaccccaaaaaggagatccccaaggcgatcgtcgtgggcggtatcctgatcgcggtattctacctgtttggcgcgttcggcgtgagcgcggcgatcccgtataacgagctttccgtggacagcggcttcatggacgcggcagggatcctgctggcaggggcgccgggtatcattttgacgatcatcggtatcctgttcatgttctcgctgatcgccaacctttcctcgtggtcgttcggcgtgaactatgtcgcgatgtacgcggcgcgtgaccatgcgatgcctaaggtatttgagaaagaaaacaaggatgaggttccttcaagcgcaaatatcatcaacggcgtggtggcgactgtgattgtcgtggccgcggccattttggggcaggtcaacccggacgcggtcgactccttctggactttgtttgccttaaatgtggtaacactgctcgcttcctatatcttcatgtttccggcatttcagaaattaaggaaaatggaccctgacagggaacgtccatacaaggtgccgggcaaaaagggcatgatcgggatcatgacatgggtgccgttcgcgctgctcatcctggcgatcttcttcctgctgttcccgtatgacgcgaagacaggcatgttgacgccggacgtggttctgattgtcggcgtagtgatctccgtggtgctgggcgagatcatcgccgcagtatgcgcgggcaggaaggacagacaggaagcgctggaacggaaaaaccagtaaaagcgatacgaacttatatgttaagttaaaaaacaaacgaaaggcagatgtattatcatgattaattacgattcaaaaccaaaggcggacggctttcggatgcccggtgaatttgagcatcacgacggctgctggatattgtggccgcagcgtccggacaactggcggctgggcggcaaacccgcacagaaggtgtttgtggaagtcgcaaaagcgatcaataaattcgagcctgtcacagtgggcgtgaacgaagaccagtacgaaaacgcgcgcggcatgcttccggaggatatccgcgtggtggaaatgtccaacgacgattcatggatccgcgactgcggcgcgacgtttgtcgtaaacgacgcgggcgaagtgcgcggcgtggactggacgttcaactcgtggggcggccttgtagacggcctgtacttcccgtggaacttagacgatgaagtggcgcgcaagatgtgcgatatcgaacgcaaagggcgttaccgtctgaatgattttgttttagagggcggcagtatccattcggacggcgacggcacggtcatggtgacggaggaatgcttgctttccgagggacggaatccggaccttacaaaagaggagatcacgcaggtactgtgcgattacctcggcgcagacaaggtcatctggctgaaaaacggtatctacctcgacgaaacgaacgggcatgtggataatatctgctgctttgtaaggccgggcaaggtactgctcgcgtggacggacgacgaaaacgatccgcagtatgcgatcagcaaggaaaacctcgatatcctcgaatcggaaacagatgcaaagggcaggaagcttgaggtcgtcaagatgtacgtgccttcgcccatcaccatcaccaaggaagaggaagagggcgtggacgctgtagacggcacgctgccacggttggaaggcgaccgcctcgcagcctcgtacgtgaacttctacatcgcgaacggcgggatcgtggtgccgggcttcggagatccaaacgacgcaaaagcggtgcagaccttaaaggaatgcttccctgacagggaaatcgtacaaatccccgcaagggaaatcctcctcgggggcggcaatatccattgtattacgcagcagcagccctccggaaagtaaaagcgcgcacaaagtaaaagtagcagtaaacgcacgtttgcgcgggaaggcgttccgcgcaatagaccttataacgaacggcgtatgggcggggcgcaggccccgtcccaaacgctaaaatccattggggaaattgtattggcctggcggcaaaaacggatcgttgatccgcttttggtttcgctatcctaaaaataccggaaaaggcggtaaacaattatgtgcagaatggtaatagcgctcgggggcaatgcgctggggaacacgcctgaagagcagatggaaaaagtgaaatttgcggcaaagtcgatcgtgccgctcattctcgcgggcaatgatatcatcatatgccacgggaacgggccgcaggtagggatgatcgacttagcgtttgaaaaaggattcgagggaggctatacgcccatgatgccgcttgcggagtgcacggcgatgagccagggctacatcggctaccacttgcagcaggccatagatgcggagcttgtccgcaacggcagcgacgatacgcctgtgatcacgatgctcacgcaggtcatcgtggatgaaaacgatccggcgtttcaaaacccgaccaagccgatcggggcattttacgacgaagaaacagcaaagaagctgatgaaagaaacgagctgtaagtatgtggaggatgcaggccgcgggtggcggcgtgtggtcgcgtccccaaggccggttagtatttatgagtatatgacgctcgatacgctcatcagcgcgcgggaagtcatcatcgcgggtggcggtgggggcatccccgtgatccatacgaaggatggctataagggcgttgctgctgttgtggataaggatttcgcggcggaaaaactggcagagctcgtccacgcggaatatctgtttatcctgacggcggtagaccgcgtatgtatcaattttggtaagccggaccagaaggagatcgtgcacatgacgcacggggaggcgcaggcctatattgaggaaggacagttcgcgcccggaagcatgctgccaaaggtacaggccgcatgtgaatttgcaaagagcagggagggaaggaaggcgatcatcgggtcgttggaaaaagcgccgcttgcccttgagggaaagagcggcacgctcattgaagaaaaatagcgacatctgtcgatatcccccaaaaaagccggatacgcatctttgtgtatccggcttttttaaatacaaaataacggtttactgttcgtatgcgcggcagagcctttggtaactttcctcgacctccggcgggatgtcgacatgctctatgaagcctgcgccgttcgggccatatccgttttcatcgtcgcggatgcgcgggatctcacgcagcagaaattcacggaaccgttccttggaccacaggcccttcttgctgccgcattccattccggcatacgggatgaacggagcgtaactgatgagagggatatccggatccaaatatttgcgcagcgtatagtggctgcggagctgcatgaacgggtcctgtaataaaacggcattctcaaaagtgatgccgcgcttttcaagaagctccagtgaaaacagtgaattttcaccggaattggtggatttcccttccatcaatatgatcgacggatccatatcataaaatttggtcgctacaaaggccataacctctgcttccgacatggagttgcaggttttgccaaacattttgcggacattgcggaccaggttttcggtggaatggccgatccctccgctgaaaacgacgttggagcacaaatgcagcgcggcggcatgcgcggcgcactcaatcacgcttaaaacctcgcatccgaatacgaagatcacatccacatggtgatgcccgcaagcctcgtaaagggcggcggaagacagtgagcggatatcccgtttggccaaaaaacggcacagcgtgttgatgtcatttttcagggcgctatcaggcataaggaaacctccggtgttttttctttttattatacaaaagacgcgtgcgcgccgcaagtatagaaaggtttgaagggcggggtttcttgtgatatactctgctggggaataaaataaagaaggacgaaacaatgctggcatcatttgcagacgtaagcgtcgcgtatggcgacgccgaaatattaaaaaatatcacggcaaacctgaacgcgggggataagatcggcctgatcggcgccaatggcgcgggaaagaccacgcttctcaataccctggtcgggcggatacttccggaatcgggcagcgtgatccacaaatccggcctttccatcggctatttggaacagaacagcggccttgaccggaagaatacgattatcaaagaaatgcgcttggttttccataaagcgctggcggcaaaagaggatatgcgccgtttggaagccgagatgaacgcgcatcccgaagataaaggggtgcagcgcgattatgcgcgcgcgcaggcggtttttgaagcggaggacggttaccagatcgaggtaaatatcaaaaagatcctcaatggtatgggcttttccgataaggcttacgatacggatatcgcaacgctttcgggcggggaaaaaacgcggcttgcgatcgccaagctgctgctcatggatccggaactgttgattttagacgaaccgaccaaccatctggattttaagacgctcatgtggctggaggaatacctgcgcggctataagggggcagtgctcatcgtatcgcacgacaggtatttcctggataagctagcgcagcgcatctgggaagtggaagatggggaactcaccgaatacacgggcaactatacgcaatataagcagcttaaggcggaatacgtttcgttccggctcaaggaatatgagaagcagtcgcgccagattgcgcacatggaggactatgtcgcgcgcaatttgacgcgcgcttccacggccaaaagcgcgcaaagccgcgtcaaaaaactgagcagcttagagcgtatcacaaagccgaacacgcatgtgaacgcgcctaaattttcgtttgatttttccatgcggcccgtaaacgatgtgctcagcgtaaccgacctgacgcttaccgtgggcgaagaggaaaaggtgcttgcgcgtgggatcaacatggagttaaagcgcgggcagaaggcggcggtcatcggtgacaacggaacgggaaagtccacgctcatcaaattgctgatgagccaggcggcatgtacggggcatgcgggatatgcggaaacaaaccgtgcagaagaaaacctttcccccgcccaaaacgaaacgagcggccatgccattgctttcggaaaaaataccatcgtcggctactacgaccaggaaaataaaaatatgacgcctgcaaaaacggttttaaacgagatatgggatgcttatccgtcgctgctggaatacggtgcgcgttccatgcttggacgcgtgttactgacaggagaagccgttttcaagcgcgtgggagacctgtcgggcggcgagcgggccaaggtcgggcttgcgctactcatgtgcggtaatttcaatgtgctgcttctcgacgaaccgaccaaccatctggacctgcctgcgcgcgaggcgctggaacatgccctcaaggaatataaggggacgttgcttttcgtatcgcacgacaggtattttatcaatgcgctggcgggaaaaatttatgaaatagaaggcgggcgggtaaacgaatacgatgggacttttgacgaataccagggaatccaggagcaaaaagggcaggcagaagcggccgcgcccacagaaacggcgaggatagaggagggcgcggcaacaggggtaaacccaaaacaaaggcgcgcagaagaggcaaaacgacggcaaaagctgtccgaactcgaaaaagagctcaaggagctggacgagcaggaggaacgcttaagcgaagagatcgcacaaaaccccacggattatgaattgctgaatcaaaattgcgcgaagctggaggaactcaaggcgcgttatgatgtgtgtttggaggcatggatggcgctcgatgcagaaaatgaaaattaggggttgacaaaacgggcgtgattgtatattataatattagttagcaaacgctaactcgaaagagaagggaaagacctcctttcttttttacaaaagagttagcaaatgctaactaacgaacaacaggagcaggaatgcagaaatgggtacgcacaaggattttgaaaaaatactggcgcggcactgcgcgcccacgcttgcggggaagaagcccgcgagcctcgtgtccttcaatacaaatatggtagaagcggaaaagtggctctactggtatacgcggggcatgaaaaagcggggcttgtgtttttttaaactatgtgactgcgaaaaccgcaagctggtgctgatctaccatgagaaactgctcaaaaagacgctgcgcaaaccgaacatacgcgcttacctgcttggctgcggatacagggaaacttcctttgaagcgttgcttgggcatctggcgcagcgcgtgtgtgaaagcggggatttcccgcacgagatcggccttttcctggggtatcccttaagcgacgtgcttgggtttatccgcaacaggggcaaaaactataagcttgccggaccgtggaaggtgtacgccggaaagcggaaggcgcaaaagctttttgccagctacgaagactgcaaatgcgcttttgatgagctcatactgagcgggaaaacgatcatgtgttattaatttgttacctcccctaattttgggatgttcataacgaccttcaaagaccccggccgcatacctccggggtttttgtatgccatgaaatttactttattgtgttgctacttaccttgggatatattataatgtaatggatcgtaaaaaggaaaaaggtgaaactgacttgaaaattttcaactcgatgacaggaaaaaaggaagagttaaacccgctcgtgcccgggcagtttaacatctatgcgtgcggcccgacggtttataattattttcatattggcaacgcgcggcctttcatcatattcgatactttgcgccgctatcttgaataccgcggttacaaggtgaattttgtgcagaactttacggacgtggacgataagatgatccgcgttgcaaaggaagagggtattacggtagctgaactgggcgaccgctttatcaatgagtatttcaaggacgcgcaagcgctccatatccgccccgcaacggtgcaccccaaggcgacggagcatatcggcgatatcatcgcgctggtaaagaagctggtcgacacggggcatgcctacgaactgaacggcgacgtatattttgatacgcagagctttcccggttatggcaagctttcaaagcaggaccttgacgagctggagatgggcgcgcgtatcgacatcaacgaagaaaagaagaatccgatggattttgcgttgtggaaagcccaaaaggacggcgagatcgcttgggacagcccgtggggtcaggggcgcccgggctggcatatcgagtgctcggcaatgagcatgaaatatttgggggatacgattgatatccacggcggcggacaggacctcaagttcccgcaccatgaaaacgagatcgcgcagagcgaggcggcgacaggcaaaccgttcgccaattactggatgcataacggttatatcaatatcgataacaaaaagatgtccaaatcggcggggaatttctttaccgtgcgcgatatcttacaagaattccgtggcagcgcggtacgtttattcatgctaagcgcacattacctgaacccgatcaatttttcgcgcgagcttctcgcccaggcggagagcgcatatgagcggatccttaattgccgtgacaacctgaagtttatcatggcgaatcccaaggacattgatacggacgtgcaaaaaccgatcgatacggtcatggagaaatttgttgccgcgatggacgacgacctcaatacggcggacgcgatcggcggtatcttcgaatatgtaagggaactgaatatgctgtttgaaggcggcggacgcacgcaggacgcaaaagcggcgctcgaggcgctcgatacgcttcttaatgtccttggtatcgagccggacgagcaggaagagatcccgcgcgaagtgctcgatatggctgaaaaacgcggggcggcgcgcgcggagaaaaactgggcggaggcagaccgcctgcgtgacgaattaaaggctcttggctatgaagtaaaggatacgccggacggcgtaaaaataaacaaaatttagggggaacgtttttaaatggatggcgcttttggttttatgatattgttcaatatctttatcgcggtttatctgctctactacgcgatcaaaggtacgggtaaggtatatgagaacgattatcctgccgagatgaaggaaccgcatgccaagctgctgcggaaattctgctggatcgcgggcgtgccgcttttggtgctttccgtactcgaatacacggcaggccaggggatctcttcgatctggggtatcatcagcatcgtatatatcttaggatgcgtggtgtggtattttattgttttcaaagttcgtttcaaagaatacctgcgcgatccgcgcaaaaacgtacctaagaaataacaagcggaaaaaacgcggcgtttttggttgcgtttttttgtttataagcattgcgggaaagaaaaaatcaaatgtaaggagaaaaggggctatggcagcgttcgcaccggtacttgatgtcgtaacgacgtgtctgaatctcgtatccattatcatactcgtatggggcgtagtcctgagcgtgaaggattatttgctcgcgcatttgcgcagtaaaagtaagatagagcggatcgggaagctacaggacacaaaaaacagcctgagcggttacattctcctggcgcttgaaattttgatcgtggcggatatcatcgaaacgatcgtaaagccgacgctcgaggacatcatccgtctcgcggcgatcgtagcgatccgcaccgcgatttcttatttcctgaacaaagagatgagggattcagatctggctaaaacgcacaaaaaccagtaatggtttcagatattttaaagaaagaagacgatacaaatgagtgagaattgtacgcatgattgttcaagctgtggcgaaagctgtgaatcgcggcagcaggatcccaaggactttatcgaacggccgcacgagctctcgacagtaaaaaaggtgatcggcgtcgtaagcggaaaaggcggcgtaggcaaatcgctggtaacggcgatgatggcggtaaagctgcgtaaaaagggtcttgtaacagcgatcctcgacgcggatatcacaggaccgtccatccccaaaatgtttggcgttacggaaaaggcgacgggcgcgggagagacgatctttcctatctatacaaaagagggtatacagatcatgtccgtgaacctgctgctgcccgacgaaacaacgcctgtcgtatggcgcgggccggtcattggcgcaacggtcaagcagttctggacggatacggtatggacggatgtggattgcctgttcgtggatatgcctccgggcacgggcgatgtaccgcttacggtgttccagtcgcttccggtggacgggatcattgtcgtcacgtccccacaggagttggtatccatgatcgtaggtaaggcggtttccatggcgaacatgatggatatcccgatcatcgggctggtggaaaacatgagttaccttgcctgtccggactgcggcaaagagatcaaagtatttggggaaagccatatcgaagatacgtcgaaaaaatacggcctgcctgttttgggcaggatacccatcgatccgaagatcgcgcaggctgcggacgagggaaagatcggcgaaatagaaggcgggtggctcgatgcggcggcggacgttgtggccgcctatcaaaagggggagtaagaaatgagtgagaaatcagagcaggccaaggcatattttaaggaaggctataactgctgccaggcggttgtgctgacctatgcgcaggaagtgggattggatgaggaaacggcgcttaagatcgcggcttcgttcggcggcggcatgggtcagttgcgggaagtttgcggcgctgtgacggggatgttcatcgtggaaggtatgaagcacggttacacctcgcccacagataaggtaagcaaaaaggcgcattaccagcgcatacaggagcttgcggcaaagttcagggaagagaatggttccatcatatgcaaggaacttttgggtcttgccgaaaaaccgaaggaggcaaatccggctgagcggacgacggaatactataaaaaacgtccgtgcggagacctcgtggagtgtgcggccgcgatcgtagaaaaggagctttaaagggcagtaagcaacaggaaatatgaaaggacagccaaaagcaggctgtcctttttatgaataatttgtgcaacggttgaaaacaaagatgaaaattattataataaaaggtactatatattcggtatagattattatgtatgaggtgcaaaaaaattaagatcattgacatcacccaggaattgggtaaagatacgaagatatacgagggagatccgcacatccgcttagagaagttttttacggtggataattacgggtatgcggtttcgaaattgagtatgggctcgcacagcggaacgcacatcgatgcgccggcgcacgtcataagcggcggtaaaacggtgcgagagataccgcttaccgacctggtaggcgagtgcatcgtggtagaaaaatcagagatcaaaatacccaagggcacaaagcggctgatcatcaagggctctgaaacggccgaagcgcgcatctcggagcgccacgcgcgtatccttgtggacgcgggcatccgtatcatcggtacggacgcgctttccatcggcaatgacgcagtgcataagattttgcttgcggaggggatttgtgttttggagtccttaaagttaaaccgcgtgacgccgggggaatatttcctgtgcgcgctgcccttaaaaatcgatacggacggatcgccgatacgggcgtgcctgatcgaagggataggagaataaatacatggaggaatcgcggacgcaaaagggaagcgcgcttacgcgcgtttttgccgcaatcgcgacggtgctcatcgtattttcggtggttgtcgcctgcgtcaaggggatcgcgttcgattcctctttttataagcaggaatatgaaagcctcggtacggcagataagctggacagcggcggcgcggcaaacctagaccgcgcgaccgatcttctgctcggttatctggaaggcggggaagaaagccttgatctgattatggggacggacgagtgggggactgaatattacaacgaccgtgagaaagcgcacatggttgacgtgaaagcgctttaccaaaatgcggtcatctttatggtaatcgggttttcggcgggcggcgcgctgctcgcatattgcctgcttaaaaagaaacggcggtatatgcgtccggccttgcaaacgtatttctggacgacggtagggatcctcgccttttttgtatgtatcggcgtatgggcggcggtcgatttcaacaatttctggatcagcttccaccatgtattctttaccaacgacctgtggatgctcgatccgcagacgtcccgcatgatcgtcatgtttgaggagcagttgttcgccgatctggtggcgcgcatactggccgcgttccttgcgttcgtagtgggggcggcgacggcggcggggatcataaacaaaaggatggcaaagcatgaagggcgttaatatactggcaatcgaaacctcgtgcgacgagactgcggccgccgttgtaaaaaacggacggcaggtcgtttccgaggcgctgtatacgcagatcgcgatccataaggagttcggcggcgtggtaccggagatcgcttcgagaaaccatgtggcgaaattaccgcaggtagtggaaaaggcgatcgaagacgcgggcggtctggaaggcatcgacgccatcgccgtgacgagcggaccggggctggtgggcgcgcttttaacaggcgtttcctatgcaaaggggcttgcttatgcggcgaaaaaaccgttggtgagcgtacaccacatcgcgggacatatctgcgcgaattatatctcgcatccggagcttgagccgccgtttttgtgtctggtggtctcgggcgggcatacgcagatcgtgcaggcaaaaagcgagacggaatatgaaacgctgggccgcacgcgcgacgacgcggcaggggaagcgatcgataaagtcgcgcgcgtgctggggctcgaatacccgggcgggccgaatttgcaggagcttgcaaagcggggcgacgcgcaaaaatatgcttttccgcacagctttcggggagaggatcatctggatttttccttcagcggcctgaagacggcggtgatcaacctgctgcatggctttgaccaaaagggagaagcgtacagcaaagcggacgttgccgcatcgtttctaaagaacgtggcggatacgctcacaaaaaataccttcgaggcggcgcggcgtacgcatgcaaagacgctcgcagtcgccggcggcgtatcggcaaacgggcagatacgcgccgcgttccaaaaaaaggcggaggaaacagggatcacgctgtactttccggaactgaagtactgcacggacaacgcggcgatgatcgcgtcgtgcgcatattacgaatatgaaaagggaaaacgggcgggtcttgatttgaatgcgcagcccgtcatggatttatagcgaaaagaggtgcccatgcggtttaagaagttactgttgctgttacttgcaggcgttatgctgctggcgttttgcgcgtgcggcgaggaggaagcaggggaaacaggaacagggctgcccgatctttcgggcgtaagcatcgagggtctcaagatcatcgtcgatgcggggcatggggatacggacgtggggacgatcggcgtttcgaccggacgttacgaaaaggaagtcaaccttgagatatccttaaaacttagggaagccctggaaaaagaaggcgcggcggtggtcatgacgcgcgaaacggacgaacccatcgcggcggcggaagaaacggatatcgcgaagcgcaaggaagcggatatgcagttgcgcgaaaagatcatcacggatgcgaacgcggatatgtatatcggcgtacaccagaacagctttgaggaggaaagcgcctgcggaccgcagattttttaccatacggattccaatatgggcgcgttgcttgcaaagtgtatccagacggtgatgaacgagcagcttgatcctaaggaaccgcgtaagcctaactgcggcaggtaccggctcttaaagccgggcaaacagccgagcgtaacggtagagtgcggttttttcaccaatccggaggaggaaaagaagctgcaggatccttcctatcaggaccaggtggtcgcggggatcgtggacgggataaaatatttcgagtggagtaaagcgaatgctgggtaagttgcaggacgaatgggtattgagcgaggaaaaggcggcgcaaatggcgccgcttacgcttgcgtacatcggcgacagcgtgttcgatttgtacgtgcgtaccaaatatgccttgaacagccggaagaatgcgggcaagctgcattccatgagcataaagctggtgaacgcgcgcgcgcaggcggcctttgcgcacgggtggatagagcggttcacggaagcggaaaaagaggtgttcatgcgcggacgaaacgccaaaagcccgaccatgccaaagaacatgagcatcgcggattataagtacgcaacggcaatggaagccttgatcggatacctgtatttgagcgggcaaacaggccgcgtgaacgaaatactgggcagtttggaatttgatctataaccttggggaaaagaggaacaagatatgccgaaaacaacattaaagacagtgcttttgatggccacgcccgatccggagctgatcgtttccatgggagcgaagctgtgctattcgcgtgctgatatagagcagttgcaaaaaacggcgaaaagcggggaatttattgacaggctcacgcagatggggcatctgtcgcccattgagcacgcgtccttttcgtttggtgtggaaggcgtatcgcgcgcgctgctggcgcagatcacacgccatcggctggcgagtttttccgtgcagtcgcagcgctatgtgaaccagagcgaaaaaaaaggcgagttttcctatatcataccgccgagcatcgaggcgctgggcggcgatgcggtggcgaaatttgaaaaacagatgcagaccatgcaggaatggtacgacgagtgggtactggccctcggcgcaaacggtgaaaaatctaacgaggacgcgcgatttgtgcttccgaatgcgtgcgagacgaaaatgatcatcaccatgaacgcccgcgagctgctgcatttctttgagctgcgctgctgcaacagggcgcagtgggaaatccgcgagctggcgtggcagatgctcgcgctggtgtgcgaggccgcgcccgggctttttaagaacgcggggccgtcgtgcgtttccggcaaatgtgcggagggccgcatgagctgcggtaaaatggaagaagtccgcgaaaaacaaaaaaaactgatggaggggattacgcatggatgaacaaagggaattcatcatcgggcgcaacagcgtacgggaggcgctccgcagtggagaacagattgataagctgtttttccagcaggggcttgccgacggcagtattcgcgagatcatgatgcttgcgcggcaaagcaagcaggtgatcgtggaagtgccgcgcgcaaagcttgacgaattgtgcgcggggatgggagcggaagggcacaccggaaaccatcagggtgtcgtggcgcaggtgccggcgttcaaatacagcgacatggacgatatttttgcgctggcgcaggtgcgtggagaagagccttttatcatcatattggacagtatacaggatccgcataatttgggcgcgatcatcagaagtgcggaagcgctgggcgcgcatggggtcattatcggcaagcggcgtgcggcgtcgctcacgacagcggcgtttaaggtatcgtgcggcgcagcgcaatatatccccgtcgtcaaggtgacgaacatcaaccatacgatcgaggagctgaaaaagcggaatgtctggaccgcggcggcggatatggacggccagccgctttcaaagacagatttaaaaggggcgtatgcccttgtgatcggcggggaatccgaaggggtcgcgcggctgacaaaggagctttgcgatgttgttgtaaagatcgagatggaggggcgcaccacgtctctgaacgcggcttgtgcggccagcatcatgatatacgaaaaacgccggcaggatcttgcggcgaaatgaggagaccatatcgttgggcgaaaacggattgtcaggtaaagcgggattgaataatacaagcgggcagggagcgccgtattcggccctaagcgacgaggaagtcgttcttttggcggatgaagagccggacgccctcgaatacatcctgcataaatacaagaattttgtgcgctccaaagcgcgctcttattttttgatcggcgcggataaagaggatatcgtgcaggaaggcatgatcggcctttataaagcggtgcgggattatgacgcggagaaaaaggcgtccttccgtgcgtttgccgagctttgcgtgacgcggcagatcatcacggccatcaagacggccacgcgccagaagcataagccgctcaattcgtatgtttccttaaacaagcccgtatacgacgaggagtccgaacggacgctggtggacctgatcgcggcgacgaagatcaccaatccggaagagatcattatcgacaaagaagattacgccaacatagaagaagagatcacgaaaatgctttcgggcctggaaaagcaggtgctggggtattacctgcaggggaagtcttaccaggagatcgcgcgggtcatggaccggcatgaaaaatccatcgataacgccctgcagagggcgaaagggaagatcgataagttccttgcctcggcacggcccaaaacttgacaaagtatagaatttctatataatagatgtcatgttaaaaatggaaatttgtgcgcttttcaggcgcgcaacaggaggatataacgaatggcgaatgatgatgtagtactcacgcatcaaggggtaaaggaactcgaagaaaagctggaatatttgaagacggtacgccgccttgagatcgcggaagaaatcaaggtagcgcgcgcttttggcgacctttcggagaacgcggagtatgacgaagcgaagaacgaacaggccaagatcgaaggcgagatcgtgatgctcgaaaagatgctcagaagcgctacggtcgtcgaccaggacgacgtagacgtgcagcgcgtcaacgtgggcacgacggtaaaggtttttgataaagaatttgacgaagagatcgaatatatgatcgtaggctctgcggaagcggatatggcgcaaaacaagatatccaacgaatcacccgtgggacgcgcgctgcttggtaaaaaagtgggcaacacggttaaagtggaaacgccggggggcgttgtaaggctgaagattctcgatatccataggtaagaaggagcggaaaatggcagagcaggaacaaaatacgcagcaggagatgtccgagatcctgcgtgtgcgccgtgaaaagctgcaggcgctcaaggaagaggggaaagacccctatgaggtcactgtgtttgaaaaaacgcattcctcagaggatatcctcagtaatttcgatgcgcttgagggaaaagaggtattcgttgcgggcaggatcatatctaagcgcgtgatgggcaaggcgagctttttccacatcatggacggacgcggcaagatacagatctacgcgcggcgggacgtgatgggcgacgagccgtacgcggcatacaagaaattcgatatcggcgatatcgtggggatcacgggcgaggtgttcaaaaccaacgcaggcgagatctccgtgaaatcgagcacgataaaactgctttccaaatcgcttttgccgttgccggaaaaatggcacggccttaaggatacggacttgcggtaccgtcagcgttacgttgacctgatcgtgaatcccgaagcgaaaaacgtattttatgcacgctccaaaatcatcaagggcatccgcgatttcctcgatgaaaaaggatatatcgaggtggaaacgcctgttttgcagacgagcgcgggcggcgcggcggcgcggccgtttatcacgcaccacaatacgcttgatatcgatatgtatctgcgcatcgcgacggagctgcatttaaagcgccttatcgtaggcgggtttgaacgcgtatacgagatcggccgtattttccgcaacgaggggatggaccccaagcacaatccggaattcacgaccgtcgagctttaccaggcttatacggattacgaaggcatgatgaacctatgcgaggaactgttccgctattgctcggggaaggtgaacgggtcggatgtgatcacctatcagggaacacagatcgaccttggtagcccgtggaagcgtatgagcatgaatgaagcggtcagggaatatgcgggcgtcgattttgccgcgtgcgagtcggatgaacaggcgcgcgaactggcaaagaaagcagggatcgcctttgaaggggcattaacgcgcgggcagcttctcaatgaggcgtttgagcagaaggtggaagaaaacctcgtgcagccgacgtttatttatgattatccggtggaggtatcgccgcttgcgaagaaaaaggcgggcagcgactggctgacggagcggtttgagttgtttattacggggcgcgagctggccaatgcgttttcggagctcaacgatccggacgaccagcgcgaacgctttatggagcaggcaaggaagcgcgagcagggcgacgacgaagccaacatgatggacgaggattttgtcacggcgctgcagtatgcgatgccgcccacaggcggcatgggcatcggcgtagaccgtatggtcatgctgctgacggattgcttcaatatccgcgacgtgctgctgttccccacgatgaaacccttggtcaagcagagtgaacaaaaaagctgaaaatcatgcggttttaaaagcttttgaaggcttataaattgagttgaaagatgggaaaatatctttagttatgcagagtgggtatgctgaggagtaatgattgctgtaaatatatttggaagactatcgtaggtggctcggaaaaaagcttcgggacgttatctaagataacgtcctatttttatttagtaaacttatagttgggaagaaaatgagtgaataaaggagaacaagaagggggtgaagaccttctgcgtatagagggggttaatgcaaagggatatggttgtatccctaaggccgtgatgaaagacaggcggcttacactttatgcaaaggcaatctacgcgtatttccgttcctatgctggatcgggtaatagggcatttccgagtagggctactattttgtatggtttacaaatcaatttggtacttgaccattctgatttagcgtatatgctaaataatattccaaaaaatagttttgccagtcgagaagaatttgaatgctttataaccgaagcacaggaaaggacgccatgcataatacaatttcagtttgccattctttgtttatgaaaaagtgtatcataaagccaatctatgaacaaatcgactccgttcggcttgtcggcggcactatgttttctggcatagtcctccaaaatctgcttttgagatgtactatgtaaagggtggtttctgccacctacaacgaaatgactggcggctcatttgtggtagaatggcgacaggcagaaaggggcgataacggacagcacccgtcaaggttaaaatgaacgggcatacgcccgtccttgactgctgctgaccgccctgctgatgggcagacgagaggtgcgacagcaaagagtgctgcgcacctctgattatgatttcgctactacattaaaagttgttgggtttatactcatattagtatatctggaaactctggacggtgcttatggagaatacaaagcaagtcttttaatgccgttttacgaaggtctccaccgctacatactacctcaaatcggtcatcacgaagcatagtataatttcctgtttcgtgaaatccgtttctgaggtagaaattttttctacgaatccgttgctcattgttttctgcattttcgtcgattacttcaaaatccaatacaagttgcaattcaggataaagttccatcatcttttgtataattgcaccgccatagccttttgagcgtgaaggactatctattgcaataaaataaatatatccacattcctcatttttcaaaagaacgacaaaaccgacaggcttttcattatcatatattccaagtatatcggtgtttgtatgtgtggcaaaagcaaaaatttcatcaaaactcattcgttctgaaagaggaaaggcttcattgtttatccgctcgaaatatttcctatctttgctgtccggatttaatctgattagttttaagtgcaattttttctccttagaaatttgtgatttatcggactgtttgaattcctttctaattatgctctaaaagcaacaaaaaggcaatgagtgcttccaaagttactggaattatcccgaagggcgcacttactcaccaccgacaaagtcggcggtggtactgcctaacggcagtcgtgcgatctacgaggagaacggggcaacggagtatatccataccgatctcagcagtgcacatatcgcttttcagtgcaattcttcacctttgtcggaaagtactgaaactgaccgaaaaaaattttttaagtaaaaatcccccttgacaaatgttctcttggctttctatcgatacgctttctctaactcgctcgtcgttgtaggaaacgcgctcattcagggatattctctctgccagttgctttttcatggtgtgcaaccccttcttctttattgtagattacattagcattaagatagtgttaaagttaagaaaggtttattgaaaaatttgctgattgggttacaatagcattacggatttcgcaaagagatttgcgaatgaagatattatttcgccggaccgccgaatccggtggacatataggagggaaagattgatatgattccgtgtagaaggaaggagatactggaaaccccttctgttcagaggttttctgaggtaaagaatttcctggcgagcagacagatcccatgtgattacagcattatttattgcgatcatacgggaagggcaggcgagatgcggcatttatatgtacgcgacgctgactacaagagagcgtgtgaggcgcttgcggtgatgcatggagcaggatgattctctggcatcgatcataatcaatcaaataaaaatggaaatgtatttatacatttccatttttatttttaatcacattttatagttctgtcacatgtactgtatcaatcatcatatcccagacgatattccatagattcttcagcgtaatccagttcgttttccagatgctcaagctggcgctctacctcgcggtaatcttcccgcgtcagtgcgcccatacggaaatcggcttcggcttgatcctcagcaaaatccatatcgttttccaattggtgcatatcttgtttaattgtcccgatatcctgcatggttgcactgtccatacgggaagccaactcagttacgcgtgtttcaaattcgctgattccatagtctcctaccccttttgaagcgttctgtgctggagcatgagttgctgtcggagcggcagaagcagttgtgtcaggggcggtggaattggcggaagactgaggagcagtagtttgtgtaccggacttgatcgtgtcgagctcagatgaaatctgatccagttgactttgaatcgcagagagattgggggatgcacaaccaatgaatattacggcagcaatggctatgcagcacaccagaataacgaattttttctttttcataatcgaatcctcccatgattgaatattcagcaggctaatatctgcctgctgtattttatggctttattataccagatcaaaatgaaaacctatatgtattatatttaacagaaaaaaatgtagtagacaatagtctgagaaaaaacggatgttgactggaatcggccccgaaaatacaatgggaccgattcgctttttgatgccacgataggcaaaaataatagcaataaatgtaaatatttactcctgtaatacgaattttgacaaattgcgtaagttgattttgatcctgcttgcggtataatatttaatgaaaaaattcttattatgagcatggaacgatatgaagagacaatatcagtcagccaatgtatacgatgcgctgcaggaacgtctggaatatatttttcaagaatttgataatatctatgtttccttcagtggagggaaagacagcgggttgttgttgaattttgtgatggatttcaaacgaaaatatcatccggataggacggtaggcgtattccatcaggatttcgaggcacaatatacgctaaccacgcaatatattgagcggacatttcaaaatttacaatccgaaacgagggaattatactgggtttgcctgccaatggcgacgcggacggctctcagtagttatgaaatgtattggtatccgtgggatgataccaaacaggaattatgggtacgggaaatgccggattatccatacgtaatcaatctggagcatccgtttacgcattaccattatcggatgcatcaggaggatcttgcaaaacagtttggaagatattataaggaacaacacggaggcagaaagacggtatgtctgcttggaatgcgtgcagatgaatccttacagagatatagtggatttctaaataaaaaatatgggtatcaggaagaatgttggatatccaaacaatttaaaaacgtgtggtgcgcctcgccgatgtatgattggtcggttagtgacgtctggactgcgaactatcggttcggttatgattacaatggcctctatgatctatattacaaagcaggcttgaaaccagatcagatgcgggttgcatccccgtttaacgatgccgcaaaagagagcctgaatttgtaccgggtgattgatccggcggtctggacaaaattggtgggaagagtccgcggggcaaactttggagcaatatatggaaaaacgaaggcgatggggtaccggagtattacattgccggaaggacacacttggaaaagctatacatattttttgttggcgacactgccaaagagactacgaaataattatattagcaagttcaatacgtcaatagaattttggcacaaaacgggcggaggattgtcagaagaaaccatcagggaactgaaagagcatggctaccgtattagaagaaacgggatttccaattatacgctggataaaaagtcgcggatcgtatttaaaggaagcctgcccgaccatacagacgatattaaaagtacgaaagatgtgccaagttggaaaaggatgtgctattgcatcttaaaaaatgatcatacttgccggtttatgggctttggtctgaatcggcaggaaaaaattcgggtggacaaaatcaggaaaaagtatggaggctttgttgatgggaagtaaagagtttagcagtccggcttatcatttgattccagtgccggtgggaaaaattattcccaatacttataatccaaataaagtggcaccgccggaattgcgcttattgtacgagagtattaaggaagatggctataccatgcctatcgtttgttattatgcgaaagagaaggatcgatatgtaattgtggatggcttccataggtatcaggtcatgttggattatccggatatttatgaacgggaacatggaatgctgcctgtttccgtgatcgataagccattgtcaaaccgtatggcaagtacgatacgtcataaccgggcgagggggtcccacgacgtcgacctaatgagcaatattatcaaggagctgcatgaaatagggcggtcagatgcatggatatccaaacatctgggaatggataaagatgaaattttacggctcaaacaaattacagggcttgcagcattgttccgagatatgcagttcggtcagtcatggaagccaatcgaagaataaagcgcggaggaaaagccaagcccggaatttaggaaagggatattgacgtccctgtggctaaggacttaattttatttggaagttaaagcatgaactcgatgctttattgtgtttatcacatttatccgcatccgggcttgtgcaccaaaatgtaaatatatcaggttgcataggcgagaagaggtgtcgtggattcatatggctccgcctatgcaaaccaataaaacacaatcaaatcgtatcatagtgtatttatctgtgcaatggaaatacgcattaagattatgttaaagtttccctgcaaattgtatatagaaaaagtgtactttgcctattctaaagcgagttctcattggtggatatacattttgaagtatttgatttcatgaaatggctcgtgtaaactactgctaaagttcagcgttaaaaaggtttgaccagaaatgaaaaaagtgaatattcctcaaagaaaatttggaaaatttggagttgtagcggtatgtattcttgcagttgtatttttttgttttgcggcagcaggtttggttcgtttagatgctggggtacatacggtaattaattatccgtatacagtgactctatctgttaataagacaacgaatgcaatgtctgagcttagggtatggacagagcaggcaattagatatccgagtgtagaaaatgtggaggaagcagaccaaaaactctcagaaatggttcctatgctggaaaaacatgtaaatgagatcaaagagaattatctcggcccgcaggaagatatggaagaaatgcaaagtattgtagaagaaatactcatgatgcagcagaatattcttgatttgcaaacagggagtatggacgatatatcgccggaaatgctggattccctgtatgagcctttctttgaagtaatggatcgtattgccgcctttgctcaaaataaaattcttgaactcagacgcgaagcagataaaacgatgcaggggaatgtagccctcatggcagtgttggtatctgctatgattgcggtggtagtatactcacaattttgcgtaaatagaaaacaaaaagagaatgaacgatatcaacaggatctgagggaaactctagcggctgcagacagggtcaaccgtgcgaaaaaggatttcttgtcacatatgagccacgaaatccgtacgccgcttaatacgatcattggaacgactgtaatcgccgctcattctatacaaaatcaagagaaattgaagagttgctttgacaagatccgcttttcttcaaagcatttgctgaatctcattaacgatgtattagatatgtcggccattgaaagcggaaaactcaacattaatcaggatgaatttgatattcaacatttgctgggttcgattacggatctcttttctggacagtgtcagaaaaagggagtcaattttaaatcggttatctcagataaattacccgaaaagttgaagggcgattccatgcggctgaatcagatattgataaatctcctgtcaaatgctgtgaaatttacgccaaaaggcggagaagtagcgttgacggtagtacaggaagaaaaaaagaccaacagcgtaattctgcgtttttccgtaaacgatacaggtatcggtatggatcaggagtttcaaaagaagatattcgaagcgtttgaacaggaagatgggacatcggaaaaatacggtggttccggactgggaatggcgattacaaaaaacattgtagatatgataggaggttcgatccaagtcaaaagcgcattgaggcaggggacctgttttacagtgattttgccgtttctgttactggatgaagcggaaatgaagagaaaggcaactatcccggatttaagcggactgcgagttctgataatggatgatgaaacgacctgcgagcatacggcgctgatgcttggtaaaatggggatagaagcgcgatgggcgttatcttataaagaaacgattgaggcaatagctgaagcgcacgaagcaggagaagattttgacgtatgtatgattgcatgggatatgcccggcatagacggttccgaatggataagccgtattcgtgcatacgaagaaacggatcatgctctgatcattcttgcgacggcatatgactggacagaaaacggtgaagaggcgctggcagcaggggtaaacgcattggtttcaaaaccaatgctcccgtcgcctgtctatgatatattgatgagtgtaacaggaaaaaaggcagaacaaaacaatgccgtggagtcagactacaagttgaattttgcaggaagaaaaatattgttggcagaagataatgagatcaaccttgaaattactacagaacttctttcctataacggcattgaggttacacctgcaaaaaatgggaaagaagccttggaaatctatatgaaaaatacagcaggaacttttgacgcgattttaatggatgtgcaaatgcctattatggatggatatactgcgacacggaagattcgtgattctggaaaggaggatgcctgccaaattccaatcattgctttgacagcaaacgcttttgctgaagatatggccgcttcgcgtgaggcaggcatgaacgatcatatttctaaaccaatagaccttgattccctattgcatagattagaacgatatttttattgaaagggcgaatggcgtgtgttttttgccaatcaaaagaatttccatttgtaagaccgaattgataaaaggacgtttccagggaatatcacggggtatagaccttgcggaggcagtatggcagtattatgcaaagttacattatatcatgcttatccccaatcaaccgtaaagaaaatattatttttatacaagtccatatgagtcgcgttataggcgtgatatttcagtgcggatttgctggatcgttttccaaacagcatttttagaaaatgttccatatctgccgccaaggtcatgttcttttgcagccgcgccgccaataccggtttgtatccaaccagagatgtgcaaggtatctccctggtaatccaaacggatatattgcatggcggcaagcaatccaaaacattttttccagacataaccgtccctgtaaccaacctcatgataattggcggaagacaatattttacgggcggcaatatccgtaagcaccgggcttttttttatttttacatctacataagttctggacatatccaccacatcctccgtttcatgaaataagatgttaattccatcatatcactgcccaaaaagacttcaagatggcaatcgtaagtttaacgaattcttaatgccaattttattgaactttattaaccgctatgttatgttttaattacacgcttgaaatcacaaagcagggaaacatattccatatgatacccactttctctgtatggaatttcaagcgtttttgtattaagcccgatcgtccctgatgatattttgtaacttttgtagagaaggtatatttattcatttatcatattaaaaaagagagcgaggaaactagcatgaaatgtaatcagtgtggtcaggaatacagcgataattataatctttgtcccttctgtggagcagtcaaacctgttgcaacgcctccgtctccacaaggcggacaatatcaggccaatcaataccaacagccgcctgtttcgtctgttcaggaacagcaaggaaatgcaccgatcttattgacaacatgtgagcaaatcgaagggaaaagcttgattccactcggactggctacaggaagcacggtgcacagcgttcatctcggaaaggattttctagcgggatttaagacgttggtcggcggagaacttacaacatatactgaaatgatgcaggaagcgagaaaaattgcaaccggacgaatgattgcagatgctaagcgtatgggggcagacgcagtggttggcatgagatatgcttcttctactgttacgcaaggagctgccgaatttgttgcgtacggtacggccgttaaatttgaatagatacgatgcataaaaggggagcctatgctccctttttatattgagaaggaaataaaaaagcttttatgattgccactgatatagaaaagggttctgcaataaaactcctcgagagattttgtcgttatggtcaagaagcttgaacaatacacttattcatcgatatctgatattaagttttaaatatatttgttccaaatcggtgacgactctctgaaacgaatctttcaagcgtttttcatatcgaaataatgatatggaatagtacaatgttgaagaaaacgattactttatgtggaaaatattacagttattatccagtggaggccgtgagattggaacgtgttcggcagaagccctgcattacgtgaagggacaaacctgaggcaaaatgttatggatttttaatgggaaaatgtttcatactttttccccggaataaataggattggggaaggaatattattagaaaaggcggctggcgtaggtgcgaaaggccataaaaaagtatgtgagtagagaggccatacagttttatgctgtgcaggaaaatcttttgcaggattttccaatggattggaattcgaagttgcttagtggagaccgtttcaaaaattgtgcaaagctccgaagggatgtagaatagagaacatcccatccgcaaacactttttttaacagcgcattcaaatagcggcccaatcgtatatggtaatgtgaaacaagacgcaaaacgccgctgctacatcggaccaagttgacctgctgttatcattggttttgcagcgcatcggcttgcattgccggttgagcaaatcgctcaacatagaatatgcactactacaatcaggaggaagtaatattgtgagcacggcgctacaaaagaatgtatcgccgtgttattgcattaggagcttcacgcaatagtatctgaggggattgggaagaagaaaaagtgagcgtacaattcgcttatgtggtcaaggcattcctttgtctgattcctcacttagaccaagagggattacctatgcttgttcttttttcttctgccatcataccacgtagctgccccggcgtatatccatagacattttgaaatgcatggtaaaaatttgctttgctgtggtatcctacttctgccgcgattttccccactggaagagaagtcgaggtcaaaagttccaccgcgcgttctattcgcaccgcgcgcaaatattctgaaacggattttccttcggtcagccggaatccttcctgcaatttatttttattgattcctaccattgaagagaggacaggaattgtcgggggatgggataaattcttttttagtatctgttttgcctgttcgagcggcagacggtcttcacgccggaacgagacgcacggttttgtgcggctgcgatccatatagtccataatcattcctgccgcagcaagcccctgtccgcgcaggaaaaggtcgaatgctgcaccggagagggaacaatcttcaatttgccggcacagggcggataatgcgggaagaaacacggtctccgcattcagcaacttatcgcaaagaggccagaaatcagcggggagagagatattgttaagagtgaagaaatcttcaaaaaaatataacgcagtaaacgtaagatgggccccttttggtacccgcataaaaaacggcacggtggaaatgcaaacataaaaatgaagccctgcgtccagcgtacgtttttcatctctacgccgataggtctctactgcgtctgcattgttgatggaaacccccatatatttttgccgaagctgcgtacggctcaggtatccttcgtgtatcgtaaggtctgattttgcaaacatcagggctgtagggtccccgcacaattctacacgtccgcacgcctttgtaccgcaaccgccggaaaaatggtaaattacgcctctttgggtgtcttccctgacaccacccaaccgttcgtacaatgtatatacatctttcattgaattggatacgatcattttcttactccgtattattttggcataagccgtattgttttggcacatatttttcccgcctgttttttatcaaacgctggaaaacaaaggcgatgaacgaattatcggccttttggagggtaccgttccaaacacagaaaaggcattgcctgtaatatgattttatgctattctttcaatcggttagcttaaactaactatggaaaaattatactatgattcgattcgccggtcaaggatggctgcggcgggaaaggatgggtatgtacaagcaaaagaaaaatacgattggcagggtcttttcaatggcgtgctgcccgaaagggaaatatacgatcggcattattttgtcagcaggcggaatcctcttggccgcagtaccgttttatgccatttaccggatcgtggagggattcctttttgcggcagcccaggaaacggtttttcaatcagcctctgcttttacatgggcgggcgttacaataggcagcattgcagcagggattggttgcacgatcggcggaagctgcctgtgccacgcgtcggtttttgatgctctttaccgtctgcggctgcgtatcatggaacacatgggaaaactaaatatgggattttttactgatggacgcgcaggcgctacgcaaaaaatgatggaagataatgtcgaaaaaatggagtcaatcatggctcatacgtttcccaatgtggtaggagccgccttattgctggctgcgcttgccgcgctgatgttttatttaaacgtatggctggctataacggttttcgccgcacttggaattgcattcgccattcagttttctgcttttggcgggagccgcggacaaaaaaactgggcgaacctcaataaaacggtaactgaccttgacgcttccttttcagagtatgtatcgggaatggaagaagaaaaaatattcggccattccaaagcgatcgcttccaaactgacagcattgattgaaaagacccgacattactgggccgtttacttaaaacgtgttactcccatttttggagcatacaaaacaattaccctgtcgcttcttgcgtttattcttgctgccggaacgattattgtcctaaatcatcctggcgatcaggaattggtaagccagatattgacgttccttatcattggtccggcggctataaacccattgatggaacttgttgagatgggctccgatttacagaatctttccgttaaaatggatcagatcgacaacgtattcgattgtgtgcctatggcggaaccgcagaacgaaaaaattccaaagggctcggatattgttttccacgacgtatctttttcctatcagcctgcatctgatccgctcaggcgaatggcgcttgacaatgtcagcatgaaaattccacaaggaagttttgttgcccttgtagggccttcaggcggcggaaaaacgacggcggggcaattgcttgcccggttttgggatatcgaaaaaggttcgatttccattggcggcatcgatctgcgggatatgaagacagggacactcatggaccaggtggcattcgtttttcaggatacgcacatttttgcacagtccgcgtttgacaatatcgcaatgggacgccaagcgagccggactcaggttgaagaggctgcgcgtgctgcacgttgtcacgattttattgccgcgcttccacaaggatatgatacgcgtctgggcgatggcggacacaaattatccggtggagaagcgcagcggatcgccattgcgagggcaattttgaaagatgccccgattgttgtgctggacgaagcgatggcttttacggatgcggaaaatgaacttgcgcttcgccaagcgatggaggagctgctacagggaaaaactgtgctgatgattgcgcaccgcttgtactccataaaagatgctgatcatatattcgtcttatcggaaggaaaagtagcggaagaagggaaacatgggctcctattggaaaaaaatgggctgtatgcccatctgtggaagatacaaagcgaaagcgaacaatggagtatgaaaggagtcgctacccatgcgtaagatgatacaacaatttacgtttcaccgccccaaagaattaatcgcgcccactgtatggctgtttgtatctgaggtgtccacgctggttcccgctattttggtctttttcggaatatatgtgttcggcgcagctttttttccaccctatatactggatacagggagcctgatccaattgtctgtcgccgcgcttgtattttgcgccttgcaatatgtcattgaattgatctcctattggaatacttatttcagggcttatcgtgacacagcgaaaaaacggattgcctatattaaaaaactgcgcacgttacctctcggattttttacaaaaaaagaatccggggagttaatcaattcgtttgggaatgattttgcaaatgtcgaatatacgatgtgttattggctcccatttactattgcatcgagtttgctaatggtagtattcgccgtttggatggctatatttgactggcgtatggcaatcgcagcttttgccttgcttccggtgtgtctgctgatgaaccatttcgcagggaaaataaaaagcaggaccagccgcaaagtcttggaagcgcgcgcgaaagccgctacccagttgaacgaataccttcatggcatgaaagaccttaaggcctaccgacaagctggccaaggatttaaacagcttcagaatgcatatgacaatctaaggaaaacgaccatgaaagacgaacttgtggccggcagcctgggaaatatatgttccgtgcttactcaatttgtcgtcccggttatcgtggtatccggtatgtatatgcttcttggcgggggactgcatatcctcgattatatagggcttatcattgttgcaaccaagctctcatctcctatgatgatgttggtaacgagccttggcgcgttgcgcggcatggctccatccggcgaacggctggattccgtgatggagacaccttcacaggaaggcagtcagacggtggcaaacgtggatgaatattgtttcagggatgtcgggttttcgtatggcagtgaaaagaacgtgattcactcagcgaactttgatatcccggcaggtcggtttactgcgctggtaggcccctcagggagcgggaaatcgacattgctccggctgatggcacgattttgggacaatcaggaagggatgattgctgcaaatggacgggatattcgccagattcaaccagacaacctgctttccaatatttctatggtaatgcaggacacctacctgttccgcggaaccatacgtgagaacctgtgtttcggtaaagatattccggctgaacaactggaagaagcctgccgaaaagcaagttgccatgcctttatcagtaaactgccggagggatatgacacgatggtaggggagggcggcgccactctttccggcggggagcggcagaggatcgcgctcgcaagggcgttgctcaaagacgttccgattttgcttctggacgaaccgaccgcttcactggatgcagataatgaggccttggtacaaaatgcattggacgaaattgcaaaaaacaggacggtaattatgattgcacaccgcctaaaaactgttcgcggagcagatcaaattcttgtgattgaggacggaagcgttacgcaacatggaacgcatggcgaacttctggaacaggaaggactgtatcaaagattatgggcgattcaaaacgaagcccaatcaatacaattcaaacatatggaggaaaaatgaaatggaaatctcaaaaagaaaatttttaaacttgaaagaacttgtaacagacgtgctgctttctgtcttgatgctagtgctagcgttaatcattagcgcgccgtttgctgcaagtatgccgcttctttattttctcgtacccggcctggctggaatcctatggggaattatctacgtggtaatcattgccaaatgcccgcatccaggcgcgcagatcttccccgctcttatttacggattgtactttctgttgtctggcagcgtctatgtctttttgttctttgtaatccttgctgtcataaacgaacttattatgctgaagggcgggtatgaaagccgttggcggccggctatccccattatccttatgggttgcctgaatgcaatgggatcaaccctgacgttattgctgtttcgggatagcatggtacaaagctatatggcaatgggtatggatcaggccgcagcggatgccgcgctttcctcagtggaaggattctggctggcgccgcagaatattgcgcttgctctggtatgcgccgctgcgcttactttcgtcggttacctcttaggcagaaagctgatgaaaaaacatttccgcccggctggtgctgcataaatccatgaataacgaaaaaaaacttctcgatccacggacttacctgttcctttgccttgccagcataacggcggttatcgtgatccgaactgaaacaagtcttgcctttctttttgccgcttgtatggttatgcaggcaatgtgcggcaaggctgtccggattccggtttaccttgtcggatatttgtttttgctttggctttcctggacaggcgtacaattattaggagacctttctaccttttctattggtagcgcgctttccaacattggcattttagggaggcgggcgatgatcccgctttcctttgccttcttgatcggggaagcgcccaccggaagtttgctcgctgcatttcatgtgcttcatatcccaaaatccggcggaatcgcggttgcggttatactgcgtttttttcctacgcttggagaggaatatcggtgtattcgcaacgcacaaaaattccggggcgttggcgtcggtttttggaatacactgacacatttgccctcgacgctggagtatatcttggtgcctctgattatgcgtactaccaaaatctcggatgaactatccgcttccattaccgttcgtggcgtgcggtttggtggtgaagttgtaagttaccgccctctttgtttttcacggaaagatattgttttatgcgccggatacaccgtagcagtcctcttgtttgcgtttctcgataaagctggattgggaggcctatgatgattgaactgaaaaatatttgttacgcctatccgggtactcccaaaggaaccggacaacttcagggaatcaacctatctatcggtcagggagaatgcattctcttatccggggtgagcggctgtggaaaaacgacgcttacacgtgtcctgaatggactctgtccgcaattttacgaaggagtcctcactggagaataccgtattggcgaaagggatgcccgaacgattccgatccatgaattgggaaccattgtggggagcgtgtttcaagatccccgcagtcagtttttcgcgacaaacacaaccgacgaactcgtattgggtatggaaaatattcctcttacgcgtgaagaaatgcaccgcaggacggttgcaacgacttcgcttttggagatcgaacgtttgatggaccggcggattttcccactatccagcggagaaaagcaacgcctcgccattgcctcggtttgtgccatggagccgaaagtactcgtgcttgatgaaccctctgcaaaccttgacagcgaagcgatacggcatctttccattctgttatatcgcttaaaggaaaagggatgtacgatcgtgttgtccgaacaccgcttttcctatgtacgtgagttgtttgaccggctggttttcatggagaatggaaaaattaactgcattttgagtcgggacaaggcgctttcccttactccggaacagcttaggacgatggggatacgcgggtttgatgaaccgaaactcaaaattcgtggaactgctttggaacaaggcgatgcagttcttcgcgtacaggggatttcctgtttccggagcggaagccaaatattagatgatgtgtcattccacgtacaacgggggcaaattcttgctgttgcagggcagaacggcgcgggaaaatctacattatgtcgcgccgtgacaggtctttaccgttcacagggggcggttgaggatgagggacggttcctccggcggaaacaacgtaccaaagcttctttttttgtccagcaggatgcagattatcaactctatgcgcctacggtcgaagaagaattttatatcggatataaattcgatccgcagcgccgcgaaaaaatgcaaaaggcactgacagcagtagggctttgggaataccgcgagcggcatccgatttccctttcgggaggtcagaaacaaaggcttttattagcgctcgcctctgtcagcggtagacgtattctggttttcgatgaaccgacaagcgggcttgatggtcataatatgcgccttactgctggtattttgaaagaattggcgagtcaggacaactatgtggtgcttattacacatgatatggaactaatcgaacttgtggcagatagtatcctatatttatccggtggaaaaatcgtttatcacaaaaaattataagaatatcgcgaaaagcggcagttcgggataaatttcgtttatccttatctgccgcataacaacctgtcggaggtgcattgatatgacactgcgtaaatcgggcgaggactatctggaagcggtgtatattttacggcggaaatatggggcggtacgctcggtggacgtggcgcggcatcttggggtgtcgaagccgagcgtatgcaaagcgctgggtatcctgcgcgattgcggcctgctcgtaatggacgggaaagggtacctgcatctgacggagcagggcaaagagcaggccgagagtatctatgagcggcacagattttttgtaaatcatttaatagcggcaggcgttgatcccgaaactgcggagcgggacggctgccgtatggaacacgcggtgagcgaagaagcgttccggaagctaaaagcgtatacggaaaaagaaacagattaaatagtgcgatacaataacagcgtagcgttaggactgccggtctggtgggaaaactattgttggatggatatgttttcgtatgtaaaatattgtttttattgatgcggcagttttgcaaaactgccgttttttatacgcatctaaactgcgcttcaccttgcattttaagcgttggaggtgctggatattggccaatacctattggtctgattttttgcataaccacaccactcccaatcacacgcggtaaaagatatcgtagtaaatatcgggagagaaaggcttgaaacaatcaaaatgagtaaaaaatgatacaatggaaatggaaaaatataaatttgaatatcaataaattatgacctcttaacagaggttacagcgtttaataaaattctctgaaagccttgaaaataaaggatttatcgcaatgtgttcgccttatcccttgttaagcctacgggtgctcctttgttggcaacgatcagcgcaacctctccacgagataccataccgcagccaatttgcagagattttttgtgactgaatccgtacatttttgcatcgaagccacaacccacgattttggtaaggattgctacggcaagcaaagctaacgcaaaatgaagctttctccgcttttttaagctgatggatatctgattccatccctgtagaaaacatcaggacaataacgccaatttcagagaggactttgataaagtatgatggattattcatgcctaataatcggaaaatatgcggttagacaatcaaatggagaaaaaatattaatgttatcttaatatcatttttagaatcttaacactatatttatgggaaacaatttataatcatcctgtgacaaaatttagggaaaaggagagtaaattatgggaacggttatggttgttgcgggcatagcaatgctcgccatgctcggctatcttttctatgttttattcaaaggtgagaagctatgagcagtggagtgattcaggacatcgtatatgtaattgccctgatcggtattggaataccgctcgggctctacatctacaaggtaatgacggggaagcttacgtggaagcccatcgcggccctcgaacgcttcacctacaaggtcatgcgtatcaatccggagcaggaacagaccgccgggcggtacgcgctctcggcgatcacattctctatttttgggtttgggatcctgttcgcgctgaatatgctgcaagggtatctgcccttcaatccggaagggattgagggcacgagcgcacacctcgcgtataatacgacggcaagcttcgtatctaatacgaactggcaggcgtattccggggaatcgacgctttcgtaccttacgcagatggcgggcctcacggtgcagaacatcgtgtcgccggcagttggaacggctgtgctgttcgcactcatccgcggcttccagcgcagggaaagcaggacgatcggcaacttctgggtagaccttgtaaaggcgacttactatgtgatgatcccgctttctatcatcgtaacgctgctgctcgtttcgcagggcgtgatccagaacctaagcgcttacgtgcatgcgacgacgcttgaatcgggcgcggaacagatcatcccgatgggtccggcagcaagccaggtagccatcaagcagcttggtacgaacggcggcggcttcttcggggtcaactccgcgatgccgcttgaaaacccaacgccgttctcaaactttgtggaatgcctgtcgctgctgctgattccggcggcgctgtgcttctcgtttgggcgggcagtcaaagattccaaacagggacgcgcgatcttcatcgttatgttggttattttcctgctggccctcactggaatgacaatgagcgaaaatgtggctgcgccgcagtatgacggcgttgccgtatctggaagtatggaaggcaaggaagcgcgcctcggcgtggatacatcggccctgtgggcaacggcgacgacatcagcctcgaacggatcggttaactcgatgcacgacagttatacaccgcttgcaggcggcatacagatgttcctgatgatgcttggtgaagttgtattcggcggtgtgggctgcggcctttacgggatgctggcattcgcgatcctcaccgtgtttatcgcgggcctgatggtgggccgcacaccggaatatctcggcaagaagattcaggcgtttgatatgaagatggtgtgtctcgtgatcctgacacctccgctctgcctgctgtttggcacggctctctcgaccttcgtgccgacgatcacggatgactttacgaacacgggtgcgcacgcgtattccgaactgctttacgcatacacgtccggcgcgggcaacaacggcagcgcgtttgcaggctttaacgcaaacacggtctacagcaacatgggaatcggcacggtcatgctgctcgtccggttcatcccaatggtagcggtgatcttccttggcggaaaccttgcgcagaagaaacttgtcccggcgtcgagcggtacgctttccacgacgaatgcaatgttcattgtgcttttgcttctcattgtgatcgtggtcggcgcactcacgttcctgccggcgctggcactcggcccgatcgcagagttcttcaagacgctgccgacgttaggataggagagttgagacgatgaaagagaaaaagataaatcaatcgattgggcgcgatgcattcgcccagtcgttcaaaaaacttgcgccgcggacgcagatcaaaaatccggtcatgttcgtggtatacatcggcgcgatcttcgtaacggtcctgtattttctcgggttcgcgggaatgcaggaggaagcgccgtggtatgtgcttacaattgcgctgatcctgtgggcgactgtgctgttcgcaaacattgcggaggcggtcgccgaggggcgcgggcgtgcgcaggcggacagtctgaagaaggcgcggcgcgacgttgtggcaaagaagctgaaaacggcggacctgaattccgaatatacggaagtgctgtccaaagacttaaagccgggcgacatcgtgcttgtcaaagcgaatgagcagatccccatggacggcgaagtcatcgaaggcgtggcctccgtggatgaaagcgcgatcacaggcgaatccgccccggtgatccgcgaatcgggcggcgacaggagtgccgttacgggcggcaccacggtcgtgtccgactggctgattgtcaaggtaacggcgaaagcgggcgaaagcttcctcgacaagatgatcgaaatggttgagggtgcgtcccgtaaaaaaacgccgaacgagatcgctttgcagatactcctcgtaacgctgacgatcatctttgtggtcgtatgcgcgacgctgcttccgttctcgagctttgtcagtggccttgagggagcgggacgcgcgatcagcctcacgaacgtgattgccctgatcgtctgcctcgcgccgactaccatcggcgcgctgctgtccgcgatcggtatcgcgggcatgagcaggctgaaccaggcgaacgtgctcgcgatgagcggccgtgccattgaagcggcgggcgacgttgacgtcttgctgctcgacaaaacggggaccatcacactcggcaaccgccaagcaagcgaattcctgccggtaaaaggcgtgagcgaagtagagcttgccgacgcagcgcagctctcctccatcgcggacgaaacggcagagggacgcagcatcgtggtgctggcaaaagaacgcttcaatatccgcggacgcgacctttccgcagcgaaggcggaatttatcgaattttcggcgaagacgcgaatgagcggcatcaatctcggcggagatgggatccgcaagggcgcggctgatgcggtcaaggcgtatgtggaaagcaagggtggctcctatccgcaggactgcgcagaattggtgcggcaagtcgcggagaagggcggcacgccgctcgtcgttgcgaaaaacaatcaggtgatgggcgtcatctacctaaaagatattgttaagaacggcgtaaaagagaaatttgaagacctgcgtaagatgggcatcaagactatcatgatcacgggcgacaacccgacgaccgccgcggccatcgcggcggaagcgggcgtggacgacttcatggcggaagcgaccccggaagcgaaactggagctaatccgcaaatatcaggcggagggacaccttgtcgccatgacgggcgacggtacgaacgacgcgccggcccttgcgcaggcggacgttgcggtagccatgaactcgggtacgcaggccgcaaaggaagcgggtaacatggtagacctcgattccagcccgacgaagctgatcgacgtcgtacgcatcggcaagcagcttctgatgacgcgcggttcgctcacgacattctccattgcgaacgacatcgcaaaatattttgcgatcatcccagtgctgttcgccagcatattcccgcagctcgagggcatgaacttcatgggcctcacgagcgcgacgacggcgatcctctccgcgatcatctataacgcggcgatcatcgtggcgctgatcccgctggccctcaagggtgtaaaataccgggaaaagccggcaaagacgattcttacacataatgtgttggtatacggtcttggcggcgtagtcgcaccgtttatcgtgatcaagctgctggatatgctgctcacagcctgcggcatcatgtaaaaggagatgcaaagaatggaagagaaaaaaagtacgaatacaaaatcaaggatatggatcgcggggctgatttgtgcggcattcatgacggtgttctgcgggcttatttatccgctggtcatgacgggcatcgcacagctcacaatgccctaccaggcaaatggaagccttatctatgtagaggaggaagacgggagcgtggtatgctatggctctgaattgatcgggcaggaatttacacagccgcagtacctgatcggaagaccgaatacaggcagcgcgtcggcctccaacctctcggctgtttccgaagaccaggcggcgcttgtacaggagcgcatcgactggtggcacgagcttgacccggaaaacaccgcggatatcccgatggacctcgtaacggcgtcgggcagcggtctcgatccgcacatctcgcccgcagcggcggaataccaggtgcctcgtatcgcgcgggagcgtggtatgagtgaggacgaggtgcgcgcgatcatcgcgaaacacacggatggaaaggatctcggctttatgggcgaggaccgtgtgaacgtgttgatggtgaaccttgaactggacgggaaaaagattgtcagctaatctgcaaatgattgatgtaaatgaggaaagaaaccatgtatgacgaaaacgaaaggccaaacccagacgagctgctacggcagatcggaacggaggaagcgccggaccggacaggaaaactaaagatatttttcggttattcggcaggggtagggaaaacctacactatgctgcgggcggcgcacgactgccttgacagtgggatcgacgtggtcgtcggatacatcgagccgcatacgcgtgcggaaacaatgaaattggtggaagggcttccagcccttccaaccaagcaagtaagttataaaaacatcgttttgagtgaattcgaccttgacggcgcgctgaaacgccatccgcagcttatccttgtagacgaactcgcccatacgaacgcgccgggcgtgcgcaacaaaaagcggtatcaggacgtggaagaactgctgaatgcggggatcgatgtatacacaacagtaaacgtccagcatcttgcgagcctcaacgatatcatcaaggatattacgcatatcgaggtgcgcgagacgatccctgactatatttttgataaggcggacagcgtttcgcttgtggatatcgaaccggaagaactattgcagcggtttgcggaagggaaaatttataagcccgaccgggtcgtaaccgcaatggataattttttcacgcggcaaaatctttctaccctgcgtgaaatatcgatgcgccgtacggcggatcgcatctacgggagggatggaaaggcgatggagaagagcgtgagcgaaaggctgctcgtgcttctttctccctcgccttcttccgctaaaaacctgcgcgttggtgcgcgtatggccgaggcctaccatgccaagtgggaggcgctgtatgtggaaacgcgcacaaagctcacagcggagcagggcaaactgttgcgcgataatatgaaccttgccgaacagctcggcgccgaggttgtgaccatgtatggggaaaatctcgccgaggtggttgcggcgcacgcgaacctgacaggtataaccaatatcatcatcgggaagacgcgcaataagaaacacctgaaggattttttcagggaagattttgaagaccagttgattggacttttgaaaaatgcggagcttcatatcattccggattcggacaacgccggaacgacgtataaaaagcctgtaaaaacgggaactcgaaaggatttcggcctactcgagcagcagacgcagattttgtacgaaatcagcaaaaagctgctggcaacgcgcggccttcagaatatcatctccgcaatgaatgaatatatatcgcggatactcgaacgctcagtcattttttacctgccggacatgaataagcaaggacgtatgtggcaggcggaatttgatcaagatgcagcgtttcttttgggggacgatgaaaaagcggtggcaaaatgggtgctgctcaacaagaagcgcgcgggcgcggggacggataccctgatgggcgcgggtgcgttctatatgccgatcatgtcgcagggcgctgtgcttggagtaatgggcgtatcgtgcaaaaaaggcctgctttctcaggatcagcggatgctgctgcgcatgatcgcgtctcaggtcgccatggcgctcgaacggcagcggatttcggacgagcaacttaaatacaaccttgagcttcagcgcgaaaaacttaaggaagactggatgaaaaacagggaatagggttgcggttttcggaaaattgtttatgataaaagtaaaagactggaaaacggataggtacggaaaatgaaaaagtcgaaaaaacagacaatagccatgaatatcctgaaaacagtcgcgatccttgcgctgtgtacactggtggcatatctcttcagctttgcggggctacggacagagaacatctccatggtctacctcgtgggggttcttctcattacaatggtgacagaacagcttttgtatggaattgccgcttctgtcattagtatattcgcctataattttttctttacgacgccgatgttcacgttccggataaacgatccgaactatatcgcgacgctggtgatcctgctcgtgggttcgtttattgtgagccttcttacgagcaagctacataaacatatggcagaggcgaaatacagggaaaagcagatgcgttccctttatgatgtcagcacgagctttttgaacgtatctggcatggatgatattgtacggtatggcatgaacgggctttccaagttggaaaaccgccagtgcatcatctatacagggcgggattttgtcaatgggacacatacgggaggaacggaattggaggataatgaggcggcacggtggtgttatgaaaacgtgaagccgtgcggctgcgggaccgattatttttccgaatcacagtggatgtatcttccgctccgcagcggacacgaggtctacggcgttgccggtgtgcattgtggggatacgccgcccgcatcaggggaatccctgatgatccagacggtcgtctcacagatctccggcgcgatgcagcgggaaacactgtaccgacagcaggaggaaagcaagctgcgcattgaaaaggaacgcctgcggaacaaccttttacgcgccatttcgcacgacctgcggacgccgcttactagcatcgcgggctcggcaaattttattgcagatagtttagatgaactttcgcaagaacaactgcagagccttctgggaaatatccgcagcgacgcacagtggctcaacaatatggtggagaaccttctcaacatgacgcgtatttcggatggggaacttattttggaaaaacagccggaagtggtggacgatgttattagtgaagcgtacagtcgattcgaacggctgaaaggggagagggagatatccatctatatgccggatgcggtgatggaagtaccgatggacgggcggctcatcatacaggtgctcgtaaacctgctcgataatgcggtgaagtatacgcccgagcacgcgcacattgacctgcgcgcctatccggaaagcggatatatggtatttgaagtgtcagataacggcaaggggatcgcccctgaaattctggataaggtattcgacaactttgtaacggcccccgcggtcagcggagatgcgaaacgcggtatgggcatcggccttggcatctgcaaatccatcgtggaagcgcatggcggcgtgattgtcgcaaggaataacgaatgcggcggagcgacgttcaaatttgctctgcccctggagtgagaaaaatggaagatacacgtattttaattattgaggacgaccagtcgatactcaatttcctgagtatttcgctcaagacgagcggatacaagattgaagtggtatcaacaggtgcagatggtatttctctggcacttgccaacaaccctgatgtcattctgctcgacctcgggctgccggatatcgacggtctggaggttttaaagcaggtgcgccagacgtcggatgtgcctattatcgtggtgtcggcgcgcggacaggaatgtgaaaaggtggaagcgctcgatatgggcgcggacgactatgttacaaagccgtttaatattggcgagcttcttgcccgggtgcgggtagcgctcaggaagcgtgcgccgcgtccggccgcaaaggaaacctttgagatggacggactggtgatcgactttgaaaaacgcaaggtgacagtagacggaaaagacgtacacctgacgcctatcgaatacaagctgctcaccctgctggtggaaaataaagggcaagtactgacgcatagcttcatcaacaaacaggtgtggggatatgagtatatggaggatgcgcagtcactgcgtgtattcatggcgaatatccgccgtaagatcgaaaagaatactgcgcagccaaggtatatcaggacagaggtaggtgtgggctatcgttttgcggacgaatagatcatatcttttgcaaagccgccgcggtaattttcaaaattgccgtcaggcggcctttcatattggaaaattcaggcctgatattggcgaaagtgttgttgaagcataacagattgggctgaaaacaattaaaattggatcaataggagtttcataaaattcaaatgcatttgtttctttaggaatatctgtagggacatctgagttgttcgcatcaatttctggagacatgccttccagtgttaaaatttcacggtcaattttttgatcggaatgtaccgtgagctcacgctttttgggatcaagacgcacccattccggaacacggctcataggtctgcggtcaacaaattttttgctatataattattttgacggctccgaccagaaggacgatattttgtccgaaggaatgattgtgcttattaaagcgattgatacttatcggccggagatgaaagtgaaattctcaacttatgcttctaaatgtatccaaaatgaaatttataattatatgaggaaagaggcgagagcgcaacagcgcgatatcaatatcgtatctattgaaatttcagagccggttcaggcgccggaaagtatggaggacggtgtggtgagctatttgctgctatgtgaatttttgcacaatatagaaacagaaggcgtttacaaagaaatgtttatagaatctcttgaccagtttaatcgccgtaattatatccccaaattgtcaaaacggtatcttattgatatattgtaatgcttgatgatgatatgtttttttgatataatctaaaaaagcatgtccatctctgctattggacaaggagtgaaaaattatggcagagaagagacaagttagaagggataaagacaggatcgttcttcgcaaaggaaagaggcagcggccaaatggtacttatgaatatcgctgaacaggcaggtatggaaagcgtcatccgatttacgccaaaacattagatgacggcttcgactattgacagcatccacacgattttgcatcaggtgttggatatggcggtagatgatgattacatccgtacaaacccctctaaccacacgcttaaagagtggaaaaaggctgagtttgatggactggatcggtatttcacagcgtcaaaattggaaggcgcatcgaacgcggaatcgctgccgaatttaacccaaagtttaacccgatgagaacataattggtgtgcagttatatagaaatgcaatcaagtgaaaaattcgaatgttggattatgtagggaaatggagaataatatcgttgctctccacagaaatcccgacgataaaaccgaaagagagcaaataatttggcaaaagaaggcggtatcaaaactgcaaagggtatcctgtatgtgctttcgcggatcgcgatcgttattgtgatcgtggtgatcgcggtggtcgctttttatacggcgatgcacactatgaatgtggagatggtcttgaaggacgcgtatacggcgcgtgcgcaggctgttttgcttccatccaaggacgccgacgaccaagatactttgcagcgcctttttacagagaattttttgagcacggatccggcgcttaatgggggccggtaccaggaattcgatatcttgaactattaccagcgtacggatatcgagtcgcttgtcgtgtggccgtgggaggatcatgttaccgttaaagtaacggatatcgtatcggaaatatcgggtacaccgctggatatgattgcggaggacgggacgattatctcatcggaaggtgcgtctaagaaaccgccggaatgggaaagcgggcagtacgaagtgaaactgatcaagaacggcaatagttggatgatcgacagccagaggcttataaaagaggttgagccggagcctacggggacgatcgccccaagcgagggcgcatcgccggatgtttctgcatcaagcgaacctgcggatacacagcccacggatgaaagcactgcggagagtacgagtgcagaagaataacggtacaggcgcaaaaatgcgcctgttttttaaaggagttttatgacgccaaaggtttatctggcgcccatggccggtgtgaccgacgccgccatgcgcgaagtgtgcgtgatgtgcggcgcgcaaatgacattcacggagatggtgagcgccaaagggatcgcttataaaaatgcacataccggcgcgcttcttgaactgagcgacctcgaaaaacaagcggtcgtccagcttttcggaaaagagccggacgtgattgcagataccgcgaaagcagtggaggacaggctcggggcgcggcttttcggtatcgacgtcaatatgggctgtcctgcgccaaaaatcgtaaaaaatggcgaaggaagcgcgcttatgagggaacctgtgcttgccggtaagatcatttcggcgctgaaaaaaacagtacgcgtgcccgtaagcgtcaagttccgttcggggttttcggaaaaagaaaaaaacgcggtgtcgttcgccaaaatggcggaggatgctggcgcggacagtatcgcagtgcatgggcgcacgcgcgagcaatattacagcggtaaggcagattgggatatcatccgcgcagtaaagcaggcggtaaacattccggtgatcggcaacggcgatattttttgcgcgaaggacgcggcggatatgcttgggcagacggggtgcgacgctgtcatggtggcgcgcggggcgcggggcaatccttttatctttacccagatactggagcttttggaaacggggcgcgtcggtacacagcccacgcggcgcgagcgtatcgatatgtgccttttgcaggcgcgaaccgcagtcgccaataagggcgaggttttggcgcttaagcaaatgcgtacgcatgcggcggattatatcaaaggaatacgcggtgcagcgcggatcagggaacaggtcgtgcgggcagctacctatgcgcagcttgaggaattgctgctcggggtattaaaaaagtagttgcttttaacgcccctatgtgctaatatattgctgttacgtattctagatggaggtatcgttatggagattctgtctctgataattaaaatagtgttggtagctttcgcggtctttttgatcgtagtcgtgctactccagtccggcgcaaagacaggcgtacctggtgcaatcggcggcggcgcggaagttatgtggggtaaaaagaaggcacgcggcctggatgcgacgcttaagcgtctgacaaagttcgcggcagtcggcttcatggttttgtcggtatttctggtcattatgcagaaatactggatgtaagcaaagaaagatttggaaagcacccgcatatcagggtgcttttttgataagaaagggaattgtttggatatacaggagcaggccttagaggtcattgaaaatagaatatatattgcgccggaggtccttgcgcaggagcttaacgttccgctcgaagcgctcatgccggtgcttgatgaactggaacaagaataccggatcgtaaaaacaaagcacggaaaatacgcgcttgcgtctacggtggggcttttccgcgggcagctcgactgcaagcagggtggctttgcgtttttgcgcacgccggaatggatggacgacatctttattccgccatccaaaaaactcggagcgatgaacggcgaagacgtgctggtaaggctgggccgccgccaggaaaaggggaagagcctggaaggtgctgtcgtcaagatattttcgcagctccccataaccacggtcggcacggtggataaaaagaacagtgcggtttttgtcgtaagcgacgaccgcaatgtagacgatatctatatccccaaggaaaaagccaagggattgaaaagcgggcagaaggtcgtggtggagatcacacgccgcgcgaaccacggaagaagcgcggagggaaaggtaagcgaaatcctcggccgtgcgggggaaaaaggcgtggatatcctcgcgtatgcacgcaggttcggactggtcagcgaattcgacgagccgtgcaggaagcaggcgcaagggcttacaaaggaaacacaggatacggcaggaaggcttgatttgcgggacaggttgatctttaccatcgacggcgcggatgcgaaggacctcgacgacgcagtatccttgcggctgctcgaaaatggaaactacgaattgggcgtacacatcgcggatgtaagccattatgtgcgcgaaagtacgccgcttgacaaggaggccttgaagcgcggcacgagcgtgtatatggtggacagggtcgtgcctatgctcccaaaggagctttccaacggtctttgttcgctgaatgcgggggaagataaactgacgctctcatgcctgatggaaatcaacggcaaaggggagacagtttcccacacgatcgaaaatacgctcatccgttcttcatatcggctgacgtacgacggcgtgaaccgcatcctggaaggcgaattgcaggaggaaagggagtatgctccggtcgcaggcacgctgaagcagatgaacgagcttgcaaaactgctgcgcgcgcggcggtttgaaaaaggcagtatcgatttcaatatcgacgaagcggagattattttagacgataacggagtgcctgtggatgtaaaagtacgtgagcggggcgatgcggaaaagctgatcgaggaattcatgctgcgcgcgaatatcacggtcgcggagcagtattattacatggaactgccgtttctgtaccgtatccacgagcagccggacagcgacaggatgaaggaactggcggtgttcctcggcaacttcgggatcaagctgaagggctttgcgaacatccatccgcacgcgatcgaggaagtgctcgagcaggtagagggaacggacgaagcggcgatcgtgaaccgtgtgacgctgcgggcgctcaaaaaagcgaagtatgccacagagccgatctcgcatttcgggctggcggcagacaggtactgccattttacgtcacctatccggcggtatcccgacctgcaggtacaccggatcataaaagcggttttagacggacgcatggacgatggctatatccgccatctgaataagatattgccggaagttgcggcgcagacaagcgcacgggaaagaaacgcgatcgaggcagagcgcgcagtacaggaccttaaaatgacggaatatatggcgcagtttgtgggacaggaatttccggcggtcgtatccggcgtgacgcggttcggcatctttgcggaacttgaaaacaccatcgagggaatgattcccctcggcagtttgcgcgacgattattacgtttattatgaaaaggaatactgtgtgatcgggcagcgcaccaaaaagcgcatcacgctgggggacaaggtcatgatccgcgtggtatcggcggatgtcgcggcggcgaaaattgaatttacctttgcaaaaagttaaggtataataggaacagcatcctaaggaaaaggaatgggttatgagcgggataaagctgctcgcgcagaataaaaaagcgtggcacgattatttcatagatgataaatacgaagcgggcatcgagctggtgggtacggaagtaaaatcgtgccgcatggcgaaggtcaacctgcgggattcgtatgtgcaagtaaggaacggcgaagcattcgtcaataatatgcacatcagcccatatgaaaaggggaatatttttaaccgcgatccactacgggtacgcaagctgttgcttcataagcgcgaaatcatgaagcttttggggctgacatcgcaaaaagggctcacgcttatcccactcaagatgtatcttaaggagggaaaagtcaagctggaggttggcgtatgccggggcaaacacctttatgataagcggcacgaccttaaggaaaaagcaatcaagagggacatggagcgaaggatgtaaaagtatatttcatacaactgaatatgggggcgtaaatggtttcgacgggggcatttgtgaggccgataagcaagctgcagttgaatactctgcataaaaaagattcacttaaatacaaatgctaaaacaaacaaaactgcagaggtgggttctcccgctctgctcgctgcttaattaaatagcagccttctgacctctcttttcctgtttgggagagaatcgggagcaaattcaaaacagggtactatattgccaaagctttgcggcaatacggattttatgaagctacctcttacggtttttgtggctgggggtctaaaagagggaattttacaaaagccaataagcttgtagaaagtcggtcaggcaggctttcggacgcgggttcgactcccgccgcctccaccatagaaaaagaagtccatgcggagcatgggcttctttttctatgacagatgtgatggaggagaacccggattgcgaagcaattccaagggggcgtctttagcccgcgcgaagcgcgggactcccgccgcctccaccacgtcgcagcaaacccgttttagctgcatctaagcaaaaacccgcttgattagcgggttttattttgcacatacgcgtttttgggaggggtaaatctatcatctccggccgcgtcccctgcggcgcggaatgctatggaacgattgcccgcttaccctgccatgcgatacgcgcttgacgggttcgggaaggataggcgaatctgccgttggagatatatcgatattcaggtttttgatcatctttcgcagccggtcgatctcgtcttcgtcctggttaataaacgtataggcgacgccttcgcgctcagcgcggcccgtgcgtccgatacggtgcacataactttcgtcatccaaaggcacgtcataattgatgacggcgtcgatattcttaacgtcaatgccccgcgcggcgatgtctgtggcaacaagggtatcaagcttgcccgatcggtattctttcatcaccctgtcgcgctgattttggttcatgtccccatgcagcgcagcagccctaaatccctttttccgtaattgtgccgccagtctatccgccttatgtttcatgtttacaaagatcagcgtcagagggaggtcattgttttttaatagtgtaataaggatgtcgtttttatagccggtgggaacgatcgtgtagtattgctttaccgtttccaccgccagagattcctgctcaacacgaatttcccgcgcgtctttttttaggaattggtttgcgatcatataaatctcctgcgggatggtcgcggaaaaaaggacggtctgcctgcctttcggcgtagcgcgcaatattttttccatatccttgcgaaagcccatatccagcatgcggtcagcctcatccagcacaacggtacggatatttttgagctgaatggtttgacggtgcatatgatccatcaggcggccgggcgtggccacaatgatatgcggcgttttgcgcagcgaatcaagctgtttcttgatattttcgccgccatatagggtgacgatacgtataccgggtttgtttgttgcaagattacgaagcacgcctgcaacctgcaccgccagttccctggtcgggcacaggataagcgcctgggaaatttgctgcgtccggtcgatctgctgaacgataggcacgccgaacgcgcccgttttgcccgttccggtcggcgcctgcaccaacagatcgtctccttccaaaaagcatccgatcgtcagttcctgcaccggcgtgggtttgtcaaaattcatgttgcgaaggctcgtttggatatcatctgagataccgagatctttaaaaggtgttgcttgcatttattgtctccccaaaaaataatttttaggccgcccaaaaaacaataaagtgcaatgtttccctaacagcccgccgtatcttcccgcaaagaaaaacgcatatttctgtaaaaccatactgggcttacaagaatatgcgcgacagtgcggaatgaatactataactatcatagcataacggttatgatagcacaacaagatacttctgtaaaaattttgcacgcagcttactgattatgcgccttatcttagagctctggtgtaagaatatacgatgcgcctatgcaataaataagctataatatctatggggaattagatttcgggattaacaaggaggaactatggggaaagacctggaacggtgcgcctgggctggagaggatgaattgtactgccgctatcatgatgaggaatggggtatccctgttcatgatgatgggaggctgtttgaaatgctgaatttggagggggcgcaggcaggcttgagttggattaccatactccgaaaaagagaaaattatcgcagggctttcgacaggtttgatattgataagatattaaaatatgacgacgacaaattggaggagcttatgcaggatgccagaatcgttcgcaatcgcttgaaaattcagtcggtcttaatcaatgcaagagcatttcgcgccgtgcaggaagaatatggcagttttgacaactttttgtggtcttatgtggagggaacacctatctgtaatcattggagcgatatttcggaggtgccggcgaaaaccgagttgtcggaccggatcagcaaagatttaaaaaagcggggattcaaatttgtgggctctaccattgtttatgcctacatgcaggcagtcggaatggtcaatgaccatatttgcagttgctcttttcgttccccaatagaacgcaggcagagtaaccattatatgggagattcctgctcccgatatacatccggatccggtgtgccggccggatgctctttcgcatttaagtatccaatcaatactaaatgattatctgctgcaatttgtgtttatcaacttcctaagtttggtgggtatcagaaatcaacattaagcggggaagtgagtatcatcggaaaggtgcgggcatttttcaaatcgatcgcgggagcgtcggcatttcttttaaatagttctttgatcgccataccatatttactgtttcttaggttgatcaacggaaccaatttatctaccatacttcctctggtgattttttatacgctccgtatgacaggcgtatttttgctgcgcagtatcaaaacaggcgtcggaagctattctatcctgttattctcgtttgtcctggggttcatcggcgccgcctttggcgtattgggcgttttctattttccgttatttattgtttccgcaatctttatgggccttgctaccgcatttattaagccggtctttacaacgatcaattttcataagcatgatgaaaaaaagaaactggatgcttcggtgaaaacaaaaggcaaatttttgccgttggcgttcgtagtcgtattcctgctcgcgctcatggccctgccgggcacgatacagacattcagcgttatgctgctgtatgtggtcctttttgcgatggctctttattccacagcccgcgatccggaatatgaattccgtttggtacatttaaaggcggcggcggtatcctttaagggggctgctctttttatcgtattctttgtactgttagccctccttcgtatcgcccgccgcacacttgacgcggaagaacttgaccttgtgtcaatttggttttccgcggcctttttagttacggtttttattgtgttcctgagaaggaagcggacaaggctgccgctatggttaaacctgttatcgctagcaaacggaatgtgcgggaacttcctttttatattcggtgcattttatattggcgcgctttacgggatcaatgcggcaacagcacaggtctatattccctttgtattgggaatgggcgcggcgatggcgtttgccccaaaggttcaaggattattcaaaaacacctcgccggtcgtggtgcagatcgtaggactatgcgcaagcctgatcctgctcatgaccccattgttttttccggtcagtatttttctcgtcagcttctttttcagcgggacgagcgcgtggctggacagggaatattacgatacaaagagtattccgtatgacaggcgattgatcagtaaatttaccttgcaggatatcggcagtattacctatcaatttatcgttgccgtacttattttagtgatcttccagtattaccagatgccgacggcagcgttcttcacattgactgaaaatgtagcgcatccgcaagcccttgttacggcaatggatattgccaaattttggggatgccttattctggtagttctttttatgattgcctggatcaatttaaggaaaaaacattccggcggagaacgggggaagacaaagacgtaatttgtcgtatcaccacggacatacaggggcttttaatgtttgtttcattaaaaggacgtgtagcttaagaaagctgagagatataaaattttttaaatcatttgtgaaaataaaaggagtggggattgtgaaaaatttagatttaaaagccctatttataggagatcaagccgaaaacggcgatttttatgaggagcaattgcacaagcttgtaaacgaacatatgggatggagggaagattatatcccgtccgatatgccggcgattacggaaaaagataaggaaaaaacaagttttattgcgacaaaggaccatattttggatgtgattgataatttaagcccaaaaatgcgttcagggtctatcccgtggcaaagcgcaggacgttactgggggcagatgaattcagaaaccctgatgccggcgcttctcgcgtataactttgcggcgctttggaacccaaacaacgttgcgctcgaatcatccatggccacatcacagatggaggcggaagtgggaaacgattttgcgaacctgtttagtttcaaagacgggtggggacatattacggcggacggttcgcttgcgaaccttgaaggactatggtatgcgcggtgcttcaaatcgattctcttggcaatcagggaagtatatccggataaggtgtcgggaatgatggaatggcagttgcttaacatgagcgtaggagagattgacgcggtcaaggccgcttcatcgcgcagcggcaaattcatcagccaactcggaaagtggatcgtttcgcagacgaagcattattcctgggaaaaagcattggatatttcgggcgtgggattggatcaaatggtcgcgattcccgtattgcttttgctgttttttgcggcagtggcagtcctgctgttctacaatccatcgacccggttcagtacaattcttggagtgatttggtttaccgtactgcgggtcgcctttcaaattctgaaacgcaaaaagacgtcggcgtaaatgaagaggggcggttgacaaaggaggcaactcatactaaaataattgatatatcaacaattgatgtatcatcgaattgtggataggatggaggaaaaaaggaaatggaagaaatgttccatatgttgctatacagggcgttccatgcacaacggaattatttgcggccgtatttgagcgaacttgggctcgggctggggcagcccaagctgcttgcctatatggcggcgcacggggcatgccagcaaagggaactggcagattactttgagatagaccgcgcggctgtcagcaggatgatagaaacgctggaaaagggcaggtttgttacgcgcaggatagatgctgaaaaccgtcgggcggatattgtcgaactgacaggaaagggagaacaagcgaatgaagcatggaaagtccattgcagggaaatggaagcgatacttctggaaggcttcacaccggaagaaaaggacaatttttccggctatctctccagagcgtacaggaatttaaaggaaaggacataaaggggacaaggctgtggatgatttgaagcggttgttcggttatctgggaccgtacaggaaggttatggttatcggcgcgcttctggttttggtagaaacctgtttcgagctgtttatcccgctcctgatggcggacatcatcgataccggcgttgcaaaccatgatattccatatattttgaaccaagggatacaaatgggcctttgcgccctttttgcactgatttcgggactgctttacgcaaggtttgcggcacgcgcctcctatgggctgggggcgcgtgtacgggaagcggaatataagaaggtgcaggaatatgcgttttccaatcttgaccactttgagacctcgtcccttgtaacgcgcatgacgacagacatcacggttttgcaaaatgcgatcaacagcgggttccgtccgcttgtcagggggcctgtgatgctcgtgctcgggatcatccttgccttttggatgaacgcgggccttgcggtagtatttttggtcgttacgcccgcgcttgctgtggcgttgttcctcatcgtgcgcaaagtcgcgccgatgtatgggaagctccagaaagcggtcgacaggctgaatggcgtagtgcaggaagtacttacggcgatccgtgcggtcaaggcctttgtacgcgggaaatatgaagaaggaaaattccggcaggtgaatgaagaactggtgcaggtgagcgaaaagacattccattatgcggtgctgaaccttcccgttttccagttggcgatgtatgccacaacggttgtgatcatgtggtttggcggtaatatgattttgagcagccagatgcaaataggcgatctgaccggttttctgagttatgtgctgcaagtcatgaattccctgatgatgatttcctctgtattcctgcttttaacccgttcgcttgccagcgcaaaacgtatagccgaggtgctggacgaatgccctgagatcgtatccccaaagcacccatgcgaagtgatcacgaacgggggcgttgattttaaaaacgtttctttcaaatacaaggaggatgcaagggaatacgcgctttcgaatgtaaacctgcatatcccgccggggcagacagtcgggatcatcggcggaacaggatcggcaaaaacaacgttggtccagttgattccaaggctctatgacgtgagcaaaggagcggtatgcgtaggggggaccgatgtaaagaaatacgatttgaaaaagctcagggatgcggtgggtatcgttttacaaaacaacgtactgttttcaggaacggtacgggaaaaccttctatggggaaatgagggcgcaagcgacgaagagctgtggaaagcctgccatatcgcatgcgcggatgaattcctgatgcgcatgccgaaggggctggatacggaccttgggcaaggcggcgtgaatgtttcgggaggacagaagcaacggctgtgcattgcgcgggctttgttaaagaaccccaaaattttgatttttgacgattccaccagcgctgtggatacagcgacggaagcaaagatacgtacgtcccttgcagagcttaaggacgttacaaagctgatcatcgcgcagaggatcacctcagtgatggatacggatcaaattattattttagacgatggaaaggtccatacggcaggtacgcataaaacgcttttggcaggggacccgatctatcaagaaatctatgcttcgcaaatgaaaggggggattgtgaatggcgcggcagccgaataacaagcgccctaagaatttaaggttcacgatccgttccctgatgtcctatatggggaggtataagctgcttttcgtgctggtggcggtgttggttacagtcagtgctctggcggccctcatgggaacctatatgatacgcccgattgtgaatagcttgatttcaggaaacatgcaatccctggtcagcggggtcatcctgacgatagctatatacggtatcggagtgctgtgcgcatacggttatacacaaatcatggtaaaggcggcacaaaaggtattgtatgatatccggcgggacctgttcgcacatttgcagacgcttcccctgcgcttttttgacacacagcgccatggggatgtgatgagctattttaccaatgatgtcgacaccattgccgaggcctttaacaacagcttcgcgatggtcatccaaagcttcatccaaatggcgggaacgcttgtgatattgtttattctcaactggcagctatcgctgatcgtattggtatgctatgcggctatgtttttgtatatccgtttcagcggtaaccgaagcaaggcgtatttcagcaggcaccaggagtatttaggtgatttggatggctatgtccaggagatgataagcgggcaaaaagtggtcaaggttttcaaccacgaagaagaaaacttaaggcaattcagggaaaagaacgagaagctgcgcaaagcgggaacaagcgcgcagggatacgcggcgacaatgatccctgcggtcgtgagcatctcgtacatcaattacgcaatcgttgcggttctgggtgggatcatggccataggcagcacgacagatgtgggaagccttgcgagctatctggtatttgtacggcaagcggcgatgcccatcaaccagtttacccagcaaagcaacttcctgcttgcggcgttggccggagcggagcgggtctttgaagcgatgcgccagccgccggagacggacgaaggaaggatcaagctggtcaatgtccggaaaacggaggaagggtttgccgtagcggaaaagaaaacggggcggtgggcgtggcaaaagctggacggaacgattgtccccttgcggggcgatgtgcgctttgaccatgtgacgttcggatatacggaaggatctccgattttaaaggatatcagcctgtacgccaagccggggcaaaaaattgcgttcgtaggttctaccggcgcgggaaaaacgacggtcacgaacctgatcaaccgtttttacgacgtgcaggagggcgccgtggtatatgacggcatcaacgtgaaagatatccgcaaggatgacctgcggcattcgctgggaatggtcctgcaggatacgcacttatttacaggaagcatcgaggataatatacgctttggaaaactggatgcaaccagagacgaagtggttcatgcggcaaaagtagcaaatgcggattcgtttatccgccgccttccggaaggatacgacaccagggttacggcggacggggccaatttgtcacagggacagaggcaattgctggcgatcgcgcgggcggcgatctccgatccgcctgttttgatactggacgaagcgacgtccagcattgatacgcgtacggagtcgctcatcgaaaaggggatggaccgactcatggagggcaggaccgtatttgtgatcgcgcacaggctgtcgaccgtgcgcaacgccaacgcgatcatcgtgctggaaaacgggcggatcgtcgagcggggcacgcatgacgagttgttggcgcaggagggcgaatactaccagctataccatggaatgtttgagctgtcctgacctggtcataaactgcttaaatggctgcagggattgcatgtttattgcaatccctgttttattgttcaaaaaccactggctgtgccagtggtacaaaaaaagcattagcgaggggaagaaaaaacctccatttgataaaataatcttggtctgccaaccgagaaaaaacaaatggaggtttttaaaatgttacaagacataaatagcttagcacatacgaaatggaactgcacgagtgccctttagggtaaatatcacatagtatttgcacccaagtatagaagaaaagtaatttatggtcaactgggagcggatataggaggaattctaagagaattatgtaagcggaagggagtcaatatattggaggcggaaatgtgtatcgaccatgtgcatatgttggtggaagtaccaccgaagatgagcgtatcagggtttgtgggatttctgaaaggagaaagcagttttcttttgaacgagagacatggaaatttgaaatgcagatatgagaacaggagcttctggtacaggggtttttgttcagtctgcagggataatgggggtaacgattccgtctgccccggagataccagctttgaccaatgtttctttcatcacaagaaaattacccaggaacagcttttggaaagcggttgcaaaacgcgctccatcctttttttcaaggctttggcgcaaaactgttgaaagttcgctccaggcagggatcggattttcggcagcctggtcaagccgcagcaagccgcccgccagcagcagaagcgtaagtttttcgtaaatttcccgaacagccgcaagcggacagcaccggacgactgcctgcaggcacgcgcttatggcggcgaccagggaagcgtgcgacgcatccgcgtctaaagcctgcgccatagcggcaaatgacttttcggaaatatgggggaaggtacactggatgaccgatttgcaggtaacggcaagcaattggtatgcttccaaaaaggatttcaggttgtcttccatcatcaatttcttgagtttgcgcaatattgtggaatccgctatggatacgacccgcgttcccacgccgttgatggttttcacaacttccagtttattcaggaggattatggtgcggcggatcgtgatttcggagacatgataaacgtctgccagaaacgcacccttcggcaaaagtattccaacagggtacataccctgattgattttgcaaagcaaatcgatagcgatcacgtcgcaatattgcagccggcctttatgcggcgcccattgaaatggaacctgcggaagggggggatcggtgacggcctgggccaaataggactccagttctgcataaagcatcgtacctaagcggcttagctgcaacctggcagcagtgtagttttcgctctggcaatccctgagcgactggagcatggacgctgtcatgccgtgtaaggcccgggcggcttctttttctccgtgaagggcgtaaaggatatccaaaaatgcactttcaatgaaagagccaacgtcgtaataaaggcttagggcagtctggctgcctaacattcgtaaggagcgttcgaataaacggtaaagcagttttccttggaaggcggggtcctgttcgttggacagcccgcgcaaaagcgtatccgttttcatgtggcacagaccctgaaaacaaatgtcggacgagatcaggtccaaggttttgcaaagatcggcaagcgccgtaacgcgctctttaaacacaggactctccaaataattttcataaggctttgcaaggacgatagtttcttttccacggcaaagtcttacgaggccgtctttttcaagggccttaagcgcgcgttgcgccggacaataggaaacatcataccgccgcgcgatttcctgggcggaaggaaaacgttccccgtgatcgaaaaaccctagctggatctggcctgcaaggctcctgtagatcgtttgttcctgactgctcgaataagacattgcacaccgcctttcaagaatctattatactttgccggatataaaaattccagatttttagtgaaaaaacccataggtaacgctgggcataaggaaagataagccaaattttaataggaaaggattgtgtattccgtccaaaacagatataatatgataaagtataatatgatcaagggagctttggaaatgaatttaaaggaatgttaccttgctgccggagcggactatgaagatatgatacgcaggttcataaatgaagaacgggcagaccgttttttggcgctattccttaaggaccaaagcttcaacgagctgtgcggcgcgatggatgaggaacgttatgaggatgctttccgcgcagtgcatacgatcaaggggatatgtatgaaccttggccttacagctttgagcagctcctgcgtggatttgacggaaaatttacggcagagaagactcgacggggatacacaacgttttttcgagcaggtgaaaaaggattttgagcgtacggcatcggccatcaatcaacattttaggccgggagagtaaaacatggaacgaaaatacaaaatcctgatcgtggatgatgcggaaatcaaccgttccatgttagcggatatactggacgaccaatatcttattattgaagctgcaaacggcagggaagcggtttccatcctggagacccagcataacgagatatcactgctcctgcttgacatcatgatgccggaaatgaacggctttgaggtactctcgtttatgagcgggaagggatggatcagcagtatccccgtgatcatgatttcggcagagacctcctctgcatatattgaccaggcatatgaccttggagcaaacgattatatcagcagaccgtttgatgaaaagacgatacagcgcagggtgaacaacgccattattctttatactaagcagaaaatgctgggggagatggtcgcggagcagatcctggaaaaagaacataacaattccttgatggtagagattttatctaatattgtagaattccgtaacggggaaagcggactccatgtgctccatatccgtacaatcacggagtttttgctccggtacctgatacaaatgacggacagatatcccctgacggacgagaaaattgcgttgatcgtcaatgcgtcgcccttgcatgacatcggtaagatatcgattccggaaaacatcctgaataaacctagcaagctgacgccgcaggaatgtgaggtcatgaagcggcacagcgtcatcggggcgcaaatccttgaaaataccccgggatggcagaatgaagaactgctgcaagtggcgcatgatatttgccggtggcaccacgaacggtatgatggcaagggttatccggacggcctgaagggagacgacatcccgatcgcggcgcaggtggtcgcgatggccgatgtatatgaagcgctgaccaatgagcgggtctataagccggcctaccctcatgacagggccattaaaatgatccttgacggggaatgcggcgtattcagccccatcctgcgtcagtgccttacggaagtggcggaacatatcgagggtgaagtatatcagaatccatcaaagcagatatcgggtgcggagatatacagcatatcctcccagatatccggcaaccgccaggcctccagccgcacgcttgccctcctggagcaggaacggaccaaattccagttttttgcatccatgtccaaggagattttgttcgaatatgatttgaataccgagcttttgacctttccggatctgggcgcggagcgtttggggcttaccgacggcgttatttccaagccgaaatccaatcagggattacagcaaatattccagccggaagatttgcaggaggtttatgaacggatgcgcaatgccacacaggaaaccccgatcataaaagggacttatctcgtcaacatacgggggcaaaagcgttggcataaagtcattgcccgtcccttgtggacggggatcgagcatccggtcatgaccatggtgatcggaaaattatcggatgtccatgaagagagcctccaactcgagatcctaaaagagcgggcggcgcaggacccgctcacgaagctgtataaccatatgtctgccagggaactggtggaaggaatgctgacttcggacaacatcgaaaagagcgcgctgatcctgcttgacctggaccggttcaaaaatgcaaacgacggatatgggcatatgtttggagacgcggttttgaagaaggtagcctcgctgatcacgcaaaatatccgcaaggaagaaattgcggcaagggtcggcggggatgaatttttgatttttgcggtttatcgcgatgaagcggaaccgatcgtaaagcggatacatgaagcgatcagcggtgaatacgacggttttgaaatatccgccagcatgggcgtggcgacctgcccgcaggacgggacggagtatgagcaactcttccgtcgggcggaccaggcgttatacacggccaaaaagaggggaagaaagcagtattgcttttacgattccacggttgaaggcgcgctttccgtgctctcgccggtagaaagcggcctataaccggctcacgctcagatccatttttgcaggatttcactcaagcgttccacgacgatcggtttggcgatatggccgttcatgccgacgctgtaggctttgcttacatcggcggcaaaggcatttgcagatagcgcgatgatcggtatcgcctgcgcatctttgcgcccaagcgcacggatggcggacgtagcctcgtaaccgtccatcacgggcatttgtatgtccatcaggatcgcggcaaagtagccggggacgctggcgctgaacatatcgacggcacgctgcccgtcctcagcccattccacgaccatatcctgcatctcgagcaggtctattgctacctcacggttcacaacattatcttcaacaagcagtacacgtttacccaccaaagcaagctggcttttctttgtcaggtcgtttgcggcgtcgagggcgttgccggggcagaatagctgcagtacgcgaagcattttggatttaaacaagggcttggtaataaaggcatcggcccctgcgtgtatgaattcttcttcgatatccgaataatcataagccgaaatgataatgatgggtacgttggctcccagcttttcgcggatggcttttaccgtctcaagaccgttcatctcgggcatttgccaatctaagataacggcgaagaaatcatccccgcgtttgtgcgcgtctacgacaagcgggatcgcctggatgccggacagcgtccagaagccgcgcatcccgagttcattgagcagcgcggcagtattttcgcataccgtctcgtcgtcgtccacgacgagcacgggaagacccgccagttcgcttgtgtgctcttcttcttccacacacagctcaaggggcaccaaaatggtaaaacaactgcctttttctacccggctctccacctggatcgtgccgttcatcatgtggacgacattttcggtgattgccatgccgaggccggtgccttgtattttgctgatgcgggaatcctcggcgcgtgaaaatggctcgaagatatgcgggatatactcgggtgacatcccgattccattgtctgaaaaaatgaactcaaattgcgctttgttcgcaagaggcgagggcagttcattgatctctaaactgatactgccgccctccggcgtatatttgatcgcattggaaagcaggttcatcaggacttgctgcagccggtccccgtccgcgatcactttttcgtggttcacacggccgacattgatacgaaaatcatggcgtttgtcggtgatcaaaggccggcacatgtccgctacatcctggaccagttcggataagtcgacttcctccggcgaaagatcgatctttccgctttcgatttttgacatatccagaacttcgttgatcaggccaagcaggtgccggctggaaacgctgatttttttcaagcagtcgcggaccttctcgggcgtccccaaattggcctgcgcgatggcggtcatgcccatgatcgcattcatcggcgtacgaatatcgtgggacatggaagataagaagttggttttggcagaacttgctacgcgggccgtctggtaagcctcttccaaggccttgcgctgcctgttttgttcttcgcgttccttggtaatatcgatgccgacgctgtaaaaggaagggatcccgtcccagctttcctcggcgctgacgtaactgtaggtcatggtcaggatcttcgtttcgccgctgcgggtgaggatgcgcgcttccacggtcgtatccccatctgtttttttggcattttccatgacgccgactgcacggtctatatcatccggatgtacataggtacactgggaagaaagttctacttcaaattgttctttggtatagccgatcagggacaggaagcccccgccgtaccagaggacggtgcgcatgtcgcgggcgtccacacgtgcaaacccgccggggatggtgccgatgatcgcgtcccgctccctgtctttctgggccagtttaaattcgggactgaacatatcgtgggacagctcgatccgcgaacggtgtccgttccagttgatgatgcggtttttgatcataaaggtgcgttccagattgggattttcaaactcccattcatagaatttgtcttccgtgagaagatcgttggtgcagaacggacagggagaagtcctgccctggatgacctcgtagcattttcgtcccaaaatttcggagggacgaagctgggccgtttcataaagggaagaaaaaccggtcttattcatgtacaacagctcataggtctgcatgtcgcaaatgtagatatttcccgcatattcgtccatcatgaattcaaaacagcgtgctttatcgtcacagctcgttttttgcccgtcaagctgccgcatcatatcgctgacgtcgctcaggatggcgtaacaaaccgaatgaccgcctatcatccggccggtgaatgccgcagagaagcggacccatgccgcactgccgtcttttcgcggcatgcggactgtcggggagcatacgtcgtcccctttataggaggcgtccggcaacccttgtatgatggaagaaaaatctttcggatatttcatataatactgacggagactttggaacttgttccggtattctgccgcaggatagcccgcgctgtcgaaaaaacagccgttggcccaaagaattgtcagctcctcgttcagcaaaaaaccgattgcgctgatccctgtaagacctgacggcataccgccttgcagggcggcctgcgccgtttcatatttccaactatactgatgttccataaatgactcctttatctggcagggctatatgcaagtataacatgataaaccatacttgatcatattatatctgactgggcaaataaaagcaatatggacgggaaagtacagaatgtgattggcgttgctaaaacgagtgtgtatatatatattatatcaagttgtttcggaacaggggggaagcatgacgcgaagccagccaaaaaccagatatgttgttttcattatcatattgctgatattggttttaagcttagtgtttttctctttccaagcgttgctggacgatccgacggataccggcctctatatcgtgctggcagcggtcggggcggcggcagtggccggtgtatcagtcctgaacgcacgtaagaagaataagcagcagtaaaagagggagcggaaaaagcaaagaaaagaacccatgtattgcatgggttctttttcctttgcccggcttaccgtaaggcaggcatgtttatattaataccggtatctgacaaacaaaaggagctggttgtatgttttatttgcaggtggggcttaaacttctggtcgcttttatatgcgtcattatttttatgaacttttcgggccgtgcgcagcttgcaccgacttcggcagcggaccagatcggcaattatgtactgggcggtattataggcggcgtactatacaatacgagcatacatgtgctcgaaatggtgctgatcatcgtgatatggggctgcctgatgtttattacgcgttttattaaaaacaggaaccgtattgcaaagcggctgattgacggcaggtcggtcctgatgtttgacaaaggaaagatacgcaccgaccatctgaaaatcacaaacaagacaacgcgggatttcattgcagatatgcatatgagggggatacgcgtgcttgacgagctggaatcggtgtggctggaaacaaacggccagtacacgatacgtaaaaaaggcgatccgccgtttccgaaggcgctgatcgaggacggtcaatacgtgcaggaaaaccttgatagaacatataataaagcttggctgaaggaagaactgaaaaaacggggttatactgacacgggcaagatcgcctatgcggagtggcggcaggatacggaagacggccagggtgtcctggtaatctatccaaatgaaacgaactgagaagatgataatatatattctggcgcagccttcctgatcgatgtataataaaatgcatacggcaaacaaaaaaggagattttatgtcatacgtcgaccagatgcttagcttcaataaagagtttgttgcaaataaagaatacgaggaatatgtaacgacgaaatatccggataaaaaggtcgcggtgctctcatgcatggatacgaggctgacagggcttctgcctgccgcgctcaattttaaaaatggggatgtaaaaatcattaagaacgccggcggcgtggtttcacacccgttcggcagcgtgatgcgcagccttctggtagcggtatacgagctcggcgtaagcgaaatttttgtgatcggccactatgattgcgggatgcaggggctgcattctcaggcgatgatcgataaaatgctgcagcgcggcgtgaggaaagaggatttggaatttatccgctattgcggcatagatgtagacgcatggctgaaggggtttgacgatcccgcggaatcggtcagggaaaccgtgaggatgatcgccatgcacccgcttatcccaaaggatatcgctgtttccggattcctgatggatccggtgacagggcgcatcgacgttatagattgaccgtccgtaaaggaccgcttaaaaaagacctccttattgatttacgggaggtctttttttgtgaaagcgtttggtgagcaataaagatggttattactaattcaaattgaggaataactgttttaaaaaatacaaataaggaaaggaatcataaccatgaaaaagatttattctgtaaaaatgacaaataccggcggacgtgcgggcgaggttttctcggacgatcgttcacttgatttgaagatcgccgccccggggagcggggaagcgggcgcgacaaatccggagcagctgtttgcggcaggctacagcgcatgctttaacagcgcgctcgagctggtgatgcaaagggccgggatcaaagcaaaaagcacggttgcgatcgtcgtatccctttatgaaagggagccgttcgattacctgatcggcgcggacatcgaggggcatatcgaagggcagccgccggaaaaaacacaagagctgcttgaaaaagcacatgaggtttgcccgtactccaaagcgacgcgcggcaatatcgaagtcacgttgaaagcggtctgagaagccatgtgtacggcactgacgctgcaaacagcgcaaaaagaaaattttttcgggcgcagcatggacttttcatacgccattgatccatccatgtacgcgcttccgaaagaatatccatggaaaaacttcctggacagcgcggcatttgtgaatgattacagcctgatcgggatcgggcaggagctttcaggagaacttgtattcacggacggggtgaatgaaaagggatttgcggcggcgaccttgtactttccggggtatgcggcgtacggttccgtttcaaaggatgcaaaaaagccgcagatatcagcgcttgaggtgatgcattacctgctcggaagatgcggcggcatagaagaggtgcgcgacgcgctgtcggggattgagatcgtgagcataccggacccggttacaaacacggttgcgccgcttcactgggtcatgacagacaggagcggaaagtgcctggtggcggagcagacggaaaaagggctcgagttgtgggataacacgatcggcgtgttgaccaacagtccggatttcaactggcacatgacgaacctgcgtaattatatgaacgccgcgccgcagcagaatatgaaagtgctgtggggaaaaaccggtttgaaaccgtttggaaacgcctcgggcacagacgggttgcccggcgggtatacgccgccggcaaggtttgtgcgtaccgcttaccagaaaagttttgtacctgtaccagacggaaggaaagaagcggtcacgacctgcttccatatcttagaaggcgtgagtataccaaaaggcgtggttgtaacaagcagggataccgtcgattatacgcggtatacggcgtttatgaacacggcgacatgcgagtatttttttaagacatatgacaacagcagtattcggacggctaagttaccgccggatatggaaaatggatccgcgcccatatgctttggaaagctggagcggcaaaccgtttttgaaagaatgtaaaggaaagcgatgcaagggggatcaccgcagggtggtccctttttatgataagaaatccgcacgcatttgtcacgctttgtgtgtgctgcttgcgtattggctgcccttaccggggcggaaggggtatatttactatacaatcggccgaaaaccggccggagactgtaaacgcggtcggaccgtatttacataaaatatataatacttgaaaggaacagaaattatgcaaaaaaaaggaaaggttcttttatcggcggcgctcgctgtgataatggtatttgcgtttagcgccattgcatttgcggcgacggccgacagcgatacgtcggaagctagtatccagtttacggccggtaatctggagctcaaggcggtccccgcgctgaatttcggatcacatgccatcgataataccacagtagattttaaaacgccggcaggtccaagcgtgatgcaggtagcggacgcgcgtggaagcggggcgggctggaaggtaacggcgcagcttggctcgttcacagtgacgggcggtacgacgcccatcgggagcgcgacgataacgcttacaagcggtacggccgcaggagtgggcacaaacgatacggcccccgtcgtaaaaacccctgttacgctcgcgacgagcggcgcggcagatacggttgcgactgcggcggcaaacagcggacgcggcacgtggaacgcatcgtggacggcggataacgcttcgatcaacgttccggtgcagcaccagcagatcggcaagcatacggcgacgttatcatggacgttggaagacgctccgtgatcaaagcaaaagtaaggatacgcgcatgtccggagaatacaaatctccggacatgcgtataaaaaagggatgggagatacggaaaattgggaaaaagaaaaatcaggatttcaattttagcggtcgctgctacgctgctgctttccttgcttcctgcgacggtatatgctgcggacaaaagcgaaacagtcggattttccgtgagcgcgaacctgccggacaaccaaaaaaacagcaatgtttcttactttgaccttgcaatgcgacccgaacagaaacagaatctgaccgtaaaggtatttaacgaaaacgcggaggagatcaaggtgaaggtagacgtgatcagcgcgtccaccaacgccaacgggatcattgattacaagacgccggacatcagggacgagacgctgcaaacgccgttatcggagatagcggaagtaaaaacgcccgtgctgactatttcgggcggcaaatcggatacggcaatcgtaagcattgagatgccaaaagaagaatatgacggcgtgatcctcggcgggatcgtactgacgcaggtaaaagaagagaagcaggcggaagaaagcaatcaggaaatacagcagggcgtatacatcaacaatgagtacagctatgttctgggcgttaagctcacagaaacggacagggaggtactgccggcatttgagggcgtggaggcgcggccggaactgctgaactatcgcgtcaatgtggtccattatatcaggaacacggaagcggcgatcgcgaaggatgtacagctcgatatcgaggtatactcgcaaagcgaacaggcggttgtccggacaagcaaaaaagtggtggatatggcgccgaattcggttatgccgtatgcgcttatgtgggagggcgagatcgccccgggaaaatatgtaagcaacgtttcgatgaaacttgaggataaagaatggaattttgaactgccattcgaaatcagcgcgcaggccgcgcaggagatcaacagcggatcggtcgagcagacacaggggatcccgtggtgggcgatcctgctggtcgcaatcctcgtggtactcatactggtcattgtgttcctgctggtcgttatgaaacgaaggaaaaagaaagaagaaaaagcagagatagggcaaagaacgacaaggtccggaaggagaaaataatcatacgatgagaaaggcggcagggaaaaagaggttccaaaagaaccgtatcatattgtttattctggccgccgcgctcgttgtggcggtgttccccgcttatgcgcaggaaacgccggagcagacgcctgctgcggccaatgaaccggtgagcggaacaccggagccgcaaggggcgcaggaacaaacgtcaacgtctgtgccgtccggtaatccggtggaaacgccggagcagtccgcactgccggcaacgccgaaggaaacaacggagccgtcccaagggacagaacagcctgttgcatccgcatcggcttctttgccgcaggacacgcaggatcccgaagcggcggcaggacagcaagaggaaccggcggcggagcctttatcgatcataacagaggggcttgccgccaatgaagtgatggtggataattttacagacttgaagaacgtgctggaagactattcgacctatgcgggagtggataccatttatttgaacggtgatatcacatatcttgcgggcggtatcacgatcaatacgaacaggaacgccgtcacaatcatcgggcacccgaaagggcaaagcgggcggcatacgattacagacattgcgggaggccagggagccgtgatccgcatacagaaaaacaactttaacctgactgtgaaagacgtggttataaacagcaagaacttttatggtacgtttactgtgcccgatgcgtatacaggcgtaacaacaagctatgtgaacgtcacatacaccggcccgcagatcacatataaccggcgggggatcgcacgctatatcgacagttccattacaattgcggcaacgggcggcgatcctgcacaggaagtggcagagttggcgcagcttgagatcggcggaaatacaacgtttaccaatacggcgggagcgacgtctatgttctggtttgcggggaacgatggaagcaaccagtacctaagggttttggacggcgcgaacgtaacagtgacgcataactcggcaagttcgccttatggttttatttatgtggaaggctcaggcggtacggcgaaccaaaaaccggaaatcacgatcggcagcaatgcctcgctctctgttgctacaagagtgggttttacgcatatagggcaccgtatagaatctgtgaatatcaaagagggaggaacgctgcgcatcagccagctgagcgatccgggcgattatccgacgatctacgtaaattcatccatcagcgtgctggtaggcggaacacttgaggtgcagcgtggcgcgaatacacggtcaaacgggctgatccgcttttataatacaggcggacagttcatcctgaataatccgaaaaggatacagctttacaatccttacggacgagtgatcacaacgcgtacggggacggcagctatctcgggtacggtaggcgcggtcaacgtctggacggcggataacggatacacggatagcatagataatatgcctgctaatatctggaataaaaatgattcgtcggcaatgagtctgagcgcgacgctgggaacggcggcggttaccgcagcgtccatatccaataaggcggaaggtgatccgtttacggctgaattcaacagcacgacattcaatacctatgcaatgcctatgctggcggcagggagctatttccttgatacagacaatatatatccgaacgatgcgcagatcacgggtactgcgacaggcaacgcagccgtaaaggtaagctataccaataacggtgcgccgcagacgcttttggcaacggcagatggaagcggagcatactatgtaagcgtacctgacacgccgctcgcgcaggatactgcggtgctggctgtaagccataaaaactacttaaaggcacggcataccgcaaaagtactggaacaaccgagcattctacatttcctctccgtaccgaagagcctgtctttccatacggggcaggttcctgcattgccgcaaatcgttggcaggcaggacgaaaactggacgatatctgtggaagatacgcgcggcagcggaagcgcgtggcgggtggatgcaagcattgtgcagccgcttacgggaacggacgggacgtaccaatatagcctgcccggggcgcttgtatatgtggacggcacaggaacgccctacgcgctcgggaacactccgttgacggtttacagcggaacgacaggggaagcggctcaaacggatattaattggacagccgacaggggcctgcttgtttccctgaaaggggggcaggggtacccgggcgtccggtatactacgacagtggaatggtcgctgatcgacgcgccgtgaaaaattaatattgtagtaaaagcggcgcggacgataccatttttggctggttcgtgccgtttttgaacggcctggccaagaacgctaaaaagctgacaaccatgcggaaaaattgatgtttgatataatgtattgcatgatgtatattgaataaatcatgaaacattttatgcttgcggggacaacaggatgtctggtttaaacggtatacaagtgaacacaatactgacatgggcaataccggcaatcgttattgtgctggctgttctgttgatttttttctatgcgcaggaataagaagctgagtaattcggaagctttaatcgcatcgcaggaaatggaatatcaaaaactccttgccaaaacgatctcaggcctttacgaaaatatttacgaattggatatcacgcgtggattcgcctgcgggaagagtacaaaagagtattttaagagcctgggaatcccggaggatacgccgtatgacgaagctatcaaggagatcgcccataagcagatcaaggaagagtttataaaaggatatctggacacgttcaggcgcagtaacgtactcaaagcgtttcgcgacggggtcaaacacctgagctatgacctgatgctcgctacggatggggaaaactaccattggatgcggatcatcggccagatattcttttggcattccgaccattcgatccgtatgatcacataccgccaggatatcgattcggaaaagaacagggaaatctccctgctggaaaagtcgcagagggattcgctgacggaactttataataagcgtaaaacggaagaactgatcacgcgtacgttaaaaagcgattcccatacggcatgtgaacacgccttccttattttcgatatagatgattttaaaaatatcaacgacaacctgggacatgattttggggatttcgttattttggagtttgcaagggaactgaccggacaatttcgcgatacggacattatcgggcggatcggcggggatgaatttgttgtactgatgaaaaactacggcggacgcggaaggctggcggaaaaactgaaagaagtatgccccaggctggtgcgcgagtatgtcgggacaaaacgcagctatgacgtgtctgcaagtattggcgtatcgctgtttccggagcacgggacaacatataccgaactttatgaacgggcggatgaagcgctgtatttttctaaagggcacggcaagaagacgggcactattttccgatcaggctgaaggggatgtttgtgcaggaaaaatacgaaggatgctatccggtgttttacgcggtgtatacgaacctgagcgaaatcgtcgccaaggtgaggacgggtatgatctattgatcggggcaagcggcgcggggcaaacaggccgtcgaaatgaggaataaaataggctttcccctttggatattccgtgctataatactccgtatgcggcggtacgcgccgcaaaaaacatgacaggggtatactatgtcagctacgacaaaaagccttattaaaagcacattgatattaggcgcggcaggcgtgatcgtcaagatcgtaggcgcgctttaccggatcatcctcgcagattttatttccctcgaagggatgagttattaccagcaggcgtttccggtctattccgcattacttatcatttctacggtgggacttcccatcgcgatttcaaagctcgtttcggagcgtgtgacaacaggagactataagggcgcgtacgccgtttttaaaacatcgcgtatgttccttgttatggtaggtattgtaacgtcagtcgctatgttttgcctcgcggggccaatcacgcagcttcaggcgctgcccggcggccaatattcgctgatggcgcttgcgcccgctttgttcttcgtatccgtgatgtgcgcataccgcgggtatttccagggattgcaaaacatgaagcctaccgcgctatcgcaaatcatagagcagtttatcaaagtaggagcggggcttacccttgcgtatttgctgctaaaatggacgggccgcatggagtttggcgcaatgggcgcccttctgggtatttccatttccgaggcggtcgcgctcctttatacgatgggcgcgtacggcaggcaaaaacggcaaatgacgcaggacatgatggcggcttacaagagtaagctgtcatggacggagatcaagccgctgcttgggaaggtgttggtgcttgcgctgcccgtgacggtggcggggcttgtcatgcctatcgtcgcgttcgtggattcggtcatcatcccgcgcagcctgcttgcgctgggttacgagagtgctgcggtacgcagcatgtacggaacgctttcgggcggcgttctgacgatcatcaacctcgcggcgatcgtttcccaggcgttgcagatgagcgtggtaccagcgatcagtgaagcgctcaagctgggagacaatgaccgcgtgaaagcgaacgtgctgcatggtatcaagtttgcgtttttggaagggattcctgtaacggtcgcgttttttgtctttgcttcccccatcttttcatttttatatccgagttccacgcccgaacagcaccagcttgcggtcggtcttttgatgacgatgtgctctgtcgcggtgttcctgccgttcatgcagaccatgacgggcgtattgcaggggatcggaaagcaaaatctgccgcccatttcactcgcggtgggggcgggcgttaaaatcggcctgagcttgtttttgatgagcattccgcagatcaacatctatggcgcggtcatcggtacggtggcgtgctacgttatcgcggcggtgatgaattatttgtttgtgcgcaaatatacgggcgtgcgcatcaagtgggggcagcacctgttaaaacccattgcggcaacggcggtgatggcggctatcgcctatcttgtatactcgctcatcgcgccgtattcaaatgcggcgggcgtgatcgcatgcgtgatcgtgggactgatcatctacttcttcatgctggtactggtgaaagcggtggacgagcgggagatgctgcagatacgcggaggcaagaaggtcgtgcaggtattgaagaaaatgcatgtgtggaaataaagggatttcaaaacaggatcacaaacgcgtataaaaatatgcgcgtttttttttatgtgattttataaaaagctattgacaaaataaatgcaatcatttaatatctaattaaagtcatcagatgactgttaataataactttacaactattgtgcgaggttagatgataatggatgatacacaactcaaatcatacatccgtatgtccgcgatcggtgcggctgcaagcgtttgcggcaggctttacataccggcggcggtctctaaccggcatatccatttgagcgaaagagacgtagagctgctttttggcaggggctatgagctccgcaggggaaggcccttagcgcagcatggacaatatgcgtgcgccgaaacgctcacattcaagggaaacaaaggaacgatcgacaagatacgcgttttggggccgcttcggggtcaaacgcaggtggagctctccgtaacggactgcttcaaagcaggcgtaacgcccgtcattcggatgtccggcgagcttgcggatacgcccggcggaaagctggtcggtccggcaggcgaggtaacgcttaccggcggcgtcatcgtagcggcgcggcatatgcatgcttcaccggcgcaggcagaggtgctggggctgcgcgacagggacgtgatacgtttaaggcgaagcggacagcgcgcagtgtgtatggaaaacgtggcggtgcgggtacatcaggattttgaactggaactgcacatcgatacggacgaagcgaacgcgggtatgatcgtaagcggcgacctgctcgaaatcgtcagataggcggcaacatggatgtaaacagcattgacatcgctgcgattgtaaagaaagtaacgcaggcgatcaaagaagaacataaactcctgtcagggataacgaacgaaagcggtaaagccgtcgcggtggtgaccggttatgtgcccgctcctgaaaagtgtagggaactcctgataaaaacctttggaaacaatgttgattgtctcctcctccatgattcggacctttcaggggcgggactatccccaatccgtatggagccgcaggacgaagcgttgttcaaacggctggagcaggcacagcaggttgcgctggttgcgccgggcgtcgcgcttatgaagcgcatcgcgaagggggaggacgaatgcgccgtttcacgggcgatcctgcgttcgctgctctggggggcgaagatcagcatcgtattggattttatgccgccgcggttcgcacgcaatacattttttgaaaagatcgtggatacggtggacgcactgcgggcgatggacatcgaggtcctcagctaccggtgcagggaagataaaaatgaaaataaactgtcccttataacggagcgcgacgtatacgaagcgcaaaaggcgggagcggataccatagaatgcgtgaaaaacgcgatcatcacgccgcttgggagcgaggcgctccgggaaacgggcctgacggtcatacagtcggtatgggagtaatgcgatgctgataggcagggtacggggaaccgtagtaagcagtacgaaaaatgaacgcctgaacggtttaaagctgctgcttgtcggcgggatcgatccacagacgctcaaagatacgggcgagcttgaggtggccgtggacgcagtggacgcgggcgaaggcgaggtcgtcatgtgcgtgcggggaagcagctcgcgcaaggtggacggactggagagttatcccatcgattatacggtggtcgcggtgctcgattccatcgaggaaaaaggaaaaatgatttttgagaaatatgcggttcgacgtcgggaaaggggcacagaggaatgcagttagggatcgtaaaaggccaggtcgtcagcaccaaaaaggcgcagcgtttagacggcatcaaaatattgatcgtgcaacccctcgatatgctcacctttgaggaaagcggccgcgcggtggcgagcctcgatacggtaggcgcaggcgaaggcgaggtcgtcatgctggtgaatggcagcagcgcgcgtatgacggatacgatgtctgataaaccgacggattccacgatcgttgccatcatagacagcgtagatatccagggcggacgcatttttgacaaagcgctgggcaaggtcgccagacaggagagcagggcagaagcaccgccggcggaagccgccggcacgccggatgaagctatagggcgggaaaccgcgaagcaggaaagaccgacagcgcccaaacagaatgcgcagtgcagcggcaacgcaaagcgcagccagaaacacggcaaaaagaagaaataagagagtccgcggggggcaagaaggatgcagatgacggaagaacaattgaaacagcttatctcaaatacggtatgcggcgtgttgagccgaaaaacgggcggcagcggtgcgcagtggctgtgcggcgacatggacgaagcggtggaaaacgcagggcaggcgcaaaggcagcttgcgggcatgacgctcaagcagcgcaaaaagatcatcgaagcgatccgcgttgcgggcgtaaaaaacgcggactatttgggacagatggcgcatgaggaaacgggctacggccacgcggaccagaaggcgtttaaaaacgtattgctcgcggaatgtacgccgggcatagaagatatcgaaacacgggcgatctcgggcgacgacggcctgacgatcatcgagcacgcgccgtttggcgtgatcggctccattatcccgtccacaaacccgaccagttcggtgatcaataatgcgatcagtatgatctcggcgggaaatgcggtcgttttcaacccgcatccggcggcaaagaagtgctcgcaggaagcgatgcgtatcataaacgaggcaatcgtttcggcaggcgggccggcgacgcttatcacaacggtcaaagagccgacgatggagagcgggcagaagatgatggagcacagggatatcccgcttctatccgtgacgggcggggaagcggtcgtatctgtcgccatgaaaacagggaaaaaggtcattgcggcagggccgggcaatccgcccgcgatcgtggacgatacggcagacctgaaaaaagcggccagggatgtcatagacggcgcaagttttgataataatgtaatgtgtatctctgaaaaagaggtatttgcatttgaaacgatcgcgcagcagttgatggacgagatgtgcaaaaacggcgcgcagaggatctatggcacggatatcgataaggtactgaaaacgacgctcattgaaaaaaacggaaagtacgtcatcaaccgcaattatgtgggcagggacgcggcggtgatcctgcacgacgcgggtgtggcggttacaggacagccgcgcatcatcattgcggaagtggagcgcacgcatccgttcatcatgacggagatgctcatgcccgttttggggatcgcgaaggtaaaggacatcgacgacgcgatcgcaagcgcgctgctggcggaaaaaaactgtaagcattcggcggtcatccattcgctcgacgtacgccgcctttcgatggcggcggcagcgctcaatacgacgatttttgtaaaaaacgggccgtcttacgcaggaaacggcttcggcggggaaggcttcgcgaccatgacgatcgcgacccctacaggggaagggcagacgagcgcgcggacattcacacgcacgaggagatgcgtattgcagggcgacctgagaatcatttaacgaggtaagggtatgagtttgattgacagcgtgaaagaagcgggtgtcatcggcgcgggcggcgccggattccccacacatgtaaagatcggatgccaggcggaatacgtgatcggaaacggcgcggaatgcgagccgctgctgcgcgtagatcagcagttgatggcgaaatacgcgcaggacgtggtcgacggcatcgcggcggtaaaagagcaggtaggcgcaaaaaaggccgtcatttgcttaaaagagcattaccacgacgcggtacaggcgctgaaggccgcatcgcgcggaaaaggcgtcagcattaaattattcaaaagctattatcccgccggcgacgaacagcagatggtgttcgaggtgacggggcgggtgatccccacgggcggcctgccgcttgatgtgggcgcggtcgtctgcaatgtaagcacgctggtgaatatcgcgaacgctttaaagggtatacccgttacagataaaatggtaacggtgggcgcgcatgttcaaaatccggtcacgctgcgcgtacccatcggcacgccaatctcgctgctgctgaaggaagcgggcgcgccggaaaacatggacggctacacggtggtggtcggcggcccgtgcatgggcaagctgacaaaagacctgagtactcccgtgacaaaaacgacgggcggcctgctggtgattccggacgaccatccgcttctcgcaaagaagcaggacaacctgcagagggatatccggcttgcgaaggcggtgtgctgcaattgcagcatgtgcacgcagatgtgcccgcgtaacgcgctgggtttaaacgtacaaccccacaaggcgatgcgtgcggtggcgcagggttcgggcgcgctgctcggttcggcgaattccgttttttcttgctgcgactgcggtatctgcacctattatgcgtgcaactttggcttatcgccctccaaaatcatgcagaagctgaaagccggcatgatgagcgaagggataaagccgaagaaggaagtaccgtttgcacctgacgaaggcatcgacggcaagcgcatccccgtttcgcgtatgatcgcgcggctcggattgctgagctacgacgtgcctgcgccgctcaaagacgagttgatgcaggtaagcaaggtacggataccgctcaagatgagcatcggcgcaccgtctgttccggtcgtaagcgcaggcgacaacgtaaacgcgggcgacctcatcgcggagatcaaagaaaatgccctcggctccaggatacatgccagtatagcgggcacagtgagcgcggtcggcgactacatcgagatcacaaggtagaggatacggaggaaaaatcagtgaatgcacttggaatgatagaactcaataacataccggtcggcatcgagtcggcagacgcaatgctcaagacggcggacgtaaggctcataagcgcgcagccggtatgcgcaggaaaatatatcgcgatcgtcgcgggggacgtgatggcggtgcgttcgtccgtgcaggcgggatgcgaaaacgctgcggataagctggtggacagcttggtgatcccgaacgtgcatgagcaggtgctgtgcgcggtaggggcggccagcgagatcggcagggtggacgcggtaggcatcatcgagacattttcgctgtgcgcggcggtcgtcgcggcggatacggcggtcaagaccgcgaatatcgacctcatcgaggtgcgtctgggaagaggcctcgggggaaaatccttcgtggtactgacaggcgacgttgcggcggcggaagctgctgtcgcggcggtcggggaaatcgaggaaacacaggggctgctgtcgcagtgcgtcgtgattccttcaccacatcgtgacctggtcggctcactattataagccgatttgtataatgctcaaatcattaaaaaaggagtaatcaaaatggaaaaagaggctttgggaatggtagaaacaaagggtttgatcggctcgatcgaagctgcggacgcaatggtcaaagcggctaatgtaaaattgatcggcaaagagcgcatcggaagcggtcttgtaacggtcatggtgcgcggagacgtaggcgctgtcaaggcagccgtcgacgcaggcgcagccgccgcaaagcgcgttggggaactgtacggcgtacatgtgatcccgcgtccgcacaacgacacggaaacgatcctgccgtctgcggagtaagcataaaatgcgcaggggaagggtcatcggaaacgttgtttccaccgtcaaaaacgagaacctcaccggaatcaagctgctcgtggtacagatcataaacgacggcgtagcggctgaggcgatcgtcgcggcggacgcaacgcggcaggcgggccttggggacgacgtattcattatggaatccaaagaggcgggactgcttttgcgccgcgaaaacacgccgtccgacgcatccatctgcggatttatcgactcgtataacgaaacgccggaagcggaggaaagcgtatgaagatcgcccgggtggtgggaaacgtcgtttccacggtaaaagacgaatcgtttacggcaaaaaagctggtcatcatcgaatggctggacgctcagctcaggaaatgcgggccgcgcatcatagcgtttgacgcggcaggcgcgggcgcaggcgatatcgtgctcgtcaattcggaaggggatgccgccaagctcatgttcggcgacgaaacgatgatcggggacctgacggtatgcggcgttgtggacagcgtcacgatcgatgggaagatgatcaaaaccacatgattttatatcttgtttttcgtagaaaaacattgacactcaagtaatcagatgatattatacaaatataatacatcatatgataatcattagataatatggagggtacagaaatggaaaaacaggctcttggattggttgagaccaaaggtctgatcggcgcgatcgaagctgcagacgcaatggtaaaggcggctaacgtggaacttacgggcaaagagcagatcggcagcggccttgttactgtgatagtacgcggcgacgtaggcgcggtacgcgcggcggtagaagccggcgcatcggctgcaaaacgcgtaggcgagctgttcgggatgcatatcattccgcgtccgcatgacgatgttgaaaaaatcctgccggggaaataacccgtgccggtcactgcacaaaaataacggatttacggaaagcgagtgattgaagttggaaatggaagacatcatcaagaagattaccgaagaagtatatagaaacctttccgcgatgcaggggacaggacaaagcgcgcccgctgcggcagggaatattacggcaggcgcctacgagcttgtgaagatggatcccgcttcgacagtcagggacgtggaagaagcatgtatggcggccaaaacaaaagggtatgcggcgctgtgtgtaccgcaatggttcgtaagcctcgcggcggaaaaattgagcggcggggcgaaggtcaacacgatcatcagcctgccgggtggcacgacgtcgacgtatgcaaagtatgcggaggtcaacgaagcggtgaaaaacggcgcgaacgagatcacgatccccgttaacatggagatggtgaaagcaaaccgtttaagcgatgcgcgcaacgaccttgaaacggcaatgatcacggcggcctctacggacggcgtatgcgtaagggcgctcatagaggtcgggaccgcgccggcggatacattgcgggaggcggcaaaaatgatttgtgattgcggaatcaagcatattgtattatcatttgtaatgagtggtatcaaggctgattcgggcgcggtcgcagacgtgataacggcttgcgcgggcaaagcggacgtagctgttttgggcggcggcgtcaccggtttgccgcagggcgcggcaagggtcatgtcgagttatgtgacctaaagtaagcagccggctcagtaaaaaactgaaatggagaaaaaagcaatgttggcgtatgttgacacgaaaaacaaattattcaaatatatcaaggcgaacaagctgcaggtgggcgacaaactgccttccgaaacccagctttccgagcttctcggcgtgagccgcctgacgctgcgcgaagcgatcaatgcgcttaaaaacgaaggagtcgtgtattccgtgcagggaaaggggacgtttgtttcctgtaatatggaccagatcgcagatacgttgaataataacctgagtgtcacggagatgatcgagcttagcggttatacggcgggcgtacagtctttcaataaagaattggtacgcgcggaaggcgagatcgcggataagctgaatgtcaacgaagggacgacgctcgtcatgtgcgcgcgcatccgtacggcggacggacgtccggtggtctattctgaagattacctggcgccgcgcctggtggaggatttcctttccgtaacggatgaaaacgtttctttatacaagttcatcgagaaccaggctggcattgaaatgggcctttgcatcgcggaactcgagcctatgaaggcggagggggatatcgccaagatgcttgaactgaaggagggcgacgtgctcttaaagttcaagatgatggtcaacgatgcatacgggacccctcttatctactccaacgaatatttacgggtcgacagtttcaaattcctgattcacagatggaggtagaaatttgaaagcggttgtaaaatatcagcagggaaaagacggtattgaattacgcgacgtacctgttcccgagatcggggacgacgatgttttactggaagtaaaggccgcaggattgtgcggatcggacctcgcatttgcgaacggccagcatgccgacatcctgtttccgcccgtcatactgggacatgagttctcgggcgttgtggccaaggttggaaagaacgtaaaaaaatggaaaatcggagaccgcgtggtttcggacaacaccggcaaggtgtgcggcgaatgctatgcgtgctccacggcggattacctgtcctgccccgagcgtttgggcctgggatacggactggacggcggattcgccaaatactgcaagatatatggagaaacgctcaaaaaatttcccaactccctcatgaaactgccggacagcatttcatttgaggaagcggcgatccttgaccccgcatgtaacgcctatatggcggtggtgcaggaagccaaggtcatgccgggagaatacgtcgcggtgttcggcgtaggcgcgcttgggcagttttccattcaggccgcacgggcggcgggcgcggcaaagatcatcgtgatcggactttcgcaggacaaggaacgctttgagatggcaaagcagcacggcgcgacggacatcgtcatctcggatcaaatagacgcggtagcggaagtaaagcgaatcacaaacggagaaggcgtgagcacggtcgtagactgtgcgggcgttgcagcggttctaaggcaggcgatcgaaatggtacgcacggccggcgtgatcatcaagatcggttacgatgaaaaaccactgggcttctcactggacgacattgtcggacgcgccattcaattaaaaggacatttcggctatgactgggtttcatggagaaacgtgatgaacctcgtagtcgccggaaaattcactctcgatacagcgatcacacataaactgaaaatatcggaatttgacagggcgcttgatttgctgcgctcacgcgaagcgatcaaagtcatactttaccccgaggactaacacaaaacaaaacacgaacacagtataagtttggaggcgagccatttggagatatacatttgcgctgatttcagccaggatggaatagaaatgctcaaagttgcaggccacacggtacgtacgggcggctggggctttgaggaacacatcctgacggaagatcaactgatccggcagattgggaatgccgacgtgctcatcgtcggatatgaagaagtatcgcggaaggtgcttgaaaatacgaatttgaaagcgatctcatccatccgtgggggcccgagggccaatatcgacgtagattacgcgacggagcgcgggattccggtgttctatacgttcggacgggaagcgattccggtagcggacttcactatgggacagatcctggcggtgacgaggaagatcgcgcgtgcggacagggaactgcggcatgggatgttcgcggcgccggatatggattacggcagcgataaggacgtgatctgggatatgacacccgaaggaccgtggcaggcgcgtaagggcatcgaaatgcagggaaaaaccatcggcctcatcggctttggtacggtcggccgcgaagtggcaaaacgtgcgaagagctttggcatgaaggtcatcgtatacgatccctaccaggatgcacagcgcattgagcagggcggcgcgcaaaaagcggagctggagcaactgctccgttcgtcggatatcatttccttccatgccaagatcacggacgataataagggcatgatcggcgaaaaacaatttgccatgatgaaggacggcgtatacatcgtcaacaatgcgcgcgcgggactgatggacgaaaacgcgctgcgcgcagcgcttcgctcgggcaagctcggcggacttgcgctcgacgtattccaccaggaaccgatcaagagcaatgacgaatattttaattacgaaaacgtggtgctaacgccgcatatcgcaggctccggccgcgacgtgatctatctgcagtccgtcatgctggtcaacgacctgatgctgtactttgcaggcggcaggccgaaaccggtggtaaaccccgaagtgttcgataagattggaaggtgaatgaaatgcctcttgtaaagacattggatatcttaaaagattgcgaagagatgaagtatgcggtaggcgcattcaatatcaacggcctcgaccagccgcaggcgctgatcaagcgtgcagagcagttgcgcagcccgattttgatggtcatccccggcgtgatcgaaaaatatgtgaattttgaggactatgtcaatgtgacggcgcgcgcggcgcgcgatacggatattccggtggggatccatttgagccacggactcgacctcgagcagttcgaacgtgcatgcaaggccggctttacatccgtcatgtacgacggttccaagttcccatatgaggaaaacgtcgcgaatacgcgtatcgcggtagagatcggccataaatacggctgtgccgtggaaggcgaactcggcgcgcttgggagttcttttgcaagcgtttccgaatccatgacggatccggcgatggcaagagattttgtggaaaagacgggtgtggatatcctcgcggtcgcgatcggcaacgcgcacggcttttataaaggaacgcccagcctcgatttcaaacgcttggaggagatccgttatgcgctgatggcaaagaattgctacctcacgctgcacggcggcacgggaattccggaagaccatatcaagcgcagtatcgaaatggggatcgtcaagatctgcatttatacggaaatgtgccatgtgggaaaaagaaacgcgatcaaatacgtggaagagcatcccgaatatacgggcaactacgatatttgcgatttgatcggctcgatcgataccggatttgcggatgcggctgaggaaagcatgcggtggttcatgagcgttggaaagatcgggcgcggaaacagtacgttcgcggcgctcgacgcgcctgcggtaagcaaacagccggtctccgcttcgtttggcggaggcagcgcggcgcctgctgcggcgcaggccgatgcgcagcccatcgtaacggatccaggaccgaaatatccgtcccttccggcggagaacaacagctttcgggcaacgggagatttttggaacaagaacgtttgacggatcagatcgctgacggaggagtatagacgatgctgctgatgggagtggacatgggaacgtctggctgcaaggccgtgatattcgatgaaaaatggaacgtggcggcgcaggcttaccgcgaataccagctccatttcccgggcggcggcgctttggagctcgaccccgaaaccgtatggaacggtatttgtgaggtgatcgccgaagcgaacagcatatgtgcaaagccggtggacgcactggcagtctccgcgatcggcgacgtgatcatccccttagggcaggacggaaagccgctccgcaattccatcgttgacttcgatatacgcggcaaaaaggagatcgacgcgtttgtggaagaattcggcggggcaaaaaagtttttcgaaatcacaggcatgccgcccctgtaccttggcagcctggccaagatgctatggctcagggaacatgaaaaagatgtgtttgagcgcgtcgcaagatgggctacgtacgaggatttcctcgtagagcggttcgggcttgcgccttccgtcagcctgagcgaagcggcgcgtacaatgctgctggatatccgcaagaaagactgggcggcggatatcttaaaacaggtgcctgtcaaaaggtcgcagcttcctcagccggtgccgtcggccgccaagctcggatatatggattcgaagctggcaaaggaactgggtttcaaaggaccggtgcagatagcaagcggcgggcacgatatggtatgcgcagccgtaggcgcaggactcgatgaagaagaaagtacgacggcagtggatattgcgggtacgatcgaagggatcgttgcagctatgccggaggcgaacacttctgcggagatgcttgaaaacctgctgccgtgttaccccggattcaccggatacgtgacgttcagcgtcaacgtgacggcgggctgtgtgatacgctggtaccgcgacgcacttgaccgcgaagagtgggaagaatgcaaaaggacaggggaaaacttttacgaggttttccagcgcagggtggatccgcagacgccgggctccctcatgctgatcccgcatttttcagggagcggcaatccatattttgatccaggtgcgcagggcgttatctacggactcaacctggatacggcaaaagaggatatcgcgcgcgcagccgttgaaggattatgttatgaattgaagcagcatacggaggcttttgatcgggcgggcatacgcttagaaaagctgtatgccgtcggcggcggcgcaagggtcaaaaaacagcttcagttaaaagccaacatcacaggccttttggtagaacagggtatcgtaagcgaatcttctgccatgggggcggcggcttatgccgcagtcgcgatgggatacatcaaaaatcccgcgcaggccttcggaaaaatcaaaaaacagggaatactttttaagccggacaaaaaagcggcggcacgttttgcggccgcatacgaaaactatgagatgttactcaaaaaaatacatcagtttgaacagttaaaacaagactaacggctttcactttattcagacttcaaggcgaacagaaaacaatcaaagatgcttgggcaggcccttgtatgtttgttgttacccaaaatagcgtaaaatgaacttttttactataaaatttgtcttattggtcagtgaaatcatgaaaaggggaagtaaagatgaaagaattaacgctgggacaaagtgcaaaactcacatcgccccatctcttcgcggcgatcgtcacaaaagacgacgacggaagggtcaatattatgggcgcgtcatggatcacgtttgcgtcgcttcgggatgcaaaaatgattttctgcatctccaattccggttatacgggcgggatcgtgcaggcgacgaaaaaagcgagcctgtgtttcgtgacgcaaaaggcggcggacaagatttttaagtgctgcacggtgagcggaaggacgacggacaaaatcaaagaattcgggatcgcccttgaagatttagagggatttgacgttcccgtaccggaaggcgcgggagtcgcgttcagcttagagcttgacgaagtggcagccggcggcgaccacggtatctatatctgttccgtaaaaaaagcggcgcagctttgcgaagagcctgttgtaatggccttcgacgggtacagcaggatcggcacattataaagcggaagctgccattggacgagaaaacggataaaaggaggagtggagcttgaattatgtactggaactttcaaatatcggcaagacgttcgcgggcgtaaacgtactgcgcggcattgacttacaactgaaaaaaggcgaagtccatgtgctgctcggggagaacggcgcgggaaaatccacgctgattaaaatcatttccggttaccacaagcaggataaaggcgggaccatcaaagtggacggcagggaagtgtccttcaaacgtcccaaggatgcgatcgacgcctctatccatacgatctatcaggaactgacgctgtgcccgtatatgacggtggcggaaaatatcgtgatagacaagcaggatcagtttgagggcggaatgctcaagacggcggatttccgcaggatcgcggcagacgcgctcaagaagctgggacagccggagatccatccggatacattggtgcgcgacctttccattgcccagcagcaggtcgtggaaatcgcaaaggcaatttctgcggacgcaaagatcgttctgatggacgagccgacctcgtccatttcccaaaaggatgcggataagctgctgcagatcgtccgcaacctgcgcgacgagggcgttaccgtcatctatatctcgcaccgcttgcaggagatcgggcaaatcgcagaccgtattacggtcctgcgcgacggaaacctggtaaagacagtcgagcagaaggacattacggataaagagctgatcaacatgatggtcggacgcgatattacaaacacttatcccaaacgcgaagtagcgctcggggatgtcgtcttgaagctggaccgcgtgaaatgcgaaggcgtatttgaagaagtttcctttgaagtacgggcgggagagatcttcgggatcggcggtatcgtaggcgcaaaacgtacggaaatactggaagcaatttttggaatgcgcaaggtcaccggagggaaaatgtatttgaacgggaaagaatacaggcccgcggaaccgcgcgacgccatccataacaaaattgcatttgtcacggaggatcgaaaaaagacgggtttggtgttgtgccttccaaccatggaaaacatcaatatgatcaacgtacagaaaaaatccaggttcgggtatatcgactggaaagaaatgactaagaaagcagaacggcaaaagaaactgctgaatatcaagctcaacgacttgaaccaaaaggtgtctacgctttccggcggaaaccagcaaaaggtagcgcttgcgaaatggatggattttgaaccggctatcgtattgttcgacgaaccgacacgcggcatcgatatcggcgccaaaacggaaatctataacatcatgggcgagttggcgaaaaaaggcgttgcgatcgtcatggtatcgtctgaactccccgaactcatcagtgtaacggaccagatcatggtcatgcgcgaaggcgtgatgaagggaattcttgacaggaatgaagcgacgcaggaactcattatgagccttgcgacaatggaagcaaaatagcaggaggaaaacgatggaaaacttaggaaagaatagaagtatgatgggatttttgatcaaatacaaaacgatcattatcctggcagcgatcatcgtgattttcgcgatccttaatccggtattcattatgccgatgaacctgatgaatatgctcaaacgagcgagttacgtggcgcttgtcggctttggtatgacatttatcattacactggcggatcttgacctgtcggtggggtccatgggggcgattgtgggcgtgacgctggctatgatgctgggcgcgggcgtgccgctcatcctggcgatcatcattgtgttcgcgctgtcgctgggtatggggtttttaaacggcgtcatcatcgtaaaaggaaagatcaacgcattccttgtcacactggcgacaatgaatattttccgtgggatagcgatgacgctttcgcaaggccgcccgatcccgatcacggcggagggatttgctgatttctttggaaacggcctgattgcggatttcatcccaacgcccgtaatccttatcgtaatatttttcgtgttgacgctgttcctttataagcatacaaaatttggtttttatgttcgctccatcggcggtaatcccgaggcggcgcgtgtggcgggtatcaatgtggacggtatcaaaatgatcgcctttacactgaacggcctgtatgcctgtgttgccggattgatccttgcagcattgatgaatgcgggtatgtcggatatcggttcggaccttgcgctggacgccatcgcggccgtcgtactcggcggaacgatcatcgccggcgggtatggcacggtctgggggaccttgggcggcgtactgatcatgggcgccctcaacagcggcatgagcatcctcggcgcgcagacgccggtcatcatcctggtgaaaggcttggttatcatccttgcggtgctcatgcagaacgtattgagccccgataagctcaaggcaaaacccataaagcccgcggcaggggaagccgctcctgtgaaagaataggtaaagtttttcattcgatgaaaaaagatggaaaaaggtaatctttctgtcctga

SEQ ID NO: 8 - DNA, 168191 bp, Christensenella sp.
ataatatattgattaattagttccgtcaagtatttttggatttctttttaataaaataatatattaattctctcacatttgtgaagcaatgtataatttcttcttttttagctatatttaaatgcgtttgctgacatttttccaaaacgcttccagttaaataattaataatattacaatttatatttaagctaaatattattaatattattacaaaaaatactggcgtattatttaatatgatgatataattaataaaatggcaacaaatttactgcacatataaaaattgttttatactatacgccaaagggaagagatatgaaaaaaagagttactatggcagatattgcctccgaagtcggaatttcgcaatccgccgtctccatcatattaagcggcagaaaagatatgagttttgccgacgagacaattaacaaggtccacgccgcatgtgagatgcttggctataagccttcacgctccttatcccgtatcgattcaaagaccattatgatcatgagtgaaaatttaaccatcccctactatgctttgctgacacagcaaattgaaaacaccgctcacttacatggctataaatcctttatttgtaatacaaaccgtaataaggatttcgaagttgcttatcttgatatggcggtcagaatggatgttgctggtattatttgtctctcgcatccgcattgccccgaaaaattcagcgaagtctcaaaaaccattcctgtcattgctgtgtgcgatcgtgtcgaaaatttttccgtagacattgtagagatggataattaccaggcatctgtccttttagtcgaccatctggtggaactggggcacaaaaacatcatgctgctgactgcttcccctgagatcaacatgggcaggcagtttcgcttaaaaggactaaaacatcgtttagcgcattatggacttgaagattctttttccgtccggattaaagaagttgattggcaaagtgaaatggcgggtctggtcgacgactacaccattggctacgagcttatgcaggatccttccattttaaaggaaggcttcacggcctttatcggcatgtcggatcttgtttcccgtggtattgccgatgccttgatcgaaaaaggaaaacgtatccctgaggatttttcgatttgtggatacgataacctgctttatgcccgtctgcttcctgtttccctcacgacaatcgatcaccatatcgagcaaaagggtcttttggcatttgaacttctgcagcgtcaaatgaaaattttaagccgtaaagaagatacggattttcaggaagcgcgtatcaaactggagcatccccctgtcctcgtagtacgaaaatcgacgggtcctgctcccagacaataaagcaagaggcgcgattgatatgcgcctctttttttacccctggtttttcactgccgccgcgacgaactcacgaaacagcggatgcgccttgttgggcctgctcttaaattccggatggaactgtactcccacaaaaaagtcattgtccgcaaattcaactgcttccacaagccttccatccggcgacatccctgaaattttcagaccgcctgcttctatttcctttctgaaatcgttattgaattcgtaacggtggcgatggcgttcggaaatctcctctgttccatatgccttttgcaggatcgatccgggtattgttttgcagggataagcccccaggcgcatcgtaccgcccttcttgtccacgccgcattggtccggcatcaaagcaatgaccggatgcaaggtatcctcgctgaattcccctgaatcggcgtcggcatatgccagcacattacgggcatattcgattaccgctacctgcatacctaaacaaatcccaaggaacggaacatttttctcccgtgcgaaacgcgccgcattgatctttccttcgatccccctgcctccgaacccccccggtatcaatatcccattacagtcaccgagcttttcttccgtattgtctgctgtgagttcctcagaatcgatccattcaatatataccttcgtcccattttcatatccgccatgggcgagcgcttccgcaacggaaaggtatgcgtcatgcaactgcacatatttgcccacaagcgcgattttaaccgtttttttgctgttttcgatccgcttcaacatcttttcccaatccgaaaggtcgggctgtctgcactgtatgttaagttcgcggcagacaatatccgccaatccgttttgctcgagcatcatcggcgcttcataaagcacgggcagcgtcctgttttcaatgacgcaatccggctttacattgcaaaaaagcgcaattttttgccttatcccttcatcaaccggttcatcgctgcgcatgacgatgatatccggcatgattccaaaagactgcagctcctttacggaatgctgcgtcggctttgatttatgttcgcccgagcttttcaggtaaggaaccagcgtcacatgcaaaaacaggcagttttccctgcctgcttcatgcgatacctgccggatcgcttccaaaaacggctgactttcaatatcccccgtcgtgccgccgatttccgtaatgacgatatccgcatccgtttttttgcctacggaataaataaacgtcttgatctcattcgtgatgtgcgggatcacctgcaccgtttcccccagatattcgcccttgcgttctttatcgagcacgttagcgtagaccctgcctgttgtcaggttcgaaaaccgattcagatcctcatcgatgaaccgctcgtaatgcccgaggtcaaggtccgtttccgcaccgtcatccgtcacgaatacttccccatgctggtacgggctcatcgtacccgggtcgatgttaatatacgggtccagcttttgcgccatgacctttaatccgcgcgccttcaggagcctgccgagcgaagctgccgtgatcccttttccaaggccggataccacgcctcccgttacaaaaatatactttgccatccatattctcccttccatcattcatacgtttccaacaatttttccgctacctgccggcgcggcacccgcaaatccatcgcctgccgttcaatataatggtgtgcctgctcttccgtcatcttcagcacttcgatcaaaatgcactttgcacggcttaccacgccgatatcctcgatcttgcgctccagcttgactttttccttctggaatgcttcgatcctcttcctgcatgcaagcgccagacggaaaacacggtaaaaaagtttctggctgatcggcgtgcgcactgccagcgcgcccgtttcttccatatggataacgtcccgctcgtctgcctcattgcccatcaccacaacgataccgcaggaaaaattctgcgccgtatgctctgtgagttccctgattttgctttccgcatgcggcgcattgatcaccataagttccggatcatataagagaagcatctcttttgcccgcaaagcggtgtccgccgtgaatatttcatgctcgccatattttaggatcagggcctcaaaaaagtccctgccccgcgccgactctgatacgatcaaaatgcgactcatgccgcttccctttctaattctgcgtgtagagcaacctgtagggattcttgctgtccggccgcagcacataatatgcgctgtccataatcttcccctcgctgtgcccaaacattttgcaaaattcctttacataattttcaatgacctgcaaatcctctcccttggccttctccgccacaacttgcggcggcaggttccttggttcgtctgcacaccttaagtatatcttgccgccatgcattcccacgccgcaaaaatttccaatcggttgcgtatggtaaagcccgagtacaaggatggttcctcccgcctggtattctccaagaaagctccccgcgctgccgccgattactaaaaccgggcttttctcctcatattctttcatatggatccccgcacggtatccgacatccccgttcacaaaaatcttgccgccgcgcattgcgtaccccgttgcgtcaccggatgttcctgcaatatagatcgtcccgtcgttcatcgtatcgcccgtcgcatcctgcgcgtttccgttgactaaaatcgtgcttccgtcaagatatgcgcccagcgcattacccggcgtgccgttgaccacgatacgttttcccttaaggccgcttccaatatagcgctgtcccatgcagttattgataataacctctttttctgcttccttgattttgtcatttaacgtccgaaaatgcatatcccttgcatctattttcatgtctttactcctcccagtttttcttttcgctgcgcccttgaaaacgccatcaattgcggtttctgcctgatcaacccataatcgatggtatcgagcggcgtttgttccctgatgagcgcagtataaatccccgcgcgcgccacgtctccaaccaggataatccctttgagttttccatcctttgaaaccagctttttataattttcaccactttgctgcgtaaacgtttctccgtcataattccctgccgtaatcatgtgcaggccgaaaaaaccgattgcgttcatggggatggcgttttgatattgcttcgttcctcccgccatattgacccccgcgcattcgccctgcatatatgcgttcggaagaagtgcaagcggacgctgcatgccggttgtgatatcgaggctttccgtgcaatctccggcagcataaatatctttaactgacgtggcgcacatcccatccgtttcaattcctttttggactgcaattcccgcttcgcgggcaagttctgtattcgctcgcacgcctacggcaacgaccaaaatatcgaacccgatccgtgttttgctttcaagcaccgccgtgttcccctcaaattttctcacaccgtccctcaaatggaaggtaacgccctgcctttcaatatgtttttgcacgatttgcgccgcctccctatcgaggatgctcggcaggatcctgtctgccagatcgacgacttctatggacttcaccttatgcgcgatcccttccacacacttcaatccgatcaggcccgctcccatgatcagcaccctgctgtccgctttcagcgcgctgtccaattttttggcatcctccagcgacataaaggtatactgtttttctacatctttgagcccttcaatatgcggcacaaacgaacgcgaacccgtcgcaatcaacagtttatcgtattctacgaccgttccatcgtctaagaacagccatttgtcgtttacttctatttttgtaacgtttttgcctaatatcagcctgcagcccatcttttcataaaaatcgtccgtacggtatttcatgtgctcctccgtcgtctcgccgcacaacagataggagatcgcagggcgcgaataggtatggtaaggctcctttgaaatcacggtaatctccccatttttatgctgctgccgtatcccttcgatgcagcccaccgccgcagccgaatttccaatgattacatacttcatgcttccctctcctcaaatacgatcgcccggttgggacagccttccacacacgccggcatgcctcctgcgttttccatgcacaattcgcatttttgcatgacgccggcctcggacggcatgatcgccccatacggacacatcaaaatacatgtacagcatccgacgcatttatcctggtcgatcacgatcactccatccgtaacgctgagcgcgcccatgatacaccccttgacgcaaagcggttccctgcaatgcctgcacgacaccgcaaagcatacgtttccagcctcctcaatgcggatgcgcggattgatcttaatatccttgagcgcttttaccatatccgtttcatccgaatttgaaaatgcgcagttatattcgcacaggtgacatcccaggcaccatttttcatctacgtaaatccgtttcatacttattctcccgcatatttcacgcccaaaataccaagttccctgtcacttaatccgatcccgcgcagcatcagcctgttcccacgcagcgcttcgatcgaattgatccccatgccgcccatcatttccttgatttcgtgctcccacgcatggacgaggtttaccagccgctcgcttccgatatccggattcagccgttttgtcagttccggctcctgcgttgcgataccccagttgcattttcccgtctggcagctcctgcacaggtggcatccgagggccagcagcgcgcctgtcgcaatgtataccgcatctgcgcccaaggccaccgccttgacgacgtctgcgctgctgcgaatactgccgcccacgatgatggatacgttgttgcggatcccttcttcccgcagacgctggtctacgctcgccagtgcaagttcaatgggtatcccgacattgtccctgatacgcgtaggcgcagcgcccgtaccgccgcgaaagccgtctatcgcaatgatatccgccccgctgcgcgcgatgcccgaagcgatcgccgccacgttatgcaccgccgcgatcttaacaatgaccggtttcttgtaatccgtcgcttcctttaaggaatagacaagctgccgcaaatcttctattgaataaatatcatggtgcggggcaggcgatatggcgtcgctgccttcaggaaccatgcgcgtacgagaaacgtcgcccacgatcttcgttcccggaaggtgtccgccgatgcccggctttgccccctgccccattttgatctcgatcgccgcgcctgcgctcaaatagtccttatgtacgccaaaccgtcccgatgccacctgcacgattgtgttggcgctgtattcgtagaaatcctcatgcaggccgccttctccagtgttataaaacgtaccgagcgcacgcgccgcgcgcgcaaggctggcgtgcgcgttgtagctgatcgatccgtatgacatggccgaaaataagataggaacgtccaaaacaagctgcggtgataaattatttttcaggtttcccttttcatcccgctcgacatgctccggcttctttcccaggtatgtgcgcgtttccataggctcgcgcagcggatcgatggatggattcgtgacttgggatgcgttgatcaaaagcttatcccaatatacgggataaggctttgggtttcccatggacgaaagcaatacgccgcctgttcccgcctgcctgtatagctctttgatcgtctcgcccgtccaatttgcattttccttaaaggtatggtccgatttcacaatcttcagcgcgcgcgtcgggcaaagggacacgcacctgtggcaattcacgcatttggcctcgtcgcttttcatcaggttcaattcctgatcataactatgcacttcgtttgcgcattgccgttcacagacacggcaggcgatacatttcgccgtatcgcgcaccacctcatgatccggatatataaaattgataggcatcttatgcactctcctttgagtcatttgtctgtcccgttttttgttcgtccagcactgcgataaccggctccccgcctttgggcgcccataccttttccagctccggctgcacagcgcgtatcgcgcattcctcgcttgccacgtagaccatatcgccctgctgtgcggcgaccatagagcgaagcttcagcctgtcgtttaaagccatcatcccgccttcaaacccaagcaggatggaaaaaggccctgttaccagcatgcttgcgaatatattgcggaggtaactcatttgagctttttttgccggaggcatattctcgatactgctccagaacggcgccgcgaccacatgcgcgatctcttcataggtcagcccctgcctcctgctcaagtaatcgatcatataagtgatcacttccgtatccgttaaaagcgtacatttatatccaaacatttctatgtaacgcctgttcgcgtcgtacgaagatatctctccattatgtacgacggaatagtcgagcatcgcgaacggatgcgccccgccccaccagcccggcgtattggttggataccttccgtgcgcggtccagcaatatccttcatattcctccagccggtaaaactctccgacgtcttccggaaatcccactgccttgaagacccccatatttttaccgcttgaaaatacgtaagcgcccttgatgcgcgtattgattttgatcacgcaacgcacggtgtattccctttcatctaactgactttccatcaaccttatatgtaaagggctgagaaaatatcgccagatcagcggctcgtccttgatacgcggatgtttttgcgtcggtattttggaaagattgatgatatcaaaatggttttcgaggaattcttcacattcccgctttgcttccttatcatcgtagaatacgtggaacgcataataatctttatattccggataaatcccatatcctgcaaaaccgccgccaagtccattggaacggtcgtgcatagttgcgatcgatttgatgattaaactgccgtccatcctttgtccgcttctcgaaaacattccggagatcgcacaccctgacggtattcttacttggccttccttttgcatgatgtcttcttcctttcctcatcttttcaacatggtttatgatacctctcatataagctgcatgtcaagtctaaaatgaaatatttaaattatttcttgcattttataattattttttttcgtttttagcctataaaatccatcatattgcaatttattgtataaaacatttcattttttcactaaaaacgcttgacatttttttgccgtaattttataattagggacgtggacagcaagggcgctgcggaaacataaaacttttcccgcagtgtccttcctattttatcaaaggcattgctgcaagaaggaccaaatagcagtgccgtggaaggatggatcataatggcaaaagcaatggaactattcggcagtatggtattcggcgataccgtcatgaaacaaaggctgccaaaggaaacttaccgcgccttaaaaaagacgatcgaggacggtaaagatcttgacatcggcgtggctaatatcgtcgccaatgcaatgaaagattgggctgtagaacatggtgtgactcactttacgcattggtttcaacccatgacgggaacgacggcggaaaaacatgacagttttatttcgcccacgtccgatggacagatcatcatggaattttcgggcaaggaactgatcaagggcgaacccgacgcgtcgagttttccttccggcggtttgcgcgcgacctttgaagcgcggggctataccgcatgggatcctacctcttatgcttttatcaaggatggtatcctgtgcattcccactgccttttgttcctacggcggcgaagccctcgataaaaaaacgccgctccttcgttctatggaaacgctctccgaccaggcgctccgcattctaagattatttggaaatacgcaagcgacgcgcgttctctccacggtcggtccggaacaggaatatttccttatcgaccgaaagttatatgaacaaaggaaggatctgaaatattgcaaccgtacattgttcggtgcaaagccgccgaagggacaacagctcgacgaccactatttcggcgccatccgtccgcgcgtctccgcttttatgaaggagctggacgaagaactgtggaaactcggcgtgcttgccaaaaccaaacacaacgaggtcgcgcccgcgcagcacgagcttgcgccgatctttacgacgacaaacatcgcgacggaccataaccagatcacgatggagctgatgcggcgcatcgcgtacaagcacggccttgcctgcctgcttcacgaaaaaccgtttgcaggcgtcaatgggagcggcaaacacaacaactggtccatctctaccaatacgggagaaaatttgctcgagccgaccagcgacccgcacggaaacctgcaattccttttgttcttgtgtgcggtcatcaaagcggtcgacgaataccaggacctgctgcgcgtctctgtcgccagcgcgggcaacgaccacagactgggagccaacgaagcgccgcctgcgatcatttccatgtttttgggcgacgagctgacggatgtgcttacctgcattgaaacggacagcgattatatcgaccgtgtgaaatgcgatatggaaatgggcgtacacgtactgcccaattttgcaaaggatacgacagaccgtaaccgtacttctccctttgcgtttaccggcaacaaatttgagtttcgtatgcttggttccgcgatttccatcgccggaccgaatatcgtactcaatacaattgtagcagaagaattgcggcagtttgccgataccctcggacaaggtacggactttgaaaaagatgtgctgcaactgattaaaaaaacgctcaaggagcacaagcgcatcattttcaacggcaacaactactcgggcgaatgggtggaagaagcggaaaagcgcgggttgctgaacttgaaatcgactgcggactgtatgccgtatttcatccatccgaaaaatgtggagctcttcacgagtcacaggatatttacggaaaaggagatgcattcgcgctatgagatcattttggagaattattgcaaaacgctcaatattgaggctgtgaccatgctccaaatggcgaaaaaaagcatcatgcccgccgtgatctcctacacccgcgaactgacggaaacggcgctcgccaaaaagcaactgggtgtaagtgcggatgctgaacaacggctttcctccgaactttcttcgctgctgacatgctttatcagcgcgatcgacaagctggacgaagcgatgatcagcgtgaaggatacgggcgatatcgccgtgcaggccaaggagtaccgcgaacatatattttcagccatgcaggaggtacgcagcgtttccgacaggatggagaccatcgtcagtaaaaaatactggccatggccgacatacggcgatctgttgttcagcgtataacaaaatcatataccgtaacacaaaggcgtgtatcccaaaatgttatagggtacacgtcttttaaaattttctaagggggctttattatgttttcagcagttgacacagtatgggttcttctgggtgcggccatggtattttttatgcaggccggatttgccatggtagaaacggggcttacccgtgcaaaaaatgccggcaatatcgtcatgaagaacctgatggatttctctttaggttcgatcgttttctggatcgtcggcttcggactgatgttcggcgtttcagcatccggactgatcggcacgcccgacttcttcgtacagggtgattatgcaacgggcgacatcccgtcttatgcgtttttcatcttccagacgatgttttgcgcgacggcggcaaccatcgtatcgggcgcaatggcggagcgcacaaaattctcttcttattgtatttacagcatcattatcagcgccgtcatctacccgatttccggccactggatctggggcggcggctggcttgccggcctcggcttccatgattttgcaggttccacagccgttcatatggtaggcggcgtggcggcgctcgtaggcgcaaagatccttggcgctcgtattggcaaatacgacaaggatggaaagccaagggcaatcctcggccacagcatcacgcttgcagcgctcggcgtgttcatcctctggttcgcatggttcggctttaacggctgctccacgctttcggcttccggcgacgcgacttcggctatgggcaagatctttacaacgaccagtatcgccgcagccgcagcttccactggcgcgatgctcatcacatggttccgttacaaaaagcccgacgtttccatgacccttaacggcgctcttgcaggacttgtcgccattaccgcaggctgcgacattgtagaaccatgggcggccgcggtaatcgggctgatcgcctctttcgtggtcgtattcggtgtggaattcgtagacaagaagctgaagatcgacgatcccgtcggcgcgatcgccgtacacggcttttgcggcgcgacaggaacgatcctggttggtgtttttgctatcgaaggcggacttttatacacaggcgacgcatcctttttaggagtgcaggcactgggcgtggtatgcgtcgcagcatgggttgctgtcacaatgaccatcgtcttccagatcctaaagcacacaaatgggctgcgcgtttccaaggcggaagaattggccggcctcgacatcgaggaacacggccttgcaagcggatatgctgatttcatgcctgcagtcaccgcagacctcatcgcaacgggcgacgttgtcgacgggcatgccgcaatcggctatactaaggccggccaggtgacgcccaccaaggcggtgcccgtggagcatatgccggccagcgtttccaaagcggcagcttcagacgtcaggatgaccaagctggtagtagttgccaaccagagccggttcagtgcgctgaaaaccgcgttggagaatatcggcattaccggtatcacagtcacgcaggtcatgggcgcgggcatgcagaagggccattccgaatactatcgcggtattcctgtggacatcaacctgctccccaagatcaaggtggaagtcgtggtatgcaaaatccccgtcgatactgtaatcgacgcaatcaaggaagccctgtacaccggacatatcggggacggaaaaatctttgtatacgacgttgaaaacgtcatcaaggtccgtacaggcgaagaaggctataacgctttgcaggacgaagcgtaagcataaacatccatccatacgtaagacgccgaaaaggaacggtctcccgttcctttttggcttatgttccccaatatggtatacttgtattatgaaacgaatttttttaacgacaacagcgatcctgctttgcatcatactgctgcttgcaggatgcgaagggcaaagcgcaaatgtcccttccccgtctgcaaccgcaacgtccgccgaggcgccaacgccgactccgacacccacgccgacgcctgagccttcccccagcccgtcgcaggcaccgacacctactctgacgccaacgccgacgcctgaaccgacaaaaacaccgatcgaagatatcccgatcgattatgcggcgcttgaagctttggacggcagcaaggacggctggggacagggacttgagaaggacgatctgaacaggccgaccggctctttggacgcacaaaaaaaatatggaaaatatgatgcgcttttcattatgcctgaagaacaaaaattctacctgacgcttgatgagggatatgaaaacggatgcacctccggtatcctcgacgtactcaaggaaaagggccaaaaagccactttctttgtcacctattcctatgtgcgcgataatccggagctcgtgcagcgtatgatagacgaaggccatgtcatcggcaaccatagctggtcccaccgctccatgccagatctttcccttgaggaagcgagggacgaaatcgtaaaactgcaccaatatgtacgcgatacctatgggattgagatgacggttttccgtccgcctatgggggaatattcggagcaaaccctggccctgacccaggcgctcggctacaaaagcgctttctggagtttcgcatattatgattacgaaccggacgaccaaatggcgccggatgaagcccttgcaaaaatcacccaaaatatccatccgggcgcgctttacctgctgcatgctgtatccagcaccaacgcacagattttaggagactttatcgaccgcgttcgcgcgcaggggtatgaggttttgcccttgcaataaatacaaaaagcacatgcaattgcatgtgctttttcattttcaatttcaatatccgttttcttccgtcgctttgtcgatcatcttaatcaattccaatgcacttctgaaactttgagtttcgttcttttccgaccaagtagcctgtccctgccatgtagcattctggcggtactgtacctgcaccacaaaagtcgcttttttccccggggcatgttccttagccgcctgttccataatcttttccttttttttctgcatagtttcctttttctttgttttaccaaacatccggtactctgtagaggccgccggatactgtatgctgtcaaagaccgtctccgtcttcaaaagcaactggctgatactgagaaaaagcgccggttcatgcaggctgccgtgatatatcctgccaacgaggtcagtaccctcccgctcatcgacacatatcgtaattgcattttgcatcggaatgccgcccctcatgtcttctcttgcctgtcaagcgcactttccatcagcttgatcagttccaactcgctgcggaatctctgcgcttcctttttttccgaccagatgatctctccctgccatgtagcattttgcttacactgtatctggatgataaacgtagccttattcttttccaacgagaaccatcctccgttacctgatatttctattttattgtactagctaaaagtcacaatcctggtcacaaattgggatagaaagccatttttttaccattgaatgtcacttttttgttcttggtttcccatcatgttgtccatgtctgcggcggaaatacttttgcaaacaaaccgcatctgattattcgtctttgaggttttataaaaattataccgcaggcggtctgccacaatattgcaattttcctgcttgatttccataagcatcgccaggaactgcgacggactgtaacgcgtataggcgtctccacgccgcagcgatcccttgatcgccttctgtacgttatccataacctttttcgtcttttccccattttccggctttgccccatttaaatcagtgacggtacaaagcatcaaaaagactgattgcccgctgcgctccatatgccttactacaaatcggtacaggttttcaaacacctcgagattacaataaaaagcaccgttctcatattccgcctctttgatctcgctgcgcacgtccatgatcgaaagattcacgtccttccgactgcctgatatatgtctaaacaattccttcatcttgtccgaaggcccgatccccagatcgtcaaacaacctctccgtaacggattcatatacctcgatcgcctcttttgcgcggttcaattcataaaggcttttaatatacataagcgcaaggtcttcttcgtacggataaatagtcaccgcctggcgcagctggtctgccagggcgccataccgttttgtttttacagcaatatgataggccctcctgaagcaattgcaatattgctcctgcaagcgtaccgtcagtcccattacccaaggctcccccgtctcttttggaagaaagcccatcttatatatcccgatcgcttccatgcacatttcaaacgcggtatcatcgtcctgcccatccggcattgccctccggatcaattcgtcaaattcttccagatcgatcacgcacggcatatcccctgtaaatccgtaagcgcttttctggtaaccgatgcattccctgtctatattgtttgactcaagctgcttgcgcaggcggtaaacaaggtttttcaaggttcccaccgggttttcacagtcttcatcgcttagtagcacatagatcagctcatcctgcggaaccagcctgcctcggttacataataaatactcgaaaagcatgagcaccttactgtgcctgctttccttcggaatgacgacctgatccccatacattgccctgaatccgccgaacatttcaattttcaatactttttcttccattttctcctctaatcataggcctaatttctttttcatgacatccggctgcatgctatgcatgagcgcttcttccgccgtgacctgcccgctttcgcagagccgtaaaagactggtgtccatcgtgaccatgccctccgctgacgaagaaaagaccgccgtctcgatttgatgcgttttggattcccgtatcatattgcggatcgccgtattgcacatcatgatctcaaatgcaggtatgatcccgccgtctaccgtcttcaaaagctgttgcgaaacaaccgactgcaacaccatggaaagctgcacacgtatctgcgcctgctgcgtaggcggaaaaacatcgatgatcctgtcgatcgtgttgaccgcccctagggtgtgcaaagtagaaatgaccaaatggcctgtttccgccgccgtcattgccacgctgatcgtctcatggtcgcgcatttcccctaacaggatgacatccggcgcctgcctgagcgcggcgcgcagagcgacctcgtagctttccgtatccgtcgatatctccctctggctgatgatacttttatcatgcctgtgcaaatattcgatcggatcctccaacgtcaccacgtgactgtttcgtgtcttattgatcctgtcgatcatacaggccagcgtcgttgatttgccgctgcccgccggccctgtcaccagaaccaatccctttggtttgcttcccagatcgagtatcgcctgcggtattccaagctccttcggatccggcagttcaaacgcgatcacgcgtaccacagccgcgagcgacccgcgttggcggtagacgctgacgcggtaacgcgatactcctttcagggaaaacgaaaagtcatcatcccccgtttccatcataccttcagggttcctcgcacccagcgcatatatctcccgcacaatacggtccgtcacctcaggcgtcaaccgttcttctcccttgcattcaatccggttgttgatcttaaatgaaaccgggcggccaactatgataaaaacatccgatgctttcatctgtgtcgcttctcttaaaatttgctctgcatccatgcctttttcccccattatttcaatacatgcaacccttcgggcgcatcatccgtatcctgtacctgtgtctgccagctcataacttcccatgccccgtccggcatgccgtcatcagaaagcgcaaggtccaattgtacgcataattgtttgttttcgccaacgtctaccataaacgctacgcttgcgttatttccttctttcgttaccgtataaccctcgtctgtcaaatcctcctcaaaatccgcatttccctttgccaatgcaaggatatttgcaaccttggtttgcgcctgcgtatccgccgcatagtattgccgctgcgtatcgacggtcttttgtgccagacgataatccgcctgcgccgaggtaaacgacaatgccgcaagcgtcgtcaaacataatatgacaaatactgccagaatcgatatgccacctataccaatgctcattccgccctgttttccgttcataccgctcctcataaaacccctgtatattgagccgcttccaagctgtaaatctgctcctgtgctttgcttaaggtgatttccgcgcttttgataccttcttcctcttcaaaggtcacttccatacggtataatgcctgcttttctccggtcgtctgtctaaattcacttccgtaatcgatatacattatttccccgtcccacgaagcatccagcaacgccgccatagccgcctcgtcgccgtccgttcctttgaatgtttccgcagcctgctggcaaagggttgctgccatagtcagttccgtacttttttcgctgtacactttaccctgtgcgaaaatattcatgcataccgcgctcgcaatcgcaaaaaacaatataatgatgatcagttcgattaaaaaaagcttgctttttgattgctgcatcccttacttcccgctttccatactgcgcaggaaaaccgcgcttccaaaggtattgccttctgtatccgtcgcatcgatccggatcagattttcacttacttccgtaagctgaagccctgacaaatccataatttcctgtccatcgcccggcgcaacctcttttcctgccgcaaccgtcacttcccgaagcttgccgccctgcacgtaaatccacgtttcataactgttttcatttactttttgtatcaatacgagcgcgtcgctattgcccacttcccgtatctctacgctgccccttacatcattttgccgcatcttctcgctcaaataggcaaccgaagtcctcgtattgtaattttcgtccatatcttttgcgattccctgataaacattggccccaaaaacgactacaaaaagcgctagcacagcaaacacgcaaaacaaagacagcacaaacacgatatccgtagcatgctgctgtcctcttttcatgaaaaaactccttccgccgcctgtatcaggttagtcggcacgaaatacaaaaatctccggcatcaggttatcccccaaacgttcatagtggtagacatactgtccttcgtccaaaatcaagccgtaattttccgccaggtaatcaaggcttttcggatagcgcccttcaatggcgtaacactgtacgacgctgcgcctgacggcttgctctgttattttcaactgctcgtccctgccggattgggcagcgttgtttattccgccgatcacgatgactgcgaccaatatgaaaacaagtaccgaaaccaatacccttataaacgggcgattatgtttcgtttgtcttacaaatgcttttctcttcaaacgatcccccttatcatccgattgccgacatcacgcccataaggggcagcatgacggacaaaaggatcatacctacgatcagcgataaaactgcaaccagcgtcggttccagcgccgagaggataccattcaatttccggtccgcttcttcttcataatgctgcgcgatacgcttcatcaccataggaagcgttcccgtcttgaatcctacagtgatcatccgtccataaagtccggaaaacaatcccgcaccgacgatcgcttccgcaaagctttccccgtcgcttgtgcgttgcttgatttccatgaccttttgacggatactatggttatcaataagttcaagggtcatatcaagggactggtctacatccataccgcttcccagcatcaacgccatcgccgaagcaaagcggctcgaagcaatggcgagggacgtctttttgaacatatgttcataaacacctgccaagaagcgtttgccgccttttgtcctgcgaaggataaaaaacaaaatgatgactgccgccactaccgctatgattaccactgcatatctgcttaccgcgtcgccgaattgcatgatgcccaatgcaaatccggacatctcgcttccgagctgtgcaaatacatttgcaaaaacgggcagcacttcgatgatcacgaccaaaataaccgcaatcatcatcgcgatcattacaagaggatacgtaacggcgcttttgatgctcctggcgatattttcctgccgttcgtaataagagcacagggaaccgagtacatcttccaatttaccggaggcttcgccgatctcaaccatgttgaccatgtatccggggaaagcgccagtctcccgcagcgcgtaagccaggctacccccttgctctactgtatctaagagtgcctgcgagatctgtgtccctgcgtcgctttcttcctcttctccaagtagcattagcccttcctgaagagagatacccgacctgatcatataggcgagttgctcgcaaaacgccgaaagctccacatccgaaagactatattttcctttaatagatgtacatttcatgatattcgttgccatcccccgtatatttttcctgctggccgctcgtcgaggccagcgtcggatccattcgtgtccattgcgttccgtcgaaataaataatattatcgatccatccctggccgtcgatatatacgctgatccatgcgtgataaagctcaccgacatatccgatcacaagtcgggtcggcaccccttgcgaacgcagcattgccgtcatcagggctgcgtaatcaaaacaaatccctttctgtgtcgaaagtgtttcatcgatcacgggcagatatccgcttgccacgttatccgctttatcgtaatcataacttatgttttccactacataattatagactttcccaacgaggtcaagttcgtcagttgcatcctttgcaagctcttctccctgctttacagccgcgctcgatgaagtaaagttcacatattggttcggatacaggaacggcaggaattcattttccagtgcaacatcgaattgcccgctgaaaagttcatggtaactatccccctgcgtattttcaaatacgccgatccgataggccccgtctccctgcgtaagggggaatacctccgctgagcctttttgcaggttatacgtatatttttcgccgtcattacacgatatttgtaatttgacattatcattatcaccgaaatatgtaacggcaacatatccctgtgaagcattggaaatatcgatgttgaccgtttcatttcccagtgtttttattcccggcgcttccggaaccagcacgccggccgccggcttttgcgaagaagtcttttcccttttggacgtatccgaagttgtttgcccgtttccgcatcccgccgctagaagcgcaaaaataaaacataacatatatagtattaattttttaaagcctttcgcaaactgtttcggcctgttcatgttgtttccaagcatacctcgctgtttatttcctttagtataatcaacttaatcaatgttgtaaagcatggaaaaccccctgaatttctttttaccatgcgtgtttggctctgtttccgcatttttcggtcacatgtgagacctattattttcatataacaacattccctgcctatgccgtcaaaaaaccacctgtaataaaatacaggcggttttgagttaaactgcatattatgaatagaaagctgtaacttcggattgtatacaggcttcttttttcttttgcgctgtcgcggctgtttttgtatcgaaaatttttcaatactttccatataccgcttccttctttttgtaggttacaaaaatctgtattggaaacagtatgcaggaaatcataacgcccccctttattcttgctgccccgggaacggccctctggggtcgtcgcgatggcatctgcccgaccactcttgggggcctgccggaccacgatggcatctctcaggtccgccttcaaacggttttctgccttctatatcctcgaatccctgcctgtggtgccggcatccctggccgctcccatatggatgtctgccaaatggaggtctttcaaatccaaaaccaaatccgggaatatccgcatctttcattttgggttccaattctgcaatgatatgctccaatagcttcgaaaattgctgtttttcctcatcactcagaaaatccaacactttctcaaaatcctcctgttgtttttccatttgccctgccgcttcttttcccgcgtcagtcaacttgatctccatcacacgccggtcctgctcggatgcactgcgtgtgataaagccgttcttttccaatttggccagcaattcgcctaaagactgtgaacgcatatccagaaggtaggaaagctctttttggcttatttccggctgcatcctgagtaaggcaagaacccttccctggcctcgatggatgtttcctcgacctcccgcctgcattgcattaagatgctggtatctatgcagcagtccatatgcctgtgtaaattgttccactaatgttttatcttccataatcatttctcctttcaaaaagcaaggtacctttgtatattgaaattatacaggtaccttctaattttgtcaaccttttatttttgtttttggtaacaaaaaatatctttgtccgccaatgcgtagcgcgataggcggcgccaccgccttatctcaatttttcttcagttaaaataatcgcccagttcttttccgggcatcggcctggcataataaaatccctggatgtattgcacgcccgccgcggcgatcatttcctgctcttctgcagtttcaatcccttcggcgatgacggtcatcgaattaacctttgccatttccacaatcgtgtgcagcaatgcgtattgcttgggattggtaggaatttgccaagtaagcgaacggtcgatcttgatcacgtccaccggcaggttggatagatagttgaggctgctataccctacgccaaaatcgtccagtgcaatccggataccggctgcccgcagcttattgagcgtcatcgtcgcctgctcaatagactgtataagaacactctctgtgacctccagtgttatcttatcagggctcacgccggatgcacagataaggtttaacaggtggtccgcactgctgtctgtcaaaagctgttggaccgaaaggttgactcccatacgcaagagccccaacttttcgccatactccttcataaaacggcatgcccggctcagcacataatccccgagctgccccaccgcgctgctccgctccgccaggtcgattacctgtcctgctgaaaaatacccgcccttcccgtcggacaggcgcgccaaagcctcgacagcagtaaatcgtccggctgcgatatcgaaaataggctgataccagatttccagttcctccttccagatcgcggattctatcctgtgcaggatttcattttccgtttggataatactgtccaatgcagcgttatacatcacaaacttctggcctgattgttttgcatagcgcaaggcgcactgtatccggtcaagcagcgcctccgggctggtccccgtctccggataccggcaaactgcaatctttacctgcaaggcaaaagaagtatttccggcagaaaccggttcttccagcaattccttcagtttattggataacgattcttcattctcaccggatagtaaaattcctaaaaatacatctccattgatccggtagaggtaatttccaaattgccgcgccagacgctgcaccacttcatgcagtatttcatccccgacgtcagcgctgaataactgattatattggctgaacgcacagatatctacacaaaaaaggctgaaacgccgctttttgtcgtaagatatcaacatattggcgtcccgaatatatttctggcggttccctacatggaatacctggtcatagtacgccaactgttctacctgttttcggtattgattgaaggctttcgacaattccatcatatcgaggtcagtatattcatcaaaactcacatcattccttccctcggtcaactggcggcatttttcggtcagcatacttgcgggggattctgccgtccgtttgttgtaataagcgcgtatcagcaacgtaatttgattttcggcgcttcctttcgataacctgcaattcatatagtgataccgtgcggtcagaaagattttcttgtcatcaatacgtgttttgagcaacagctccaatgataccccccttgcaaaatcctctgcctgctcaccgtccatatcttctcgggcagccagcacaaaatggccgtcgcccaaccgtcctgcagtaaatggacactttacaaattcgttcaagcgcccgtgaatgcttctttggaaagccgctttttcttcggaatccattaactgggatatctggccatatccctcgaaaacaaagtagaaaagcgtaattgggatttctcctttcgttgcccatccttcaagcactcggagcaagcctgctttattatataatccggttttactatcctttaaggataattgtttgaatgtccggctatatgaaaacagcctatataacgcatatataagtcccagcaaaagaagcgccagcaggcagcagcttattacgatcccaacgctttgcggagtactcacccatccgccggacggttggatactgaggttccattcagtcggcaaataaaaatttgtttttaccgcctgcgaaaaattaatatccggccgcgacattacgacaacctctttactgccgtcttgcggatctacccgccacagttcataatcgtatccctgcatggtaagcatatccagttcaagctgctgcaacacatagtcgctgtccagcgccacgacgacctgccccatgtaagcgtctccatccataaagggttgcagaaaaagaaatacttcctgtccttcatcgctgccatccagaaccaccggcccctctacgacaagctccttaaccacctttgccaacgtatagatgtaggaaaaatcccttaactcctgtccgatttgtccgacatcaatatcctccggcaacacgctaaccagggtgtcgccctcgaacagataaatggcacggacttcttcccgctcaaacaggtacgctgcagcgttctcgaaccatacaacgtcgccgctttgcatactgcgcgctgtctgcgcaagcgtatttgcctcgttaaggctttcctgaagctttaaaagaaccgtttcactataatattgcaggacgctgtcaacatcatgtttgcgcatatcggtgaggcctgtatatatacctgtccccgcggcaatagtaagaataataaccagcagtatgacaataaaagccggaagcagccgccttaaacgttttctcatagacacctcagttttgatggatcttataataacctttaccgttctgcttgacgaagtacaacgcctcgtccgcatcggcgatcaggcgttccaggctggaatccggataggcaagcgcaacgccgatgctgcattgtaccggaatatgccgatcggcggaagtaatctccgaatggagccggagcaccagttcatccaacacatcgcgcagctcctcattgtcatccaaatccgtcagcaaaagcacaaactcatcgccgccatagcggccgaccacaccgctatatctcttttcatattcccgcaggatgtatcctatgcttttgagcgccacatcgccgccgttatgcccataagtatcgttaatgtatttcaggttatccatatccacgaaacacaaggcactgatcaaatgcggatctgcttttttcagctgcgcctcagcctgattgaggaaaacggaacgtgtaacgactcccgtcagggagtctgacaatccatctcccgtcaaacgaataatctcattaaaatcgacattctccggccgttcatcctggtatattttcttttccaattcttccacggaccgcgtcaacatatctaccaccttcatctgctttgatataaaatggcgtattgccaatattaaaccaatgcttaatataacggctatacttgcaacaaacagcaaacttggtaagattgctttaaataccgtccagaagttcacagagcacagcacgtcccagcctgtattttcgacgcgctggcaggtcgtgtaatacaagtttccatcactgatactccaataatcggtggggatttgggccaaaagcttttcctgcagagtatccgccgtaattccaaacagagtgctttcctgtatttggttcatgatcggatcgccgtaaggcaggcctgatgtagtagacataacttgtccctgcgaaccgatcagcactgcttcagagttgttgctaccggcggactgctccaggatttcccctacttcgtcaaaactaatcgcgcaaaacagacttcccgtaatattgtttcgttcgtcaagcaagggaactgccactgtatagttaagggttgcgccatccgcaccggcagcaaaactgtctgtgacctgtctttcccctgttgagaacaaccgttgcatataatccctgctggcaaggcttacaggctcggagccatcggaatatacgataatatccgcatccacgtagcatatcatcaaatagccgaagatcggagccatctgatccagcttttttactttttcgataggcgggatatcaggatcataatattcgggcaatactgccaacgcctccaacagtgtgatcgattcgtcgatcttctgggcaatctgcgcatggacgcttgtcagcgatgctttggcatcttttttcatctggctgaaagagagaataccgcctcccagtagcatgactaccaatattaacagacaaaataccacgctataccgaaaaattggcgagaaagaaatctgccactttccatctttgctttttttatctttcttgctcatttttctctctttccggaaaaaacattatttccataatgttgaaccatcataagcctgcatagctgccttccagtaccccagccgtttacattcctcaataatcagccgatgaatatactgatacatttccgctgccgttttcgcaaaacagccaggggattcccaggtcaaaagcctgaccgcctccatacattgacgataaatttttcggttatactcatttttattatgattaatcagtttcggtatctgtcttccgatatgataatttttcactatagccccataaactacgcctagagcgttgtactggatatggtcaaccagaaattccagcaaaacaataggtgaaagctgatatagataatcgttgttccaaagattctcgatttcctcttttaaccggcctgcttcttctgccgttacatgggccgccgcatgagcggcaacgccttctattgtcagcgataacagttcaaggctgtccaagtatctgcggatatggcaggcaatcaaatccggatggattttaattttactcaaatccttcaaatccatcgctacaaaaatgcccttcccccgcgtcgtttccaccacaccccattcctgcaggacctgaatggcttttagcgtggtatctacgcttacactatagattctttgcaattcgctgtgggtcggcagtttgtctccctgccggtaatgccccacggcgatcaaaccaagaatatcaagataaacattggaataccgttcctctgcatagtgtaatttcgtatccagccctgctatccccattcgcagcggagaattatgcgcgacgcggcaaaacggtgaacctttctgttcgggaacaaaattatacagatgggataagtcagcaaaatgtatttcccgtacatcttttttgtacttgactgcctgggtatattttattaatgtttcatgaaacgtcgaacgtacctccaccgttccgggaagcggatcgatctccgaaaggcctaaactgtctactgcatgcaaactgaattcattcccattccgtgctataaaaaaccgccagaaccgattcgacatctgccaaaatcctttttcctgcttggggtccatttgccctgcaatggtctcgggtatcttccattcttcctccgtacaaagggacataccacggcttatcaatggataacataataaaacccctgtttttaaaatatcgtttgccgctaaggcgtttgccctcttcaaggaaactgatccaatttcctgccaggtcgtgtggtcaaacgttacgacgggccttttcctctgcattgttttgataaatcctgtatctgcaagcaatttcacggcacgccgtattgttttttcggaaacatggtattccatgcataattctgcgcgcgaagacaactggcaaccatttgccagcaaccccgactcaatcttgctttttagaatctggtacattttcatgtacataataccgtcgtttttcatttcggtccccgcctctgaaacaaacacataaaaaataccttattcatccggtattatattttccgctatttatgctttttagcccattcctatcggataatttttttcaatttcaatcttggaaccattaccagataatagtaacatggccgttcttataagtcaataaagtccccctgcccatgcgcttcctgtccgcacagatattcgtatgtacctgttgaaataaaaagctgttcgcatggtgttgtattaaaacaggccgctatacacttgatataatccaaaaagaacaaacttatacgttgtcgttttttccggatgaatataaggaataaatgcttttttgaggccaagctcattatcgaatgtaagctgacacagatcacgaccccttctctcgacgatttttatgcacaagaggccaaagattggttagataaaacgtatcaggaagaaaatgattatcgaaaatatgtatttggggagatcacgtatgtttggataaagaaataacaagccggagtacgccgcctggagaagcgtattatcccttactttgcagacggtatacagcgatgaagtcgttacagtttcttaaacccggcaacgtcccaaacagccaaaaagcaaaaccgtactttttcatttccgtgttgaggctccattcatcaagcagtgtcactcccttacaaagctcctctatgtcttttccgctcttggcgccccacctgaaaacggcgcttgttttactgacggtatcgtgatgcctattgccggcctttaacatagcagccggaaataattcagcaagcaccgtcgcccccgggaaccttcccgtaagcattgaaaacagctcccttacctgatcttctgtaaaatacatcaacaatccttctatgattataacaacaggacggttgcctgcaagcacttcgtctggccaattctcatcaaaaacggaataggaaagctggtgaaccctgtcctgtgccggaagaagctgaccgcggatttccatcacattcggcaagtccaaatcgtaccagtctatcctgccgttatccatgcggaaaaaacgggcgtctaggccgcagccgatacagatgcatactgcatccggatgttttgcaataaacttgcttacctccttatccaataggacggagcgcgcaattacacctcccgaactgaattttttatttttgaatttgctgaaatcataatcgattttagatatcatttcaactgccttttcatcccgaaaatgcggctccgacttttttgtttcctccgctttgatgcaaagaggaatcagcatcgtttcttcaaccccttgtaactttaccttcataatttgctcctcgctttcaccatataagttagcatatgctaacttatgtcattataacaattttactccaaaaaaacaagcgggtcgcagggcctttccttcgcagctcttcaaaaaatgcatatcagcattatcatccccatatctagaatttttcatccccccaaagattcattttgcatggtaatgcccattttcttgccggattgctttttcttttccttccatttcagcaaaaatgcagaattgataatgacgatgacagaaccggcattatgtaccaaagcgccaatgacaggattcagtatccccgtaattgcaagaccaatcgccacaaaattcaacacaagcgaaaatgtgatattctgcttgattgtccgcatcattttccgcgataacaaaataagatgagggatagacttgatatcgtcatgtaccagtgcgatatctgccgcttcaatggcaatatcgctgccaataccacccatagcaatgcccacgagtgctgttttcagcgccggcgcatcattgatcccatcgccgatcatgcaaaccatttcgccgtcttcttgatactttctcaaaatacgcaccttatcttccggcagacaatttgtataaatgtccgtaattcctgtctgccgcgcaatatgcgacgcagcatattcgttatcgcccgtaagcaaggtgcattgaatccccgcattgcggatcgcctctatagtttggcgcgcgtccggcctgactgtgtcggataatgcaataaatccaatgattgtgttttcctttgcgatataaataatcgtgcagccgctattcgtttgttcccgcatatctgtctgtatttcttttggaatatcgattccgtttgcagccaacaatttttcattgcccgctaaaatggtttgcttatgatacaccgctctcaccccgcgcccgggaagcagttcaaattgttcaggttcctccaaatctgcagaactatgtattttatagtgccgtatgatcgcttttcccaaaggatgttccgattttcgttccgctatcgctgcccaaaataaaagctgatctgtgctgtagtgaccggaataactccttatggctaccacagagggctgtccaaacgtcagcgtacctgttttgtcaaacagtatacggacaacgttggcgagccgctctaacgcatctccctcgcgcaccaatgcgccaaactttgtgacatttcctatccccgccatgattgccgtaggcgtggccaataccagcgcgcaggggcaaaataccaccagtatcgtaacggcccgtataatttcccctgtaataattccggtgagggtagctgaaacaagcgcgattacaacgatccacgttgcccatttatcagccaggcttacaattttcgccttgtctgcgtctgctgactgtaccaagcgtatcatcctttgcagggaactatcttcgccattttgggtcactctcatatcaaatgtaccaaattggtttactgccccgcttcgcacttcatcgcccgcttctttgtctacaggcaatgattcgcctgttaatacagattcatccatggaagtttcgcctctgataataatgccatcggcaggaactgtttcgcctgccaatacacgcaggatatgtcctttctgcacttcatccgctgcaatcttctcctctcttccttcccgcataacccgcgctgtttgtggtgtcaaatttaccagcttctcaattcctgaacgcgcttttgcaacggttaactcttccaacaaagcaccaatcgtcataataagggccacttccccagccgcaaaaatttctccaatacagatggaagcaatcagggcgatggacaccaagacatccgctttgatatcaaagcggataacaaggcctaccgcagcatccttcaaaataggaataccgcaaagcacaattgctatccatgccatatcaacagcaaacaatttgataccaataaagcttaataccaaggcaacggatgaaattataagaaacaaaatagttcttttaatatcatttttaaaaaaatttgctaaacgtgacatgttccatctcctttataccataaggggtatatgtatattacgaaaagattataccccatagggtatcttgttgtcaataaaaaagcaaccattttggctgcttttcgatactatttcgctgaactgcgcctatgacatcctggaaaaatgttctaccgctttggcaaagtcttgtatcgttttttcagcatccccatgctcaatgccttctttcacgcaatgattaagatggccttccaaaacgacttgcccgactttatgcaaagcactttttgccgcattgatttgtatgagtacatcctcacagggaatatcctcatctaccatcttattgatagcgttgatctgtcccaatattttattcagccttctatgcaggttgtccgcatccatacattgccgcattttctatacctctcttgtcattaataccccatagggtatctttattgtatcacacaaacggtttggaaaccataaggcaaagcaatatttttgataggctgatgattcttttatttcatcaaatgtaatgggaaattcattctgttggcatttgttcaacacaagtacatgttcccagccataaaacgtggcgtcttgcgatttttcgcgtttaagcttcttactcccagggcatgatcggaggcaatatgcacaacggatgccctgcggggtcaatcatcacctgccaacggtcatcatattggatttcagatttagttgcaccacaggacagggcatgcttcacaccttcttccacatccttaacatggaagtctaaatgcgccatttgttgttgttcatccaatgttgccggccaaacgggcgccacataatcatctgcttgttgaatggtaatccaagttggaaatccctttttctctaaattcactaagactgtgtattcttcacctttgaaccgcgtccagccaagcaatttttcataaaatacagacaactcgtccgcgttatcagaatccaggacaacattccaccccacaagatccaacgccataatatgatacctccagtttttatcatttataaactcaaacctatcctgtatctttaataataatatcagtggatactttgtcaatgtcagcttattaaaaaaccgaatacctcacccataaatacaggttgggggtgcggattggaatcttttggcggacagtttggatacctgtgctacgtacgagctaaagacgagcccattgtactgtattggtggtataatagcaacattgaaaaagccaataactttgaaattatacaacataattagaaagttgcaaacagcagatataaacagaatggcagatctttggttagaaacttcataattttatttccgctttcacaaggagtgcatactgttctgttgaggaatccacacagagaaaacacccaagttgctggttgtatgacacaatggttgcggtagaaaaaaatatcactatagctactgccattccaaatatttgcccacataaatgtaacttattgtatgtagacttattgtatcattttatgaaaatatataactagggagggttaaaaatggatattgtaaaagtatttggagacaacctaaaatcatatcgtatgaaactaggtatttctcaggaagtatttgctgacaagtgtggtctgcatcgaacctacataagtgcagttgaaaggtataagcgaagtatctcgcttgaaaatattcaacggattgctgatgccctcggtgttgaagcatacaagctttttttggatggtagcgaaaacaatgagagaaaatgatttgttaaaattaaaagaaaaatttctagagattaagagtatgggctggataaaaaatagacgtcatggtaacgcaggcggtgttgggaacacgcttgaggatttattggaagtggccgaaaataatttgcaattaccagatttcggaaaatgggaattaaaatgccaacgcaaagataccggttcattattgacactctttcacgtggagccagaaccgcgaaaaattagagtcgtacctaaaatattgcttcctttatatggttggccccatcaaaaagcaggaactatttatcctgcatctgagaaaagctttagacagaccatcaatgccacacgatacagtgatcgaggttttagagttcatgttgatagaactaacaaccgtatatatatttcgtttgattattcaaaaatcaccaataaaaacgaacaatggcgtgattttatcaagtcggttgtcggtgtaaccgatattagtccaaatccatattggacgtttagcaccataacagaaaaattgaaaaaaaagattaataatcttatatattttcgagctgagcgaaagatggaaaatggaattgagtattttaaatacaatgaatttgaggcttatgttgatcctgatttagaaaagtttctactgcttgttgaacagggagcaatctatgttgattttgatgctcggacaggccataatcatggtacaaaatttagggtaaagcctattagaaaagttgaactctatagcaaccaacttcaagtataaacaaaataaaagtattcttgaccaataatacttttattttgtttcacttttcatgaggtatagtaaagtctagaatatactcaaatgttgtccccatagtaatgtaactacttggccaaccaaagatgccaatattgttaatgagattgcgcctatcccaaattattgtattgcgaaattcgtatcctgctttaagcatagcattaataatgttgatatgcaatggaacccgttttccgtcaatccaagcgtctgtgatgttgatgagtatatgtgccttttcacaaaatacaggtttcatacttgcaaagatatctctaatagcttcctcaaatttttctgcaggaagaatccccagatcgcgaggatcttgactgtattgctcaacttttagaaattgttcattttgtcgaagatccccccggcggcttttgtttttgcgtctacggttcaagatgtttgcatatggtggtgaagtgaaagccaattttacggtcttgggcacaattaatgaaacgatctctcttgcatcagcgcatacagcaaactgcttggttatcgtttcattagcaactgattgaacacgaaaattagctaagtcgacgtactgttgtttcaaatcaatgcctattgcatttcttttaagatcttgtgcagcaattagtgttgtccctgttcctacaaatggatcgagaaccaattcacccatatgagtgaattgttgtataatacgatttgccatagaaattgggaaaacggcaggatgaacgttcttatcccttatatcccgtggctcgtaattaaaggtccacacacctatttgatttttcatccaatctttagcttctatacaagatagatatccatttttacaatcacataaacgttcagagccgatttctaaaaagttagacatctttacatccccttgaagattcaaatctttcttttgcatatgcgaaaaactctttgttaatctcgaaccctatacaatgtcgattaagcctatcgcaaacaatccatgtagtccctgtccctagaaacggatcaaaaacagttccgttttcaggtgaaccgcacaagattattttctctacaagtttttcagggaacgttgctgtatggcttcctgataatggctgtgtatttattgcccaaacatcgccaggatttttgggggcaccatttgctccagctatttttaccgcattaaggttaaagtagtattttttattcagaacaaaatgaaatatatgttcgtaggtgttattaaatctatccgtaacgcttgccggaatacgatttggcttttgccaaattatgtcatcgcgcaagagccatcccctttcttgcatttccatggcaaagcgagatggtatcaaaagaagttgtttattttggtacaatttaccgttctgcgcgattttaggttgtaatggtttggtggtaaaatatttttctttcctttctttttgataggaagtaacattgccgtcactgtcaagatacttattccaagctcctgcaccagaaccaaaaaaagtatcaccgatgtttataaaaatattggattcgtccttaaggtagggctttaatgtatcgaaaaaattcgctaacttctttacatactcttctggcgtattttcagaacctatttcgccctcgccattataaatacgttttgcccaatatggtggtgatgtaacaagtaaatcaatagacttataatctacttgcttaatcagctctaaagtgtctccattctgaacaaaatgttcatatgatatgggtttgtgattagatatttgcgattccattattcgtcctttttaaagttttactattaagtaacttatattataacataacattgccattaaaaatattttaaaatggtgattcaatataaacaacaaatccgaatacctcacctataaatacaggtttggggttcggatttgaatgttttggcggagagggtgggattcgaacccacgtgcccgttaagacaaacgcatttcgagtgcgccccgttatgaccacttcgatacctctccatgcaacgttatttattttaccaaagacccgttccaattgcaatatcaatgtcaaatctgtataataaataatgtttaatagcctgcaaattggagttttgtatgaaaacgttttttttgattatcgtattgcttctgaccgtccttctttgtgttgcatgcggccttccggcagtggagcaatacgataattttttggctgacctcgatatcgagatgcgtatcgacatgtgtctgaaacagatttacgacggcaatccttcctggtatacgcgggcagatctaaaaacgattcagaaagacctgaagactctgcagatcgaggacgaggtaatcgcggagatcaatcaaattttccttgatacggcgcaggagctgcaaacaagcatttccctgcttgatgagcgggatacagacggtgcgcgcgcaagctaccagaaagcatatgatatgcgcatacaggccaaagacctgttacatcagcttcacgaaggagaaggaggcctgcccagtgtctgatctggattatatgtactttgcgatcgacgaggccaaaaaagcgcgggtaatggatgaagtacccattggggcggttgtcgtacaaaatggtgaaatcatcgcccgggcgcataacctgcgcgaaacaaaccattcgcctctcgcccatgccgaaatactcgccatcaaacaagcttccgaatatctggacggatggcggcttttgggttgcaccttatatgttacgctggagccctgccctatgtgtgcaggcgctatcatcaatgcccgtattccgcgtgttgtctttggcgcatacgataaaaaagcaggcgctttcggcacactgtataacctagcagaaggaaaactcaaccatacgccagaaatagcaggcggtatcctggaaacagaatgcgcttcccttctctccaattattttaaacaaaaaagaaagtgaggatctactcatggactgcaaaaaagaaaaaaatatggatcactgtacctgtacttacaactgctccagacgcggcttatgctgtgattgcgtaacgcaccaccgccgcgcgggcgaaatacccggttgcttcttttcccccaaaggcgaagcaagctacgaccgtagcatagaagcattcatcagggactgggagtcgagataatggtcaaagcaagcttaaaaaaaatcagtaaggaacgcgaataccttctggttgccgatctcgcgcatgaaatctggcgcgaacattattcacccttcatcagctccgaccagatcgagtatatgctggaaaaattccagactcctgtggccatccatgcggctgtcgcaggcgaaggttatgattattatctgatcaaaaagctggcagttcccatcggatatgcgggcattcggatgaatcatccacgcggaaagctgttcctaagtaagttttatattttaaaggaatatcgtgggcagggctttgcacatgacgtcataaacgagttttgcggtatggcaaagcggatgcgcctgaaatctatctggctcaccgcttccaaaaagaatgaatcctcgatcgcggcatatgaacgcctcggtttccaaataacggatagtatttgcacagatatcggcaacggttttgttatggatgattacgtctttgaaaaagaaatttaatcgtccattgtttcccattttcctgcgtcggataattttgtctgtatttttgccgacctcttttgtactgcttccaaatggttttgggccgccgcgagcgaattctgagttttttgcaacagcaaggcaaattgttcaaattcagctttgatcgctgcaagcatatcgatgatcaatgccgaatgttccttgatggccagcgtcttgaatccggtttgtaggctcgtcaaaaatgcgctcagtgtggacggccccgtcaccattaccttatacttgttttgcagttgttcaatcagccccagtcggatcacttcggcatataacccttcggatggtaaaaacataatcgcaaaatccgttgttttcggcggatggatatatttatcgcttatctttttcgcttccgcgatcacggcggcaagcagttccttttgcgcaagccgcagcgcatccatatcacccgtttccatcattgcaagtacgcgcgcatagcggtccatcgggaacttcgagtcgatcggcaataatgtgtcctgcccttcttcccgcggcatacggacggcgaattcgaccgcattatcgccttcaatttttacattttcctcaaactgccccggcgccataaagtcggcaagcaaacggtaaagctgtacttccccccatatcccccttgtctttacgtttgagagaatattttttaagtcgccgatgtcgcttgtcagggctcgaacctcgcccatgcttttatatacctgctgcaactgctcgcttacgcgtgcaaacgatgtgctaaggccgcttttcagcgtagaatccagcttctggtctaccgacttttgtatctcgcttaatttctcctccacagctctgcgaaggatctcgacgctttgcgtattcgcccccgacacccgtcccatcgtatcaagtaccatattcgataatatattaaactggtttgtcagttccatgcgaagacgcgctccatcatcggtctttttcccctgccgtaccaggattacgacacacagcgcagcgatcgccgccaaaacgatccatatcaaattttccgtcataaagcaaaatcctccttagtttaaggataccacatcaaaatacaaaatacggtacatcccctgatgatttttaaaggtgcttttgatataatggttttataatcggcgaaagcaggacataacatgaagaaaaatgatttgatagaatgcagcgtgcacgatcttggcacggacggccagggcattggcaagtgtgaaggaatgaccattttcgtggatggcgcacttcccggcgaaaccgtacgggcaaggctgatcgccctcaaaaaaaattatggcgtaggtaaactggaagagatcctcactccctcacccatgcgcgtaaagccgctatgccatgtattcggtaagtgcggtggctgcacgctgcagcatttttcctattccggccaactccaattcaagctaaatcatgttatgaattgtgtgcagcgtatcggcggcctcgatatccccgttaactttccattgcccgcgcggcatgaataccgttaccgcaataaggccgcttttcccgttcagcagaacggccagcaagtcaatattggtttttatgcggcacattcgcatcggatcgtcgacgtagacgactgcatgatacagccttcggattttaaaatcgttatgtcgcaattgcgcgtatggatcattaaaaataatatcagcatctatgacgaaacatctcacaccggccttctgcggcatgtgatcctgcgcgaaaataaaaacggcgacgtcatgcttgtactctgcatcaacggatcggaaataccacacaagtcccatcttatttctttatttgaatttgttttgccgcaggtcaaatccattatgctgaatatcaatacgcaaaaaacaaatgctattttaggtgaaacctccatttgcatccacggacgagaccatatttttgaaacgctggcaggccttgaattcaggcttggcgcccagagctttttgcaggtgaactccccgcaaacggaagtgctttaccataccctgcttgaaatgctggatttgactggaaacgagactgtgctcgacctgtattgcggggtcggaacgatatcccttgcgactgcgcagcatgtcaaaaaagtgatcggcattgagatcgttaaacaggccgtcgaagacgcgaactttaacgcgcaactgaatgaaattgacaatgtagaatttttatccggcgatgcagccgcgctgcttccgcatatcatgaagcagcatggcaaaatcgacgccgtgatcgtcgacccgccgcgtaaggggcttgatgaatccgtgatccatacgcttgtttccgctaaaatacctaaaatcggctatgtatcatgcaacccgtctacactcgcgcgcgaccttgccttgttccacgagctcggatacgataccgaccttatccaaccggtcgatatgttcccgcaaaccgcgcacgtggaaacggtttgcctggtttcacgggtcgaaaaataaaacgttactttgataattccctgaaatggtatcgatcgattataatgtgcaaaggagtagctacggtgaaaacagaactgaagatcagggttgcttccgtacaggacgccggtgctttgctggaaatatatgccccttatgttaagcataccgctattacctttgagtatgcggtaccgactgtgcaggattttgcggatagaatccggtgcatatctgcaaaatatccttatttggtcgcagagcaaaatggcgaaatcgtaggatatgcttacgcggagatgttcaaagaacgggccgcatatgcctgggatgccgaaactaccatttatgtccggcaggacaggaaaaaaatggggatcggaaaagcgctgtacggagccttagagcacatcttggcagcacagaatatcctcaacttaaacgcctgtatcgcatattctgaaaatggtgatgaatatctcacgcaggacagcgtgcagtttcatgagcatattggataccggtttgtcggggaattccacctgtgcgggtataaattcaaccgatggtacaatatggtatggatggaaaaacacataggagtccacacagaaaatccgcttgccgttaggctgtttccggagattcgtgaagaactcgcgaaaaatgtgggattgtaggataaatttcaaaagaagttttcgtttaacctcattcttccgttgttatttttttatgccggcgttataataaaagaaataaaaaattactatttttcaactctatttacatatgtaaattttttctggcaaaaggagcacagattatggcaaatgcaacagaacaattctatcaggacctcgaccaatgctacgcaaccggagacatggagaaggtcgagcggtttctgcaaaccagcgcaaatacattccgcccctgctgcggcggctttaattccaattaccttgccgttttgagcgagctgggcggcttttatcgcggtaccagcaaatatgcggcctctgtggaagcatttttaggcgcgcgtgatatcatcgttgaatttatcggccgtgaaagcatggagtatgcgaccaacttaaataaccttgccggaacttaccgcctgatgggcgagcaccagaaatccctgaaagcgttcgaagaagcaatggagacgtaccgcgcaacgatcggcacggacaattacttttttgcgagcgcgctcaacaacgtatcgcttctctatcaggatatgaaggattatgaaaaggctgtggactgttccagacaggcgcttgctattttggaaacgctttccgatacagccgacgatatcgccactacatacaacaatttggctgcgttatacagtaggatgggcgacgctgcgaaggccaaggaagcgctggataaatccatttccctttatgagagccttgaaggcggcagtcctcattatgccgctgctctcaaccaaaaagcgtctttcttatatagggacggcaagtacgaggaagccagggatacgtacatcaaagttttggagcaggtcgaacggttctttggccgcaacgtcgaatatggcattgcctgtgataacttaggccgcgtatatgaaaagctgggcgatatgcagcaatccgaggcttaccttagccgggctgccgatatctatcaggccgtatacggcagcgaccatgagatcagcaaaaaagcccttgatatgctcgcggagctcaagaacaaaaggaactcctgcgacctatgaacgggctggaacttgcaaaacggtattttgaggattgtggactcccgatgatccggcaatccttttcgcaatatgaaacccgcattgcggcgggccttgtcggcgagggttccgaatgttggggttttgacgacgaaatatcccgcgaccacgactggggaccatccttttgcctctggcttacggacgcggattttgaagagatcggcagccctctaagcgcgtcgtatgacgccctgcccgacgattttcttggtttcccgcgccgcgaagtaagcgaattcggcgaaggacgcgtgggcgttatgcctacctcgcatttctactggaaatataccggactcaagcgggccccccagactttccttgaatggcggcgtatccccgaaagctatctttccgttgttaccaacggtgaagtttttatggatgctttgggtgaattcagcagtattcgccgccggttcctggctttttatccggaggacatccgcatcaaaaaaatggttgcccgcgccgctattatggcgcaggccggtcaatataactatacacggtgcgtagcgcgctccgaacatgtcgccgcgcagtgcgccctgtacgaatttataaaagcggccttctctatggtctacctgctcaataaaaagtatatgcctttttacaaatgggcgcatcgcgggatacgcggccttggcgtcctttcggaaacatattctctgttttccgatttatccaaggacgattgcagcaacgatgcctaccataaacgtgcgcaaacgatcgagcagatatgcgccctggtgatagatgaacttgcaagacaaggcttgacggacacaaaggacgatttcctgcaagcgcattgccagccgatgatgcgcaggatccgtgacgaagaaatccgccgcctgcatatccttgcggaataggagataaaaaatggaaacgacgatcaatcagattttagatatcgaatgggacatgttcggcgccgtgcaaaatatcggcggtcgcgcatcatgccaggatgacttgaaaacatttaccatccagcgcggcagccagcttcgcgcatggacgcaggatatgcgcgaaagctacctgcgcgacctgcaggccgcacgcagcgaagggcgaaatccccttgctgaaaaatacggttacatgatggagcatacttctcctgcggaatatgaacaaatcaaggccggcctccccaccgtatcccctgaaaaaaaggcgttgatttccggaattaccgcggtgcaggtcgcatggcttgaagatctatccgcgcgttatccgtatgtcacgggaaacggccgtccgatccaccgcagcgaagacagtctctatgcaacgtcatttgaaacctacctgacgggtgaactcgccacatactcggaaaatactttggaatattatgatgaatatatccagaacctgctgaaagagcataaaaacctgaacgagatgatccttcttcatacatgccttgcatatggttacgagtctattgaggacgcggagaaccgcctggccggataagatggagatagctacaaaaaagcgcaggtgcgatcacctgcgcttttatttttttcttacaggtatttctcgacgatacccgcctgcttctggtacatgtttttgagcgcgagatatagttcgcggtaggattcataataatcattgtaccgcttcacattttccctgatcggttcggttacgctggaaactttgacgagttcgtcgcacgcctcctcaatacttgcgaaatgtccggagccgaccgccgccatgatcgcaccgcctgccgcagggccttcttccatgttcatcgtgagtacgttcgcgttataaatatcggcctgtatctgccgccacagcgcgctctttgcgccgccgccgttcgcgcgcacttcattcacctcgatgccgaattcacggcaaatttctatcgtatcgcgcagcgcaaatgtcacgccttccatgacgcttctgcacatgtccccaagtccatgcctgtaggaaagcccaaagaacgtcgcacgcgcgttcgggtccgaaatcggcgtcttttcgccgttgaaatacggcaggaacgtcagcccttcactgcccggcgaagactgggaagcaagctgcgtcatatagtcgtaaatgtcctcgccctgtgccgccaacgccgcttttttatccgtgaacagcgtatcgcgcacccatttgaacgagccgcccgccgtcagcaccaatcccaggaagcaccattttcccggcacagaatgcgccattgtcatgagagcgcgttttttcgtatcgatcagcggctgatccgtgcatccgaatacaacgcccgaagtaccgatcgtcgctccgatcacgccggatttcacgatacccgttcctacgccgcccgccggctggtcgccgccgcccgccacaaccggaattcccgcggtaagtccccactgcgaagcgatgtccggcaaaagctgtcctacaacttcctgcgattccacaagcctttgcggtacgatatccctggaaatggataatttgtcgaaaatattgtccgcccacttacgattcggcacgtccatcaaaaacgaaagagaggcgtcgctgacctccgtcgcgacctcgcctgtcatcctgtaacgcaggtaatcctttgtgaaaagtacagtgctgattttttcataagccgcaggattgtttttcctgacccacaagagtttaggcgcccagaaactattcaggcagaaatttgccgttgtatccagcatttccttttcggaaatcagcttttcaatatcgcgtacttcttcttccgcgcgctgatcgagccagatcatgcaattcccaatcgggtccatgtttttgtccataagtgtgctgccctgcatctgccctgaaaacccaatgctggcgacttcttttccgtgaccgcttttatcaaccgcctgcctgaccgcgcggtcgcatgcgtcccaccatacgagcgggtcctgctctgcccaacccggattgggcgttatcacatcacattcatagtaaccgattccacttatttttcccgtttcgtcaatgatcatcgctttgatgccgcttgtacccgcatcaatccccaaaaaatatttcatatgtaccttgctcctttgacctgtttatatgattttgatttttaaatttacatttgtaaacttcatttacttaatgatgcacatatttaagctatcattttttatcttgtctgtcaatcctttttcgcgtaacccgccgccctctgattgcacagttgtgctaaaataagttttatggaaattcctttccctggttgacaatgtttttacaaaagtttatgatattattgacaaacataaaattaatttacagttgtaaatcggttgctgggcataccgaaatttcatcattgaagggaattccaattatgtcgctttcgtccgaagaacgttattacgtcaaactaaaggcttcttacctttattataaggaaaacaaaacacaggcggaaatcgccgagcttttcaatatctcgcgccctacgctcatcaaactgctgaacgacgccaaaaaggaaggaatcgtgaccatagaggtacacgatacgcgcatgggcagccattatatcgagcttgagcaaaccctgcgtaagctgcttggcttaaaggatgtcaaaatcgtaagcgcgagcggagacagcaaggaggctgtgaatatcagcatcggcgcggcggcagagcaatacttaaccaacctgctgcgttcgggcatgactgtcggtctcggctggggacgcacgctggaaatcatggcgcgttatatcaagccgcatcccagtatcggcaacctgcatatcgtttccctcctgggcgggcttgggagcacgagcgcaggcgattattccatgtttgcaaattccctgtgcgagatcatggcttctaattattccaattcttcggtgtctatgatgtactcaccgcttgtggctccaaacgaggtcgtcgcgaggacctttacggacacactcgctgcgacatacgaaaaacagcgttcgctcgacatcgccatcgtgggcgtggacagcgaccccgagcattccacaacactggagatcgaaaaaccgatgcaggcgctgatggatgagatacgcgaaaaggaaatcgtcggcaacgtatgttcccgcttttataaccgcaaaggcgagctttgtcctttgagtatcgaaaacaatatcctctccatttccacggacgacctgcgcagcaccccggtcgtgatcggtgcggccggcggagaaaacaaagtcgattccattatcggcggcgcgcgggcgcggcttttcaatatcctggtgacggatgagcatacagcccgcatgatcgcggacagccattaaggagatatttccttggatacaacttatatggttccgaatattgcccagccgcttctttcctggtacgaaaaaaatgcgcgaattcttccctggcgggatgatcccgcgccttaccgcgtctggatttcggagatcatgctgcagcaaacgcgcgtagaggcggtcaagccttattttgaacgcttcctcaagactttacccaatatacgagcgctgtccgtggttccggacgagcaattgatgaagctttgggaaggccttggctattacagccgtgcccgcaacctcaaaaaagccgctcaagtcctcgttcaagactttaacggcgaacttccttcatcgtttgcatcactgaaaacattacccggcatcggcccgtatacggccggagcgatcgcgtcgatcgcctttggaaaaccggttcccgccgttgacggaaacgtgctgcgcgttatctcgcgtctcacggcaagtcctgaaaacgtcagcgaagccaaagtcaggcaggcgatgggcgatcgccttatacaaattatgccgcccgaacgcgcaggtgattttaaccaggcgctcatggaactgggcgcgacagtatgcctgccaaacggtatgcccaaatgcgaaaactgtcccctgcagagcatgtgcgaggggtatctgcgcggcattgcccacacgcttcccctaaaggatgcgaaaaaaaagcggcgtatcgaacaaaagactgtgtttatcctgatcagcggcggcaaggccgctcttttgaagcgtcccgcaaacggattgctcgccggacttttcgaactgccaaacacagacggcatccttgattttgatgcagcgtcctgtttgcttgaaacatgggggatccccgcgctctccttagagcctgcgggcgaagcaaagcatatttttacacatgtcgagtggcatatgaacggataccttgtatatacagacagtatgccaggccgttttttatggcggagcctcggtgagatcacccatgactgcgcgcttccgtccgccttccgcacatatacgaaaattttgtgcgatgcgctcgatccgatggtataatcaagaggaaactaagtacaggaaaggcaatacatgactactcttacaaatttggcgttaaaattacgttccctgacccttttccgcagcctgctttgcgatgatgttttcgcagctttcatcgacatggcggacgctgccgaggcggaggatgtttcccgcagcgtttcgtgttacgccgcgtttgccgcaaagctgtatcgccatacgcctgattttggcgactatgtcctcaatgccgtactggatgacgagaacctctacatgctccggcgcgcgcaaggccagaacatagatgaatgcatcaaaaaaagccttttaaacgagctttccatcctcgagcagctcagtatggtcaccagtggcgatatcaaagaaaaaatcgcctacgcggggccgcttgcggattggtgtaatacacagcatgattttctggctgtttacagcaaatatatcgatgccatcccaaccaatggatacgggatctttgccaagcatcacatttttacgatcgcggggcacaggcttgtccccgtgcttcatcctgatgaaacgacgcttgcacagcttgacggctatgaatatgagcgccggtgcgtcatagacaacacgctcgcccttataagcggcaaacctgccgccaacgttctgttgtacggcgacagtgggactgggaaatcttccactgtcaaggctgttgcgggagaatttgcaccgcgcggcctgcgtctgatcgagatcaagaagaatcaattgcgggaaatccctgcgctgatggattcacttgggaaaaatcctttgaaatttattctttttatcgatgatttgtcttttacaaaggatgacgacgacttcagcgccctaaaagcgatcctcgaaggctccgtttccgcgcgtaccaagaatcttgccgtatacgctacaagcaaccgccgccaccttgtgcgggaaagtttttccgaccgcgagggcgacgacgtgcacgccaacgatacggtacagcaactgacgtccctttccgaccgtttcgggctgaccattaccttctggcgtccaaaccgcgagcagtatctttcaatcgtatcgcatcttgcgtcgttttacggcgtggataccgaccaggacgagctgtttcgacaggcggaaatttatgcgcttgagcgcggcggccgttcgccacgcgttgccaagcaatttctggaacaagtccagtcgattggcttggatcaatagctaaaacatccgtactgctatatataatacagcttataaaaccgctctgttgagcggtttttcttgtttattctgataatacccccgtcaggtcgaatagcgggataaagctctcgtccgccgccgtcccttcctgcaaaaagcccttttccacccccatcccgagcgcataccggacgagctctccatattcttcttccgttacattgcaccgaagctctattgggaggccgcttcggcgcaccggcgtatactggctcatcaggcttaggtataccgtgtccccataggtatcgtaaagatactttacaatggttttagcttcttccgcatgcccgggcagcagcaaatgacgtacgatcacgcccttttgcatcattccctgcttgtcaaaaaccgccgtgcccgcctgccgcaccatctcccgcagcgcttctttgaccacatgcgtataatcctgtgcatgggaatactcctgcgccgttttcacgtccatatacttgaagtccgtcaggtagatgtccacaagcccgcgcagcatttccagcgtgtccgccgtttcatatccgctcccgttatgcacgaccggaatatgcagaccgccctcttttgccatgcgcagagcgacggcgatgtgcggcgtatagtgcgtaggcgtcaccaggttgatattatgcgcgcctttttcctgcagctccataaaaatatccgcaagccgctgcatggtgatttccgcgcccgcctgtccgctgctgatcgccgcgttctggcagtaaacgcagtgcagtgggcaatacgaaaaaaacaccgtgcccgagccgttttctccggaaatgcacggttcctcccaaaaatgcagcgcagcgcgcgcaaccttaaggtccgctcccgctccgcacatccctttttcgccctccgccctgtttgccccgcatttgcgcgggcagagcatgcagcgtctcagcaactcttccatacaggacattatatcacttttcctggttttttcccttccattttatggtataatagtaaagcatttatcaatttgtaggggtacttaatatgaaacgggaaacatggggatctcgctccaattttatttttgccgcagtgggcagcgccgttggcctgggcaacgcatggcggttcgcgggccaggtataccaaaacggcggcggcgcgtttttgctgccgtatatcattgcgatttttgccatcgggattccggtgctgatgatggagcttgccatcggtaaaaaatatcggttgggcgcgccttcggcttttgcagccatgaataagaaattcgaatggatcggctgggcgggcgtgatcattgcttttgtcgttgccgcatactattccgttctcgtcgcgtgggttgtcaattatatttttgcttccttcacaatggcatggggcggcgatcccgccggatttttcaacaatactgtgctgaatgcgtcgggcagtcccagcgcgttaggcggcttttccatccccgtcctgatcggccttatcatcacctgggtagtcgtatttttaagcatgcgcaaaggcgtggaaaaaatggccaagctcgtcaaatggatcgttatcattcctgtgatcctgcttgtcgtcatgtgcatacaggctgtcaatttgccgggcgcggcggacggcatccgctattatatcacgccggactggtctgcgctcgcggacgccaacgtatggcgcgccgcctttgggcaggtcgcgtacagcatgagtatcctgttcgcgctgatgatcacgtatggcagcttccttgaaaagaaaagcgatatccccaaggacagccttgtgatcggggtcgcggatatggggatcaatctccttgcgggctttgtcgtattctccacactcggctacctctctttccagagcggcactcccatcgcggatatgaattaccagggcgtcatgctcgccttcgtcacctatccgcaggccttgtccgtcttccccggcgggcatatcgtaggcgttattttctcgctgatgttctttatcatgctgtttgcgcttgcgatcgactcgctgttctctatcgtgcaggccgtttctaccgccgtgtcggataaattcagcttgaaaccgcgcaaggcgctttacggtacttgtatcgcatgcttcgcgcttgcactgctcttcgcgacaaaggccggactttactggctggatatcgtcgaccattttgtcaacgaaggcaacttgctctttatgggcattttcgaagccatcgccgtcggctggctggtcggcgcggagccgcttagggaattcatcaactccacagcttctaaaaaaatcggcaaatggtggaacgcgatcatcaaattcgcatgccccatcgtgtttttgttcctcgcggccagcttcctttattccaacatcgtttcgccgtacggcggctatgaacagcaatatctgtttgtcggcggttgggcgcttatcattgcgacgtttgtactcgccctgatcatccccagacttacacgaaaaaagaaaggatctgagctccaatcatgaaaattttgcaaatcgcgcttctttgcgtaacggtcgccttgatcatccaggtggtcgtgtacgcggcgaaacacgatcatgtcaaacaaatcgactgggccgaaacctttacgctccgctacccgcacctttttctctgggtcgctatcgtattttttgccgcgattgggtttttactgctcaacatgatcatttggcaggagtttaacccattcatcgtaatcctgcttgcggtgctttctgtttgcagccttcccgcttttctgctggcgcttcggtggaggatcgtggtaaacgaggagtatatcatccatacgccaatgttgggcgggaaaaaacaaatctattataaggacatcagccgcgttgtcgttacgccaaaggtagtcgtgatggagaccacgctgaaaaaaatcaaatttatttccggcgtatattatatggaggattttttattccgcttgcgcgaaaacggcgtagagatcgaaaggatattatgaagcaagcgcggcctttacaggtcgcgctttttagatatcctgcgcataaaaatccccagtgcaacggtcagtaccgcgaggatcacgatggaaaccaacgcatcttcccagtccgcaaagttttccggttttgcgatgcacgcataagcgatcacaattgctgcaatcgccgcaagcatcaatataatcagccctttgaatacgttcaggacattgccgctcctcttttccctgctcgcttcgtcggtaaacgcttccggcctctgccccgtgtattccttcctccatacgaacaggctggccatcttgcctgccagctcccaaccaaattcttcatacgtcctgacgtaatccttcgaatgcagcgcatgcaagtccaccacataccggtattgcttgggctccgtcttatgaaacaccatgcgaaaagaatcccactgcttgatcttccccacattccatccctcttttgccatcttttccatatagttttcaaaatccaccggagcggcatatttatacggcagccaccatttcgccactttatttttgtttttcataacagcacctctgcgatttccgccatctccttgatacgggcggcttcttcattcaagattataagaccggtttttgtgatcttgtatttctttttcctgtcgacttcctgcgtcgcagcgatcagcttatccctcaaaagttttgagatactctggtaaatcgttcccgcgcccagcttaaggcggccgtttgtcaggttctccacatattgcatgatcccataaccgtgcctttcctcgcgcagcgaaaacaaaatataaaacattgtctcgctcatgggaatgtaacgcttcctggcatgtttcaaatccatattcttcacctcatatcgcatcgcactatatcatactatgatatagcgattatatatcacaatgtgatatatgtcaacaaaaaaacaaccgcgcatcgcacggctgttttcttttcaatattctatgctattttttcgggggcgctttttgcttatcatccggcggggccgaagatccggctgcctgcgcaccttgctgttttgctgcgtccgctgtcgttgcggttgccgttgcagcagctcccgccgctgcggtatcgcctgttaccggaggcattttgacgcccggtggcaaaggattctttttccgcataaagtggtagatgataaacggtacgaacaccaccaccacgaagctgattatcagtatcgtcaggtattgtgtcgatgcgtctttcccggttaactgagatggcggaacgaacgagatcaccagtgcgaaaatcgacaggatcagtcctgcaaacgccataaccagtttgatcggtttctttttggaaatctcaaacgcccgtttcaggtcgccatgctttcttaccagcttgatataagccaggaagaatatgatgtaacctacgatgtagataataaccgtgagcgagattgccgtaaagaacgaaacgttgctgccgccgccaccgaatgtcaggatagcagcccatgccgttacgatcacgccctgcagcagcaggaactttgtcggaacgccgtgtttgttcgtttccgagagttttttcggcagaagaccgtttttaccggcttcgagcatcccccaggagggaccgaccacccatgcggatacttctgcgataacgcctactgcaatcaggatcgcgataacgcctacgatccaatccataccgcttccgaagtggtgtaccaggccttcaaagccctggataacgcctgtcgagaggccaagctgcgcttccggtacgaccgcaccgatggatacgccgccaatcgtattgagaatgatggccagaataaccagtatgatgatcgcaatcggataatcgcgttttacgtttttcatttcgttggcgtgtgtcgcagaggcctcgattcctgcatatgcaaggataaaggatacgaacacaaccaatgtgtcaatcttcgtgaagtccggtatgagcgcctttgcatcaagcgggataagactcttgccgcctgttgtaaagaagccgatcgccagagcaaaaagtacgatggcaggaatcatgataccaaatacaaaaccgatcttagagatttttgccgtcagctttgtgcccttgaactgcgagaatgtcagcgcccagaagatgaccagcacgccgataaacttgattaccggatttgtgttgagcgcgtcccaatgcagtacataggacagtgcgcctaaaataaagtagatcatcgtaacaaacccaaccgtgatctggaaccactggaagaatatgtttgcaaaaccccatttctcacccagcatattgcccgaccatgtgtatacaccgccggtatcccatccctgcaccgtcgccatttcagccgaggacaatgctacaggcagaaaccataggatgcctgccaggatcaggaaaaataccagtgaaaaaccggaggatgcaaacgtcggatactcgtaaatcgtcatgaccatggaagccgtgattgcgaaaaatccgaacaatgtcaaatgcttgttgcttgaagcagcattcgcaactgttttcatttcattacctcctctttctgtaagagatcggcccgtatggcgaaaagccgttttgccgtccgccatactgccaatttactttgatttaatatatatcattcgtttggcataagcccttaaggcctgccgtagttagtgcgtgaagccctgtgcgccgctcttctgcttgccaggtgcatcttcttttgtattcttctccagatagtcgattgccatccgcatatcttcaatgagggaatccgccatgttgtaagagaggtccgcacgtacgacgtaacgctggatcacaacgtctgtgaggtttttcggaagcgtatacgccggaacctgccaacccttcatcgccagcctgtctgccagttcgtaaagcgtccatttgtgtttggacggatcctgaagcttgtagcacagtaccggtatgttgctgccatcgttatagatttcaaagataccgaattttttgatcgcatcgatgatatgcagtccaacgtcctttgtatgtccctgtaccatcttcatgccctcgaggccgtaacgcaggaagatgtaatattggccgatgatctggcttcccgaacgggagaagttgatcgccatcgtgggctgttcgccgcctaaatagttgacgtagaaaatcaatctttccggcaggtattctttgctcttccagagtacccagccgatgcccgggtatacgaggccgtatttatgaccggaggtgttgatggaatgtacgtttttaagacggaagtcccattcgagtttcgggtctacgaacggtgcgaacaagccgccggaagcgccgtctacgtggataccgatcggtacttttgccgtcttattatgtttttcgatcagctcgtcgagttttttgatatcgtcaaatttgcctgtgtaggtgattccgaggattccgactacgccaatggtataatcatcgacaaaatccattaccttgtccatattcatgctcatatgctgttcatcaagcggtacaagacgcatttcgatatcccagtatacgcagaatttttcccagcatacctgatagccggaggaaataacgaggttcggcttcttcgccttggtgtcgattcccgctttttccgcgaggtcgcgccaacggaatttcatagccataccgcctagcatacatgcttcggacgatcctacggtggacgttcccatcgcttcgccttccttgccatgccaaatgcttgcgatgatattcacgcaacggttttccacttccgtcatctgcggatattcggatttatcgatcgcgtttaccgcaagtgtttccgccatcagccttgttgcttccggctccatataagtctggcagaacgtcgccaggttctggcgtgcgttgccttcgtcgatcagctcatccttgatcaggcggtaagcgacttccgccggaaccgatttttcattcaatgcgttgacgggcatcgcctcgtctgcttcgaatactgcgaggttgggggagactattttacttttctttaatggtttatttatatgcaacataatatttcactcctttgatttgatattgcgttttggattgtccatcgcgatttgaacaatatatgaacattgcatgctacttttttaaactgtagcgttcgctttaaacatttaatgagaattttaattttataccctgccggtacgatagaagcggacaaaggattcatttagggttcacaaaacgtgttataataagatataagactattattggagaaatattatgtttcatattttgatcgttgaggacgataaaaatttaagaagactgatggcaacctatttggaacgcgaaggatatgaagtctatcatgcgggcgacggacagcaggcgatggagctgctcgacacgcagcatatcgacctcattatcagcgatatcatgatgccgaatatggatggctaccaattgacggaggagcttcgaaaagcggattatatgctgcctattttgatggtgaccgccaaagagacctttgaagataaacggaagggcttccttgttggcacggacgattacatggtcaagccgcttgatatggaagagatgctgttgcgtgtttccgcgctgctccggcgggccaacatcgccaacgaacataagctcgagatcggcgatatctctcttgattacgattcccttaccgttaccgcgcacggcaaggtttacgagcttcccaaaaaggaattttatttgcttttcaaacttttatcttatccgaagaaaatttttacacgccagcagttgatggatgaaatctggggcatggaagcgaaagcggacgaaaggactgtggatgtccacatcaagcgcttgcgcgaaaaatttgatgattttccggaatttaagatcgttaccattcgcggacttgggtataaggcggaaaaaaacgcatgaaaataaaaggcctctcccccttcaatatgcggaatatttcctccatacagctaaaatttatgatggtattcgtcggcatccttttgatcgcctgcgtcgcatctatggttgtggtgtccgcattcatgcaaagcacgcttataaaagacatcaaagaacagcttatcgccacgtcgcggagcattgagcggcttgttgacgagaccgatctgccgcttgacgagatcataggcatggtcggcagctcttattacgatattcatgtttacgatccggagtccatggctttgcccgacgggatcagtgaagatacgcttgccgccctggagcctgaccatatcttttttgtaacggatcaaacgaagtcccaaacgctgccgctcggtattttaaaggtcagggactcttaccttgtcatgacatcccataccgagaacaatgaaatcctgtatttccgcaatatcgccttcatggttcttgtgatttgcgcagggatcggctccatcctcatgctgcttgccgtgacgcacatcaccaagcccgtcaaaaggctgacgcgtgcaaccaaggaagttgccaagggcaactttgatatttccgtggaatacgattcgcaggacgagatcgggcagcttacacaaaatttcaacctgatgacaagtgaactgaaaaacatggaatacctgcgcaaggattttgtcagcaatgtctcgcatgaattcaaaacgcccatcgcctccatacaggggttcgcgcagcttttgaaaaccaaagacctgacaaaggaagaatttgacgaatatacggacgtgatcctgagcgaaagtacacgcctttccaagctttccgaaaacctgctgcggctgtcacgcctggaaaaacaggtgatcccgccgcagaataccgagttttcgctggatgaacaaatccgcaggacgctggtgcttttggaacgcgaatggagcctcaaaaacctcgagctggatattgatctggaaaatattcgttacaccagcaacgaagaaacactacagcaggtttggatcaacctgctttccaacgcaatcaaattttcccatccaaacgggctgcttcgcgtatcgcttaaaaaggatcaggactttatacgcgcagaaatcacggataccggcattggaatctccaaagaggccatgccgcgtattttcgagaaattttaccagggcgattcctcgcattccaaggatggaaacgggcttggcctttccatcgtcaaacagatcgtggaaagcaacgccggcagtattaccgcaacgagcgaggaaggaaaaggcacgacgtttaccgtgctgctccccttgccgaaaaaatcttccaaaaataagggatcagaccgctaggctgcggacaagtgtttgcacgagcgagttacacgaggcgcgcagcgcatgtctgttgtttaaagcgcagtgtaaatacttgccgcagccataattgctttgtgaattttttcccaaaaatatattgaaaaatttttgatctttcggtataataaaatatgctatttgtttttgcgtgtatttaaagccacgccgtttttaagttgcttaacaaagttaagcgttcggtatacgtaccacttaaaaagtagcgaatattagccttgcgctgcggcgcatcccaagtatttactttttaggaggacgtttttttatgtcagaaaatcaaacagtatctatgacgatcaaaaggtacgccaagcggtggtttattgacggtatgggcgcaatggcgctgggtcttttttccagcctcatcatcgggctcatcatttcccagcttgcgaccatccccgggctttccgtgcttgcgcaatttactgaggtcctgagcgcgaaatcccccgtcgttggcgcggccatcggcgttgccatcgcctacggcctgaaaaacaaaccgcttgtcatcttttcttcggctgcaacgggcgctttcggttatgccatgggcggtccggtgggcgcgtatgtggcggcgcttgtgggcgcggagatcgggcgccttgtcgccggaaaaacgccggtggatatcatcgtatccccgatcgtgaccatccttgcaggctgttttgtaggtctgcttgtcggcccgcccctcgataccttcatgacctggctcggtgattttgtaaactcggcaaccatccttgccccgctaccgatgggtatcatcgtttcggtcatcgtgggcatggtcttaacactgccgatcagctcagccgcgctgtgcatcatgatggggatcagcggcatcgccgccggtgcggctgttgcgggctgttgcgcgaatatgatcggttttgccgttatgagcttcaaggaaaacggatggggcggctttttggcgcaaggccttgggacgtccatgctgcaagtgccgaatatcctgcgccgtccgcagatatggattccgcccatcgtcgcttctgcggtcgtcgggccgatctccactattgtattccagatgaccaacacgccgaccggcgcgggcatggggacgtccgggcttgtcgggcagttcggcgcgtgggcggccatgagcgcgactacgcctgctcctatgcttattttggagatcgcgcttgtgcatttcatcctgccggccgtgatcacgcttgcggtcgcagccattttgcgcaggatcggctggatccgttcgcaggatctgaaactggaattgatgaattagtcattttaatgcaaaaagagcggttcccaaagggagccgctcttttttacggattacttttaaaacgaagtccagccgccgtccgtctgcagcgtagcgcctgtcatatgtgttgcgtcgtccgatgcgaggaatagtatagatgctgcctgctcttccgccgtggcttcgcgttcctgcatcgtttttgttttctgccctgccatggactgtgcctgcgcggcatccatcccctgtgccactgcttccttttgcttttccataacaaaagcataagcctcctcaaccatcggcgtagccgtacctgccggattgaccgaattcacgcggatattgtaacgcgcgtaatcgagcgccagattttttgtcagcccgttcacggcatgcttggaagctacataagccggattacccgggagccccgtcatacccgcaatggaagcgttgttgacgatcacgccgccgtttccctgcttcaaaaattgcaggatctcatgcttggcacaaaataatacgctataaaaattattggcaaacgtaaaatccattgcttccttcccaatttcatggacaggacttggattccccattacgcctgcattgttaatagaaatatcgagttttccaaatgccttgaccgtttctttaaccattttggctgcattttcctcaatggaaatatcgaaggacagaaaaatcgcttccccgcctgcatccttgatctcttttagaacttcctctccttctttgccgcgtttatccaccaatacgacctttgcgccttccttagcggcccgccttgccgtggctgcgccaatcccgcgcgccgcacctgtaatgatgatgaccttatctaaaaacctgttttcaaaatacttcataactgcatccctcccttttttataccttttcagtcgatccgtatgtattccgccgtttcgaccgcctgtgcaaccagcgcttcgatatccagaacgctttcttcttcgatgatccgttccagcttggggcgcgtcgttggatgcttgggcacaaataccgtgcagcaatcctcatatggcaggatcgatgtttcatatgtaccgattttttctgatatctcgatgatatcctgtttgtccataccgatcagcggccggaatacgggcatatcggtcacaacgctgttggtaacaccgatgctctccattgtctggctggctacctgcccgatgctttcccccgtcacgatcgcctgcgcccggtcgcgctttgcaagctcgcgggcaatgcgcatcataaaacgccgcatgataatcacgagcatttcgtgcggacatttttcataaatctgcatttggatatccgtaaaactgaccacatgcagccggatacgtcccgcatactgcgatacgatcttcgccagatcgatgaccttctgttttgccgcttcgctcgtatacggaaagctatggtaatgcaccgccgaaagctctacgccgcgcttggcgatcatataccctgctaccggactgtcgatcccgccggacagcagcagcatggcgcgcccattcgaacgctgcggcatcccgcctgcgcacgggatgatatccacatacccatagcatttttcccgcacttcgatatgcactttgatctgcgggtcgtgtacgtctacgctgagcgtagggatcgcttccaaaagcgtccctccaaggctggccgcaagctgcatcgaggacaacggaaagtgcttgtccgcgcgttttgcctccaccttgaacgttgcgcttgcgatccccttttgctgcatatattcacgcatgatacggatcatcgtttcattgatatcgtccatatccttttccatttctaccgccggtgaaacagagtgcaagccaaataccttccttaccgcttcaatgacgcgcggcatatcctcttccgcgatatccgtgacataaaaacgtccgtatcccttttgcgtctttacgcccggaaaatccttaagcgcccgtttgatcgccgccaattgcagcgcttcaaaatgcggcctgttgagcccttttaaatgtatttcgccataccgtaccagtaataacataacccttatcccctattttcttgtgaaccgccgcagcagctccgcactctttccgatctcttgcgccgcaaccagtacctcttcttccgtagtaaacggcgaaaaactgatgcgaatcgcgccttccgcttcttcttccgtcagggaaagcgcttttgcgatcctgctctttccctttttggacgagcaggccgagcctgtcgaaatacagatgccctgtgcttccaatgtgtgcagcaatgtttccccgcgtacgcccagcacagatagattaacgatatgcgcgcaggcctgcgactcgtcctgcggcgttagcagcgttacatccggaattttcatgcaggcgttaagaaaggcatcccgcaaatgttcaaaatgtgcgtaccgcacgttttccataaaatatcgcaccgccgccgcaaaggaaaaaatccccagcgtattctgcgtaccgctgcgcaatccgctttcctgtccgccgcccaagatatatggcttgagcggtacgttttcgcggtaaaaaaccgcgcctgttcccttgtgcgcgtgcagcttatgcgcgctcacagtataataatcgatatttgccgtgtttttcaaacgttccttacaatatgcctgtacgccgtccgcatggaaaagtgtttgcggattttttgccttgacggctgctgcgattttctcaatatcgttttttgcgcccgtctcgttattgacgtgcatcacgctgacaagcgccgtgttctcgtccacggcctccgccgcctgcgcggacgtgatcacgccgtgcctgtccggcttcaaaaatgtaacgggatatccctgctccgccagatatttaaaactttcctcaacgcatggatgctccgcgccgccgcacacataattcatattcttcttgccccgtgcgccgcgcaggatcaccatgttcgcgctttccgacccgcaacttgtaaacaggcacttgtgtcctgatgcgccgaaggcatgcaaaagcacggccttcgcctcgtcctcctccttttgcacgcgcgtcgcgtctccgtaaagagccgaaggattctgccaaagcccgcgggcatattccagataaatatcgctgcattccgcaagcggctgtgtcgtcgccgcattgtccaaatatattttctgcatgaaacatattatatcatatttcggcgccataatcacgcgggcaaacaaaaacgcggttgcccgcgtttttgttttattgtactctgaatgtctttattacggcgtttccgggaagagttggttgccttgctgttgctggctctgtgccgccgtgtccagttcgtttaaatccgccagcgtcatcgtgacggtatattctttgccgtcccgccataccgtcgccgttaccgtatcccctactttttttccgtcaaaggaaggcattttatctgccgtcgtaaggtccacaccgtcgatttcggtgatcacatcattttgctgtaagccagctttttcagcaggaccgcccgttacgacgctcgctaccagcgcgccgcgcggcgtattccacaaacccgcatccacttcggaaatcatgctgtaggaaaggccgattcccgcacgcgggatgctgccattctcgatcaactgctgggcaatatcgatcgccttgttgatgggtatcgcgtacccaacgccttcggaagaaatcgcattgccgctttcgtcatatcccgcatacaattgcttcgctaccattacgccgattgtattgcctttggaatcgagcagcggaccacccgaatttccggggttgattgccgcatctgtttggataacgtccagcgttacgccgttgcttaagctgatcgatgtattcgtgttgctgacatagccgaccgtgaccgtattgttaaacgtatctccatgtacgttgccaatcgccactgacagctctcccaccttcaagtcgtcgctgttgccaagcggcgcagccggaagattaaggccgtccaccttgagcactgcgatttcagatgccggatccctgccgaccacttccgcaacatgctcctggttatctgatgtcgttaccttaatcaggttcccgtctgcaacgacatggttgttcgtgataatatatccgtcgctggaaataacaaaacctgtccccgcgttgagcgcctgttcaataggctcctgccccgatacaagctgcttattatatgccgtaatacccacgacgctgtccttcattgcttccgcgatatctacgacagggttagcggaatccttaatatccgccgcgtctccgccaagctgcggcgcctcgctttggttttcttcctgctgctgttgctgctcctgtgttggcaggttcggcaatacgccgtttccattgttgatgatcggcccaaccacaaacgccataagcaagcacccgacgagtattcctgcaacagctactgctgttataatcccaccaatcccatgtttcttagccttttcttttttccgctttttggatgttggctggtcataattatagctgtcgtcatataccgtctgctgtggctgctggtacggctgctgctgatattgatattgttgattatccggcggcgtaccctgcatctgcggcggttgctctccctgcatgctttgcggctgggaaggctcctgcccctgaccgctttgcccctgcggatccgtgccgtttccattcatattgttaaaaccgttctcgtccatcaatcttacctcctgcaccaaactttccgtcggtttcttttactatttccatcttacacgcgctttgtgaaaaagctgtgaacaaacctttaataatttttatacctttttgagcgtgaatgtgaaggtggtcccgtcctgtgcgctcgacgttacccagattttctgtccgtgctctttcaggatattttttacgatagaaagcccaatgcccgtgccttcctttgcacgcgagtgtgatttgtcaattttgtagaacctgtcaaacaaataaggcaggtcttccttggagatcacgtcgcctgagttgttgatattcacaaatatactcgccttcgttgccgaagtggatattttcagttttccgccttcgtttacaaatttgatcgcattttcgatgatgttatgcagcacctgctttaagcggttttcatctgcgtaaacatattgcttttcatccggcaaatcaactgatacctcgaggtgttttgcttcgatcttactttcaaaggtgatcagcgtccggcgcagcaactcgcttaattctactttttcgatttgcatggggaattgtccggactctattttcgcaaggtcaagcatatcgcttatcaggaagcccaatcgcttggtttcgtcgagcactacgcccagataatgctccgcctcttcgcgaggaatcgttccgtcgatcaccccctgcaaaagcccctgcatagacgtcagagggctcctgagttcgtgcgatacgttggcaaccaggctctcgcgcgtcgcctcgtattttttcagctcgcttgccacactgttgaatgtatccgcaagctgtccgatctcgtcctttgaggatacgtccaggcggatatcaaagtgcccctttgcaagttgcttggctcccgtattaacaatagataagggacgcagcatggattttgagaacaggtatgtgaggatgatccccaaggccgcagaaatacatgctgcaagcacgatctggcggtacatcgccatcagcgacgcttccagttcattaattttcttatgcacaaaaacataccccgtcactgtattatcagatataacaggttttgctaccgtgatgaccggcgtattgaaaaagttggattcttccgtgacgaccttgaccgcgtttcccttttgcagttccgcgagcatatcctcaaaatacatttgtatttcttcgttggtgacgctcgtctgcccgcttgggtcgatcgcctgccataccgtgccgtcgctgtttacgatccagatcacgtctttattcgtttccgctttcacgagtatttgcgccgccatctggttgaatgtcagataattgcttttataaaaggacaacagggtatccacatcgtttgccacgcccaacatttgctgctcgctgtcgtcgaggtatgcattgcgtacgacccaactcatcatcatgcctgaaataaacaaagagaccatgataatggccatgaaaagcagcataatttttccaaaaatcgttttgatcatctgaatccctttaatctttgtgtcctgtcttttattataatgccttttttacgcgcatatgtaaacaaaaattaaataattactctttttagtaaaaaacaggccgtttcggtctgttttcataactcacattatcgccggccactaggtccggcgcaggaatacgcgccctgacgccgacgcctttgctagcgcatcgcgcaggctcggcgacagggcgttagtcctgtcgtcggaaagggttgaccgacataatacatatacaacggcatacacatacccgttatcaataccactaaatctcgaacttgtatcccacgccccagaccgtcttgatctgccacggttcatcctcgtcgaatttttcgcgcaggcgtttgacatgtacgtccaccgtacgcgaatcgccgaaatactcaaagccccatacctgctccaaaagctgatcgcgcgtaaacaccttgtttggccgtgccgcaaggaaatgcagcagctcgatctccttgggcggcatttgcagttcttttcccttatacatgacctggtaattctggatatcgattttaaggtcggggtattccagcacgtccgtcttttcttcctgcgtgctgcggcgtatcaccgccttcacacgcgcgacaagctctttggggtcaaagggcttgaccacgtaatcgtccgcgcccagctccaacgagagcaccttgtcaaaggtatcatctttggccgtcagcatgattaccggcacattgcttttttcgcgtatctttttcatcgtctcgatcccgtcctgtacgggcatcatgatatcaagcaatacaagatcgtacggcctgcccataaaaagatcgaaaccgattgcgccgtccgccgcttccgttacctcgtagccttccttgcgcaaatataactttacaacttccctgatgtttttatcgtcgtcaatgatcaaaatattctgatttgccattttctctccttttacggtatctccaccactttaattccattctgcttgagcagcgcgcatgtcacgccgcagccggcaatcgttctgccgctaaaactgccgtcatatatctccttgacgccgcagctcggacttttttccttaagccatacttccgttatagcattttcgcggataaaatcaagcagtttttgcgctccggctataaaaccgcttgtaatatcttctccctcactattataaacacgcgccttgccgtttaaaacgtcaaacccgtcgcccccgcgtatttccgcgctcagccgcggcgttgggaagcctgccagtacctccggacaggccgttaccgcttttttcccacgcaccagcgcaagcgcctgctcattcgtctttgcttttccatcgtaacggcaggcgacctccgccagacatgcactcactacaataagcgctccctgccggtcgcttcgggaaggggcaacgctttcccctttccgactttcccctgctgacggttgttttgccacgcgtttccgcttacaaaaccaatttatttctgacgaacgtactacttgtaacataaaatatcttttccctacttcagcgtaacgaccgtaacgccgatatccccttcgccgtatttccccgggcggaaactttttacatgcgggtgggtgcgcaggtattcctgcacgcctttccgcaggactcccgttcctctgccgtgtatcaccgtcacttcattaaggcctgataaaaacgcatcgtccaggtatttatccaggataatcagcgcgttgtctaccgcctgtccgtgcaggtctatctccatagacacctgccgcctcgggtcgagctgcacatgcgacgtttttgcacccttttggggcgcttcctcctgccccggccccagttcgtccacatgcatgtcgacctgcatgatgcctgcctgaagccgcaccattccctttgcattcggcagcttaagcaccgtcgcaggcgcatccattgcaaggatcgtgaccgtatcgcctacgtggatgtcccctatcgtaagcgtcttttcctttttctgccgtttcttgtgctgctcgatcgattgtttctttccggaaatcttatcgcgtattttttttgtattgaccgtacgccccgcctcgtcttgtttcttcaactgcttcgcttccgcgatcgcgtcttccgccgtttcccgcgcgtcgtccagtatctctattgccttttcatttgctttttcaagtatctgcttacgcttttccgccgccttctgcgcaacctgttctgccttacggcgttcttccttcgccttctgcaagacctcacgtgcgtctttctgcatcttgcgcgcgcgcttttccgcctgctccgccgcctcgatcagcctgccgtattccaaatgctcggcattcatatatccctgcgccgctgtgatgacgtctttcggcaaccccaacctttgtgaaataagaatcgcgtttgagtgccccgccacccccataatcagacggtatgtaggcgttagcgtcgccgcatcaaactccatacttgcgttttcaaaaccttcacgctcattcgcgaaagccttcaattctccaatatgcgttgtcgctaccgtcatacagcctttttccataagcgccgccaaaattgcctgcgccagcgcgctgccctcctgcggatccgtccctgcccccagctcgtccagcaataccagcgaattgcggtcggcatgcttcagggcgaaaataacgcttttcatgtgtgcggaaaaggtggaaagcgactgctcgatgctttgctcatccccaatgtccgcgaacactccgtcgaaaacaggcatcttgaccggcgattttgccggaataaaaagacctgactgtgccatgaccgcaaataggccaatcattttaagcatgaccgttttcccgcctgtgttcggtccggtgatgaccagcgaccgtatcccgcccgataacgtaagcgatacgggaacgaccgtaccttccggaatcagcggatggcgtcccgcgcttatagaaagctcccctgtttcattgaagctcaccggaacggccttcatcgcaagtcctaaggaagccttcgcaaacaagacgtcaagctccgttaagaccgcaacgtctgttttgatttcttcgcgatataggttgaagcctgctgttaattccgcgaggatacgcgcaatttcctttgcctccgacgcttccagctcgcgaatgcggttgtttgcttccacaacgcttgccggctcgatgaacagcgtcgcgccggacgcgctcttctcgtgtacgattcccgaaacgttcgccttgtattccgccttaaccggcacgacatacctaccggcacgctgcgtgatgatcgcgtcctgaagatatttggagtcgtcctgcgaacggatcatggattggagttttcccttgatatattcgttttccttgcgcatttccctgcgcacgcgcgcaagctctgaagacgccccgtccgcaatttcttcttctgaaataatacagtcctctaccctctttaaaagcccgtcatcataaaatagttccttggccatttcgggtatgatacgcgccgattcgtcctttgaaagcggagccgccagctttgccgcgcgaaaaacgcttgccacatgcaaaagttctccgcccgaaaggcttgctcccgttttcatgcgcctaagttcggcgccgatcgaagcaaacgagcaaataggataggagggacgctttaaaagcagcgtttccgcttccatcgtcttttccattaactgccgcgccgcctgggccgtgctttccggcccgattttaagcgcagcctgcgcgcctgcctgcgaaaccgtcttttcagcaagtttttccaatatactgttaaattccaaagattttggtatattcataatgttatattataccacaattccttcgatttgttgtaatacctgtgagcgcaatataaaaagagccgcctctcttgaggcggctcacgctttgactgtttatttgcgatagggcacggtacggttattccccggggataaccgttccaactcctttttcacgcgttccagttcctttttcgtcgccaccagttcgtcgtgcgcctttgtataatcgtctgcaatattcagtgatgtaagcatcgcaagctggatgttattcagcgccggattggcttttttcatctcgtcgagcttggcattcaccttaagcgcgactctatggatatattccgcactgtccgttccgcagattgtatattcctttccaccgatactgacaaccgttttcaccttttccaccgattccaccgccttacacctcttttttccttattatacaataagctttcattttacacaaccgcatattattccgcccgcaggcttgcatcaaactgctctcccaatacgcgcagtatcttttgcatgatacgttccacttcctcgtccgtcatcgttccttcgctgctgcgcatggaaattgaaaacgctacgcttttctttcccgcgccgatcttttcgcccgcgtatacgtcaaacaactctacttgctccacacgtttgccgcctgcctgggagattgcctgcatcatatcgcctgcgccgacgtcctccgatacgagcactgccaaatcgcgcgcggccgccggaaaacgcggaagctgcttatatttcatatccgtcttttccgctgcaaacagtttattcaggttgatctgcgcgatcaccgtgttctgcgggatttcgaatgttttcatcaccgcaggatgcacgcgtcccatgcttccgatcttttcctccccgacgtaaaggtctgcagatatccccggatgtaggtatggttccccgctgcgttcacaccttaccttgcaaccgcataaaagaagcgccaggttttcaaccgttcccttgagcccaaaaaaatccttctccccgtataccgccatcataagcgtcgggacctcttcggggagcggctgcccgcttaccggattgtaaacccttgagacctcgaacaattgaaggtccgtgttttttctgttttggtttaacgaaaccacgtttagcatatgcggcacaagcgtcgtgcgcatatacgccgtatcgtcgcccagcggatttaatatcctgaccgcctccggcatcgcgatacccagcttatcataatcctgttcccccgtgaaggaatacgtgatacattccagaaaaccgttgtttttcagatagtccttgatacggtctgtcttagcctccgtcatggaaacgcgcccgcgcccgacttccatcaccggatttgtctccgggacattatcgtatccgtacatgcgcgccacttcttccgcaatatccgcgctgccataaatgtcgccgcgaaatgtcgggatcgtacaaacgagctcatctccgatcagtcccgtattaatatatacgcggtttaaaaattgctgcatttccctggctgaaatctgcgtccccaactttgcgttgacttgtgccgccgtcactttgatgaccttgggcttcaaatcctcgcttaaaatatcgatcattccctgcgccgcgtttccggccttgagcgtttcgatcagcgttagggcccgctgcatagcgaacatcgatgtgcccgcgtccacaccttttgaaaagcgcatggaactctctgtcgaaagccccaggccgcgcgatgtctggcggatattcccatacataaattttgccgattcaaatataaccgttttcgtgttttccgtgatttcggaatccaggcctcccataactcccgcaacgccgattggcccctgcttgtcgcagatgagcagcatattttccgtaaacgtacgctctttgtcatccagcgtcttcatcttctcgccatttttcgcccggcgcacgatgatcttattgccgcgtattttttccgcgtcaaacgcatgcatcggctgtcccgtttccagcatgataaagttcgtgatgtcaacgatattattgatcggccggattcctgcttcgcgcaggcgcaccctgatccattctggcgacggcccgatctttacatccgtaacggcggccgcgatatagcgcgtgcacaaatccttgtcctgcacatccacactgaccatatcctccgttttgctgccgctttcccgatagccggtctccggcaaatgaaaagcgacatcgtccgctgcggctgcttcacgcgccgttccgatgatcgaaaggcagtccggccggtttgcgcctacctcgaagtcgatcaccgctccattaagatttaaaagctcgcggatgtccataccgacctccggctctccttgcaggatcatgatgccgtcgacccccgcccccgggtaatcttcttccttaagattcagttctccgccggagcacagcatgccgaaggattccaccccgcgcagcttcccttttttgatcgggcccgcaggcagcatggacggcgcttttgcgacagggatataagctccctcaaaaacattgtccgcgcctgtcacgatctgcaggagctgttcgtcccccacgtcgatccggcagacctgcagcttgtccgcatcgggatgttttgtgatcttttcgatcctcccgactacgacattctcgatatcctcgcccagcataacgatttcttccacgccgtttccggtcatgaccatcttgtccgcgagcgttttaacgtctgattttatatccgcgtaatcgcagatccatctatacggtgctaacatttcccatgccccccttatacgaattggcgcagaaaacgcgcatcattttcataaagcaaccggatatccgtgatcccgtacttcgtatttgcaagacggtcgatccccattccaaacgcaaagccggaatattcgtccgggctaagtccgcaattttcaagcaccaccggattcacaagaccgcatcccaagacttcgatcatgcccgctcccttacacgcgctgcatcctttgccgccgcacactgtgcacgtcacgtccacttctgcggaaggctctgtaaatggaaaaaatcccgggcggaactttgtcttgacgttctcgccgtagaaattgcggataaacgtgtttatcgtccctttcaaatccgaaaagcggatgtttttacctacgacaagcccttccatctgcatgaatactggcgagtgcgtcgcatccacatcatccgtgcggaatacgcgccccgggcataccatgcggataggcggtttttgcttcagcatagtccgcacctgcacaggagaggtatgcgtcctaagcacaacgtcgtcgctcacataaaacgtatcctgcatatcgcgcgcaggatggtcctttggaatattcagcatctcgaaattatatttatcaagctcgatctccggtccttcgttcacgtcaaagcccatgctcaggaaaatatcccttatctcgtagtaaacctgcgtcagcggatgcagcgcacctaatttctgcgctttacccggcagcgtgatatcaacgcgttccgccttcagcttttctgcgttttccttttcggcaatcttttccgccgctgcaagcagcgcctgttctacattcccccgcgctgcgttcaccgcttgtccaaaggccggacgctcctccggcgataaggttcccatttgcttcatcagcattgtgatttcgccctttttgccaaggtacttcacgcggatgtcgttgagctgtccgctcgaggctgccgcgcttatttcccccagcgcctgcttcacaatttcgtcgtttgacatatatcttttcctctcgtttccaaatttatatcagtttccaagcgccctgcgcacatcatataacattatacccgcagcgacgctcgcgttcaagctctccgcctgtccgtaaatccgtatcttataaaggatatccgcaagctcctgcacatcctgcgagatcccccgcgcctcgttgccgatcacgacgcatgcttttccgatttgcgcaggcaaatcataatttccctgcaagctgcccgcaaccacacttactcccgcgctcttcagcttttttaaggtacgctgtaaattacatacttcgatcggaatatggaacgtggagcccattgccgccctctgtgcctttgggccataaaagtccgcactgttgtccgaaatgaatacgccctcagcccccgccgcgtcggccgtacggatcattgtcccaaggtttttgggatcattcacatcatccatcgcaatgtaaaaacgcccgtcataatccgggagattctcctgctttacaacacatgcgatatcatttggcggtgtttttgtatccgcgacctgctgcaatatatcatatggtacatatattatttttacattatgctcgcgtgcaaaccccacaatcgcgctgcccggctctgccgtcagaatacattctacttcctgctgtgcgcgcaccgcttcttctatcgttttaaatccttcgatgatatatttccccgcctcatccctcgcttttttctttttcagcgacttcagaagctttatatattcattggaatggctctttatttctttcatggcttttcccccatgtgaacaaaaaaggggataaagcagtttaataccagcttatccccaaaatcatctcctgattatgcctgtgccttcttctttgccgtttccgccaattccttgaatgcaggcttatcattcactgccatatcagccagtactttcctgttcaggtcgatcccactctttttaagaccgtccataaacttggaataagaaagaccgttctggcgcgcttccgcattgatacgtacgatccacagacggcgcatatcgcgctttttgagtttcctgcctgtgtaggcatagttcatggatttcatgactgcctgttttgcggatttatattgctttgacttcgctccgaagtaaccctttgcaagtttaaatacttttctgcgttttttatgcgagcttaccgctcttttaactctagccatttttgtaaacctcccttaaatcttctcgatattatttgtacggaatcagaactcttacgttcttttcttctgccgcacaaatataagtacccttgcggagatttctcttcctcttagagcttttcttattcaatatgtggcttttgtacgctttggatctttttaccctgccggatttcgtgacgctgaatctttttgccgcgcctctgtgtgtcttcatcttaggcatcttaacgccctccttttgtatctcaaacttattattgacaacttttttagccctgcctattatgctttgggggcaaggatcataaacatgcttctgccttccatcttggcatttttctcgacaaccgcgctttcccccagcatttccaggaacaactgcatgaccgcacggccttgctccgtatgcgcaagctgcctgcctcgaaaacgaatggatatcttaaccttgtcgcccgcttccaaaaacttacggacattcttggccttgacttccatgtcgtgcttgtcgatcgtggcggaaagacgcatttcctttaatgtaacgatcttctgatttttctttgcttccttctgccgtttattctgttcaaagcgatacttgccgtagtccatgatcttgcataccggcggattcgccttcggcgaaatatttaccagatcaagatccgcttcgtcggccagcttctgtgcctcctgtgaagacatcacaccaagctggctgccgtcctcggcaaccacccttacttccggttccctgatttgttcattgatgaacggttcgtttgcgattttatttccctcctatacataaaaagcggatagtgacactacccgctcaaaaaactaactttaccagtttgcttatttgacccatacgcccttgcttataggtgagaagcgggtagcttctactttgttttaacttctaaagtctatcatacgcgcaggccgcttgtcaagcaggttttttaagatccggcgtaagcgcgaaagtctccgtcacgcgctcgcctgcctcctcgtatccgccgtcctccagaattccgaggccataaaacgtcactgtgatacctgtctgcgaaaaagaatcgatcgcacaatcgatgatcttgcttccggggtatttttctttatactccgcagccttcccgtcaagcgcatcaaacgcacggtcaagcgcctcgccgatttccggctcctgcttcgacttcatgttctccctccgaaagccgttttaccgcgcatatcctttatatattttttaaaaaataactttatccctgtcctgctgggtgatcagttccagcagctcgtcctgccccatgctgccgatctccccctcgccgcgcctgcgtacggcgaacgtgccgtcttcgatctccttttcccctgcaacaagcatatagggaatgcgctcgagacgcgcttcgcgaattttgtagccgatcttttcctgacggtcgtccacggtaacacggatccccgcagcccttagcctttttgcaaattcttcgcagtaagcagccgcagcgtccgtaatattcatcaggcggacttcttcgctcatcatccacatcgggagcgcccccgcatatttttcgatgagcatcgcgagcgtacgctcataacatccgatggacgaacggtggacgatgtacggcgcttttttctgaccgtcgctgtctacataggtcatgccaaacctctctgccagcgcaaaatcgatctgcaccgtaaagagcgtatcttccttgccgaatacgtttttaaactggatgtcgagcttgggcccataaaacgcagcctcgccctcagcctcataatatttgaggcccgtatggtctaagatatcgcgcattgcgccctgcacgcgttcccattcctccgcatcgccgatatatttttctttatcatttgggtcccatttggagaagcggtatgtcacgtcgttttcgatgcccagcaccttcatattgtactgtatcaggtcgagaacgcccaaaaactcctcttcaagctgccctggcgtgcagatgatatgcccttccgcaagcgtaaactggcgcacgcggatcaggccgtgcatctctccggacgcttcgttcctgaacagtgtggacgtctcgccatagcggataggcaaatccttgtacgaatggtgctccgcattatagatcgtatactggaacgggcacgtcatcggccgcagcgccagtacttcttcatcctttgcttcatcccccaggataaacatgccgtcctggtaatgatcccagtgtccggatatcttataaaggtcgcttttcgccatgaacggcgttttggtcagcacatagcccctgcgctcttcttcatcttctacaaaacgctgcaaaagctggatcgtctttgcgcctttgggcatcagcagcggcaggccctgtccgacgatggggcttgtcgtgaaataatggagctcgcgtcccagcttattgtggtcgcgttcctccgcttcctttagctgctttaagtattcatcgagctcctgctgcgacggatacgccgtaccgtaaatacggttgagcatcttgtttttttcgtccccgcgccaataagcccccgccgtgcgaagcagcttcggaacctttaccttacccgtaccgggcgcgtgcgggcctgcacacaggtctgtaaaactgccctgctcgtagaagctgataaccgcatcttcgggcagctcctcaatcagctccaccttatacggttcccctgccgccttcattttttcgatcgcttctgcgcgcggcaatgtatattttgtgagcgggatgttttccgctacaatctttttcatctctttttctattttcgcaaggtcctcgttggtaaacggtttttccgtatcgaagtcataataaaaaccgctgtccgttgcaggaccgatcgccagtttcgcttccggatacagccgctttaccgcctgtgccagcacgtgggaagccgtatgccaaactgctttttttccgtcctcgtcgtcgaaggtaaggatttcaagggtcgcgccgtccggcaccaccgtcgccagctcgctcaccgtgccgtcgatctttgccgcaaccgcggctttcccaagtttctggttcagctcttttgcgatctccagagcgttcatcccatccttaaattctttgacgctgccgtcagccagtttgattttcatagttttgcctcttcttttaaaatttataaagcgtattttttattttacgccaagattacaataccgtcaattgatctcctcgagacttacgctgttgtttagatacagcaggtaaatggatttctctttgttccagtcgggcttgtccttgatgatgttttccactgttttcttaagcgcacgggtcaactccttgatcccaccgctatacaagagcgtaatgtccgcgtgacggcggaatacatatcccatctcgcttaggaggtccgtcttgatcttttgcgcggtttcccctgggaatacttcttccaaacggtaaagctccgcgcttgccgtaagccttcccttgtaataacggataaacgtctccaagtcgtcgacgttgctgccgcgttccagcttaaagaggatcatacagtaaagatgccagttaaagtctacgttcatcagcttctggatggtcgtgcccaccgtatcgatgaactggtctcccgtagcaaatccatgttccagttcaatggattcgcgaaaatccatttcctcgccagccatattactggtaatatagaaaatatccgtcaaaacccgtccgtagtcctccatttgcgccgcattgttcacaataaagatataatcgatgatactgtcgcagctttccttgaactgcaccacgaaaccaaggtcgtttttcatcttgcgcgcaatcgtatcatgcaccagcttggaaatgatgttttcaatggtttccttgcggtaatgcagcttagagctgttatcacgcttatagcgcttgtataggtcatggagctggtggtcgaccaggttcaggttctccttgatggatacgagattttcaatgacctgctgctccaccataaagtaggatggattcttataaattatcttatgctcgatctcgccccagaacatgttgatcatggacttgatctgtatttcaaagttgacgcggatctcgtcttcctcacccttattatcttcataacgcgcgtcgattttgtagatatcgaaaccgtttttttgcttcacaggctgcttttcgttgagcttgaaccgcatcttgggaaattttgagttgtaatagaaaatctggtcgtccgttttattgaacatcttaagcatgagcttgtagacgtattgttcatcttcattgaatttacactcgatgcggataccgataatgtcctggatgttggcgacgatctcctcttttgacgtgtgcatcctgtagtagctgttccgaatcagcttttcccgcacgctgtcaagctccttgacgcggtacgaaatattgagcgtatactccgaattcttgacgatgatatcctcgagcatatgcttcaagtcgtgtgcaatatttttatatcgatattggaccgtttcgtaataatcgaccacttcgtccacatatttgaatatatccattttttacttttctcttttccttttattatcgcctctggcgacaaacttaccgcagccttatatcctgaacctgcaaacagtataccgccaatcgaaacggcaattcgtctgccgggtctgcgcgcttcgcttgcaaagacgccggcaacgaaccccacatttcgctcgccgcctcctaatcgtttggtatcgttttgtctggcgtatacgaagtaggcgggcaacacaatgccgaacactatactcctatgtcggcgtgactaattcgcagcggatcacccttttcttatttcttgatccgcgtaaggcaatcctttaaaagagtcacttcgaatccgttgtgcatgagccagacgacgatgcccgaaagcaccgtccccacttcaccggatacgacgacgcgttccacgaattcccgcttgatgcaatccgagagcagcccgaacgtctcgttcttcgcttcgccgccctttgtatcaaacacgttatagcgcgcgaccggcgtgttcaccgtcttgatgatttcgtcataaaacgcctgctccggcggacagtcccctgcataaagaacgatctgctgcggatgcgcgttaatgtccgcgatcgtcgttttcagtatccgctcgtcatctaccttccccacgtggatacgtacggtaggctttacctcgtggtattcgtccttcagggaagccggcagcgcacgtttatgcgccgaacggccgtaagccgcttccagcttttcccgcacatcgtccgctattttattgcccttgagatacgcacagatatccgcatatttcagccccaattcgtcttcgtccgtcacagatattcccaagcccgcggcaggctgctttagaatcaccgcttccggcgcaccgagcgtctttgacatcgcgtaaatatcatcctttaccaattcctggatcggattcaaatcgctgccgccatcgccgaatttggtatagaaaccggtgatcgcttccgtcgcatgatccgtccccgctacaagcattccctttgcaagggcgtactggtacagcatccgcaggcgcggctgcaaattgcccagcgtatatacgtccttctcaaatccctgcgcgcccttgaggtccccgatcgctccccggtagccccccgcgatggaaaccgtatcgcataccgcctttggattgatttccatgatcctcttggcacaggcacgcgcgtcttcaatatctgcttgctccccgttgggcaaaagcacgagatacattttcctgttcgtgtttgcgcatgctatcgcgcacaacgaacctacaagaaaactgtctatgccgcccgaaattccgagaacgatgcccttggcgcccgacttttcaagatatcgttccacaaaatcaatgatttgcgcttttttgcgcgtaatatagtcttcgcttgtctgtgtatcccgtttaaaatccggcgagatatcatttaatataagcctctgtttcatttcattaccgccttgtatttctccgccattcctgcaatttcttttcctactgcttccaagagttcaggcgggcttaccacctcggcctgtgccccaaaggaaagaatccatgctttaaggtcgggcgtaaccgccgctttcttgtaaaacgttacggctttcccctcttccgaaagcttgtccgccttatgcgcgtggaactcctttacgagccgcgccgcatctcctgaaaaccgtatcttgatatcctgtaccttttcaccagccagcttatcaaagcgcgttttctggtattcctcatagaaacgctgcggcacgcggaaggtatccgtgagcagctttgcctcctccatacgcgatagtctcaaatcccgtaccgcgccgcgcaaatggcaatgtccgatggtatgccagcagccttcgcgtacctcgagcacataaggatcgaacttacgcgtcatcgtttcgcctgtggaaaacgagctgtatacgatctgcaaactgcgcgactcctgcacagcggcctgcacggcctccagaatttcctcgtccgtttcctcttgtgctgccgaagccggaacgatcttgatcattctctcaacattttccatagcgctcctggaaagctcgggcatctttcccagaatcttatccagtatcttgagggcgttttgcgcaatatccagcgttttataggattccagcacctcgcgcgtaaaatataaggacacaacctccgcaatggaaaaatccatgtcggataccgcatatttatccgccttatacactgttttcccgcctacttcttcctcatacacgaaaaaattctgcgagatataatctatgtcccgcaccaccatacgccgcgttgcgtcgatatccgccatgcgctttagcgaatcaataatttcattgatcgtatagccgcttttcttctgcgcaagcagggacaatatgaaaagctgccgttccgtgctggtcgttttatcgctcatcccgccttgcctgcttcctctcggtatgtttatcgatcaggtattcgttcatttctgcgtccgtattaaggcgcatcgtataaaacgccatttccgccacgtattcaagcgccgccgcattatccactgtctgcgggatatctttaccccagacaaacggcccgtggttctttaccagcactgccggcgtggtcatcgggtcttttaaggtgaaggcgtccacgatcaccttacctgtgttcttttcataatccttggcaatttcctccggcttcatgctacgtgttaccggaatatcacatttaaaataatccgtgtgcgtagttccgaggttcggaatgcttttacccgcctgcgagaacacagttgcccatttggaatgtgtatgggccacgctgcgcacatctctaaaggccctgtatatttcgagatgcgtaaacaggtccgaggaaggcgtatgcgatccctcgataatctttccgtcaagatcgcacacgatcatatcgtccggcttgatcttggaatacggaatacggctgggtttgatgacgatataccccgtatggtcgtccatcgccgaaatattgccccaccgcagcatgacgaggccatatttttccagttccatgtttgctttgtagacctcaatctttatcccctcgagcatcttttcattacctcaacttatgttcatttttactgaaaaaaacagctcatccgtccttcttttcctattttacatcctgcctggttttttctcaagtattgcgttgatttttcccctgaaatcggatactattatgctagcatgctaaactgcatgaacagcatgctctattcatttttggaggtggctttctttgaaatcacagaacaaattcctgccgctttttgcgggcgcaatcatccagctttgtatcggtattatttatatctggagtattttccaaccggcggtcatagaatattattcgtggaatgccgcggatgcttccgtgaccttttctatcatgctggccacctttgtcctgggtatcgttctgggcgggcgcttaaacgataagaaaggcccgcgccccgtcgtctttttgggcggcgcgatgttcgtggccggtatcctgctttcttcgttcgttccacaggacatgccatggctcatctacgtcttttacggcggcatggcgggctttggcgtgggcgcagcctatacgtctacgatatcatgcgcgcaaaagtggtttctcgacaaaaagggattcgcgaccggcgtcatcgtctgtaccttcggcgcttcgacggtcgtgtttacccctatcgtcaacacacttttgaaaacagtcggcgtttcgcagacattcttgatccttgcctgcatctttgccgtgatcatccttattttcggctggttcgtcaaaaatccatccaaggaatatatggacgcgttccatgtggcgcttcccgacctttccaagcaaaaacaatacgcgccgctcgagatgatcaaaacgaaatactactacttcattttcctgtcgatgatgctgctgactccggcgtattttatcatcaaccccttgctcaaatcgctgggcgaactgcgcaaccttacggaagcggccgccctcgcgggcgttatggtgacaggcatcgcgtctgcggccggaaggcttttggccccttggctttccgacaggcttggccgtaaaaatgttttattcctgctttatgcgatcacgcttgtatgtatcctgcttctcacttttgcggaaagttacctgtttatcgtgctgatcgccctgatctcgtttgccttcggcggcagcgcaggcgtattccccgcagtcacggcggattatttcggcatcaagaacaacggcgtcaattatggactgatcatgatcgcatttgcggtctccggcctgttgttccctgcaattgcaaaaatcgttacgatcgacggcatcccaagcgcatggacttttatcatccctgcggcggcgtgcgtagtcggcatcatcgtgaccgcgcttttaaagaaagacagcgcaaagaagaaagccgcctaggtcggtgttacaagccaatgcttccttctttgatgtaccccgtcaccgtcatataggcaacctgcgtacctaggtcgtcataaatccggacttcgtaaaggcatgtcctgcgcgttgcggaaatctcctgtgcatgcgccatcaaaactttgcccttaggcggccagttataggtaatgttgttcgaaagcgacacaacattaccgtgcttgcagttggctgcgactgcaaacgtgaaatccgcgattgtaaaaatcatacctccctgtaccacattgcctgcattcaggtgtttttcttcgatcggcgcgctgcaaacgcaccggccttcccgtgcgctgtcgatcacgatgccgagattttttacaaaacgatccatttcaaaaaatttctttatatgctcaatatccaatgtctttgcctcctattgcaactgaaattattatactacgtttttctcttacataccgtatattttttgacagaattttttccagcttggcattgacatccatactggtctcgcttattataaaactgttttaaatgacttttcggaggctttcagactatgttttcacttgaagatctgccaagaatgattgatatgacttctatctatgcggattcgcgcctttgtgatatcgaccgtgtgtgcgatattaccaaggcttatcattgtgcttctacaatcgcgtttccgtgttatcttacgtacacgattaaaaatacaatcggctatgacgatatccttcatggaagcgtaacgggttttccttatggcggcgagcttacttccgccaaggtttacgaagcaaaacaactcgaactgatgggcgcgcaggaaatcgatatggtcatgaacgtcggcgcctttttgtccggtaatttgaagtatgccaagcaggatatggcaactgtatgcgaatcggtcaaggtaccggtcaaggtcatcatcgaaactgcatttttggacgatatacaaatcgccaaagccgcagaacttgcggtaggtgcgggtgcaaaatttgttaaaacaagtacaggccttcacggcaaacctacgactgtagaaatgatcaggatcatgaaagacgccatcggcgacagtgctctcatcaaagcggcaggcggcatccgcgatgtagatacgatgcttgaaatgattgatgcaggcgtaagccgttttggtcttggcgtacgcagcgcagaccctatcttccgcgagatcgacaaacggcttaaccgcgaaagcctgatggattatatcaaatagtgaccgtcattataatattacaaataaaaaagagctttgcaaattgcaaagctctttttactgtttattgatatatttgtcagatactcgcgaatccctgctttaagtcgtcgaggatatcttccacattctcgatgcccaccgaaagacggatcatgcccggcgtgattcccgccgctttaagctgctcgtcgctaagctggcggtgtgtctcgctcgccggatgcagtacgcatgttttcactgtcgccacgtgcaccacattggacgccatggtgaggctatccataaacttgatcgccgcttcgcgcccacccttcagtgagaaagcaatcacgccgcttgcgccgtccggcaggtacttctgcccaagttcataatatttatcgcccgcaagtcccgggtaactgacggattccacctgctcctgcgattgcaaaaattttgcgaccacaagcgcgttggcgctgtgccgctccatccgcagcgcaagcgtctccaaccccatgttgagtaaaaatgcagcgtgcgccgtagggctcgccccaatatcacgcatcaactgcgtccgtgcttttgtgatatacgccagcttgccgaacgcctctgtatagatggtgccgtggtagctgtcgtccggctgcgtaaggccagggtaatccttccagtcgaagttaccgctgtcaatgatcacgccgcccaattgcaccgcatgcccgtccatatattttgacgtggaatgcgtcacgatatccgccccaaactcaaacggacggcacaggaccggcgtagcaaacgtgttgtccacgataagcggcacaccgtgcctatgggcaaggtttgcaaatcgctcaatatcgaaaaccgagatcgcaggatttgcgaccgtttccccaaaaacaagctttgtatttgggcggaacgccttttcaagttcttcgtccggcgcgtcctgatcgacaaaggtgcattcgatcccaagctttttcagtgttacggaaaacaggtttatggttccgccgtaaatttccgaagcgcagaccatatggtctcccgcgcccatgatattcagcagcgcgatcatgttcgccgactggccggaggctgtacacatcgcgccgacaccgccttccagcgcggcaatcttttcttccacatagccgaccgtcgggtttgcaaggcgcgtataaaaatatcctgccgcctttaggtcgaacaaatcgccgatgtgctctgtcgaatcataatcaaaagttgtggactggtagatcggcaatgcatgcggttcgccgttttttggcttccatccctcatgcaggcattttgtttcgattctcataagatgttttcctccataatattttatattctttaaggcatgcacatacatctgtcaaaactccagctctctatacacgcgctatatcacaataccgccgttcgggcttattacctgccccgtaatgaatttactccgttcctccgccagaaacaaaatcgcctgcgcgatgtcgtccggctcaccgatacaaccaagcggggtttcctctttcagcccttctctggtatccgtgtcaagtgccgcgttcatctgcgtttccaccacgccgggcgcaacgcagtttacctgtatcccagacgggccgacttctttggccagcgccttggtaaacccgatcaccgcagcctttgacgctgagtaatgtacctcgcacgacgcccccacgatcccccaaatggaagatacgttgatgatcttgccgcgtttttcgcctaccatctgtttcagcgcttcctgcgcgcataaaaacattcctttgatattgatatcaaacatcctgtcccattcctgctccatgatatctgaaaacatcttttgctgagcaattcccgcattgttgaccagtacgtccacgcgcccgaagagctcacgcgcataagaaaacatatccgctacctcttcgcgccttgaaacgtcggcatacaccatctccgccgaaatacgcaggctgcggagctcgtcgcgcagggcaagcgcgtcgccctcatgcgtgcggtagttgacgagcacattgtatccctctttcgcaaacgcaagcgccgttgcacgcccaatcccgcgtgaagcgcctgttacgagcaccgtcctgttcatcgccgtatcctttccaaaatcctatgcttcattataacgcatcttcaaaaaaaagggaatatcggcatattatgaaaaggggctttccccgactctggaaaacccctttttctcgttttatgccgtttttacttttaattgcctgtcaaactgccatcccgtctttttaagcagcagtacaaggatcggaatgacgacgatctggatgatgatccccggcagtgcgacaacaaacgcattggtcaggaatatctcaaagctgtaaggcgtacccgccatgccaagtaatatcgtattcaggatccccgatactgcccttcccgcgagcatcgccacgatcagcgatacgtatacgttcgtcctgcggtacataagtccgctcacgatcccatatacgcataactcaaacatcataacaagccctgtcgggtaaagcggcggcatccccgttgcaaaggacgacaggagcggcaatataaagccgcagataccgccgtatttccatccgcagatcagcccgcataccagcaccggaatgtgcataggcaaaaacacctgtcccgccgccgcgccgaatgcatggaacaccatgggcagcagcatgcccgccgccagacatagcgctgccgctaccaatttcttcgtttcattcttcatttttttcctcccttttttatattatcattgctttagaaaacgtttgatcctgccgtcctcaccactttcgaaaaccgccccggcatgtttgtatacgccacattcttcaaaataccgccattccaacggcatccacctttcaaaaaacatatgtgcacccatattcccttcgcgtgtaacgatccgttcttcctgcagcgcccgttcaatatgcagcacgatactgtctgtataataggggcgcagatgcggatgaagcgcatacgcgccctctacgatataaaacgccttccgaggaagttcccgcttatcgcccattttgcccgccgcgcaatcatattggcggtagcgcacggcctctcccctgcaaagcggctctaatacttcctctgccacccgttcatagtgtacattcccgcccggctctgacaagcgccttttagtccgcatatcctgtggcaggaaaaaatcatccatatgcactacgccgcagtcaaatacttccgcaatttgttgggcaagcgttgttttcccgctcccgcagcctccgtcgatggcgatcacgcatctttccttccggccctgccctgcaatccatctcaatacagggtaacaattcgtgtgttgctgcgccaccactctgtaatgcggctggtacatttttcgaaattcactgctgtgatgcacacacggcattcccgccttcacatagtcctccaattccaaggccgcctccgatcttttgtgtatcccataaaatcgaaacaatcccagccgctttaacttccgtaaaaatgctgtgcggctgccttgctttctgcctgccaaccacagaaatatcctctccagcaaaaacagatccctttcatcgaatccctttgcgtttagatgcatcctgcataggccgttgccaatcggttcaaataactcctcctgtttttcctcatcgatcccgtcatattcatgcaccagcatatcatgtaccgctttagaatccgtcagcagatgctctgccccaaattcattttggtacgccagtttgattgcgtcctgaagcgccatcttctcatatttgcttctatgccgtccgacaatttcttcccactcttccatttgtacctgcttcaacaaaaaaagccatgaatcgtttgttttcttttcgaaaaccgctaactcttcatgacttagatttcccggatatcattttaccttgtctttttcacggtatttttaccggatacgttccccgcatcccaaccttcttcctgaaggctgtttatgccgctttgttcaagacctgctattcaattttttgatcatttccaccgcttcgccgatgtgcgctgaaagcgcatgatccttcagccccataatgttgatatggcacctggagacgggaatggcgattttttccgccgcgcacgttgcaagcgcttctgcgatccgtggcgttacctcgcccagcatggcatttgcaaaaaatataccgatcggcccgatcacaacatccgcgcgcatacaattatagagcaccgcattttctcctgtcgccccctgcgcttgcccgcccttgagcatattcgcggtcgctgcggcgttcgtacccaccgcaaccaattcgatatcagaaagctctgcgcgtagccgctcgacgatacttcttcccataccgccgccctggccgtctatcaccactaccaacataataaaaacctgcttctttttatgttgatagtataccataaaatcatccgtatagccaacatttttacagcgaacccctgccttttcctgaacgtctccaccctctcccgcttcgtcatattacgcgcctcaaatatccgcagatatttaccaactgcgaatgcacttccggcctactaaatttatgtattttttattatgaaaaaacccattgataatcaatgggtttttgttttcatcttgatcagcttttcccttaccaggaaccgccgccaccgccaccgatcccgccgccaaatccactgccgccggaatctttggtcatcatcatattctgccgcgtataatacagcgattggttgagcatgctcgcaaaccagatcgtcgtaaatacggaaccgtcatagccgtaataccagcttggcggctcgatcgcgatgctctcaaactgcttggcccacttatccgtcacgccaaggacatacgcataaggcaggatgtgataaaaatactgcgggtcgtcattcacgagcattttcagcttttccgcttccaccgtctcgatgaaatgcttgagccctaatatccgtcccgaccactgcgcgcctttttccgtcctgcggcgaaaggccggcgctaagaacatcatcagggccgtcaacgccgccggaagtaagaaccaccatccgaaaatttccgcactgaacaaccacgtaagcgcaagataaacgacgatcccgatcgaccagccgatcatggagcctgttctcgtcgacagtttttccgatttcattttatgaagattcgtacataaccctgacgtaatgacccaaccaaacgcccaggccaccacgccgccgaccactgccataaactccgcagagcttgagaaataaaggctgaaggctacggcaatcgcgacaggcagggaggagagcacaaccgccaatttttccatacgtcctgattttttcgtgaaaaccaggttgtccggtgtctgatatttgtctttgatgcgctctttcactgcggcgatcgtggatgcaaaattatactgcatgtccgcaatactgatcttagtccccttttcaaacatcttgtcaaaaagaagcgtctcgtaatcattcgccgtttcgggcagctccttcagcttttcaaaggataactttttcttatcctgctggatgatcgaaatattcccctggtccgcccaataaatgagcagggacaccgcatccttgtcctccacgataccatctataatataaccgacatccgcagaattcatgccctcaggtgcgttgaattctaccgtctgcacctcttttttccgcttttccgacgtgagcagcaagatcagcacaagcacaaagatcgccgcgccggcaagcaggcatggcaggatcatatccgatggattactcactcccacataatatccctccggcagctccagccggatcgtaaagctttcgtatggcacgaccgtttgcgatatctcgcctgagatcgtcgttccttccaccttatattgcaccgcatcctggttatatcctgtatttcccatctgtccgcttgtgaaaccaactttggatgcgtcaaattcctttggcatatggatcgtaaaggtaaaatgatcgataggcgccgcccatttcgaatctatcaggttgaaataaaattcatcgaaggcgctcgtcccgtcatatcccgcgtccatcgtatatccatattcatacgttcgctcgccggatacctcttcgtccggatcgccgatatagaccgaaaggatatcgccgttatgctccgtatcaaactgttcatccgcgtagatatccgtaatcctcagacggtacgtattggtatatttctgcccattggagacacgtgtggcctccgactccgtagggatgtccacccgcaggccatgctgccccggggcaataaaattcgctgtaaccgtatccttgatctcataggtgttgttttcgttaacggtgatctccctgttgtagtcaaggatttcaaaatctgtgtttgccgcagatccaagcgacgggaccagcatcgccaaaacgaccgcaaccaggacgatccattttttcatcatgttcaatgttcactccaattttccataaaggaaaaacggggacgtttaaaaaatccccgttttatctgttttttaaaactgtactttaacattttcgcgctcttgctggttctctacctcaaacatcggctgtttggtaaatttgaacttacgcgcgatcaggttggtagggaaagtctccagcttggtgttgaacatcctcacgtttgcattataatacttacgcgcattggcaatgtccgtttccaccatattaagctggttctgcaggtccaggaaatttgtgtttgctttgaggtccggatatgcttccgctaccgcaaacaagctccgcagcgttcctgtcaggatattctcattttggagccgttcttcggtcgtcgaagaattcgcaacgttcgtacgtgccgcagtaacctgctccagcgttcccttttcgtgcgaggcgtatccctttaccgtttctacaaggttggggatcaggtcaaacctctttttcagatatacatcgatggtagcaaacgcttcttcgatgctgtttttcattttgatgaagttgttgtaagcaacgatgtaccagatcacaatgatcacgacaatcgccacaacaactgcgatcaatatccatagccacgtcataaaatttttctcctccgcttagcctgcaacgatcactgcatggaaaatcaggtcctcactgcctgtgctgataatcccgtgagaatccccgtcataacagatcaccacatcgccgggttttactgtataggtctgatcattgtcgtggtattcgccttcacccttctggatgtagtaaagttctgcttcgcccgtatgcgtgtggtctcccaccgaatctcccggagcgatccgcaccgttgcaaccatattcatgttcgggctgttttcttcatcggagagccagtatgaaatatgcgccgttccttttccgtcgcagcactccaccaactctttttcaatcaattctttgcgtaccatattccttacctccgtttgtttccgattatttttccacccggatacagcttggtacatccactaccgcatccagttgtttgatctcttcgatcgcagcctgcaggtctttctcatgcgccttatgcgttaccaaaataagcggcgcatccgtttccccttttttagcgcctttctggattacactctcaatactcacgtcgtgtttaccaaggattcctgcaatctttgccagcacgcccggtttatcctgtaccgtggtgcggatgaaatattctgtcagccagtcgtcattaaagcgtacctggtctgcgtcatacgtattttcaaatgtcgcatatcttggcttatgatgcacggaatagatcatatccgaaacaagcgcgcttgccgtcggaaaatcgcccgcgcctttgccataccacatcatctctcccactgcgcttccattgatgaagatcgcgttgaaagaccccttgatattggcaagggcgtggtcttttaaaatcatcgtcggatgtacgcgtacctcaatcgttccatccgcggctttcttgcctattgcaagtaacttaacgacatacccgagttcccgccctatttcgatatccagctttgtgatcttcgtgatgccctcgcaataaatcttatccacaggcacacgcgcgtgaaaagccatggaagcaaggatcgaaagcttgtagcgcgcatcatacccttccacatcgctcgtaggattggcttctgcatagccgagttcctgcgcttctttgagcacgtcttcaaaatcgcgtccctcgtcgtccatctttgtgaggatataatttgtcgtaccattgacgataccgtatacgctgtcgatgctgttcgcctgcatagaatcctgcaatgcgcgcaggatcgggatgcccccgcctaccgccgcttcaaaataaaagcctgcgtttccttttttagctgccgcttccaggtccggccagttctgcgagatcatatccttattggcagaaacaactgttttgcccgcttcaagcgccgcaatgataaattcctttgcaggatgctgcccccccatgacctccgcgactaccgtgatctccggatcgtttatgatctcttcgatgtccttcgccttcttttcctccggtacatccactgcataattcaatgccagcgtcttttttacttccaggcgcatatcttccttatgcccgatatttttctgctccttttcgatcagctggtatattccgccgccaaccgtccccattccgaggatcgcaacctttacatctttcattccctgtactccttgtcagcaattcttcatataaatcttattcaggccgatcagcgtaagcgttggtatgatttcgtcgatacaatccgtttcctgcgcgatcagttcagaaaaacctcctgtcgcaaccaccttcgcaccgcccatttcagccttcatctttcctacaatatattgaacctgtcctacataaccatatatgattcccgcctgcatggcggtgactgtcgatttattgatgatccccgccggacgcatcaattcaatgcgcggcagctttgccgtattgatcgtgagcgcctcggatgtaatcttgatgcccgggcagatcgctccgccgaggaaatccccgttttcggaaattgcgccgaagctggtcgccgtaccgaaatcgatggtgatgaccggaccgccgaaaagctcgtacgcgcctaccgcattgacgatacggtctgttcccagttctttggggttatcatatttgatattgatacccgttttaatccccggcccgacaaacatcggctttttcttgaaatattcccgcaccatatggtcgagcgtatagttgatggacgggataaccgaagagatgatcacaccgtcgatatcgcgcggcacatgccccagatacctgaaaaactcgatcatccgaatgccgaactggtcggaagtcgcctcgatatctgtcgccatacggaaagagtggatgagcacgccatcctcaaacatcccgcattttatatttgtattgccaacatccagcacaaaaatcatttaccctgtaatctccttcggttttgctttggggatcatcggcaccgtctttctgagcgcctttatgataggcggacagatgagcgttgccgcgatggcttcgggcaggccgtttgtaagtacaatcgtccagatcacagccattgcgcccgccgcgtttacattataaagcgagcagagaagcggcgtaagcgtcaagcttacaagaaacaaatatcctgccgtgttcgtcagggaacctgcaagcgacgcaacgcctaagtttgcaaatgcattttttgttttcattgctttacctgcaaaccacgtaaccaccggaatcagcagcctcggcgcaatcaggcagatgcagtaaagcaatccgtatgttccaaagtctccaacgacaagcgcggaaaacgcatccggcatggtaaacatttttgcaatgctgatcaccgcaaacagcgcgccaagtccgatacccgttcgaagccccagcaccatcgttcctacaatcaccggaatacacatcagcgtaatggtgaccggcccgaggataataaaacccagataggggacgaaccccatgatcagcataatagcgaccaggatcgccgtcaaagtaagacttctcgtttttgttttcatcagtacctccgctcaggtttcgcttccgcaaataccctactcagtaaaattttaatgaaccgtaaggtttgtccgtacggcttttggggtatcaaaatgccgtcggaacccacttttcatcattaagttattatagcagtattacatattgttttgcaaggaaaacggtgaaaaacacggggggtcgtcaggaatcctgttttgctgagaggagcgttgccggtatgatacataatcccgtgacgggtgaagtaatggataagaaaaaaatatggcaggtcgtagtggcggtctttgcgacgggtgaaggctccggccttgcgcttatgtcgctaaagacagactcggcgtggttccagagcctggcgctttcgcctgtccatccgccttacgtcgttttcggccttatatggactgcgctttacgtattgatgggttcttcctttgtccttgcaatcctcaatcctaaaattaccaagagtattcatcttggctatatcctgaatatcttcctgggtgcgatgtggtcgcctgcgtttttcctgctggaaagcccgcttgccggccttttgatcgcggtcgcaacccttgtgaacgccgctgttttgttacgcaatgtacgtaaggtcagccatgaagcggcatatctgatcattccttatctcatatggattgcctttgcgacttatctgaacatcgcaattatcgcactaaattaatttacattgtaatgaaagggtgaaaacaaatgtttattatgacttatcaaatggaagaacggaagtgggaaaaaaatttaaaccgcttaaaagtaatttttgccgttttactgactgccgcaggcgcagtaatcgccagtcttgcgacgcaaacagataccttatggtaccagtcccttacgctttccccattgcagccgccgcccttggtgtttgctatcgtatggacggtgctgtatgtactgctcgcaatctccttcgcgcttttcgtggcgcagcgaaggcctcgtggcgtcgctgttttcggttatatcctcaatatcattctgaacgcgctttggtctcctgtattctttctgctcgagcagccgctgcccgcgctctttatcatggccgcgcttgtcatcaacctgatttttttgatgaaaaatgtgcgcaaagcatgccgcataagcatgtacttactgatcccctacctcgtttggctgtgcattgctaccgtgcttaacgtttccgttgtgatcctcaattaaaatttctccggcgccttcttctatctccggtttcaggcgtacccagcgaagaaaagtgtcctgggctacgccgatcagggacgctgctttcctggatgtgattttatgttccagccactccctgcgcagctcgtaaaatgcccgcggcacgggttttggcggacgtccgaattttacgccgcgcagcttggccgcagcaatcccttccgcctgccgctgcctgatattttcacgttcggtttgcgcaacataggaaagaagctgcaatacgatatccgcaatcagtgtgcccgtcaggtcccgcccttgtctggtatctagaagcggcatgtcaagcactaccacttctacttttttctcttttgtaatgatacgccattgttccagaatttcatcataattcctccccaagcggtcgatgctcttgatcacgagcaaatgcccttccttcattcgtttgagcagcttgcgatatgccgggcgctcaaaatctttaccactcatcttgtccatataaatatggcttttcggcacgtcaaactcgctcatcgcaatcatctgtctgtcttcgttctgttctttcgttgatacgcgaacatatccccaaacaacctgttccattttgcccgtttcctcctgctaaaaataatataaaatcaattaccaaaaattgttaaaaaaatactgatttttcgcgctttgaaaaaagctggaaagtttctgtaatatcggaacgacttatgatagcacagagcaggagaatcggcaatatcaataatttttcgtgagtaaggacaaactggatttttagcggatatcaaggcattgaaatgcgtatattaaaaaaccgctgccctttgcagcggtttttcattcgtcgtccggcttttcctgatcatcctgcgtctcgcgttgttctttttccttcaattctttcagataatcctcatcatggatattttccatatatacgttggctccgcactcaggacagctaagcagccggtcagttccctggcgcgacgcaaagaacgattttaatccggatactttaaaccgcgccccgcagcgcgggcataaaaaatgccgctttgtttgtatcacacaataggcgatcacgcaagccaccacgacaatcgccgtgatccctaccgtaacgattccataaagttccattccattctccctgttttttgatttattccagtatagcatacctgctaaaaaaatagttgaacttttccttaaaaattgctatgatagtgcttacagaaatgaatataatgcgtttttcggggatggcatcccggctttttgacgcaaacctaatgaaggcgggctttttaagtcaaccagggtggaaccgcggaagtgatctttcgtccctgctgcaggggatcgaaagtttttttttacaaaaatttgggaggatttatcatggaaaaaacaatggataagatcgtagcgcttgcaaagggacgcgggttcgtgttccccggctcggagatctacggcggacttgcaaactcatgggattacggcccgctcggcgtggaattcaaaaacaacgtcaaacgcgcgtggtggcagaaattcgtgcaggaatgcccgtataatgtcggcctcgacgcggcgatcctgatgaaccccgaaacatgggtcgcctccggacatgtcggcggcttcaacgatccgcttatggactgtaaaagctgtaaggagcgtttccgcgcagataaattaatcgaagattacgtcgcgcaaaacaacctggatatcggtccggtggaagcgatgaccaaagaggaaatggaagcgtttatcgccgagcatatcgtatgcccgtcctgcggcaagaaggattttacgcccatccgccagttcaacctgatgttcaaaacgttccagggcgtcaacgaggatactgccgcgcagatttacctgcggcccgaaaccgcacagggcattttcgtcaactttaaaaatgtattgcgcacgacacggcgcaaaatgccgatgggcatcggccaggtcggaaaatctttccgtaacgaaatcacgcccggaaactttatcttccgcatccgcgagttcgagcagatggagctcgaattcttctgcgatccgaaagaagaattcgaatggttcaactactggaaagattactgtcaccagtggctgctgaatcttggtatcaaggacgaaaacttgaagctgcgcgatcacgcacaagaagaattgtcgcattattccaacgctacgacggacatcgagtatttgttccccttcggctggggagagctttggggcattgccgaccgtacggattttgacctcaaggcgcacatgaaccattcgggcgagagtcttgaatacctcgatccggcaacgaatgaaaagtacgtaccgtactgcatcgagccttcgctcggggctgaccgcgttgcgcttgcgttcctgtgcgaagcatacgacgaagaaacgctggaaaacggcgacacgcgtatcgtcatgcacctgcatccggcactcgcaccgtttaaggccgctgtgcttccgctccagaaaaagctttcggaaacatcggacaaactttttgcggatctttccaaacatttgaatatagattatgaccttgcaggttccatcggcaagcgttaccgccgtgaggatgagatcggtacgccgtactgtgtcaccgtggactttgagtccttggacgaccactgcgtaaccgttcgcgaccgcgacacaatggagcagcagcgtatcccgatggacggtgtgctcaaattcctgcaagataagatggagttttgatctatggattattctgacgtattgcccctttgtgaggatgcgatgattgctgcacgcgagcgtgtggattctttatccaagccgctcggcagtctcggaaagctggaagagtacgccgtgcaactggcggggatccgcggccatatgggcggaacgctcgcaaaacgctgcgtactggtattcgctgctgataacggcatttatgaagaaggcatcacccctgtcccgcaggaggtgacgcccatgcagacgatcaatatcgcaaacggcgttgcaggcgtcaatgcgcttgccgcgcaggcgggcgcagaggtttttgtatacaatgtcggcatcgcgcagccgttaaaacgcaaagggatcatcgacgcgcttgtgatgcacggtaccaacgatatggcaaaagaacccgctatgacgcaggatcagtgtaaaagggccatgaaagcaggctatgacgccgtgagcgcacatgccggttatgatgtgatcggccttggcgaaatgggtatctgcaatacctccacgactgccgccgtagcttccgtgctactgaaaaagcctgtcacgaagctcgctggaaagggcgcgggcatcacagatgagcaatatgcatgcaaaatcgccgccattgagcgcgcgatcgagcgcaatagccctgatccgcagaaggtggtcgatgtgatctccaaagtaggcggccttgatattgccgccatgacaggcgcctaccttgcatgcgcacactataagatccccgttgtgatcgacggctttatttctgcatgcgccgcgctttgcgcacaaaggatggtgcccctgagcgcaagctatatgtttgcatcccaccaaagcgaagaacaggggtacgcgcctattgtaaaagcgctcggcttatcgcctgcgctcatgctgaatatgcgccttggcgaaggaagcggctgccccctgatgttttatattttagaagcgtctctgcgcgtcctcgaagatatgggaacattcgaggaaggcagcatcgatccctccggatttgtggacctgcgtaaataaacgctccgcttgaaaggcagtcccttcatgaagatcaggaacatacaaacgctgcgtatctggcggtatatactggaatggtttacctttgcgggtatcatcagcctgattgccttttttgctctcacggcatccatcctgcccccgcccgcgcctgtttccggcgcgcaggacgggcttgtcacggcgtttggcatgaaatttgtgcttctcttgctttttttgctgggcagcggtgtgtgcggcggcctctttttactttcgcggttccctcgcctgttccattatcccgtcaagatcacggctgataacatcgaatcccaataccacctcgcgaagatcgctttgtgtatgggacaaattattgccgctatatttttttgtaccttgatggtacgcgtatacacgcaaactattacattcgcttcttttgagttccgccaaatcgtagcgactgcgcttatttgcagcggcgctacatgcgtcatttattaccttgccgcccgtcatttccgctaaaaaactgcaaataaaaaacccggttccccggggtttctttttttagtcatagagtaccgatgtccttcggtagtttttacggtaccgccgcacaaattgggagagcgtaaaacaaacgataaagtacaaaagcgccatcataccgaatatggcgaatatttgagtcgtggagttgtaaaggttcatgaggatcatgcctttccccatcagttcctgaatcgccattgctccccacaaatacgaggtgtccttgatcgtcgtcaccatctgcgaaagcaatgcgggaaccatattgcgtaccgcctgcgggatcacaatatataaatacgtcgcaccgcgtgaaaatccctgtgattttgccgcttcccattgcccttgcgggatcgcactgataccgccgcgcaggatttccgcgatccctgcggaagtgaacaaagtaaaagccagtatcgcagaacccatcggtgggatacgtgctacgaaaaaaatcaacatgatccataaaagcagcggcgtatttttgaatatttcgatataaataccggcgatcttcggaactaccttgttttttgcattgcggccaatggcgatggccatgcccagtatgatggaaagcgcaatggaaatcgcagaaataatgatcgtcgtcaaaaggccctgcaacaggaaacggatgtttatccacgtaaataattctgacatgtgatatcctcctcccctggcttgatctccttttgacgcttttcctcaaggcgcttcgcgagccgtgaaagcggaaaacaaaggataaagtacaatatgccggctacgacatatgcaggaccgtagtagcttgttccgtaggcaaacgaattggaaaaatacatcagctcaccgcccgcgatcagcgcaagcacggatgtgtttttgatgaggttcgccgcctggactgcaagcggcggcagcatggttttgatagcttgcggcaatatgacatgcagcatggtcgcgccatagggaaagccttgcgactgcgcagcctcaaactggccctttggtacggacgaaagccccgaatgcacaacttctgaaatatatgctccatggtaaatgccaatccctaccacgccgatcataaacgtgcccatcacaatgccgaaaagcggcaataccgcatacaatacgaacatctgtaaaagcaaggggatattctgcacgatctctacgtatacgcggtttatggcgcgcggcgctttatgctttgcataagacatcatgccgaatgcaaagccaagagccagcgcaatgacaagcgcgagcaatgaaatcagtatcgtattcaaaaatgcctgcgcaagttggtcgccttgctcaaaaagcgcttcccatttgaatggtgcaaatacgtctcccataacctaaagtccccacttttcctcgagcgccgccatgcgcccgtccgctttcatctcgccgatcacgcggtcgatctccgccgccatctccccgttattgagcgcgctcgctaccccgtattcctggggtgcgaactgctgctccaaaagctctgtcgtatcgtccaaatacccgttcagtatcgattcatctacggaaaaagcgtcaaccctgcctgaaacaagggcgatcttgatttccggataggtcgcatattcattgaagttgagcgtgatgccaagctcgtcggcagccgcctgtagcttctccttcgtagtcgcgctctgcgctacgccgatcgttttcccgtcaagatcctcaaggcttttgatccccgcgttctttttgaccagtatgccgatatgatcggtataataaggctggctgaaattgtaactttttttgcgctgttccgtaatcgtgaacgtgcataacgccgcatccagcatgccattgtccagcatcgcgccgcgcgtcgttacattgacgcccgtcagcgcaaggttatcctcagacccctttaattcctttgcgagttcccgcgcgatatcaacctcaaatccttcgatctgccctgtctgcgggctttgatacccaaacctaggcacatcgatcttcacgcccacatgaaggatatcctcgtccttggcgcatgccccgaaaagaaacaatcctatgaaaacaatgcataaaacagcggctatcttcttcataatcattttaatatcttgcttaaaaaagcctgtatccttggattttttgcttcatcgaacaactctttgggcgttcccgtatccacgacctgtcccgcttccataaaaacgaccctgtccgccgcctcgcgcgccagccccatttcgtgtgtaacgattaccattgtgatattgctcttcgcaaggtccttgatgacctccaacacttcctgtatcatttccgggtccaaggcggaggtcggttcgtcgaacaaaataatttgcggatgcatattgagcgcccgcgcgatcgccacacgctgcttttgtccgcccgacaacttcgtcgggtactggttcaccttatcgcataaccctacgcggttaagatactccgccccgctgcgttccgcttcctgtttcggtacatgcaatacacggatgggtgcaattgttacattttcgagcacggtcttatgagggtacaggttgaaatcctggaaaaccatcgcaacatcggcgtacagcttcttagcgtctatcttttttgccgtcacttcgagcccgtctactatgatcgttccctgagtcggtttctccaatccgttgatgcaccgtatcagcgtgctcttgcccgaccctgacggcccgatgatcacgattttttcacccgtctgtatttcaaggttcacatccttaagcgcatagacttcaccaaattttttcgatacgttctgaacggaaatcatactcttctcccatatttcattaagaattgatttgctcttatttatcagcactttcgcggcgatttaaaccatagcgggtattaattcctgcaaagcggcaaaaggctgtttggtacttaaataaaaaacgggcgcggaggtttttccttccgcgcccgttttttatttcaatccgctttatttctatagtggagatattttaagaaacatttgacagccaatgacgcgtttttttgctcctcaaggccaatccaatctcacgataggccgattcttccagttctttcgttacgatccggtacggcgtgcgttgcaaaataagctcgggcaaaatactgatgcccataccgttttccaccatcgacatgattgcatagtcatcccacgttgtaaaatgtatttgcggggaaatcccaaatttgtcgaatatatcatatgcgtctgcctgtccgcctttttctaacagcataaaaggataatcacacaatgcgcgaaccggaaaaagatcgcaagccgctaaaggatgatcttcgggcaggacgacacgaagaatatctttttccagaaaaatcgattctaaatcgggatgggccggcagcctaagaaaaccgcaatccacccgcccttctaaaatccaattttcaatttcgacatagtcccccaacaaaaactcatagtcaatattcggataactcttttgaaattgcttaatgatttttggcagccaatgtgttgcaacactggaaaaggttccaatacgaatcaatcccgactgcagtccgttcaatccatccatctgcatctgcaattcatgatatcggagtcgggctggcgacccttttatactattgcggtcctgttgccatcatgacgctttctccttttctattccatgaatcgatcacacgtacgatgatctgcggatttattgccgttttgacgggtatgttgttgctgagcgcccgttcaatccgtggcaatctgcggctacttggagcctttatcggcattactattttctttcctgtttttacatgaaaaaatggggatcgttcaattggttggagccgctttgattattggcggtgcgatctatggagaatgtcgtcgtttcaaattaaaataagtacgaaaaatttatgtgcgcctatacgtcctgcgatatttcagaacaaaaagaagccgacccggggtcggcttcttttttgctttacaaacttatttcattgcacgcagggcgtttacaacagcgatgagcgtcacgcctacatcggcaaaaaccgcccaccacatatctgcgatacccgttacgccgagcaccatgaccgccgctttcacgaccaatgcaaatatgatattctgccatacgatacgctttgtcctgcgcgacaggcgaatagaatccgctacctttgacggttcgtccgtcatcaagaccacatccgccgcctcgatggccgcgtcgcttcccgcgccgcccatggcgatcccaacgtctgcccgtgcgagcaccggcgcatcgttgatcccgtcgcctacaaacgcgctgcgtcctttttccttctgtattgtctcgagcacagcaaccttatcctgcggcaaaagctccgtatatacttcgtcgatcccaatttccgcggccaccgtttcgccgatccgtttcgcatctcctgtcaacatagccgttcccacgcccatggcatgcaaagcgcccgcagtttccttcgcgtcctgctttatctggtctgcgatcagtatactgcctaaaaaacgtcccgcgcgcgccacatacaaaaccgttcccgcatctttcgcctccgcaaaagcgatcccgttcttttccagcagcttggcgtttcctgcaaggatctcttcgccatcctctgccgtcgctgccacgccatatcctgcctcttccctgtagccttttgcggccggtgcttctttgccgtatgcttccagtacggatttcgcgatcggatgcgacgaatttgcttccgcgaccgcggcattctcgagcacagcgtcgccggatattccatcggccgccatgatctttttgaccgcgaataccccttttgtcagcgtacccgtcttatcgaacaccacatcccgcacattcgtaagcgcttccagataattggcgcccttgatcagtattccctttttcgaagcgccgccgatcccgctgaaataggtgagcggtacggataccaccagcgcgcacggacaagagattaccaaaaacagcagcgcacggtatacccatgttgcaacatcgcccgtcacaatagatggaataatcgccacgatcagcgcgcccgcgcatacgatcggcgtataataacgcgcgaatttcgtgataaatttttcagtatgtgcttttttacttcccgcatgctccaccaggtcaagtattttggcaacggtagattccccaaattctttttccacacgtatcgtcagtaatccaccgccgtttacgcttcccgcaagcacggcgtctccctgtgtcacctcacgcggcatgctttctcccgtgagcgcgctcgtattgagtgcggacgctccttcgagtatcacaccgtcgagcggtattttctcaaacggctttaccacaatggtatcgccgatccctacttcctgcgggtctacacgctttacggtatcgccttgcttcaggttcgcgtagtccggccggatatccatcagctttgtaatggattttttgctccgttctaccgcaaggtcagaaagcgtttcaccaatcaggtaaaacagcataacagccgtaccctcggcatagtccatcaatataaacgcaccaatcgttgccacagtcataaggaaattttcatcgaacaccttgcctttgacaatgtttttacctgccgtaatcagcacattgattcccagaaccaaatatgccgcaaaaaagaccgcaaaccgtgcccattccggcaaatccagcgtattctgtaaaataatccccagggcaaagatcgccgctcctacaataattcttgccagataagtttttggttcttcctggttatgcgcatgttcgtgtccgcatgcgcatccgtcagagtggctgtgttcatgctcatggttgtgctcatgcgccgctgcatggcctagctcgcatgcacattccatgtgctgcgcatgttcgtgatggtcgtgtttcatgtccctttcctccaatcatatgaatatatgttcattcattcatatgtattataccatatccgcatgctttgtaaactgttttttaaaaataaataaaaaaaggcagccgataaggctgccttcaaaaaaatatccatcttatatcagtgcctgatatgctccaatacctggtctataatatggagtacgtgcgcatcgtctaagctatagaacacatttttcccttccttgcggcttttgaccaggcgtgctgttttcaaattctgcaattggtgcgataccgccgattgctgcatgcccagcgtttcgcacaggtgcgccacgcacatctccgtatcgtgcagcgcaaaaatgatcctgagcctgctttggtcgctcagcatcttaaaaatgcggctcatcttgtcaagttcttccatatcctgcttcatcattgcgcctgctcttcgtattgctgctgcaactgatccaggatcgtatacgctttcaaaagcgacgccaccgtctttgcatccctgatctctccgcgcaataccatctgcactgctgttgccagcggcattttctcaacctttacaaattcgccttcatcaaggcactgttcctgctgatcaatacctaccgccatatacatatggatcacttcgtcgcaaaagccgacgctggaataaatttgtcccagggaaaccagctcgcccgcgacaagccctgtttcctcttttaattcccgcgccgcggcctcctgcggatcctccgactctttatccagcttgcctgccggcagctccagcaagacttccccaaacggatagcggaattgccgcacaaaatatacgttcagatcatggtcgatcgcgcacacgctcaccccgcccggatgcctgactacctcccgaatggacgtctttccgtccggcaaacgcaccgtatccttagtaacattaatgatcgccccatcgtaaatcggttccgatgccaacgtcgtttccttcaagtcatctatatccatgtaatctttgctccttttccgtttgtctattttttttattttatcatgcacccaaaaagaaatccatccccgctcttataattgcacacgatacgtatatttgttataatatggtggaatatcgagggaggtatttatgcgcattttgaaaacgccggccatgttgctgattatcattatactagccattgcccttgttccggcaagtgtatttgccgcgccatccgaagaacccgcagaagatgtgacgcagcctgcttccaccattaaaatatatcatacaaacgacgtgcacggtaacgccgacgccacgcccgattctgtcggctatgcgcgtttacaaacatatatcaagcaggatgaggccgatggaaagctgctttttgacgcaggagatgcgttccacggcaatacctttgcgacactgagtcaggggcagagtattgccgagatcatggaaacaatggactataacgccttcgttccggggaaccacgacttcagctatgggatccccgcacttgaaaaactgattacaacctcgggcgcggatgcgctttccgtcaatattacaaaaaatggccttcctatttttgacgcataccatatttataaggtcggcggcgtgaaaatcggggtgcttggtatttcctcacccacagcgctgaacgatattgaagagaataagcttagtgggatcgattttttaaatggcgaacttctctaccaaaaggtccaacaagcggtaggcgagatgcggcaggagggcgcgaacgccgttatcgccctgacccatcttggaacggggcagaactctgatccgtcaagcgtcgatatcgccacgcacgtaacgggcatcgacctgatcattgacgggtactcacatgccctatatccaaacggctatacggattatccaggatatgttgccgggcagacccctatgattttgcaggcgggcagttcccttgaagcctttggcgtggtagagctctcttttgatgaaaatggcggtattatgagcatcctgcccttcaccgtagatgcggaaagcattccttccgtaacggcggataaaaaaattggttctgtgatcagcacgtatgtgcaggagcaacagacgtttttgcagcgcacggtcgcttccacacccgtttttctcaacggcgaaagcgaatttgtatataccggccctacgaattttacgaccatgatcggcaacgcaatgctcagcgaaacgggtgcggatattgccctgttttcgagcaaggccgtccgcacgtccattcccgcaggtgatatcacggctgcggagatcaacaatgcgattccctccggcgattatatcgtcacgacgacgatctccggttccgagctgaaaaaaatgctgaatgaacatatgctccttggctatgaggatttcccgcagtttgcaggcatcaatgtcatcgcggaaaagtacctgacagccgacggaaactatgcaggccgtgtcaaatccattatgaaggacggcgcggagatcaaggacagcgaccaattcacggtcgcgaccaccggagacctttataacggcgagctgaattaccgctttacagctccttctatccgtgagtaccacacgctatatgaagctgtaagcaactatttcaaggatgcggacgaagatatgtttttagatactgcgcagaacggccagcttgtcatgctcgagcagatcatcgacgcggatactatcattgccaagctccaactcgcgatccctgtcgatgtccacgttgcactcaccaaggcttctgtggtttcggaaaacatactttattccctgatcggccaggacagggatcttgtctttacggtcgatgggcaatatccctatgctttcattttcaacggcgcttcgctggagtcgcccagtaatgtaagcctggaagctgatgtatcgcaaaaggctccctcggggaaacggacggcctccaccgccgataaagatgcattttttgtggatttaagcgagaaccagacaattccctcgtcggtatatatgcagatatacgtaggcgatgcctatgagcctggcagtactgtttacatttattattatgatgtcaataacgatatccttccctacaacgaaacagggatcaccgtagcgagcgacggttctatcgtttttccggccaaggccggctccacttatctgatcaactccaaattgctcaatgcagcgaccagttatgaattgcctacgccggagcagccttattctctgggtatcctgattattttcgccgtgtttgttatatgggcggtttttttcctgatcaccaagaaaggaagtcagtcaaacaaatgaaaacaggccggatttacacgttgatcctttccctgctgcttatcgcagccggtattctgttgattgtttttcctatagagacgttattcaccttttcttttttattgggtatcgtccttgccggatatggcgcgttgaccatcatcggctttctgttcgggcgctataattctcttgcagtcaccctgaacatgctgctcggcggtatccttacgcttgtttttggcatcatcctcattgcaaatcccgggatcgccggacattttctcgctatttttatggccctctggatgatactgatgggcgctgtcaaagtcattattgcctatacgtataaaaaatcccggctaaagcaatgggtatccacattggttggcgccctcttatccatcgcctttggcctgctcgccgcattcagccctctcctgcaatttcttgtcatcgatctggtgattcctatatacctcatcgccctcggcgcttctaatctgtggagcatcctttctgaccgcctttccgaccgcgcacgcgtcccgcttccgctttggatcgaggcatttttgccgcagcgcgtgcttaagggcttaaaacaaacaattgcaaccgaagattccggacattttgcgcccggctccctgtatatcgacggcatgccgctaaacacagacagcatcgaaatctttgtccatttttccgagcgttccgcaagcgcttttggccatgtggatatcggactcggtgattatgtgctttcctatggcaactatgaccatgccaaagacgccatttcccttttcggtcttttatacgacggtatctttttcatatgtccgcgtaaagaatatattcaattttcattgcgtgaagcaggtaaaacaatcatcggctatcagcttgcgttaaatgagcatgccaggcagcaggtcctaaaaaacgtcacggcctttttggaagattgtacgccgtggtcaccgctcgatacgcagcgtaaggtcaacgattattgttgggcgcttaaggacatgggcgcgcatctttacaaggtctaccagggcaaattcaaaacctattttgtactcaacacgaactgcgcgcttctctctgagacgcttctcgacggtactggcgtccctcgctctcgggcattcggcggcgtcgtcacgccgggctccgcgtattcgttatacgaaaaagaactgcagcgtccgcatagtctcgtcgtttccaaaaaggcttacctgaatagcgatatgctccgtgagcttgcggccgaaaacgatattggttaaaaatcccttttatgtatcacattttaggggtaatataaatatataaattttttagggggtactacaaatgatcagcaaaaaattagaatccatgctcaacgaacaaatgaaaaatgaatttttctcagcctatttttatctttcaatggctgcgtggtttacgtccaaaaatttaaatggctttgccaactggtataccgtgcaggcgagcgaagagcgcgatcatgccaaaatgattatggattatatactgcgtgtgggcggtaatgcggagtttctggcgatcgaagcgcctgatacggactttgcttccccaatggatatctttgaaaaaacgctcgcgcatgaacagaaagtgacgggcatgatcaacgacctgatgagcgcggcagtagatgaacgcgactttaagacgcagcatttcctgcagtggtatgtgaacgaacaggtggaggaagaagaaaatgcgtccggcctgatcgagaaacttcgtatttccggtaacagcgaagcgggtatcctctatatggataccgaagctgcagcccgtgcgtacacacctgcaacacaggcaaacgcataacaatattgagccataaaaaagagcgcttaggcgctctttttttattttagtaccgattttacttcctctttcttgtcttgcggctttttatccctgtttccactgcctctttttccgcataagcgatcagcatatcgaaaaccagtttggatcgttcctctaccgaccctaccccataaagcgagatcgaattgagcatgccaaacaataattcagacagcacttccgcatctttttcgctgatctccaccttgcattctttaaaaacacgcgtgatcagttccacaaacaactgctgcacctgtttgcggataccaaacaacgtacgttcgatatattccttatccgactcgaaattgactacttggttgataacgtcctgcggcgtttccaccatacgcccgataaaacaataaatcgcaccataaagcgcttcgcgcggttcctttccaaacacagtttccatgaactgcgtcataatctgttcgatctcacctgccagcacctgcgccagcaacgcttccttatcctcaaaatgggtatagaccgtacctaccgcaaggccgctcacctctgcaatccggcgcatagacaggctgtcgtatccttcctggtgataaatttccagtgcggcatttataatcttttgcgtaacgtcttctatctttttgggcataatattctcctttttattgctgagcgttgggatcaagcaatcccaattcgtatcctgctttcgtctccctgatatacctgaaaatacgtacggccagtaccgcggcgatcataccggaaataatatccgccaccagcggggaaaccatgataccaataagtcccaacacgttggccagcaccaatactgtcgggatgaggcacaccccctgccgcgaaatggaaagcaccaaagcgcctttcgcccgtccaaacgcctgatgcgtcatcatcatgacaagcgtaaacgccgtcagcgtaaatccggctgtaaaccatcttaatgccggtataccaatctgcgtcacataatcatccgttgtgaaaatatgcatcatctgcggcgccaggaaataacatagcagcgtgaccgccgcaccaatccccaaagcaaccgcaataccaaatttcatcgctgatttgagcctgtcaaactgatgcgccccaaaattgtatcctgcaaccggctgatatccctgcgaaaatccaaaaatcaacgcaaatcccaaaaactgtatccggttcacgatgccgaaagccgcgatggccgcatccccatatggtttggcacagacattgatgaccgcaaagccgatggccgccaaaagctgtgttaaaaatgttgatgaaccaattcttgtgatataggagatgatctccctttcaaaacgaaaccccttcagtttgaaccttgctatcgtcttcttgcgccagtaattcgaggaaagtatgataaaagacagtacctgtgcaattgccgtcgcgactgccgcacccattactcccatatcaaatgtgaaaataaaaaccggatctaggataatattgactaccgcgccaatcaccattcctgtcatggactgcactgcgcttccctctgaacgcagcaggttattgaacgccatattggtgagctggatcggcgaagccaggaacatgacgatcgcgtaatccatcgcaagcccgatcgtgctgtctgaagctcccagccataaaagaagcggacgcgcgctgatacatccggcaatcgccaccaagactcccgccaaaaaagcaagtgtaatcgtcgttgtggccgttttgcctgctttttcaagctcttttgcccccagcaggcgtgaaaggtaagcagcgcctcctgcggcaaacaggatggaaagcgcttgtgttgtaagcatgataggcataaagaccgatactgccgcggttccgaggtatccttccggagaaatactgacaaagtaggtatccgccatgttgtaaatcgccataacgaccatactgataatcgccggaactgccaggcggaggatcgccgccggtattttggccgttcccatcatttgcgcacgctgatcaatttttccttccattcattgcctcgcacattacaaaaagatgttttaactgaacatatgttcattatgatattaccatattataatttggatagcaaatgttcatgtgaaaacattaacatttttacttgtataacacaatccgtttcgttataatataatttgtgcaatataatttatatgcctattagggatggagtgaaaacgatgttcaaaattttaaaaaaggaagaacttgcaaataacattgcaaaaatggtgatcgacgcccctctcatcgcgaaaaaagcgcagagcgggcaatttgtcgtgctccgcacgcacgacaaaggtgaacgtttccctttgacgatagcagattttgaccgtgaggccggaaccatcacgatcatttttgcacaggttggtaaatcaacgcagcaattaggaacgcttaaagaaggcgaatccattctcgatgtggttggccccttaggcaccccttcacacttcgacccgtccatcaaaaaagctgctgtgatcggcggcggcctcggatgcgctatcgcccttccgcaagccaaacatttgaagggtatgggcgtctccgtagacatgatcgccggattcaaaacaaaggatatcattatcctggaagacgaaatgacagcggcgagcgatcatctcatcattacaacggatgacggctctttcggtctgcacggcttcgtgaccgatgccttaaagcagcagatagaaagcggcgtgcagtatgacctcgtcgttgcgatcggtcccatcccgatgatgaagtttgtttccgcccttacgaaagaatatggtatcaagaccattgtcagtatgaatcctgtcatgattgacggcacggggatgtgcggcgggtgccggcttgtcgttggcggcaagactaagttcgcctgtatcgacggccctgactttgatggacacgaagtggattttgatgctgcgatgcgcaggctctccatgtatgacggtttaaaggaaagagatgcggattgccgactcgtgcaaatggcggataaggagaactgaccaatggaaagaaatatgtcccttgaaaaggtaaaaatgcccgagcttgatcccgaggttcgcgcaaagaatttcgaagaggttgcgctcggttatacggcggatatggcgaaggaagaaagcctgcgctgcctggaatgcaagaaccgcccatgtgttgccggttgtcctgttcaggtcaatatccctgaatttatacatgagatcaaagaaggcaatttcatggaagcctatactgtcataacggcaacaaacgggcttcccgcagtatgcggaagggtgtgcccgcaggaaagccaatgtgagaaatactgcgtacgcggtaaaaaaggcgaaccggtcggtatcggccgtctggaacgttttgcagcagattttgccatgtcccagggtgctcttggcgtacgtgacgtcgctcctaaaaacagtaaaaaggttgcagtcgtcggcagcggccccgcaggcctcacgtgcgcttccgatctcgccaaacgcggctatgacgtaacggttttcgaggcctttcatacggcaggcggcgtcctgaaatatggcatcccgcagttccgtcttccaaaggaaatcgttgaccttgagattaacgtactgagggaactgggcgtcaagattgatctcgatatggtcgtcggtaaaatccttacgatcgacgaactgaaagaaatgggattcgaagccatttttataggaagcggcgcagggcttccatcttttatggatattcccggcgaaaacttaaacgacgtatattctgcaaacgaatttttaacgcgcatcaatctcatgcacgcatatcagtatccgtcgtacgatacgcccattaaaccatactccaatgtggctgtgatcggcggcggcaatgttgcaatggatgctgcacgctgcgcaaaacgtctgggtgccggaaacgtatacatcatctaccgccgcagcgaagcagaaatgcccgcacggcttgaagaggtgcatcatgccaaggaagaaggtattgatttccgtcttctggaagctcctgtggagatcctcggcgatgaaaaaggaaacgtcacggcactaaaaaacgtacgcatggaactgggcgaacccgatgcttccggcagacgccgtccagtcgtgatcgaaggcagcgaatatacgctccctatggacgcagtcattgttgcgatcgggcagtccccgaacccaatgatcaaaaactccacgcctgatttaaagacgcagccgtggggaggtatcatcaccgacgaggagacaggcgctacctcgatccccggcgtatatgcaggcggggacgctgtcacaggcgccgctaccgttattcttgctatgggcgcggggaaaacggctgccaaaagcattgacgaatatctcaggaaataacagccactttacagatataataaaaaccggaaggaataattccttccggtttttcgttatatagctgaattttcgccttatgcccttgtaaatacgctggtcccgccatcggttcctgtggtaaacgtatccccgtccacaacgccgctaaatgtttctccgtttgaactgaaggtcacttcagcgcccgtttgttcccactcgccaagcgcttcctcattatttacccccatgacaaatttgccgccgctttggaactcataatatatctcacccatcgccgccgtaagctcttcttccttaattgtttcgccgtcctccgtcgttacgcttgtaaggagccacttcccctcaacggatgcagcgccgttctgctccgtatcttcttttggcgccgaacatgccatcaatacgccgcaaaaaagcaggcatattactaaaaacgaaatgaatttaaaactcttcctcatatttctgtttccttactaaaatatatttttggatcagcccattgccagtgcagtaagacctacgatcattacaatcatcatcacgactgcgatgatagaccatactgtgataataataccgataatcataccaatttttgctttcgtatccgtacggttcactttgaccgccttgcgccccacaacccacgcgacaatagcaaaaacaagtcctataaaagataagaagtttaccgccggaatataagaaagtcctgtgcatgcggcggcgatcacgcctaaaaccaatgccgtcatatcatttccctccttccgtatttaatggataaatatttgctggaatcagtatatcgcaatacttcatcccatcattttccggtgcgtgaaacggtcataaatcgtcctgaaacgaccgcgcttgcgtagtatcaacaagagtatatgctttttgaagaaactgatcctcctgcctcatcgacagggtgtttttctcatggtaaaataaattcgggaataattttattcgggaagccgattccagagggagccaatacaatgaaaattgctatctgcgatgatgatttacaggatcttgaatctttcagcatcatgttgtccgattacgaaaaaaaaaccggtgctgttcttcacataaacaccttttccgatgcggatagtttgctgtacgcactggagagcggagatcgctttgatgtaatattcctcgacatactgatgcccggcataaatggcatcgaggcggcgcgggaacttcgcaaatcggacggcaacgctgagctgatttttctcacaatctcgcaggattttgcactggatgccttttctgtaaaggcaaaagattatcttgtaaagcccttggctgaggcgacgctctttcgtctgctggatactctggcggttaagatggacgacagcgatatcattcttatcaatagcaaaagaacgttgcgcagactccatcctgaccgaattgaatactgtgaggtgaaaggccacagcatcttttggaatttacgctccggtgccgtactggaaagcaaaaacagtattcaagaggccgagaaactgctttcctcaagcaaatttttcataaaggtacatcgcgcctttctcgtgaaccggtactgtatcgcgttctttgacaggggcaactgcaccatagaactggagagcatgacccgcattcctgttccaagagcgaaatttgttgccattcgccagcagtacctgaatatgatggaaaatggcaaggtcaaatgaaaaagaaatatttgttgatcattccatttttagtcattgctgccggactattgctctatctatatagcttcactaccacaaatgccgagcagctttacctgaccgttgtaccggaagacgcctgtggttgggagatcacaggcttgcaaaacggcgtggaaatgcctattacccctgaagatgccataaacggcggtggcacagcggttttgcgccgtaccattccggacgaatggtcaaactacgaccaaatctcggtcagcggctggcgtgagatgtgtatttttgtaggcgatgaattggtgttttccaacattcctgcaccaattaccgccatcggggagctcccgcaaacagaacttcctgaggatgcattgttttcccaggtgtttgctgtaaatccggcatggagcggcaaaacgattaccgtcttaacaaggacgtttgtaggcgagcctttcgcatccatttctttcaatcttttgagcggtaccgtcgctagcgagcagcaaacagcatgggcaaacgcactggcaatacccggcgcgattttcgccactttgtttttgcttttattgggattgttcctctaccgcctgcccgcaatcaaaaaggcgttgccgctgcttctattggcattggcggcattgttgctcatgctattttatttagacaggctgactactgtttccaacaagatgaataccgtttccacatcattgtcctatgacgtagtaattcaggcgctctatattttgatgccgctgctttatgcagcgacgcagatgagaaaagaacgtaaactcttcctgtggatcatcgtaccgatttgggcggtatattttgcgtccgtcgccgcatggtcagttttccatctggaggttcctacgtggtttgacgcgctggcctatttgacacttttactgcttgccatactggttggcttctcgatcaagattgcaagggacggcgatctatattttcagcggctgctgaaggttatgggaatatttgtgcttggtgcgggaacagtgtttgggttgtccgcactttttgttccttccttgtttgagttatccatcatctattggaaagaggcagtggcgggctatcccttcccactggcttatattatctttaccgccatcctgcccatcgaatttctgcttgcccttgtggatctggtggaaagtcgggtccgcacagcacaggaggtagaaacgttgaagcttcgcaatgaactcactgtgcaaagccttttgggtgcagagcaaaccaacgaagccttggccgtggcgcgtcacgatgaactgcatcatttgcgcgcgcttgctgctttatatcgtgataatccgctcgaagcagcagattacgccgccactctggcaaagaaattggaggctatccctgccatgcgtttcactgaaaatcgtttggtgaacgcgatcttatcgatacaatccatcaacgctgcaaaggcaggcgtgcgctttgaggcaaaagcaagactgccggaatcgttgcctttccctgcgtgcgatatatctacggtattgatgaatttactggaaaatgctatagaagcagcggcaaaagcgctgaatggaaaaaaacgtaacgtctctgttttactggatatggaagaagaaacattcctcattgccatcacaaattccctgcctgaggggtttgaccgtgagttattccgtgagcgtttctcccatacgactaaagcggacgagacacagcacggctacgggatccgctcggctcaaaacgtcgtatcccactacggcggcaagctgcggtacagcgtccatgaggataccattacagtcaatactgtcatggagcggaaagaggcgaacaggcacacaagtttgtacgaataagaagccgctggtgcttattgttttttctgatttcataagttttgttttatttttatgcatattctaatcgcttccatgcttaaatattcaccatagccggtcatttggcaagatgcgctccaattcctttttgcgcataaccacgcgtttcctacgattgtggataactctggccatccgattttccgattgttccgcaaattcgctgtatcaagccgttttttaacaaataagttatccacatcgattggtggataacttcaattttctgcgttgctgcgcggtttttacttcgaggataactcttttcccttatcctttttcacgcttcttttttcttcttcctgctctatgcatattacatatgattttatgcattttttgaaaccctgtgaaattttttgtacttgttgtataatgaaagataagattgattatattaataagcgaggtcctttttatgcgacgccaatataacagaccttaccgcaggccaacttccatgagctattcccgcccccggccaaggcggcgcggccgcctgcgtgttgggcgcctgattattgtagttcttatttttgcggccatcgttgccggtattgttttcggtattatgttttttacaaaatcaggggtctttgcgcagcagtcttccgcccaaagccctgccgcttccgttacgccttccccgcagcccggtacatctgccagcctgcccgaggatacgcttaccgtggcggcaaccgatgctacttccccatccgcgttcggactgcaggcggaactcgaacaaaatggagagcagctcgcttcctataaccggacttatcctatctcttttccgtccggcgggtcgtatacttccctctccggcatcacagcttttcgtggaaataactatcgcgacacagcgcatttcggttctatagaaaaagccgttaccacgttggaacagagttggtcttttgatatgggcgcagcccttacgcaggaaactgccgccggccagccggtcatcgtccaatgggatgctgatatgcgccggatgatgaatttacatgacaccaagaaatcccaggataatttgacggaagtaatcctgccttctatagacggcaaactttattttcttgatcttatggacggcaaagagacgcgcgatccgatcgacatgggcttttccgtaaatggaagcgctgccgtcgatccgcgcggatatccgcttctgtacgttggacagggtggagacggcagcggcccttcctatatgaatgtttacagccttatagacggacagcttttgtaccgctgcggcgcagacaggcaagattcgttttcttaccgcagctccttccaacggtttaatgcttccccactcattgcttccgaggccgatacgcttgtctggccgggcgagaacggtatcctgtatactattcgtttgaattccgattttgaccgcgcggcaggcacggtatcagtttcgcctgacgaacctgtgaaatatcgttacactaccagccagaacgcggatgattcattgataagcgaacaaacgccccgcctgtatggtatcaaatcttctcccgctgcctggaaaaactatctttttatggcggacaatggcggactgatgcagtgtatcgacctgaataccatggttcctgtttatgtgcaggaccttggtggcagcaccgatacagccatattgtttgaatatgcaagcgacagcgcgttcctttattccggtgcgtacagcagcgcagataatacatcccatatccgtaagctcaacgctctttccggtgaaaccgtatggcaaaaggatgcaaacggcagcgtacaggcttcccctgctttaggaaccggcgtattggatggcaccgtgtttttcaacatctccggatcgtccggcggcgagctaaccggctttaacaaggatacgggcgacattacatggcaatatactttagaacgtgcatccgcatcgtctcccgcggcagtctatacctcggatggtaacggatatatcctgcaatgcgacggaaacggtaagcttgtattggtggatggcaagaccggcctggaatctgcaagtgtcagccttggcggggaagtccaagggtctcccgccgtatttggcaatatggccgtcatccaaagcggacaaaaattattcggcgtaaatataggttaaaagctgcataaacatggcggctttgtggtatcaatcattatataaaaaacagggggaatgcaagtttgaatgatccaatatggtggcaattattattacaggttgtattgatcgccttgaatgctttttttgcttctactgaaattgccgttatttcgctgaatgcgaataagatccgccgtctcgcggaagaaggagataaaaaagcgaagcagatgctgaaaatggtagaaacgcccgcaggatttttgtctaccatccaaatcggtattacgcttgccggattcctcggcagtgcttttgccgcggataattttgccagcaagctgacagactggatggtcaatgtgcagggaatcacctccatctcccctgatacgatcaacacgcttgcggttattattatcacactcattctttcttattttacactcgttttcggcgagctggtgcctaagcgtattgcgatgcaaaggccggaaaaggtcgcgcgcgcgtctgccggcgtgatcactgtcctttctgtgatcatgaagcccattatatggcttttgagcgtatccaccaatggtatccttcgtctcctgcgcatgaatccaaaccaggaggaggacgacgttaccgaagaagaaatccggcttatggtggacatcggcgaagaaaaaggagcgatcgaagccacggaaaaagagatgatcgagaatatcttcgaattcaacaatacgacagcacgcgatgtgatgacgcaccgcatcgatgtcattgccatccagaaagaagaaatgtttgaggaaatcctggatttgattcgtgaaagcggactttcccgttttccggtttatgatgaagatatcgatgatatcattggtattttgaatacgcgtgcgtttctcctcaacctgcgcgaggacgccccgaagccgatcgagcggctgctcaggcctgcttattgcgtaccggaatccgttcataccgacgtactgttccgctccatgcagaaatccaaggaccatatcgccattgtcgtagatgaatacggtggaatgagcggtatcgtcaccatggaagaccttctggaagagattgtcggcaatatctatgacgaatacgacccacaggacgagcaagagattgcgcaattaaaagacaacctgtggcgcgtttccggcagtatagaaatcgaaacactgaatgaagccctctcgctggaaattccggaagatgcggatttcgatacgctcggagggcttgtgttcagcgcgtttgacagcattccgcaggacggcagccatccggatgtagatgtatatggcctgcatatccacgtggaagagatcatagagcggcgtgtggaatgggctcttgtttcaaagcttccgcccgtgccgccggataaaccctaaaatgttaaaaaagcggcttctttcgaagccgcttttttgttcttgttcttattatttatttcctaaaccgtcaccggatgcaaactcaaagcgatcaggatcatgcccgcaaaataggtgatccaattgagttttgcatgtatccatttgtcagagtgataattccatattccgaggaacaaatcggataccaaaaacagcacagcgcctgatgccatcacagcgctgcgcacagggagtgcctgcgctgaaaacataccgacaaccgcttttgatgccataaacacgagcaaaaccgtatagaccgtgagcggcaagcgcgccctgcccagttgccaatcttgttttttcataagcagtaaaaccaagagcaggacaacgaccgtaattacaaattcctgccagccgagcccaaaacgcagcagcaatgacgcgatcaaaaaacactgtgtaagcgcaaagaaaaagattccgatgttgaatttctttgcatccagccggataaactgcaaaaaataatccccgccgatcgcgcagatcagcccgcacagcacgaggatatccggtacttccagcatccccgccagcataagcgtaaggacacaggccacgcccatgatacaaaaaagcgcccccaaggtcagcttgagagtcgtcgccctcaggaagtcgtgccgcgcttccatgcgcaggtaaaaacacagcaatatgacataacagaccacgatcacgatcggcgcgataagcgccagccaggtcatttccatttccattatcccgctaccgcctttcccgcagggttccaaaaaagctgcctatttcttatgtttttcagtttcttgcttggaatcatgcgcgccaggcaacgcttctgccttgcctgatttcatctttttttgtcgtcttttttctatgcggatcctgttcggatcgtcttcgggcgtaaacaggcgaaaaatatcctgcagcctgccaaacagcaaaagttgatctccctgctctacgattgtatctttggtgatataatcaagcgcctcgtcgtttcgcttgatcatgacgatatgcaatccatagtttgccgtcagcattgcttcattcagggtctttccgtcaagctctgtcgggatgcgtttgacctttacgcccgcgacaacgccgcgcgcatattcgtccatcacattaatgatattttcccgcccctggaacatccatctttcacccagcttttcgataaaactattgaaacgcatacgtatactgggccttttcttcgccagcatgaataccacaaaaacgatagcaaggatgatcgccagcgtccatatgtcttcctgtattgctttgggaagcgtcaatactacgtttacaaataccgtaatgatcgttatcgaaaaaacatacccgaacagcatgaccatccgtgccatcctcctgcgcaacagctttgtcatgacaagctcgctttccttggttgtatatccgctgttggtgagcagggatatcacctggaactttgctttttcttcagtcattccagtcatacggaataaaatggtgaaaatatcgataatcaggatatatgcgactgtcacggcaaaaaatagcgccagggccactgacatattcaactggaattccccccttttttggcgtgcctgcttatatacgccctctttgtatcataataaacatcattttcctagataatcaagaatttgcgtccagccttcctcaagcatttcaagcgtcatggcagcgttcgccggactcgtcgacggcaagaccctgcattccctgccggtcttaggcaggcatagcttacagtataatgcatgcgcctttttgccgtttgcaaaaaccatacggatatccgccgtatgaaaaatatctgaaaaatcattgggtatcggatctttaatggatgtatccgcactccccgcaatatcacacgctgcaagtacgtcaaaaagggcgatccccgcatctgccagcattgcttttttgtgtggtatcgtctccggctcgggatatcttaaaagattgctgactaccgtccagaacctgtttcgcggattgccatagtaaaagccttcttcgcgcgacttcacagacgggatcgtccccaatatcaatattctggagtttttatcaaaaataggttcaaaggtatgtatgaccctgccgctttgcatactcaggtgcagatcgcgcgatagatgtcatatacgctgtccaggatataatccggttctacgtcgccgttcacaatatcttcgtagctgatctcgccggacagcaccgcgatcccgacgatcccgccgtttacagccgttttgatatccgtatacagcctgtctcctaccatcgccgtctttttagcctccatccccgtttggctcaaaatatagtctaccgtttccttgaacggcttgcctacaaattttggttctataccggttgcatgcgtgatcatgcttgccatagatgcgcaatccggccaaaaacgcccgccatccagcgggcataccctgtcgatattggtcgccaggaacggcacgccatttgaaaccaacctgcaaagcgcatccgccttttcaaaggcaaacgttgtatcaaatcccagcaccgcaaaatctgccgtttccgtatccgccggcagcagtgtgatccccgcacccttgaattgtatttccagttcaggggtacctgcaaggtatacctttggattttctttatgcgttttcaggtagtgtatcatcacgtcgccggacgtcatgatattctcacgcgtcattcccgcaaatcctaatcgctccagctttttaacgtaatcgagcggcgccttggaagaattgttggtaaaaaagtaaaactgtatccccttttgctgcatacattcaatatattcttttgcgccgtcgatcaatcgttcccctaagttgatcgtcccgtccatatccagcacaaagcattcgatatccttaagatcggctgcaccgccgtttaccttacctcttttttccactgttttatcccccatataccgcattgtaaattcgtttcaagttatcgtcgtctaatgaaatctcattcaggatagtatacctgtttttgcgcgttgtgggcgcaaggcgcatcgccgcggcatagtcttcataagtaagccccaggtcctcgaaacttgttgggatcccaaaccgttttaagaagctgcggataaattcataatcgccgccgtgcaaatattccacgagcacgcttgccatcgccgcctgcaagccgtggaaggttcctttccccagcgcgtcgatcccgtggctgatgaggtgctccgccccgctcgacggtcgtgtatcgcccgttatattcattgcaaggccggataatacgatcgattccgcaagctgcgtcaagaatgtaatatcatcaaggcttggctccgtatactgcaagatcgcgcgcactgccgtccctgaaataatataggcgaagtcgtccattttcgccttgcctgcgcgtacggcgatctcccagtccttaagggctgtgatattggaaatcaggtcgcccagccccgcaatgatcatattgcgcggtgcacggcgtatgatatccatatccatgataatatatgtcggaatctccgccatgagcgtacgtacttctccatggtcgcacttaagtactgccattggggacgcgaccccgtcgtgcgacattgaagtcggtatgctgataaacgggcgttttgacatcgtcgacgcatattttcccacatccagcaccttgccgccgcccatcgcgataaccgcgtcaaaatcacggtttacgatataataagccatcagcagcgcttcccgcaggctgcctgcatgcacaaattcccgtttgatatcttttaggtaagaggacaaactttcataaacgtctttgccgtaaagcgcgtctaccgttttatctacaatgagcatcaccctgtctgtcggctttaaaaattccttcagctttggatacagtatcccgctcccaatttttacgccatccggcactgcaaaagtattcatatcacttgagcccctctttatgaatgttatttatctccaaatacaaggaaaaggcctttttatataagaccttttcttagtatacatgatatttaataaaaattcaaaacctactagaggttttcggacataatcaggaactcgtcgtacatatcttttttaaagaccaattcctttttaagagcctcgtcaatatcctcgtcgatcatcttattgtcgcggatgccgactaccctgttgccgataccacggcttaaaagctgcaccgcgcgcacacccatctgcgtcgcatggatgcggtccatggcgctcggcgtaccgccgcgctgcgtatatccaaggacgatcgctttcgcgtcaaggttggcctttgcacgcatataatttgcgaccgcttcacctttgcctgcgccttccgcgatcaggatgatactcgtcattttgcccttgatccggtcgctcatgatcttttcacagatatggtcgatatcaaattccacttccggtataataatatgctccgccccgccggcaatacccgcataaagcgcaatatctccgcatttattacccatgacttcgatcactcccacacgctcatgggaattcatcgtatcacggatcttggacatctcgcttgttacgccgtttaccgccgtatcaaagccgatcgtaaaatccgtatagggaagatcgttgtcgatcgtgcccgggataccgatggtcggcactccgaggtgcgaaagcacctttgcgccctggaacgaaccgtccccgccgatcacaaccacgcctgaaatatcaaacgctttaatgaccttaagtgctttttgctggccctcgctcgttttgaattcttcgcagcgggccgttttgagaatggttccgccctcttcgacgataccatccacatcctccgtcttgatacgctcaacgcgtccttcgatcaatccggcatacccttttttgatgcccataaccgaaaatcccgcagcatcagcagccatcacgacgctgcggataccggcgttcatgcccggcgtgtcccctccgcttgtcaaaataccaattctttttttcatcacactaccaccatatataaaatataaaccttagtcttcttcatcccccgaaaaaatctcgccgtgcttagtcagtatccgcgcttttccggaaatcttgatcgcagaaatattgtcggtaaactgggcgagcaagacatcccccgccgtcagcttttccgtatgctgcaaacgcgtatccttgccccgcgtcatgccgatcacgttaacgccgctctcaagtgcctttatgaccacataatcttccgtgcttttatcgcttatgtccataacgttccattccttaagacgtttcccttactaaactacaatacagataatattctatcaaacccgcccctgaaatacaataacatttgtaaaatttccggatttcaatacaactatttccatatcttacacatcgctactttacaacgacattttcttcccccagataccctttcagttcatctatcagagcggcatggtaagcgacgctgcgtccgcctgtgagcttgtatttctgccctgtcttttccacatatacgaccacgctgttgttgccctgataacgcgatgtgatacgcataagcccatccacgtcacatgatgtatcctgcgcgatttttacgtaaagctgcttgccttcgaaaaaagaatcgtccgggacaaaagcgctgatcttctctgccagcagctcgatcccgctttgcgcgcttacggtaatcttccctttcaccaccacgatactgtcgctatggaccaatgcttccgcctcggcatagacattggggaacgcgatcacgccgatctgggcgtacagatcctccaggacaatattcgccatcattttcttttgcttggtcgggcgtatccgcacccccgtgatgataccgagaagctccacctgcttgccgtcgtactcgtacatggtcatctcatcgttttccgtctgtacgatatcgccgatattgaccgtgcgcgagttgatcgctcccgcgagttcgtcgagtggatggccgctgatataaagccccgtcatttccttttcataggaaagcttttgctgctcatcaaattccggaatatccggcaatgcaatgccgagcgcctcaaattccttttccgcgctgtcaaaaagcgacatctgcccactcgcctgccgctttttaagctgtaccgcgtctgctaatacctgctcgtatacagccataagctgcgaacgcctcacaccgaaacaatcaaagcaacctgacaggatcaggctttccacgcgttttttgttgagtacgtccgcgtttttattgacaaaatcctcaaagcttttatacccgctgccccgccgtgtaatgacctcctcgatcgcctcgcccacatacgtaatcgccgaaaggccaaaccgtacgctgccgtcttccgtggtaaaacgcatatccgagcggttgatatcaggcggcaaaatgcccacgccctcgtgccttaaggactggatatattccgccagcttttgcttgctcgtaatgaagctgtttaaaagcgcggtcataaattcgaccggataatagcatttcaggtaggccgtctggtaggcgaccactgcatacgcgcaagcatgcgatttattgaatgcgtaatttgcaaacgccatcatctggtcaaaaagcgcagtcgccgttttttcgtccatgccgcgccgcaccgcgccttccacgacgatctctccgtctttttcttccccataaatgaatatccggcgttcctcctccagcacatcctgctgctttttgctcatggcgcggcgcacaaggtcgctcctcgccatggaatagcccgccacatcccgcacgatgcgcatgatctgctcctggtaaaccatacatccataggtatcgtttaaaataggctcgagcatcggatgtgcgtaatgcacatttttatggtcgttcttgctgcggatatattccggaatactttccatcggccccggacgaaaaagcgatatccctaccatgatctcgtttaagtccgtcggctttaagtcctgcatcagcctgcgcatgcctccgctttcaagctggaacatgccgtctgtttcgccgcttgtgatcaactcgtaaaccttccggtccttaaggtcgatatgttcgatatcgatatccaccccgtggttttccttgatcatgcgaagcgcatcgcggatcacggtaagcgtccgcagccccaaaaagtccatcttcaaaagccccaggctttccagttttttcatcgtgtactgcgtcatcacgctttcgtccttggggttcttttgcaacggcacgtactgcgtgatgggcgcatccgcaatcacaacgcctgccgcatgcgtggacgcgtgcctcggcatcccctccagcttgcgcgcaacatcgatgacctgctttgcttccggattattctggtattctgcctgcagctttggattgcgctccatagctttgtcgatcgtcattttcagttcgaacggaaccatctttgcgatcttgtccgcgtccgcaatgctcatgcgcatcacgcgcgccacgtcacggatcaccagccgcgctcccatcgtgccaaaagtaatgatctgtgcgaccctgtcctgcccatatttctgcgttacatagtcgatgacttcctgcctgcgttcatagcagaaatcaatatcgatatccggcatactgatgcgctccggattcaaaaagcgttcaaacaaaaggttatattcaatcgggtcgatattggtgatccccaggcaataggccacgatgcttcccgccgcgctgccgcgtcccgggccgaccataatcccgtttgttttggcaaaattcacgaaatcccatacgatcaggaagtaatccgtaaagcccatatcgttgatggtgttcagctcataatcaaaccgctccctgatttccggcgcgatatcctcgtagcgttgccttaagccgtcctcccccaagcgcttcaaatattcaaagttcgtgtagccgtccggaactttgaattccggcaaatggttgctgccaaactcgaaatcaaggttgcacttctcagccacctcgcgcgtattgatgatcgcgtccggcacgtgggaaaacaaatgaaacatctctttgggagatttcaaataaaattcctgtgttgcaaaggacatcttactgggggcgtcgatggtcgtgaccgtctgaatgcacatcaaaacttcctgcgcatatgcgtcttccttgtcaacataatgcacgtcgttcgtcgccacgagcttgatgcccgtttcgtccgcgagctttaaaatcatcggattgatacgccgttgctcttcaataccatgatcctgtatctccaggtaaaagtcttcgccaaacatgccgcgcagcttttccgccatttttttagcgcctttatagtcgttctgcatcagcagccgctgcacgtcccccgcgaggcacgccgcaaggcataccagcccttccgtatgctccgccagcaaatcgtaatcgatgcgcggtttgtaataaaacccttccagggaacctgcagacaccagtttcatcaggtttttatatcctgtcatgtccttgcacagcaggacaaggtgcgcgtattccttggatacggcatttttttcgaaccggctcccctgcgcgacatatacttcacatccaatgatcggctttattccggctttttttgccgccgtataaaaatcaagcacgccgtacatcacgccatgatccgtgatggcaagcgcgtccatcttcatttccttggcacgcgcaaccaaatcatcgatcctgctcgcaccatcgaggaggctgtattccgtatgtacatgcaaatgtgtgaaatcaatcatattcgttttcctttttcaagaagttcgccgcaccgctttgcacccttggcgcaaccaagcgtcatccattacgttttctcttcttaatatgtttagtataacatgccggtttgccatattgtgcaaaaattatgttaattttttacacaggtatcccccttctcctttcccactgcccgccgccctttcaaaccggacggctatggggaagtttcttttgaaaaaaagggctgtatactgtataatattgttatattgaatttttacagcagaaaggaacgactcaaacatcttatggcttacaaactgattgcactcgatttggacaacacattgttaaacgctcaaaaacaggtcactccggaaaaccgcgaagcgatccaaaaggcacgggaaaaggggattcacgtcgtacttgcttccggccgcgcatatccgggtatcatccctgtgaaaaaggacctcggccttgacgactatgtcgtctcctgcggcggcgcacaaatcttaaatccgcaggcagacgtgatccattccgtttatctcccgcccatcgccgccaaacaggtgatgcgctgggccgccctgcgcggcatccatttccagatatacctggatgacgggctttattatttgaagcgcaataaatattccgattactatgaaaaaatttgctcctacggcgggcagcctgatcctgacctgatggatattgaaacgatcctcaccgctaagatcgtgctcattgacgaagaggaaaagctgcaggaatacgcacgggaactgcgcatcaccttccctgaatttttctttacaaaggcacagacaggactgctcgaggttatgaaccctgaagcgaccaaggaaaacgcgatcgcctttattgcgcgtaaacttgggatcgagcagcagcagatcatcgccgtcggcgataacagcatcgatgcgggcatgatcgaatatgcgggacttggcgttgccatgggcaacgcatccgaggaactgaaggaaagcgcaaattatgtttgcggcacgtgtgaacaaagcggcgtcgcggaagtgatcaacaaatatatcctgggggtgtaacgttatgaaacgtgtcatcaaaatagccgatcttgccaaagcgatcaatttaaacatcatttatgtagggaaacgcgatacagccgagatcgactccagcgacctcaaccgtcccgggctgcagatgagcggtttttttgaatattttgccgtgaatcgtatccagcttttcggtatggtggaaatgacttacctgcaaacgctggatcctgcaacgcgcatggagcgtttagaccgtttcttttcccatcccattccgtgcgtactcattgggcgtaatttaacgccgcctgacgaattccttgaatgcgcgcgcaaatacgacgttcccgtcctcatgtcggggctcacaacgaccaaactgagccataaaacgtcgatctacctggatgaattattggcgcccgttatctcccgccacggcggcctcatggacgtatacggcgtagggatgtttattacaggcgacagcggcgtaggaaaaagcgaaactgcgcttgaactggtaaaacgcggacaccgtttcgtcgcggacgacgttgtggaaatacataaattatcagacgataccctggtcggccagtcgccggacatcatccgccatatgatggagatccgcggccttgggatcatcgatgtttccgtgctgtacggcatgggcagcgtcgtacgtgaaaaatcgattacgctctccatccatctggagcccggcgacgtgcgcgatatcgaccgcctcggcacggcggacaatcatatcacgctcctggggatcaaagtcccccagatcacgcttccggttcggcccgggcgtaatttggcgatcgttatggaagttgcagccatgaatttccgcttaaagagcatcggccagggcggtggggaatggctggcacagaatatcatggacgtggtgcagcagtcatgacgcaaaaccagctcatttccgaacttgtttcggtcatcggttccggcagggttctggaaaatgagcccatgtcgaaccatacgacatttaaaacgggcggcaacgctgatttattggtgcttccgcagacggaaacacagcttttatccgtgctgaaaatactaaaagatgcgcacagcccctatacgctcatcggacgcggttccaatcttctcgtttctgacgaaggccttacgggcgtcgtcttaaaacttgcggacggctttgacaaagtcacggtagacggcgaacttgtgcatgcccaggcaggtgcgacgctgcgtgctgcatgccttaatgcaatttatgcgggccttgccggtcttgagttcgcgggcggtatccccgggtgtgtcggcggcggggtggtgatgaacgccggcgcttacggcggcgagcttaaggacgttttgcagtgcgtacgcattttgacgccggcgcttgaaatacaaacacttacgaatgaccaaatgcaattttcttaccgcaaaagcgcggtgcaggacagcggctcgatcgtccttggcgcatccttccgtttagcgcccggcgatccggaccaatcgatggaaaaattcaatcgcctgaacgcgcggcgcaaggaaaagcagccccttgccttccccagtgcaggcagtacgtttaagcgtccgcagggcaattatgccggcgcgctcatcgaccagtgcaacctgaaaggttttacgatcggcggagcgcaggtttcggagaaacatgcagggtttattattaacatagggaatgcctcgtcacgcgatatctatgaactgatctgccacgtacggcaggaagtcctcaaacaaacaggcgtgatgctggagcccgaggtaaggctccttggcgaattttgatatatgattgagattacttgggatacgcatacgcatacggtgcacagccacggtacgggcaccgtggaagataatgtccgcgcggcgatcgcaaagggcttcacccgcatcgtgatcagcgaccacggcgtcgggcatctttgttataacatcaaggacgtggatgcttatttaaaagatatcgacgcgatgcgtagaaagtataaaagcgatattgaagtgcttgccggagtagagatgaaccttctttccgacgacggcgagatcgatttgccagagcagtgggcggatgcctttgatatccgcctgatgggctatcataagctcgcgcgttttaagggactgaaaaacaagctgcactacttgcttccaaaaagcgacagtgaaaaagctgtcgcgcgtaatacgcaggcgtatttaaacgcaatgaacaggcagcatatcgatatcatcacgcatatcggctatggcattccggtcgataaatataaggtcgcacagcatgccgcaaaggtcggcactgcccttgagatcaatgccaagcatccggaatttacaacggacgagctgaaaaaatgtgcccaaacgggcgttttgttttccatcggaagcgacgcccattcccctgatcgcatcggcgactttgcccccgccctcaaaaaagcggaggaagcgggagttatgccggagcagatcatcaatgcaaggagaaacactgtatgaaatttacgatcgtaacagggctttccggcgcaggccgttcctctgccttaaaacgccttgaggatctcggctactattgtgtcgataacctgatgcccgaactgatcccccagtttgcccgtttgtgtatgcagagccagcacatacgcgacaaggtagcggtcactgtagatacgcgcatgggcgattttttcgattcgatttacgccacggtagatgaactgaagaccatggatttggatctcgatatcctgtttttggacgcttccgacgccgtgctcgtgaaacgcttcaaagaagtgcgccgcaagcaccccgtttcgggcagcggcgagattctggccggcatacacttagaacgccgtaagctccaacagatcaaggatatggcgaaccacgtcatcgatacttcgtcttataatgtcatgaagctgcgccagatgatcgatatgatgtatgcggaggaaggcgaaaaaggccttttagtctccattatttcctttggttataaacgcggtatcccgcttgatgcggatatggtttacgatatgcgttttatccccaaccccttctatgtggaaggtatgcgtgagcataccggccttgagcaggatgtgcgggattttgtgctgtcgtttgagccgacgcagtttttcctgaatgaactggtaaaaatcgttgaaaaactggcgccttgttttatcagcgaggataaaaaccagcttgtaatcgggatcggttgtacgggcggtatgcatcgcagcgtcgtcatggcagaggagctcttccggcgcctttcagaccagggcctgcgcgttacgctcgagcaccgcgacatcaatttggagaaaaatcggtaaaacggaggagcgttcatgtcgttttcgtcgtctgccaaggatgagatctgtacgctgcaaatcacggacgattgctgtgtcatggccgaattgtgtgccctcacgctcgtgtgcgccaatttgaaaatcaattcgtccggcgtgcatatccattataataccgaaaacatggccgtcgccaagcgaatctatgatacggtaacgcgtgtgctgaagatcgaagcggatgtgcagctcaaggataactttttaaaaaagaaacattcgtacacgatagccgtggataatgcaatgctgctgctgtctgtgctcggtttggaaggcaacctcctgacggaggccgttccccctgcctacatgctcgaaaaggaatgctgcggcgtatccattttgcggggagcgtttctcggcggcggtacggtttccaatccgaaaaagaattatcacctggaatttgtgctgaattcgcaggcttacgcaagcgtattatgccgcctgctggaaaataatcaaattcgcgcaaaaactataccacgaaagcaaaattttgtggtatacttaaacgaaggagataatattgccgcttttcttgccttaacaggcgcatattcatccgttctgaattttgaaaatgtgcgtatcttaaaagaaatgcgcaataatgtaaaccgtgctgtcaattgcgagacagcaaacatcagcaagaccgtgaacgctgcaatgctgcaaataaacaacattcacctgatcgaccggcatatcggtcttgaaaatttaagcgatacgctaaaggaagctgcgcagcttcgtttagataatcccgaagcgacgcttcaggagttatgtgagcttggcggtacgactaaatccggcatgaaccaccggttgcgcaagctcaatgcgatcgccgaagacttgaaagaccactgactgcaaaaacggcttaaggctcacggcatatgattgccgtccattacagcaaggaggtttgggtatgatttacaaagaattggtgattaccaacaacgacggattgaaggcaaaggctgccgcgagtttcgtacaggtcgcgaaccagtttgacgcccagattttgattgagttttccaacaagaaaatcaatgcaaaaagtatcatgggcctgctttctttgggagtgaaatccggagaatccatttatgtatttgcgaacggtgcagacgaaaaagaagcgatcgacgcgcttgcagagctcgtagataataacttcggggaataagagaagaaataaaaacggtacggcttaagccgtaccgtttttttgtccttgtttattcttccccctgcatgatatgccactgcacgccgaagcggtcggtcaccatgccgtaaagcccgctccaaaaggtttgctgcaactccatgcctacctgtccgccctctttcagcgccataaacagccgcctgacctcttgcgggtccttaacgctgaccgtgggttggatagtattgcctttcacacattccatatcggacgggaaatccataaacatcacagtgcagtccccgatcttaaggtccgtatacatgatcagatccttatccttttgctgggtatccccgccgggcgcatcgccatacgtcataaaaattggtttgccaagcccgaacacctttgcgtagaattccaccgcctcccggcagttcccatcaaagttcacaaaaacgctaaatgtcatggtatgatctcctttttatagtgtgtgtttttgataccacccctaaccggacccaaaacactattttttatgatccctccggatggaaatagcggtaaacgacttccgcaacgttttgcggcacgccggccgccgcctttaaatcgtcaagcgacgcttcgcgtatccgtttcacgctgccgaacgccttgaaaagcgcacgttttctgatgtcacctaccccttcgatcttgtccagctcccctgtatggtgccgtttttcacgcagtttacggtggtatgtgatggcaaaacggtgcgcttcatcgcgtattcccgtcacaagacggaattccggacttccaacccgcagaaggatgctttcgtcccgttccggtacaaaaatctcttcctgctttttcgcaaggctcacgatcggaatatcgtcacatcccagcgcaaacagcgcgtcgcgcgccgcgctaagctgccccttgcccccatcgatgatgatgaggtccggcatgggcaaaaaactttcgtcaccctgcagcccgcgcatcagccgcctttccagcgtttcgttcatggatgcaaagtcgttcgcgccctcaaaacccttgattttaaaatgccggtattttttgcggtccggcttcccgtccgtaaataccaccatagaggatacgttgttcgtcccctgcgtattcgagatgtcgtaacactcgatgcgctccggcgtttccggcagtcccagtgcttttgcgagattgcccgccgccgcctgccgctgctttttcgcaccttccttgatcttcactgcatccagcgcattcttacgtgcgagttccgccagcttgcggttgtcgccgcgcaccgcctctttgatctctactttggagcctcgttttgcgctcagccattcctccagcaactcgtggtcgtccggacgcggcagagcatagatatgcttgggtataccgctttggtccgtataatattgctgcaaaaactcgcgcatcatctcactaagcggttcattatgatagtcgaggtaatatttctgggcaaaattcagcttgccgttgcgaaacaagaatgcttgcacaaccgcagtttccaaacctttttctatagcaaatacgtccttatcattgaggttcggaaaacccgcgcgctgtttttcgcggatgcggtcgatgagcgccagcctgtcgcgcagcaacgccgcctgctcaaaattcagttcctccgccgcctgttccatcttgcgcaccatatcttttttgagcgcattgttgcttccggaaatgacgctgatcacttccttaacaagctccccgtattcttcttttgaaaccctgcctgtgcaaggcccgatgcaccgccccatctcgtagttaaggcacggccgctcaccccgcgcgatcatacgcgcgatatcattgttgcagctccgcagtggatacagccgcccgatctggtcaagcacatcgcgaatgatatgcgcggcaataaacggcccgtaatacttcgcgccgtcgtcttttaccttgcgcaccacggtaaaacgcggaaaatcttcattcagatcaacccgcacataaggaaaatgcttatcgtcctttaggaggatattgtaatatggacggaattttttgatcaggttacactccaaaataagcgcttccagttccgtatccgtaatgatatactcaaaatcgtcgatgtgcgacaccatcgcggcgaccttggtatatttctgcgcttctttacggaaatactggctgacgcggttttttaagacccgcgccttgccgacatatatgaccttgccatccttgtcgcgcatgatatacacgcccgggttttgcggcaggtttttgatcttcttttgcaatttttcgttcatcaatatcccatatcgattgcttcgctcaatatctgtcccgcaagcggcgtggcataagatgagccgaagcccgcgccttcccctaaaaccgcaatcgcgagcggatggttctcatcctccacaaacccgacgaaccacgaatggttctttgtttcaccggtatccggatcgatatattccgccgtgcctgtcttaccgcatacggctccatttccaatatccgcttttgtcgccgtgccgctcaaaaccgtttgtctcatatattccccgatcgtcgacgccacgccttgcgaggcgactgtgcggaactgcgccggcgtatacgtataagaactgctcccgctgtagcgtacatcaagcagcgtattcggctgcatcattacgccgccgtttgcgataccggcagagatcatcatgttgtgtaacggcgttaccaggtcgtggtattgcccgatacccgcccatgcaaggtcgcctttgttgccggaaacctcgaatacgctgttattcatcctgaaatccggaaacttgaagttatagttgaacccgaattcatccgccgttttgagcatagcgtcgtcgcccatctgggctgccagcgttccaaaataaatattgcatgatttttcaaatgccgttgcgaggtctacatgtccgtgattcgacgtgcaggtcaccttctgcccctctatgatggcctctccggtgcagtcgatctccagatccgttacgccgttttcaagagccgcagccgtagtgacgatcttcatcgtcgatcctgggggatatagcccctgcgtcacgcggttgacaaacttggaaccgctctcgtccgtatcctcttttaccgtataaggatcaaaggtcggcttggagacgctcgcgagtatctcccctgtcttataattcatcaaaacgaccgcgcccgcgccttcgctcatattgtcataaatatattcgcacaggttcgcatcgatcgtcagatagacgtccccgcctttctgcccgctctgcacgcttgcgaatttatccgctacattctggtcgtagccatacaagtattttgcaaaatacgtttccgcccccagcgtgcgtccgtagatgtcgcccacgatgtggctcaccgcgcggcgcatatcctcgccttcggcatatttgcgcgtatccccgtccgaataggcaagcacgacgccgttacggtcgtaaatgcttcccgcatcctttatattgttcttggccgcgatccttggattaaaaggcgtggtaaaccattggtcgccatacgccaccgtggaatacaaaagatacgatcccaaaaggacaaacaagcagcagaatacggcaagcatggcgcgcatattctttttgatgttggttttcttcttcattctaccgcgcctcccatctccgcaagctccgcttcctcgtattccccgtttttaagcgcaacgccttcaataatgccaagctgcatcatagacgcgaccatcgagcttccgcccgcgcttacgaaaggcatcgtgatacccgttaaggggatcagcttgatcacgccgccaatgatgataaagctctgcagcgacagcataaccgtcgcgccaaataccagcagcttatcgaacgtcgtgcgcgcatccatcgcgatcaaaataccgcgaatgatgaacacgaggtaaagcgcgatgatcgcgatcgccacgataatgccgaattcttctgaaatagcggcgaaaatataatccgacgttcctacggggatcacctccggcataccgagcccaagccccgtccccagcaaaccgccgctcgcgatcgccagcagcccctgcacgatctggtatcctttatcgttataggtcgcccacgggtcctgccagacctccacacgcgtttttacatggtcaaacatcttataggagagaaatgcgccgccagcgaaagcgccaagcgcgccgagcgtgatgcctatgctgcccgtcccgacataaaacacgatcaaaaacgtccctgcaaaaagcaacgccgcgcccaagtccttggaaagcaccaatatccctacgcatgcgatcgtaaatacaaaatacggccacatatcccgcttgcggtttttggatgccaggaaatatgctgtcacaatcaaaaacaatatttttgcgaattcgcttggctgtacgctgatcccgccgattttcagccagtttttcgcaccgccgatcgtacccgcaagcacgagtgtcagcgcaagcatgccgactgccaaaatcataaaaatataattgaccttaccaaaatcgtgcgctcgtttgatcaccagcatcacgaccaccatcgccacattgccgatcaatatccacatgaattgcttgagcgcggtatccggatcgagacggtacaaaatcaccatgctgatgatgcacaaaaagtccgcgatcagcagcgtaaaccgttcgaaatgcttgaacaccttgcgcaggatattatattgcaggataataaacacggcaaaaataacgcccaccagcgcgcactgcatatcaaacgtccctccggcaaaagaaagcagcagcattccggacagaaggaataatatcatgaatgtaagcacgagagccgcgccatatcttttaatgatcattgcctatcctcgttctcttgaaatagatgcgcatgctgatattcccaaaggagagcttgtcccctgttttcagcttgtgcgcattgaccgcgcggcggtcgttgatgcgcgtttctcctttgccctccggctggatataatactcgccgtcctgctggtagatcacggcgtgccgcggcgcaacgctcctgtccggcaacacgatatcacagttacccgcgctgccaatgctgttttcctgcgtcagcccaaaacggtcgccaacaaactcttccggtcccgctatgatctgcatatacccgtcaaactggccgacctgcgtcatgacctgttttttctgctggtattccttatgcgaaagatatatcaccgcaatgagtatgacgagcaccaaggcgataaaccaatagcgcatcgcatatgaggcgacctcaaaagcctgttccatactattctcctaaaatgctttgcttctgcttatttgacgcatatgcgcaacgaaatgttccctcttaatacctgctgctgcctacgagccttccccgcagcgctccataataccattgggcggccttggaaaacagccagtcgtacagcaggaaaatgagttcccccgccaccaggagcccccaccaaggcagttgcatagggaaaagcgcagtcagccatccatccgtaaagaaatacatgagcgccgcgcacacgttgaagtagatcagcttcataaccagcgcacccgctccccccctgctgccgtctatataaaatttaaagatgccgtaatgcccaaagaaaaaaaggtagggcagcatgccaagcttcaccggtacgattaaaaagccgataaacaaaacggcggcaaaagatacgaacgcactgaccgtcatacgttccatcataatccccataataaatacggatgatataaagtaaaatgtgatacgaagcgccggaagtacattcgcaagataaacgcacagcaatgtaagcgctgcgaacatgaccaccaggctccccttgccggagcttcgtttatatcctcttcccttgaccattctttatcctctaaatacagcagaacatgccgcgcccgcagcacaggctgaatcctgcgcacgcacaaatcgcgcacgggatacatgcttttccgctcatttgcacgccgccggccggcacgtctccaaagtccatatatgcgcctgtctgctgcgacattgcgcgcatcgcgttttcatattccttattccccggctccatctggtaggcgcgcgtaaagtgttccgccgcgccgtcataccatccccgccgcaggagcacgacccccatcaggaagtgccattccgccggacgctcgctcatccggccaagcatcgcttccgcctcgccgatcgcgccgcgctggattgccgcacgaacagccgcaaactccggcgtgccgctccattggtaatccccctgcctgatttttgtaaccatgtcgtaggccgcgtttacctgctttagtttctcactggccgcagcttgtttctgcggatcgcttgcgaagcggtccggatggtattttttaaccagcttccggtatgccgctttgatctcctcgtccgtggcgttttccgtaacgcccagcacctcgtatggattcatttatatcctttcaacttgcatatttatccttggttgcccgtttaccacgagctccgtctgttccttaagccccagatagatgatattttgcagcagttctttgttctttttcacttccagcctttggaaagcctgcgcggcctgtgcaaggcagtactgtaagctgcgcatgatttccccttttgccttcccgtcccgttttccgtacttacgcacgtaaacgttgtaatttccgtttttttcatcccgctcccagtcctctgccgcgtcgatcagatagacccaccgccccaggctgtatccaaggtcatgcagtatatgggactggagcacgtccgcattttcaaataccgccgccagaagctgcgcataagtatccgctacggcgtccgtattcgcgctcttttcctgctccagccgttcaagctctccaatcgtccgctctgccagggaaacaatctccggatgcttttgcgccgcgctgccgtatgcgctctttaaaagaaaccttgcaatccgtcctttttttccgtcgcggatgtcgtcgtttgctttgaaatatgccatcaggatattgatatccgccgcataacccgcttcttccgactctaccttgccgcgcttttggatcggatgaaaaccgcatttgcacggctgtatctccgttttttcgctgcataggctgtccgagagcagatacaaaaaaacgctgtcaaaattcagcaccgcacttcttttgtattcgcttccaagcgctttacataagccgcagtaatacgcccgaaacaactcatattcccgcactttgagctcacaaacctttggaacaatgtatccaaacatacggatattatatcatcaaaccccgtctgtttccatgcttcatacaaaaaaaggcttctaccgacgcgataaaagcccattttttaaattttattcatatttacagctttctcggcgcaaatccgatctttttctgtactttcaaaagtgtttttcttgcggcgcgcgaagccttttccgcattctgcgccatcgcctgctgcaggaacgccttatcaccgcgaatctgctcataccgtttttgcagaggctccaactccgcaatgaccgcgtccgctacgcgcgttttcagcatgccatatccttctcctgaaaattcctgctccgtctgtgcgatcgtttgccccgtgatcgcggaataaatggacaggaggttggaaacgcccggcttttcatccgcaaagcggatttctccatcactgtccgtaaccgcgcgctttaatttgcgcgtaatcacctccggcgggtcgagcagtgcaataaacgcattctcattctcatccgatttggacattttcttttccggctcctgcaaactcatgatctttgcccctgcctttggaatgtaaggctccggaatggtgaagatatcgccataaagattattcatgcgtatcgcgaggtcccgcgtcagctccaggtgctgcttctggtctacgcccacaggcacaaggtccgcctggtaaagcaggatatccgcagccatcaacgccggatatgtgaacaatcccgcgttaatattatctcccgcctttgcgctcttctctttaaactgtgtcatgcgcgaaagttcgcccatatacgtaaagcagttgagtatccatgccagttcggcatgctccggaacatgcgactgcatgtataagatgttcttttccggatctacgcctgcggcaatcagcagagacatgacgtcaagcgtacgcttgcgcagtgtcgccggatcctgccggaccgtgatcgcgtgcatatccacgacgcaataataacaatgatattcatcctgcagcgccgcccagttcctgacggctcccagatagttgcccagcgtcaggttacccgaaggctgtattccgctgaaaatcgtctttttttccatatcctgttccatctgctcagtcccccatgtggtgcaaaaatgtctccaccgccgcgatcagatcatccttttccacacacatatcgtgcagcagcggtttttcgcaaagctcgctgatttgcggcggaatgtgcgtccccgtcgcctgcgaaagtcttcttgcagcttcgaatgcatcctctacagtctcgcccgtaacacagcgcaaaacatcctgtgtgaacttatacggattcgctgtagacacgaccaccgtcactgtctcgtcgcccgtggcttgtctgtatttttcgtatacgcactgcgcgacagccgtatgcgtgtcgatcaggtaaccatatttttcaaaagtattcctgatagttgcgcccgtttccgcttcatccgcaaaatccgcgtaaaacaattcgtttaaccgctgtttcgcatcctccggaatgttatagacaccattattcttaagcgacgccatccactgcgaaaccaccacttcgtcgcgtcccgcaatttcatataacagccgctctaaattactggagatcagtatatccatagaaggcgacattgtcttgaaaaacgtgcggtttgcatcatattttccctggtggaaaaagtccgtgaggacgttattgtggttggacgcgcacaccagcttcccgataggcaggcccatgcgttttgcatagtaagccgcaaggatatttccaaaattccccgtcggcaccacaaaattaactttttgtcctttttctatctttccatcggccaggagctttgcatacgcataaatataatacgccacctgcgggatcagcctgccgatattgatcgagttcgcggacgaaaacgtatagcccgcttcttttaagatcttcttcaaatcttcattggcaaacagcgctttgacacccgtctgcgcatcgtcaaaattcccctgcacgccgcaaacgctcaaattgccgccttcctgcgtgaccatctgcagtttttgcatggtcgccacgccctctgcggggtaaaaaaccaggatcgccgtgcgcggtacatccttaaatccttcgagcgccgccttgcccgtatctccggacgttgccgtcaggatcagcacattctcctgctggtggtggatatccagccccacacgaatgaggcgcggaagcacctgcaacgccatatctttgaatgcaagcgtcggcccgtgcgaaagttccatcacatattccatttccgaaagctgcttgagcgggaccacccgcgtgtcgtcaaacgacatatatgcctgctgtgtcagcgttgccaaagtatcttcgcttatatcaaaaaaaagccccaataccttcgcggccagaatatcgtattcgtgcgccgcatattccttcatctcgtcgagattgatttgcggaaacgcctcaggtacaaacaagccgccatcggcggcgatccctttcagtacagccattgtcgccggaatcttgtctttctttccgcgcgtactcaaaacctgcatattccttctcctttaaaagcaaacgttaagccaagcgcattttatgcggctgacttaacgtaaaaattccattccaaatacgggggctgtttccccctgcaatagaccccttcttattgcctcagataatataaggctttaagaaatcaggtgcatcgcctgggtcagcgctgatgatgatcaccgctttgaagttattggcttcggaaagcgcgctgatcttatccatcaggcttttcaggtctgcaacatccatttttacgatttttaaaaacgcgtcgatgaatattgcttcgatatcgtagttctgtgataccatcccgcacaacattccatacagcgcgtcgcccgattcaatcccaaagtcttttacatccacaaaacgtgcctggtgtgccacgtcgtacatatagcgtttgtcgtcatcgatgaacacgacttcgccttttgtggagttcagttccgcgttcgcaaggtcgatcagtctttttgttttgccgctgccttttggtgcgtagattaattgtatcatggtaaagaccccctttgtttatagttacgttacgctttataatattataatatattacgattcttttatctacctgtaaaatgattatttttcaggtagtaagaaaaaggcgcatataggatgcgccctttgcctattactttttgatcagacttttgccttccatttccgcaggttgtggcaagcccatcaaatcaagcatcgtcggggcaagatccgccagtatcccgccgtcccgcagcgtatccgcccggtgcgcttctgacaccaggatgcatggcacaggattcgtgctgtgcgccgtaaacggaccgcccgtcttcgggtctatcatgatctcagcgtttccgtggtcggccgtaatgagcacgtcgccgcccacagagaggatcgcgtccacgaccttctttacgcattcgtccaccgccttaaccgccgataccgccgcgtcgaagatccctgtgtgccccaccatatcgcagttcgcgaagttgagaatcatcacgtcatatttttgggacttaacaagctctaccgctttctcgcaaacctgcggcgcgctcatttcgggttggagatcatacgtcgcaaccttgggcgacgggatcaggtaacggtcctcgccctcgttgggctgctctacgccgccgttaaagaaaaacgtgacgtgcgcatatttctccgtttccgcaatacgaaactgcttcttattgtttttcgcaagatactcgccaagcgtattctcgagcaactgtggtttataggccacgtggatgttcttgaacgttttatcgtattgtgtcatgctgacataatacgtcggaaaatattcacggtcgaatccgctaaaatcttcgtcaatgatgctacgcgtaatttcgcgcgcacggtccggacggaaattgaagaagatgacggaatcgtcttttttcagcctggccaccggctctccgttttgcgtgatcaccgtaggctttacaaactcgtcgtattccttcttgtcataggaatcctgcattgcctgttccgcatccggcgcattcaggccttcgccttttacgatcgcgtcatacgcaagctttacgcgttcccagcggttgtcgcggtccattgcatagtaacggcccatcaccgtcgcaattttgcccgcgccgatctctttaatcttcgcttccagttgcttaataaaaccttttccgctatccggcggaacgtcgcgcccatccatcaggcagtggataaatgttttgtcgccaatatcattgtccttcgcaagtttcaaaagagcatataagtgctcctgatggctgtgtacgccgccgtttgaaataaggcctatgagatgcagcgcgccgccatgctttttcacgttatccactgcatccaaaaattccttcttgctgaaaaaatcgccgtctgcaatggattttgtgatccttgttaactcctggtatacgatcctgcccgcgccgatgttgagatgtcctacttcggaatttcccatctggccgtccggcagcccgaccgacataccgcttgcgccgatttgcgtatgcggatattcttccatcagtttattcaagttcggcgttccttccgcgcaaattgcattgcctttgctgcacgcgtcaatgccaaacccatccattatgatcagtgctgtaaaactcattcgttattcacctgttttctttagtaatttacaacctttgaaaaatcctcagccttcagcgaagctccgccaatcaggccgccgtcgatgtcgctcatcgccatcaattcggatacattcttgggattcatgcttccgccatactgtattcttacctcgtcagcggcgttcccaaacacttcttttattgccgcacggatttctttaatggtattgtttgcgtcatcgctcgtcgccgtcttacccgtaccgatcgcccaaatcggttcataagcgacgactactttggcaacatcgccttccgctacgtccaggagcgccagcttcgtctgttttctgaccacttccgccgttacgccgctttcgcgttcctccagtttctcaccaacgcatacgatgggccttaaacctttttccaaagccttcttcactttcaggtttaccgtttcgtccgtttccgcataatattcgcggcgttctgagtgtccaatgatcacgtatttgacgccaagccctaaaagcatatccgcagatacctctcccgtatacgcgccggaatcgtgatagtccatgttctgcgcgcccagtgaaatgtcgcttccttcgagcgccttcgctgccgcggcaaggtccgttgccggcgggcaaacgacgacttcagcctgtgccgaagccaccaacggcttcagttcacctatcagagcggccgcctcgtcaggcgtcttgttcattttccagttccctgcaataattggttttctcatcgtttcattccccttaaaaatatgaatattttgaaaaggacggatgacatccgccctttttgacacctgttatgaatctttttatttatcgttcagtgccgctacgcccggcagctcttttccttcaagaaattccagggatgctccgccgcccgtagaaatatgcgacatcttgtccgcgtatcccagtttcttcactgccgccgcactgtcgccgccgccgataatcgtcgttgccgacgcttcgctgagcgcttccgcgatcgctttggtaccatttgcaaaagcaggaatttccgccacgcccatcggcccgttccaaataattgtcttggcgcgtttgatctcgttggcaaagatgatccgcgtcgaaggtccgatatcaagcgccatcatatcagccgggatattgtcgaccggaacgacatgcgcctgcgcctctgcgctgagttctttcgcaaccacgaaatcagacgggagcataattttgattccctttttgtttgcttggtccatcaggtcaagcgccagacccaaacgttcgtcgtccacaagggatttacccatttcatagccctgtgctttaacgaaggtgtttgccataccgccgccgatgatcagaccgtctacctttgtcagcagattttcgatcacaccaattttgtcggataccttagcgcctcccagaatcgcgataaacggccttgccggatcttccaatgccttgcccataaaggcaagctctttgccgatcaggtaacccgcaaccgccggaaggtattccgcaacgcccgccgtcgaagcgtgcgccctgtgcgccgtcccaaaagcatcgtttacaaaaatgtcaccgagacttgcaagctcttttgcaaagaccggatcgtttgcagtctcttctttatggaaacgcaggttttcaagcaatacgacctgcccgtcctcgattgaatccaccgcgtcccttgcttcctttcccacgcagtctttcgcgaatacgaccttggtattcagtatctcagagaggcgctttgctacaggcgccagtgaaaactccgcttttacctcgccctttggacgtccaaggtgtgacatcaagatgaccttagcccctttatcaatcaaatactgtatggtcggaagagccgcctgaatgcgcgtttcgtccgtaatttcacccttttcgttaagcggaacgttgaaatccacgcggacaagcgctttctttccggctacatcgatatcttcaatcgtttttttcataatgctactcctttaaatttgaataatcgcatacaaattcattttaatcaatttgcagccaataatcaagcacaagttacgattaatgcagctctccgcgcagtgtaagggctgcaatattagccgcatggtccgccaccctctcgcacattgtgataatatctgtgaagagcgtgctcgcgcttgccgtacattcgccctttttcagacgcttaatatgatgctttttgatcttctcttcgtatttgtcgatctcatcttcaatttccatcacgcgctttgcatattccaggttcccatcgcgcatcatatcgcgcatcatggaaaacgcttcctccagcttctttcccataaactcgacttccgccgctccccgtttggatatcttcgtctttttctccagacggatcgcggcaatatccgcgacattctgtgcgatatccgaaatacgctcgatatccatgatcgcatggagcatcgccgtcacagtgcgcgagtcgacctccgaaagaccagtctggctgatattagcgagcgcatccgtgatttcctggttcaggtagttgacgaccttttcattctcagcgacctcgtcaatcatcttttcgtcgccctgcagaaagctttgaagcgcgaggttgaagttctcaccggaaatgcgtgccatgcgcgccacctcgagtatcgcctggccgacggcaaccggctggctgtccgcatttttatcgatatatttcagctttcttccctcaagcctcttatcttcgccgcgcacgaaaaagcacgccaccttcgcaagaagctggggacagccaatgaaaataaatgcgttgattacattaaaaaacgtatggaagttcgccaactgacgtaccggttcatccggcgtccacgatttgatccagtcgacgatcggcaggaattgtatagccagcataaagatcagcgatccgaaaacattgaaaaacagaagcgcaatggccgtacgttttgccgttttggtacctgaaaggctggcaatgattgctgtgacgcacgtaccgatattaagtcctaaaatcacgtataccgcggaatcgagccccataacgccctgcatggcaaatgcctgtatgatccccatggtggcagatgaactttgtatgatcgccgtgactgcaagtccggccagaagtcccagccatggttgctggaaggatgccagcaaatctatgaaaggctggtaatccctgagcggcgcgaccgcgctcgacatgatctccatgccaaagagcaatatccccagtccgccgatgatctcgccgatgcgccgtaccgaacgttttttgacaaagagcatcatcagtacgccggcaaacagtaccaccggagcaaactgcgttacattgagcgccacgatctgtgccgtgatcgtcgtaccgatattcgcgccgatgcccacgttgatcgcctgtatcagcgacatcagtccggcgtttacaaatccgacgaccatgaccgtcgttgcagacgaactctggatcacggccgtaacgcccgcgccaagtcccagtgcgctgaacctgtttttggtcatcagctcgagtcccgtcctcagcttatcgcctgccgcagcctcaaggccgtcggacatcagcttcatgccgtaaaggaaaagacccagtccgccgaccagcatcaagatactccaaacatccataaacttcccccatcaatacttcaaatgttttaaattcttatgccaaggcgcaaaagcctatttcatacaaaagtaatcattctgtcgcagcgcctcgtaaacgcctgcgcataccgcattggaaagattgaggcacctctgtccattttgcatgggaatacgtaccgcgtgctctttgtttttatccaacaaggccttgggaagccccgctgtttcctttccgaacatcaaaaagcaattttcaccgtatgacgcttcattgaaattgcgggataccttagaagagaaataccagcactccgcctccggattctgtttgtaaaaatcatcgagactttcatacatatgcagctctagatccttccagtaatcgagccccgcacgctttacatgcttttcatcaagcgaaaaacccattggaccgatgatatgcagcgcgcttcccgtgaccacgcatgtacgtgaaatatttccggtattctgcggtatttccggctctagtaatacgacctgtattgccataaatttcctattcctatatcaaatctcaaaatatatccaatataattataaagtaaagttcacatatgtgcaacgagaaatccctgtaaacaggcaaaaaaaagagccgtccttcaggcagcccttcaaaccttgttattttccaaaaacaaacttatcaatcgcctgtgccacgccgccttcacagacatccgttgtcacataatccgatacttccatcgcctctttcatagcgttacccatcgcaacgccaacccccgctgtcctgatcatatccacatcgtttccgctgtcgccgatcgccatcgtttccgaaatatcaaacccgtaaaaatcggccagctttttaagcccgctccctttggatgtattaagcccattgaactcaagattggatttatcgcctcgtacaaccgagaacttatccttgaattgctctcccattgcatgcaattgcgggatatcgtcatcgctgcgcgcccagataagcaccttctggatcggctttccctcaagcgcggcaaaaacctcttcatcgttttccccaatatatgccggacaatcacccatataaccgaaatcccacctctccttcagcgccggaaaagcatcatccttcgtgtaatagatcaggttatccgccgaaacataccggctgagccgcgtgccacggaaggcttcaaaaacctcttttacattttccaccggtatatcgtccatgtaatacgtcttttcaaacgtcctgatatccgcgccattgattgaaatgaccggttccatgatctcaaacatctcgagccaacgccgcgtcaggttgaaaagcctgcctgttgcaagcgttaccttaacgcccgcttcctgtgcccgacgcacggcttcagcgtctaccggcgcagtctccgagttcgcgtctttcaccaacgtcccgtcgatatccattgccaacaattttattttctgcattcttcaacaaactccgcgattctctttagcgcttcttttaaattatccatcgacgaagcatacgagcagcgcatgaacccttcgcccgccgcgccgaacgccgtccccggaacgcatgccacgtgcttttcactgatcagcttatgacaaaactcctcggacatcattcccatgcctgaaatgttcggaaagacgtaaaacgccccccgtggctcaaagcacgaaagccccatcttcttaaatgaattatatacaaaagtcctgcggcggttgtaatccgccaccattttacctacctgcgcgaaatccgtgtccagctcatgccgcagcgcttcttctcctgcgtgttggctggccgtaggcgcgcacagcataaaatactggtgtatcttcaccatcgccgcgatcatatcctccggtcccgccgcatatccaaggcgaaaccccgtcatggcaaacgctttggagaacccgttgatcaccactgtcctcggatacatatccggaaaagaagcgatcgagcagtgcttgctgccataggtaagctccgaataaatttcatccgaaatcacgaacaaatcatatttttcaatgatacccgtaatcgcctcaagctgctcttttgtcatgatcgcgcctgtcgggttattgggatacggcaggatgatcgccttggtcttttcggtgaccgcatcctcaagtgcctgcggcgtaaccgtaaacgaatcgcactccttcgtttctatgggtaccgcaacgccgcccgcgaacgttacgccgggcatataggacacgtacgacggcgcggggaccagtatttcgtcccccggctcgatgaccgagcgaaaagctaggtcaagcgcctcactcgcgccgaccgtgaccattgtctgtgtcttccagtcatattttgcgccgtaccgctcgtctaaataccgcgcgatcagtttcctcagcgccggatttccgtggtttgaggtataatgcgtatatccgcgctcaatggatgagattgccgcttcccgcacgttccacggcgtcacaaaatccggttcgcccaccgaaagggaaataatatccttcatttcgctcgcgatgtcaaaaaatttccgtatgccggacggtggcatatcttccacagtttttgcaataaattttctcacggggtgaccaccaatctttcgtctgtttcatcccccacgaggatcacgccctgttccttatacttgcgcatgatgaacactgtcacagtgcgcgtcacgccgtcgatcaccgccagcttctcgaatacgaacttagaaatatctttcatgctgcggcttttaatgcgtacgcacagatcgtacgtccccgccatcaggtataccgctctcacttcgtcgaaacggtaaatccgcttcgcaagatcatcatagccgtaatcacgctgcggcgtcacttccacttcgatcagcgcttccgcgtcttcctcctcggaaacaagctcgcggttcacaagcgcgctgtattttacaattgcctgctgctcttccagtgcgtcgattgtctcttgtaccgtggcggcgtcgctcgaaagcatcatagcgatctcttccgccgtcgtttttgcgttatcttcaagaatatccagaatgtccagtttcaaatcccttttcatgacaacctccagaaaaacaataattaaaaatattgtaccatactctgccctaaaaaaaaaccgcgctttccgccgcggtttttctatgctgttttataatattcgttttatttcgctcataatatcacgtatataataaaaatataagtttttctaacgaattttaaattgcaaaagcaacatggagttgctataatagtttataaagagggggattgtcatgaaaaaaatattaattgtaattctgtgtatcttactagctatttctttaattgggtgcggaaataccgatgagtataaccagaaactatacgaatactacactaataatttagtactaagtgattcaattagccaaagtctgaaggcattcacaaattcctgttatgaactagatgttgccgacgtcgcattaagtgacttggaagcagacaaaatccttgaatcatcagccaaagtgaaggaaacaatttctacactatttgcttctcttaaggatccacccagtcaatgcaaggatgcatacgcaattgccgagcgcatttatgaggcacatttaggaatccagattactcaggagaatgcatataaggaagcgcctgcgggtcaggccatgacatatgttaacatcgcaacagactattttacagattatgtagatgccttaggcgaactccaagcctatttcaccgaaattggattcgagcccacatctaaggcagaagcatctcctgcaacaaaatgatttggttttataaattagatagacagtggtttagcagatataaaaaacgtgctgaaagcacgttttttatatctgctatttctcttttacattttctagcgtgtctctttttcgtttaagtccacagcatgcgcgcacagcgctgtatactttatgtgatccgcatctttgacgatgatctccagctcgttatcaccgaaagacgttgtgcgtccctccgcgtactgcctgtcgacctcgtctttgatcttttgcaccagagcggacttcttgtcgatcttgtggcttccctccaatttgaagtgcgcgtttacccagtgggcaatacccgcaagccccgaatgctcgccgatcacgaccgcaaccggccgtcccaatattttatccgtgttgaaaatattgtatatctgttcgtccttcaaaaggccatctgcgtggatgcctgcgcgcgtggagttgaagttcctgcccacaaacggtgtgcgcgggttgatatcgtatttcagttccttttcaaaataatccgcgatctctgtgatggcccgaagatccataccgtcctgcgtcccttttaattgtacgtattcaatcgccattgcctcgatcggacaatttcccgtccgctcgccgatgccgagcatcgagcagttgacggacgacgcgccgtaaagccacgctgtagcggcgttgcacacgaccttgtaaaaatcattgtgcccgtgccactcaagcaacgtggacggtacgttggcataaaaccgcagtccgtaaacgatgccctgcacgcttcgcggaagggaggcgccggggtatgttacgccgtaaccgagcgtatcacacatcctgatcttgatcgggatgcccgtctcctctctaagttccataagcgcacgcgcaaaaggcacgacaaacccatagaagtcggcacgcgtgatgtcctcgaagtggcagcgcgggacgatccccatatcgagcgcgtctttgaccacgcccaaatatttatccaaggcctgcccccgcgtcatacccattttgttaaaaatatggtaatccgagcaggacacaagaatccccgtttcgcgaatgcccatatccttcgcgagcgcaaaatcctttttgttggcacggatccacgtcgtgatctccggaaactcgtaaccgagcgccatgcactcttccagcgctttgcgatctttttccgtatatacaaaaaattcgctctggcggatgatccccttcgggccggaaagtttgtgcagcagcttatagagatccacgacctctttcaccgaaaaaggcgtacgcgcctgctgtccgtcgcggaacgtcgtatccgtgatccagatttcctctgggaagtgcataggcaccgtcctgtggttaaaggtgattttcggcacctggtcataatcgaacatatcctcaaacaggtttgcgtgcggcgtatcctgtaatgtatagttgtaatcattctcctgcaacaggttggttctcttgtatctgttgccgttatcagcctgcatatcttttctccatttccatatcagtcaagcatccctacaaattccgcgatgcgcccaattcctttttcaatgttttcacgcgagatcgcataggaaaggcgcacgaaatcatccgcgccaaaggctgcgcccggaataaccgccgtcagttttttctccaaaagcatctctgcaaaatcaagcgagctttcgattgtccgcccgtccagtctgcgtccttttacgcctgaaatgttgagcatcacgtaaaacgcccccatcggcgtgacgcaggaaagaccgtcgatctcacctatcagcttcaccatcagcttacgtcggatgtcgaactcctcgcgcatacgggcaatctcgtcacgcggccccgtaagtgctgcgatccccgcaaactgcgcgatcgaacaggggttcgaagtcgcgtggctctggtaactccccatgatcttcgcgatctgtgcgctgcttgccgtgtatccaatgcgccatcccgtcatcgcatacgtcttggaaagtccattgacaaggatcgtgcgtttatacgcgtcctcgctgagcgccgcgatgctcgtatgcttgtttccgtcataaacgagttcatcgtatatttcgtccgaaacgataaagaaatcgtgcttttccgcaatatccgcgatgtccccgagcgtcttttgagaataaatgcagccgcacggattggacggattattgacgatgatcgcctttgtcttgggagttaccgccgcttcgatatcttccttcagtggttcaaaattattgcattcctttgcatcgacataaacgggtacgccgtccgccatctttacaagctccggataagtcagccagtatggctggatgatgattacctcatcccccgggttgaggatcgcctggaacacattgaacagcgaatgctttgcgccgttgctgatcacaatctgtgtcgggtcatagttcagcccgtgttttttcagatccgcacagactgcttttttcaattccacagtaccggatgccggcgtgtattttgtcatgccgattttaaggccctcgatcgccgcctccttgatatgctgcggcgtatcaaaatccggttcgcccgccccaaagcctaccacgtcaaggccacgctttttcatatctttagccattgccgtgattttcagcgtgagcgacggcgaaattgcaagtgctttttcggaaagttgcattttatacctccagtataataacaattaaaatcttatttcaaagcatatcaatgctttcatattgcttggttagcatatctattctaatacaaaacgatggcgaaagcaataggtattccatgctggaaatgcaaattataaataaaaaattttcgttttagcattatctgtttttttcgcttgccagaagcttgcaagccccataaacaccttgattttctctgcatcgaaatgatacaataatagtgtattaatttgaaaaaataatagattggagacaaaacagatggcagattatgtaattacatgcagctccactgcggacctccctaccgaatttgcccgtgagcataatatcaccgtccttccttatcaatttttcatggatggaaaagaatattatgacgatcagggggtttcgatttccacacatgatttttatgaaaaagtacgcgcaggttccatgcccacgacttcgatggtcaatgcggaacgttatgtcgcttttttcactcctttcctcgaggcaggcaaagatgtcctgcatttggaattttcttccggcctgtccggttctttcgacaatgccgtcatggtatcggagcagttgatggaaaagtatcccggccgtacaattaaagtagtagattccctttccgcttcgcgcggttacgggctgttcgtacatcttgtcatgcttaaaaaggacgaaagcgcgaccctcgatgaagcctttgcttacgcagaatccctgaaatggaagatcacgcattggtttgcggtcgaaagcttagagcatctgcggcgcggtggccgcgtttcccgtgccagcgcattcctgggcaccatgctcaacatcaagccggtattggctttcaataatgaaggaaagatcattcccgtcgaaaagatccgtgggcgtaaaaaatccttgattgaaatggtcaataaaatggaagaggacgtcgacaatccggacggacagatcgtgtatatcggtcatggcgatgcgcctgaggatgcggaatatgtggctgagctcatccgcgaacggttccctatgatcaaagaaacgctcattaactatacaggccctgtgatcggcgcacattccggcccgggtacggtcaacatccactatattggtaagcagcgggtcgatacaaaattcaaataaaatgatatcgcaaaaagcacggaacgatttccgtgcttttttgatttactttgtttgttctttttttcttttcttataataggacatcaggtacgagtatccctctgtctcgatatcttcttccggcacaaaccgaatcgccgcgccattgatacaataacgcataccgccgcgttctctggggccgtcgtcaaatatatgtcccaaatgaaaatcccctccggcgctcctgacctctgtgcgtatcattccatgggaaaggtcctgtaattggataatacagtcctcgctgatcggccttgcaaagctgggccatccgcattccgatggaaacttatcaaacgatgtaaaaagcggctgccccgtggcggcatccacataaataccgtcgtcctctttttcccaatactcgcttgtaaatgggtgctctgtaccgttttcgcacattacataatactgttcctcgcttaagttgtgcctcaggtcatcttcggacggtctcacgtaattccttggctccttcgctctgataggttcccgcataattaaaggcctcctttccaatgtggcaatatcctctcggatttttatccaggtacttttgatggtattcttccgccgtataataatttttaagcggctgtatctccgttacgatcgggtcttcatatttttcctgttccttggcggcatacatgcggatttcttcttcgtccgactcgtcgatataataaatacccgtccggtactgttcccctatgtcgtttccctgcctattctctatcgttgggtcgactgcatagaaaaatagcttcaatacgtcccgcaaactaagtttttgctcatcataccgcaggcggatcacttctgcaaaaccttttcctccgcagcatacctgcatataactgggattttcggacgttccgttagcatatccggcttgcgtctcgagcacccctaccacacaatcaaaatatttttgtaatccccagaagcatcctccggcaagataaatttctttcatttgtttctttcctttcccgctggtgttctttatgctatatataaacgccctttcttactttaaaaaggaatgcgccgaatattaactttttttaaaggttccctgaaacatttgacacatgcgttgaataccgataaaatcttacatagaaatcagaggagagcatacatgaaaaagcttatttgtattttattggcgttggtcgtcacattttcctgtacgactgcttttgccgcgccggatacatccaaatcatataccgtcaatgtgacagtcgaaacggaaggaactggcagcgttaccggtggcggaacatattcagcaggcaaaaatgccgcccttaccgctacgcctgcggagggctatgtctttgccggatggttcaaggaaggcgatcttgaaaatccggtcagcaccgatcctgaatttacttattctctggaagaagaccgcaccttcgttgcgcggtttgataaaaaatatacggtgaccgtttcgtccgatccggagggcggcggcagcgtttcccagagcggcagcggcgagtatatgctggacgattccgttacagttacggcacaggcaaatgaaaattttacttttctcggctggtttgatgttgccgcttcttcagcagatcctgtcagtacagataccgcgtatacttttaatattcaaaacgacgtacagcttgccgcaaggttttctgcgacataccggctcgaccttaccgtaagtccggagtctaccggcagcgtatcgggcgggggcagcttctcaggcggtagtgtcgttaccattaccgcgacccccgcggatgggtaccgatttgcaggttggtatgatatcaattcccccggaaaaattatcagcaccgaagagagctataatctgaacctcgacgaaaacaggaccatcggagcgctttttgaacgcagctatggttatattatcatgtgggtgctgatttgggttggcattggctttgccgtgtttgtcatcgtaatgcgtactattcgccatatacgtatcgtgcggcgcagaaagcgcagaaactatagcaggcggccgcgccggtaagcatttaagtacctttagaaatagtgaaacggctgacgaaaacccgtcggccgtttttttataaactctccaaagcgcagcgcattttaagccggtcgcattttaatccaaaagcgcatacatattttgtattctgtgaccgaaagtgtgaccagcttttcttataatatgaagtaagaaaacaaaacaggagataccatgttatgaaaaacaacaagaactccagcaaacagaataaagcgatcatcatcgtttcgttgatactgtgtgttttaatatgcgtcagtccgctcgcattcagcacttccgcgcaggacaacaataataacgatacggtagaaatcaaagacgctcctacgccgctcgcggcagggaatgcccaaaatacaaatgcaggatccacaaatacgggttccgcaaatacaggcggtacggctgcgcaagtatccgagatcattacgactggccaggcgcaggtaacaacacctccgcctgcgaccaataacgataaccggacgacgcctgacgctgatgaacccaccaccacaccggacgcccctgttgtcgatcccgaccaacctgtcgatcccgaccagcctgttaatcccgatcagcccgttgatcccgaccagcccgttgatcccgaccagcctgttgatcccgaccagcccgttgatcccgaccagcccgttgatcccgaccagcctgttgatcccgatcagcctgttgatcccggcggcaccaacacggatattacgcttgcctatgcgcagcgcgtaatcgacggatatgatgcctgtaccacagatcaagagcggcaggaatactttgggatcaacaataataatttttccaacgacaccttccgcagcaaattgcaggaagtcatgggaagccccctctccctggaaaatggcgtagtcagccaaagttcttattgccaggggctgacgttgtacctgcatgtatattttgtaaaagacgggaacacaagggttcctgtcgtatatacgacaacaaccggcgcgtacgatggttccggcagatgggaggcatggatggtccatttcggcggcacatggtacgaaagccagaaaacgcatacatacaacggttcccaccagcctacgggcatctcctctttcaacagcatggatatctcaggcgttgaagcaatgctgaatgatcaggcacagttccttcccttaggcgtgatgcctgctgccgatacaaaggaagaagagccgcaggaagcacccatgatggtgatggcagcgctcgaaccggaagagccggttacagcagtagaagatccggaagcagtggcgacggaaacctctgaaacatcacaggagcagccgtctgatgagcaaacagcacaggttgctccacctgttattgatgcagaccaagaaataccaccggcagaagaacctgcactgatagaagaataaataacaatttttcactccggagagctttattctccggagtttttttatattctttattgacaataccacatatattattgaattataattcaatgaatggatgttcaatttgtgaataagcgaaacgaccaaaagcagcagcgccgcctgcagatcctgggagtagccctcgacctgttcattcgccgcggtttttccgccacaaaaatcagcgatatcgcgcacgccgccgatatgagcgtagggctcttattccattacttcccttccaaagaagcgttatatgaggaattgatcaaactcggcgcaatggtcctatcggtataatggacgaactcgccggccttccgcctttcacttttttcgaacgtgcctgtgaatacatttttgacgggatccgtcaggatatttttgtcgcaaaaatgtttgtacttatggatcaggcttttgccaatagccgctacaccctcgcatattcaaaaggccatacaacaaatcaattattatgaaaagtcagtaccgctgatcgaggccggacagcaggaaggcacgatccgctccggtaacccactcgccctttccgttgcatattggacggcaatacagggcagcgcgcaagccgtcgcgctttacggcatgccctgtcctgagagtgaatggattctcgatatcataaggagaaaagcatgaaaaaaatattgatcataggcggcgggatcgccggactttccgcaggtatttatgcccgccgcagtggctttgacgctgcgatcctcgaaatgcacaccatcccaggcggtaactcaacgagttggaagcgcaatggttttctgtttgaaggcggcctggctggtcggctcctcccccaatgcccctctccatcgtctatggacggagacaggcgcgcttagtgaagctacgcccgtttataaccgcgatccatttggatacatttttttcctttggcattgaagcggatttatccgccctgcccgaaaatctattgttttcattggccgagccgatcgattttgcgggcgaacgttttactttccttgggatcaacaattatgctaattttgaaggatatgcgcctgcgggcagcagcgcccttaccagcatattaatgggcgacagctatgattactggaaaaaggcaaagcaagacggcagttacacccaaaagaaaaaagaacttgcggagacggtgatggaccgtttaagcaaacagttcccccagatgcagggcaaattcgttacctgggatgtcgccaatccccttacttacgagcgttactgcgggacttataaaggctcttggatgactgtcatgaaggcaaataagccccaggcaaactatccgttgaaatcacagtctatatccggactgtattttgccggacaacgcatgcaggctcctggcggcgtacccgtcgccatatcgacaggcaggagcggcgtacaatatttatgcaaggatacaaataccatattcgaatgtgatgcctgatgcccctccaaacaaaacaaacccgcccgatagctatcaggcgggtttttccatgcaaagtaaaaagcccttaagcattatgcaaaaggacccctcacatagaatattattgaaaaatagaatccggcagctacctatcctcccacaccgttgccagtgcagtactttcggcgtataagggcttaacttctgtgttcggaatgggaacaggtggatccccttagctatcgccaccggaaattttataaactttttcaagaatgtaacgcatcgctaacgctctgcgggcattcgttgtggactcgccttaccttacggcttgctcatctcatactcacagccaagcacactcaaaactgtatagtaggtaggaaagacaaaggaatgtcttaagtca

SEQ ID NO: 9 - DNA, 155513 bp, Christensenella sp.
agtatatatgtggaaatttagtaatttattttttaattcctatctcctgcaatggatgcctctgctaaagtttttaaaaaacaaaacgataaataatatggaatcatttagacttcttacacaggagtatgcaaaattatggaacctatatttataaatcaatatattgtatctgaaaacgcaactccaaactatcattgcgcagcggcgcagggcaaaaacgaacctgcttcttcctacgaccgggaccggtcgggaaaaatagtacggggaatcggccttgtagccgccgggattctttctgttttctgttttattattgaagcatatgggcttatggtaattggcctgttgcttacggcagtatatatcttcaggatcttttttacaaagcgcgaacctgaaagcaattttaaaaaagtctcctctgtcactcccctcaatgaattgaaatggattcgcatcgtgaaattttacgaaacgcaaatcaaggtcgaggatcccaaatatggcggtaagtaccagtataataatattgccagacgcagcgaagatcctttatactgcacggtatggtttacagaccacaccagcatccgcattttaaaaaacggttttatttccgggaattatactgatttcgggatatttatcgaccgtatcatattgacaaacaaaggaaatggataaatgggtatcttttctaaaaaattaaaacgaaaggcagagcccgaggcggatttggaaactcccggcccggcaacggacggcatagggcctgccccaatggacgcaatcagccaaaatgaatttgacgagaatggttaccgctttgatatcaatacgccggttgacggaaccgcagatttaaatcaggaaatactcaaataccgttcttcggacggccaatatcaatttgtattggctttatatgcaaattatcctgacttaaaagcgaattttgaaggcacttatggggaaatccccgatattatttataacctgtttttgctggatgaaagctatgcgtataaaatttggaaatggttattggtaacgtttcattcaattttaacctctcccgccaattcatacaggctgataagcggtcccttatatgcattgtccaggcggcaggctttttttgaatattttttgccctgtttgaaatcagatgtggaattttcaggaatcctttttcgggaatctacgtatgtcgacaagcgccatgccctcatactggctgcctgcattgaaaaacaggaatatgctcttttccaggagttaatggcgttccttaaggaaaaccctcatttagggcgcgagaatgcggcgacctttgaaaatattttgcaaacaattttggaagaaatcccgtccccgactgtcaatcatgattcctatgcccttctgtcgggttacattaagcaaagcgcaaagcccatgctgcgcaaaattttatttaaggttttagacagcaagatggaatatttattgaaagaggaagcgcgtgaaaaagctgaaaaggagcgcgccaagcgtcttgaggagcagggcctccagcatcaaaatgatatagcgttccggttgaacttaagaaatacaaaattgaaataccacgaattaaaacttgcctgcatttcgcaaagaaaaaaagaaccttattgggaaaacggccgtttcattgatttccaggcgcttgccggcacaatgattgccctgaaggagcgcatcgagatattggattcccttttgccgggggaccgggtggaattggtccgcgaaccttataatataaaagacccagcctctatttccgtccaggatgagtcaggcgtaaagctcggttatatctccaaccaggcaaatacgctcctctccttcatcatggattccggcaaggaactctttggaagaatctattcgctgggaaaggagccgggttccgatattgtccaaatatgtattgaaatatttatgaaaaagcctgatggggccgaggcggtataaatacgtaccaattgtttccactatccttgatcgatagttcatggtcatatcttcattggttaaaaacaggaaaaagcgcggatcgtccgcgctttttcccataaataataagttccgtacgtaggtaaaagaacttatctcagcagtgtcagaacattctgcggcagggagttcgcctgcgccagcatcgccgtcgccgcctgcgacaggatgttgttcttcgtgaacgtcgtcatctcggacgccatatccacgtcgcggatacggctttccgctgcgctcaggttctccgaagataccttcaggttggcaatcttgtgatccagcctgttctgcatagcacccagcgtcgccctctggtcggacaccttgttgatcgcgttacgcaccgccgtgatggcagaacccgcgctatcctgcgtcttgaggttctggtcatccagcttcaggcccgccgtattcatcgaatcgatggatactgcaagctgttcgccttccagtgcgccaacctggatgcggatcgcgttgaacgcatcgtcatctacattaaccggcctaaatccggtaacatctacttttgcgccttcgatgatgatcgcgttgcccttcgcgtcgatgcccagcgccgtgtcgtcatcggtagctttgagtcctttcgcgatgtccgcaaccgtgtcgccctcctggaacgtatattcgtataccttaccgtttacgtccagaaccaccacatcgtcctgcttcatcttcacaacgtcaaactcgatcgtattaatttcgttggcgccggaagccgccgtgaagtttacatccgtatcacctgtgcccgcagttttctgcgttaccgtaaaggaaccttcgtcaacctcaacgatgtccacattcgccgacgcggtagcagcggtctcaaggttcgcaacaaaatcagaggtattatccgtcgcgccgttccattcaacgcctacgttcgtgcctgtcgctgttccgccagtttcgataacttcatatacgttgccgtcgatctcgaatgtatcgccatacttaagtttcgtgaggtctaccgtcgccgtttcttcctgcgctactgcatcggcagaggcgtctgttccctccgtgacagtaacctccgttgtaagttcagtgctgtcattctttacctcaacatcggctgtaatcgaggttacacccgcatcatcagccgtcaacgtaaccacaccggtagtatcatccacgctgatcgaatatccgttaaccgtagcgccttttaccgcattataaagattcgtaccactaaggtcagcgccggttgcttccgccaagtctattgtgttggttccgccatccacggaaatcgtgagttttgtaccatcagatacgtttacgccgctcaaatcaatctcaatctttgcctgtgtcgctggtgtcgacggcgctttataacctgtcgtaatttccgacgtaatcgcgtctcccttcaccgattccatcgtggttacggtgttgttgatgcctgccgtcgcatagctgcgctccggcccgttgtacgaaagggaaccgtccagaaccttcatgttgttgaacgtcgtctgctccgcgatgtcgttgatctcacgtttcaactggtcaaattcctttgccagcgcgttccggtcgaggtcttcgttcgtgcccgtcgccgcctgcaccgcaagctcgttcatcctctgcagcatggagtgcgtttcctgcagcgcgccctctgccgtctgtaccagcgagatagcgtcctgcgagttcttcgtcgccatgttcaggccgcggatctggctgcgcattttctcggaaatggcaaggcccgccgcgtcgtcgcccgcacggttgatgcggtaaccggacgaaagcttctctgcgctcttggatacgttgtcgttgttgatggtgtactggcggtgcgtgttcatcgccataatgttgttttgaattctcatcgtaaatacctcctgtattcggtttgatttacccatgcggacagaattcggtatccgccgggcatcgggcctcttttttccgctgtctctgcgaaagcccttttgcgggaacaataatgtgccgtttcaaacgccgggtgacgtcccccgccgtttcataccctgcactttttcaagcaaataagaagcgcagtcacactacatttgtttcctctatatcctatatcgcagcttattaaaaaaactttagcggttttcataaaaatttattgtcagaataaaaatcttttgggagggctgaaaaatcccccattgcacagcgattaaaagaaaaaaccaatccactcccggattggtttttggctcttctgtcaagttgtaccgctgcgtttttattttccccgcatcctgtttactgtatgttactgcgctggagccgctacaatcgcaatttccgtatttcctgcttttgcatggtcaataaccgcctgcgccaatttaccaaaattgccatacgaggtagtcgcaccggcgattgcgtcaatcgcatccgcctgctgcttttccaaaaattgtttcgcataatttctggtatattgattgggataggttcccgcatttgcatccatcacccgcatataattcatatcccaggatttaataaacccgcttgcattccgcgcgttatattctgccgaaacaaattttcccccacgtacaaaaacagtcaggtattccttccacccattgttgtattcggccatttccgccgtatagtatccgtccctcagcgcgtcggagctttgtgagcaaccggtaaggcatacagtccccacgcatatcactatcattgccaatataaccgttacaattctacaatttctctttcccatagcttcctcactttcttagcctgaaccggttcgccattttttggagcgagtccgcctgatcggtaagcgtcttgcttgcctgtgcgctttcttcgctggacaatacgttttgctgcgccagcccattgatggaagcaatttggtcggtgatggcttgaagcgatttcttttcgctctctaccgcattctccagctgaatcgtaatatccgatatttcttttgtgatctcgtaaatatcctgcatggatttcgccatctcaacagcgaaaccggatccttcgtccacgacttcctgcgattttcggatcatctcggttgtcttacgggaagattcgccgcttttggccgcaagatcccttacttctgtcgccacaacggcaaaaccagccccagcatccccggcatgcgccgcttcgacggatgcgttcagcgcgagaacgtttgtctggaaggaaatatcctcaaggaatttgctgatcttagtgatctcctccgagctattcccaatcgcctccattgcgttcagcatatcgtccattttatgcttgccgatatccagccgttccattgctttatgcataagctcattgacattatccgtatgcttacttacttcgttgatgttttgggaaattaattgcgtttcgcgttcaagttcattcagggaatcggcctggccggttgaactttcacggacattcagtgcattttccgacaccagatgcgatgtatcggaaacctgaacggctgctctttgaatcgctttcataatttgattcaggaagtctacaatctggttcagcgaatctttcatgacaatgaaatctccacagaaattcccattcaccacaacatccaagttgctttttgagagttcatccaaaaccctcgacagctcggacgtataaccgttgatactgtcaacagtatcattgagcgcacgggacagcgtttccgtctcgtctttcgtctgttcaacatcgaccggcgaatgtaaatccccgctggaaagctggtcgattcttccagtcacgcggctaaggggccgcttaatacgcctggccagccatagggttggcaggatcgatagccccagcaggataattgtaaaaataacactcgtcaggatcgccttgtttgtcgcagccataaagtcgctttgcggagcagtaattcccagactccagtgcgttccgcgtaccggggaatagctgaaatattgatgatcgtaaaatccgccgactccccgggaaccggtctgccccactaccatctcattgaatatgctgtcaatagcctcgttgtttccataattatcgaatattgttctttgctccttgaccatattcacatcctggtgtccgacaaattcccctgcttcattgataataaaagccgttccattcgcaccgatgttgatgttgctcagtacatcattcaacacgtcatacttatagcttccgacaaggtaataaacaacttggtcctctttggtaatcggagtgccaataataatttgaagttcatcgccgctggcctccgtatcgctgatcacgaggtttttagtttccttcatattcgtataaaactcacctgtgatgtttgcgggactgtttccgctcccggtatacaactgcccgtttgcgtcatagagggcaagccatccaaattcaattcccgattgcgcataatccaaaacgccctgcttatcctcgagggtggtctcgtcgctggtgagcgccgcattatcggcaatcataaaaatcctgtctgccatcatatgcagattgccttcaatattttgcgaggcgacttttgccgttggctgcaggatatcaagtaaaatggtattggttaaatccgccataaagtaagacataaccgccaccaaggtaatagataccaccaataaaacaataatggtatgaataacgatttttttgctgatactcgttttttgcccgtcggcgtgccgggatatccggctgctttgtttttttgtttttttcaatattttatgctttgccattgtttcctgctccggatgattcattttttatgtctatttaaatactatcggaatattttctagaatatttagctgttttctatatttttgaaaaaaattgtaaagcaaaacccctgctgggatgcaggaggaataccgctgcggagccttgccctgtcaatatgcagtaaggatggccggtttccaaagtcaaaaaaggcgatatgggccggcaaataccattacccttttgcgtatttccggtcctgccgaccatccaattatttagcggacttcacatgttgcgccagccgtttatcttctgtgcgtatatgcgtaaccagtatccccgctgcttcatttacctttccaacagaagaaatatttgccccatttgctgtcaagtcattggttacttgcgccatcttttgtttatacccttcgtggaatcttttgtgcgccggataatctgggtatttgctttctacctgcaggcgttcttcgtcggaaaaatgtttccctacataattatttaagaactggatcgtgctctgtatttgcgcgcgcccttttccttgcgaacaagcgtccagcaaattattaatcgcctggaaaagttgcctgtgctcgctatcaattaatgtattccccgtttctagatcctttgttacttcgtatgccattttttacctctccttttaaaaaatttattgatttttatataataagtcttttcacagtgttcaagcgcaatatcctacgcatttaccccctgtttttatttcattgaaaagctgccaaaattataaagttacaaattcccgaaaggctgctctgttcatgctttttgccattcttttgcaattttaactcctaggttattctatcgtatactttcgtaaaaagtttaatccgacgaatacttttcgctccttatttcttacttaaaaaacaaaaaaatttgtagtttacgcttaagttttttttaatattgacgataatataaatagataattaaagtcacactctaaggagggccttaaaatgataggaatttcttcaacatatgatttcagcagtattggaaacgtcgggctatacgcctccaatatcgtaaaaaattatatggcggcatcaaactcatcttctgccttgccgcaggataattcgtttgcttctgttacgaataatgctgtgaaaaacacgactgcgttcgccagccaaaacattgcaaaccttcgtctgctgaaatcagcaagcaacgagctgaacagcgctgcacgcggtttaggttcttattcatccgggcaagacttagtcacggccgcgcaaacttttgcttcggcatacaataaaacagtctcgttcctgacatcagggcttgccgatggcgagggcgtctcaaaggcgttaaacctggtagcagataatcgaatgacagagttatccatgacgaattacggtacatatgccgcccgccgcttatccacgctcggcatgtcaattgacgaagatgggatgatgtcaattgacgcacaaaagcttgccgatgccgctgcaaaaagcccggccaatgtaaaatcaatgctgaccggatatggcagtattacggaagtgacccagagtaatgctgccgaggctatgcggataccagccgcaacatataccgatttcagcaacatgaaggtttcagacagcgtgattgatatgttgttgcccaaaactgggtttttgtttgatttctcgctgtaaattaaagacttggtttagttttcatttttgctaaactaaccttattgaataaacaaataccagctgaaaaacagctggtatttgtttattctgtgattttaaaaacaaaatgtcacttctcgttttggtcttgttttgcgttcttttttaagtttgccagatcgatcaggtttacgttgacatttgccgccgcctgattttccaaaactactttttttatcgtctcataccggaacacccgcatacttttgggcgcttcaatccccagtttgatacgatcagaatcaacgctcagtacggtcactttaatatcatctccgatgagaaccgcctcattcgcctttctcgtcaataccaacactggaatccaccccctcttcctgatgataatacttttgtaatgcttcaaatgcggggaaacgaatgggaagggttttataatccatcatcatttgagcgccgaccatttctttaatattgattagcagcggagccataaggttggccgtcatttttgtaatatcttccggtattaccataatactgagcaccactaagtcttcttccttatgggtctcaattaaatccaaatcatcgtcgtccacttcaatttcataatccggctttaatataaacggattgacgattggaattgcaatatccttgtcatccaggctttgcagccattgtatcggctctgtttgatcacagcgtataattgcataccgatccagcttctcaaatccaggtaaaccaccgacaaagcggataatgctattcttattaatctctatttcgccaaagcgtgttgattcaatcttcacattaaaatcctttcaacttttgtcaaatctttttatcaactttcttaccgctggtctttggtaaattattttcatttacgctgattttaacatcggcatggtttcgcagatgaatttccacagaatggggagtgaccgttatatccggcataaattcatcctcccatataatttccacatcacccggttcccattcaattttaatacttccttctgtccactgaacacttggcgatggcactcctgtagatatccccacctctgggacagaatttaacatctgttcgtatgcccagtccccgattgggctttgcgccgtattgaaatagttttcaagctgggccatataattgccgttcgcagtcatattctgtacggcttcatttacaatttggcgcgctaattgccgcgtatactgcaaaaaatgctccggtgagcgtaccccacggttagcccagacctgtttccagtcaactttgatctgtggcatctgccgctctacatgcatctgtggccgtgttgttttaaccctaaaactcctgcggacatgattctggatgtttagttgagctctcgttgtatgaatatcaagcgcagcgcggctggaatgaatatcaagggtcttcatacaactctccttcctttttattatatcataaaaactaattcagaaaatccattaacgtgggctggataatcattgctccggttgccagagcttgtttataaatagtttcacaatatttcatatccataattacttttgcctggtcgatatcttctacatccgaacgggcagcttcataactaattgcatccagcgaatagcggtttttcatggtctcaagctttgtcgttctcgtaccacattccaccatacaggtaataaggcggtcctgaacgtttgtcaatgaagtcaaatatgtagaaatctcttcatttggcgctccgctgttcaggtcattgactaaattaatcagtacattaaacatattgtcctctcccgttccgaccacgtcaatgcctgtaaatgaaacatcgaaatacatgttatatccaatttcaaactggatatcctgtgtgtgttcttccccatatgcagacgtgacaaattcagcgcttccgatcaattgagccaattcttcagggcttgcgggggtacccgtccaactgacgatgccgaggccttccgtcgtaagattgatctcccccgcagcaatgtctgcagcagttaactgtctgtgcgcaacttcgcttccatgtgaattgtagaatgttatcgtatcctgatcaacttcaattctatatttctcatttcctttgatctcacccttccattgcaaagatgcatccgcgcgttcccccattactgcagtgctcggtgtagtaatggagcctgccgacgcgattgcttctgcaacttcatttgcagttgcagctatcgggtcggaattgtcccaagtgatgattcccagtccttccgcagataaatcgatttttccgtcttggatttcctgcgcgctaatcgtatgggttacttgattcccgtctgtgcccgtaaatgttaaagtatctcccgctgcgctaagcgaatatttttggaaatctgtcatgctgccggaccactggaaattcgaagcatgatccgtattagcaatctcgtttccaaggatgaccgcatccccagacaacgtgagatcatacccattatacattacgccggtcagctttcccgcaccatcacgtatggcctgaaaaggcgcgtttgttgtgttgaacccggcaaacatatgtttattcccaaccacgccgttgcatgtttcaagcagatgctccatcaattcttctatttgcgtagcaatattccttttgtcgtctgcgttggtaacaccggctgcttccgtggttaattccttaatactaacaatcgtttgttccatgtcattgacggcattttctgtctgtactacccatttatttgccgccgttacattcttctggtactggttcagtcttcttatttgttgccttgcccccaaactattgaacacgccgaccggatcatctgaaagattaacgattctcctgttgcttgaaagctggctattatatttactaacacgccccaatccggcattcagattcgttagcaggttatctatcatcatagaattggtaattctcatatatggttcctcccttttctcttacggatcaacttcattggttacgccctgccaacaagtcccattttattaatcaaattatcgagttcttcgtcaattgccgatataacccttgaggcagcattgtaagcatgcccaaaccggatcacatcggtcatttcctcatcaagggatacatcgcttatcgaacgcctttgctgctccaaatgatttaccataacagcctgcccctggtatgtgctgtgtatatgatccatttcaacgctgatattgttcagtatatttttataatatccatcaatgctgtcatcatttccggattcatttttcttattaattaatccgcacatctccagcgcaattttaccatttcccttttgttcgttttcactaccacccgccgataccttcatatccgatgccgctatattatagacgtcattcataatatcgtcgctgattcggaaattctgcgcggtaatcctgctataatccttttcgccgttttcatccatcggtacgtggaagaaatctatgcccgttttgctttccgcgttattgccattcggtatcgtatagcctttctcatgaatttcattcatatcggctgcaatcttctggcataatccgtttagctggtcaattacgtaaggaataccaatcgaagtcttggaattgccgtcacgaatgtccatatatcctttcaacgaaccacccgtaattcctacctcgctggtggttggatttccctggctgtcctcccaataaactccatataacttctgtccgccttctatggggttttctatattatccactgtagccatctgcttatagtcagcgtgacgcactaaatttttaccgtcaacctgtacgattagctgaccgttggtgtcttcaaaagtctcaatgtctatgaggccggacagggtatccagaagtgcattcctctggtcgcgcaaatcatttgctttggcgccggaaagctcaaacccgtatatctgttcattgagctgggcaatttccctggcaatcgaatttatttcggcaacggttatccgtacgctttcatttaaagtatcctgttgtccaactaaatctgtaaaataattattgagcgtatcggtcattacaatcgctttttgctgcacatttaaacgaatcgctttatcttccggctgctcctgcagttcatacagcgcatcataaaaatccgaaaatattgcggaaattccggtcgacgtttcaattgcatccaattcattgttaaacaaagcttcaacatattcaaaatattgttctttcgtctgccatttcgatgtagccgaattttctttgcgaaactgataatccagaaacggattccggatttgttcaacgcaaattgtcgtaacaccacgccctgaggttcccttgatgtccgtcgcaatcaagctggtaccaattgctggcggcaacgacgctatgctcagtctttgccgcgtatatccttttgtatctacattggaaatattatgccccgaaacatcaagctgattctggctgataaacaaaccagtcttagcaatttctaatccataaaatgttgatctcatattgtctcacctcatacctgattatcaataatcgctcggttttctgtatcgtcattcggaatctcgccagaactgccgtatatattgctgacctgcggttccttcagcactatattgaccatataatccatatactccaaatgtaaatcaatcaagcccttattttcgttgttgattttcttttgtgctgcaatcagtgccttaagttcccctgcaacctctttcagcacaccgttttcaccttcggctgcatatcgctccatatccgacaatgagacgttttcgttcggatccgcatcattttctattaaaattttgcgtgtaatccgaattctttcttcttccaaatttgagatttcagacagtaattcccattcctgttttacaatttcacttaccgcctgtatatccccatcaataatcgcctgctttttttgcaatgaaatatcaaatattttctggtagatattttttaaattttgcaggttgtcaatcaacttctttaccatttgcaactcctaaacatacatcagaattgcatcggccacctggtcttcatatacaacataggacctattccgaacatcataacgcatttgttcaatattcgaagctgccgggttggcatccgtttcttccaaaactgtttttgccttattaaatatttcagcaaaggaaactgcttcgtctgaaatatcgatatggtcttgcggcgcctcagtaatattgggggcaacatttctgttgattgtattatagtattgtttaattccataaactgaatttgtggcatctattttcatatctgctgctccttttatctacgcttggagatatctacgtgcaatccatccgacctgtcggatttcaaaccataagacgccttctttttcggcgcaggtttactttgattcggcagcacgcttcccagagcccgggataatgactccgaacatttcctgcacagccgcccactcttgataggagtcccgcatttctcgcacgcaagggatccatccgctacaatcatttccagtcgcccgtcccgcaggaaatgcaagatcagcttttcttcaattcctgtttcattcgatatctctgcaacggaagctccttgattcttatataaatattccttgattattgtaaacttttcttccctgtctttcatacagcgcgggcattcattccccccagtcgattggaagatcgtaccgcaatgtttgcattgcttatattggagtgccatagcttatccctccctccatttgtcagcctcttatagaatttgccgtaccatccatttcatctgctgtcgataatgccctggatgataactgcatagccctgcttgctcgtattaattttgaaaattcatccgccagattcacgttggaaccttccactactttttgaatcacagtagtttccgtatcggctgcctgcgccactcccgaggaagcggaaacagcatatagattgtccgttaccgcaagtaacccctcctggtttggaaaagtaaataatccgagcttcgcataagcgggattgtctgttccattcgataaatatccctcaggggaaatatctaattccgttccttccagacgaattttccgtccatcctgatcaagaacatagtacccttgggaagttaccagatactccccatctgcttcagagcttctttggaaactgccatcccgggtataataggtctgcccttccggcgtttgcaccatgaagaatccttccccctccagataacaattcgtatcgatccctgtttcgatatactgcccctgtttaaaaagccttgtagagcctgaaaccaacgttccatgccccttcagcatatttagttcatcctgcggctgttctacacgttgcatattctggtataaggcatctttaaaatccgtacgcgacgctttaaaaccgtttgtattaacgtttgcaagattatttgcaattgtatccaaacgttgctgctgggatgcaatcccaagagccgccgtataagttccctgcatcatactcgttactccttaaaatcttcctatatcatttacggttttcgacagtgattcatctaccattttcaatatcctttgattgctttcatataatctattggttgtcagcatctcggccatttcacgtccaatatccaaattggacccttccagagtattctgcaccacatttggattctgcataacagcgggattctcaccattataagcataataaaggttatccccagcttttcgcagaacgccgttatcattaaattgtacgatccgcagccttcccacattttgtccctgaacaaatatagcgccgctgctgttgactgtaaactctccggttccgacgttaattcgttcgccatttgtgcctaaaacataatacccttcttgtgtcagcaacatcccatttgcatcaacctgaaaatttccgcttctggtataacgaactccttccggtgtttgaacacagaaaaagccgtctcccgctattgccatgtcggtttgtatatccgttacttccatggggccctgcgtaaagtcaacaacaagttcatctacatatacgccggtattctgatcgccaacgtaagtcgtctgattcagaatagagggatcgttcaaacgatccagcaacaggtcttcaaaagaccgggatatcacctggtcctttttatatccggtcgtatcgacattcgtaatattattaataataacatccattttagaacgctgtgtcagcatacctgtgccggcgatataaaaacttcttaacatattgtcctcccgttaagcaactctacatatattatcggagattcttataaaaactttagccgtgtcgaaatatcactttccggaaagctttataataaaacgcacttcactccgggatatcctgtatttctctgcgatttcatcttcagctttcccgttccgataacattccatgattttttcatgaagaccttcgtctttccaggcagcttcgctttccggcctctcttcctcctgcttgctgccgctctctatacgttctcttttgctgggatccagtgtgcttttcaggtgtatattatccgacagagcctccagcttttctgttttcaatctgatcgtttcatccgtatggccaatgtattctttcagggaattcaacatatcttccacttcaaaatacaatagcatcacctttttttcctgttcttcaagtgcggattgatcctttccatttttagaattacctttttggttccctctgaaaataaagaataatacagcaactgccactcccattccaaaaatcataaacgcgaacaaaaaatattctattcccatgtgctttgtttcctccattaaatattgatgtcaattgaacttcccaagccttctttggcttcaaattccgcttccggcctgtcttcggctgctttctcatcccctgtttccctgtgcgcatcctgcatagtccgggaattttggttgtcctgcccttccttttccctgcgtatgcgcttttgctccgtttcttctgtttggctgacagtcttgtcattatgttccatctgcgctttttccatctccgcgatgaaatcttttgcctgctggacattgctgttttggtcggtcagctgcttggtataatcaatagacttatttatcataatttggctgtcaattccgcgtatcataatttttccgccctttcgtataagttcaccggtcacttttccggaatgaagcggcatgccgctgtcagaacgtcctttttatccttatagtaagtcacgtattcattgtcatacgggacgacataacaaacttttccccaaaaaattttcacacccttataaattgtttccagtacgtgtacattgccgtcttttgctccttttatcagttcttccaattctgttttctcctgctccaaccgctttttttcttcttttattttcgacagggaaataacgagttccagccgcgcttttccgaccatatttgaattctggttgtttaatgccaggtttatcctttcgatactggtggataacgcattgatttccggctccagctcgcctaagcgctggcgttttttggcaaacgtaccaatgtggatttctgtttgtatcccggcgtcagagccaattcttttggcaacaacatatttcccggcgctgacttttccgccgattaaccgtccccggccgccagatacatctacatatccctcgctaacgacagtgctgttaacgattgttcccgcagttacgtttccttcggcagtaattttcatccgttcaataaataaagctgatatgttcccttttgcggttgcctcaccgcggtccgcccccttgatgcctccctttgctataatattcccgccgctttcaagcgtggcggcttcaacgaatccgtggactataatatcccctgaacttttaatcataaagccctggttaacgtttcctttaattacgatatctccatcaaattcgatgttaccaacagacatatcaacatcgccctcaatggttacgttaggcaaaacggtaattcttcctccacggatcgtcacctctccgtctatggctgaaaaaatttctgtcttgtctttagagatacgaacattcttgccaaccttgggcaatatagcttctttccccttcaccgcaggcaactttttcccgcaaacatcggtcccatccatgccatgcgtagcaagaatgcgttttaccaatatctgcccgctggtcaccttttcaaaagtcagcatatttttaaagtctgcccgtcccttttcatcgtaggtaatttttccgcctgaatttttatgattgaaataatattccagggctccgtcttccccgcgttcaggttcacggccagttgcaatcaaaaattttttgtcatatagtttcctgtcaaaaatttcatttagcctctcttcatcgatcccataaccgacatggtgtttttgccctaaaatgacctttgcatcttctttggaaagcgtttttcctcccacatccggcggcaataaggtcaggtaagccttcatttggtcggcagagagttccacacataattcctcatccaaaattacctcgtcctgcttccctgcaattttttcttccgcgtgccgtatgttggaaaccatttcactgatgacgttgaaataaggattctctatttttttgcgcttaatatattgaatcatctgatgtggattcatttcgtttttgtcaacggctgggggatcgattgcaagatacaccccgtcttcccggtaatagagcctgcacccattgttctttgcaggcgctcctaattctccttgcttccttgccatgtcaatttttcccattttcactacgctccgtctatgaagttatttgtcaagctactcctgatatttcttttcatacatatcagcaattttatgaattgccgacctgtgtatctgtgaaatacgcgactcagttaaatccattatgtgggctatgtcttttaccttaagctccttaacataatataaatccaaaacaatccgctcgttttcaggaagtgttcgcagcaattcaaccagttcctcatgcgtctctttgcgcagtatgctttcttccggtgtctgtccagcactagatttctgatgtctcagcaaatccggttccggatttacaaactcggaacggtaggttacttcattgataatatcttcaaagtgcagcaggctgtattgatagtcgttaaaaaagattttttttacttttcctggcgaaacacccagccgcttcgccacttcttcgtactccggaggccgctgaagttcaagaatcaggtcatcgtaagcttgctttacttgtttgatttcttttcgcatattgttaggaatccaatcttgttgccgcatataatcgagaatcgcgccgcggatcctgcgctgggcatacgtctcgaatttaatattgcgttcgggatcgaatttttgcactgcatccattaagcccaggactccattgctaactaggtcatcgtagtcacgaaaggtcgtctggtacagcggagacatcctgagaacgattgcctttaccaagtataggtaattctcaacaatttgattcctgttttctacggttggatctttaatgtatgcgccccataactccttaggctctctttcatttttctttatcaaccagttttacctccgctgataccccatgtgtttcttccctgttcacttcctttttgcagcctgctgcatatagatatattttctgatatcttttttcatatactccggcagggctacaaaccttacgccaaccttgaacatcatattgccggtattcgggggaatgacacgtacgatttctcccgttaggaggtgccgttgccccccgagtataacctcaaaataaaaaacttctccgcacggataggcattcctggaaaggaaacctaatcccgtatccgaaatatcaacgctatataatctttgttttttctcctcatccggttcgatgagatataaatcaaatgactgttttaaacgaaatgattccctgcgttcatttttaacaggcgcttccgacaggacaatacgtgtcatggagattccatcaataaaattttctttatgtttgacctccgctttcaagaaataaacgctcgtgtccatgaggtagatcgcttcgatcttcttcccagccataccagctttttcaagttcattggatatattgagcacccaaactgaatcgcctgaaattttttcgacttttgtctctatttttccggtttgcgtcaatactatgagcaaacctccaacttttaaatgttgtttcttatccagcattacggttccctcttcctttgattagccgtaaaataaaatttttcaatccgccttcttttttctccgggtgcgaatttgtaattctatttgcgatttgctggaattggaatgctacggcgcttcccggatattttacgatatacggaaccatagcggtgatcgcctgtggaacccttgaatcaaaaggtataaatccaagcatatcgacattgcattttaaatatctatggactacattcgaaaaattgtgaaaagtttccactgcctctttctcggaagccgctttatttataacagccgttacattgccgaccggcatctcttcactggctgttttcaatacgacatagctgtccaaaatagatgtgggctccggcgtcgtgataagaattgcctgatcgctggcgtgaatcatcttcataatattgtcattcattccggcgccggtatcaaaaatgatatagtccatttcccgttcaaggatgcccaattgttcaattattttttccatttgatcgtcgcgcattttcacgagttccgataccccggaccccccggaaatataccaaacattctgatagcactcttccattacatcttccagccgtttttcaccgcgtactatatgttcaagtgtgtatttcgcatttttccccagcataatgttcacattggaaaacccaaaatcgccgtctatgataatcactttttttccgcattttgccagcgcaagggcgaagttaaccgaaaagcatgttttccccacgccccccttgccgcttgtaacgcaaaaaatatttgcttttttagcggaatgattgaactctgacttttttttgcctaatgatgcttgttttgcaacggcgtcacgcaaggttctttcttgttcgctcatactactttcccaatactgtttttactatttctgcggtgtctactattctgatatcatccggaacattttgtcctaccgaaacataggaaagaggcattccgctcattttggcaatatagaaaaacactccccgataggcagtttcatcgattttcgtaacaatcacgttgtacttttggagaaatttatagttctcaattgttttctccaaaacccgcgttgaggttgaagccgaaagcgtgacataaatatcgtcaatctttccgctccccacaattttctcaatatctttgcggtagccaagatcatccgacaccttaccggctgtatcaatcaaaattacatctttatcctgaaatgctttgatggcatccgaaatttcatccggtttatatacggtcagcaggtctgtttgcaggatttcacaatatgctttcaaatgttcctgtgcggctacgcggaaggaatccgtattgatgacgccgacattcagcttttcctgatacaccagcatataggccagcttcaccaatgtcgttgtcttgccgaccccagtcggccctaccagcataattaccctctgtttatattttgtatgctcgatcggccgtggtttccctaacatatctttgagtaaactggcggcgacgtcaccggcgcttgcctttcgattcaccactaccgcctcggtctgcgcgcagatctccgcggcgattccttcatcaatgtcattttttaccaagtttcggtaaatagccataacgtttcttgaataccttttttcgaccggactttccgcatggcctacgcgctccgaaagtttggcgatcattccttttaactcgtccaggcttccagccaattccgtatcatttggcgcggaaactccagtgtaatcagctacaggatgccgttcctgagacagcatactttgaaaattaggtttcaccggcttgtattcttcataccctgccaccacttcgaattctttttttgagaacaaacccaaaatcccttttttcttattgacctgtttactgctcatgataactgcatccggtccaatttcgtctttgataatttccattgcctgcgccatgttgtccgcacggaatttcttgaatttcatcttttcttcctcttctttcaaaatttacaatcctattacgccatccgagaaaacttctacattgttttccagttcgttatatgacagcacaatcaaatcaggaatcatcgtactcgttatatttttaaattgtcgtctaaccaaaggcgaggtcagtacaataggagttattcccaattgattcattttttctatcatttcctgcagatgcccataaatcctttgtagttcatcctgcgaaagggctacataggttccctgctccgtctgctttgtcttctctgcaattaggttttccagagctgggtcaagcgtgattaccctcgccttatcgctggggacaaaacgcttcgatatagcacgccgtaaacttttacgcgtatattcagttaagagatccgtatcgcgcacaactttaccacaatccgccaacgtctctactatcgtccccatatccctgattggaatattctcatccagcaggttgctcaataccttttgaatttcacccagtgaaaagagctttggaatcgcttcttccaccaaagccggttgtgtcgctttcaagttgtccaccagcgtctgcacctgctggcgtgtcagcagttcggaagcatgccgcttgatcgtttctgtcaggtgggtcgcaatcactgacggcgcgtccactgtcgtataacctagaagctcggccttttcccgttcgctttcaggaacccagaccgccggcagtccaaatgtaggctcgactgtatcaatcccctggatttttcctttcacttcgtttgtgctcagtgcaagaacatgatccagcatgacctcgcctttcgccacttcaacgcctttgatctttattacatactcatttgttccaagttggatattatcccgtatcctgataaccggaacaataattccaaggtcaatcgcacattgcctgcgaatcataataaccctttcaagcaagtctccgccctggctggtatccactaggggaatcaacccatatcccagttcaattcctattaactccacttgcagcagggaagtgacattttccggctttcttttttcttttgccgcggcaatcgctttgtcttcctcaatttttggctgtatggtctttttatcggctcgaatcagcaccaggccgatcgcaataaccagcccggcaataataaacatgggcgccttgggcaggcctggaataaaactgatacatatcagcatgactccaagtatcaaaaaaatgtatggctggttggtaaactgattgatgaggtcgcgtcccaggttatctttcgatgctgatctggttacgataataccggttgccgtcgataccatcaacgctggaatttggctcacaaggccatcgcctatcgttgcaatggtatatgtttgtaaaatctcatcaaaaggtactccctcgccggacatagagccaataatcagtcctccgacaatattaatgacagtaataagtatgccgacaatggcatctcccttaacaaatttactggaaccatccatagcgccatagaaatctgcttcgcgcgcaattttttcgcgccgttcttttgcctgctgctcattgatcaggcctgaattcagatcggcatcaatcgccatttgttttccgggcatggcatccagcgtaaaccgtgccgatacttccgcaacacgctccgctccttttgtaatgacgacaaactgtataacaataatgatgaggaatataataattccaacaataaaattacctccggttgcaaagcttccgaatgcctcaatcacgctgcctgcgtttccaccgttccctaaaatcagccgtgtagaagcaatatttaaccccagccggaacagtgttaaaatcaataacaaagatggaaacgcagcaaagtcaagcgcttcatgcacataaagcgtcatcatcagtacaagtaaggaaaccgatatattaattaccagcaaaacatccaacatagtggggggcagcggtaatataataagtaatacaacgattaaaactacgcctgcaattaacgtatcttttactttcatcccaaacctctatttaccgggataccgtttttatttccgtcggcatcagccatgcttttttttgtatacctgggcgagaatctcagctacaacctgatacatctcaacaggtatctgttcgccaatttcacacattacatataagctgcgtgccaaaggcttattttcaaccatttcaattttgtgttccgccgcaatttctttaattttctgggcaatcatatctttccctttggccaccacgattggagcgctgcttttttcttcgtcatatcgcaacgcaattgcataatgtgtcgggttcgtaataattacatctgcatccggaacatcctgcatcatgcgcatcatagccatctgccgctgtttctgccggattttccctttgatttgaggatctccttcctgctgcttcatctccatacgcacctcatattttgtcatcatgaggtctttctcatattttctccgctgaaacataaaatccaacagtgcaattgccgaaagaaacagcataatcttaaatccggcgttaaaaattaattccgcaacctccagaatcgtagaggtcaggctgggtgacaacatcatggaaaacgccggtaaatccgcctgaatttccgtataaatgacaacgccgatcactactatcttcaggattgctttcaggagttcaaataacgttctccctgaaaacatccgtttaaatccttccgcaatattaaggcggctcattttaggttccagagcttttgtgctaaacaaaaatcctgtctgtataatattaagcaataccgcccccagcaccgctattgccaagatgggcaacatgatttgcaggaagccaaatatcatttcccgcatcacagggccaatgttatctgcattgagcacttcatttgtcaggtattgccccgacagaaacgacgcggaaaaattcatgatgttttctgcaatcatcggcgttaaaactttcagtgcgccaaacataatgaataacgagccggtcattaccagctccatactcttagatacctgtccgcgttcccttgcgtcttgccgtcgtttgggggtagcgctttcggtcttttcaccagtactgttgtcagccatacgttatctatcctgtcagtgtcgcaaacatttgttccaatcccgcaaacatctgttcaaataattgcggcatataattcacatataccggtatcagggcaagaagcacgagaaaaccaagtataatctttaccggtattccgatagaaaaagcgttcatctgtggaaccatccgcatcagaatgccaaaacacgcctcccccaacagtccagctcctatgatcggcatggccacaatagcagcgagtaggaatacttcaacaaatagttggagcgccacccagccgatttgtggattaaacgtcgcgcctccaatgggaatctgttcaatcgtcagcaccataatctgcagcaactgctcataccccctgactgcaaaaaaaacgagcagcatgataatattcaggaaattcccaatcattggtatactcaggttgctttgaacgtcaaaaacattgaccatgccaaaccccatttgcatatcaatcatttgacccgcagtaaaggccagcatctgaaaaaacaggttcaatacataggccagcacgacaccaaacaacaattccttgacgcatactagaataaagaggagaatgtcccctccataatcaaatgcggccatctgttcggtgatttggggggcagacataaagaacaatacggcaatgcaggaacaataaccaatctttacaatattgggaatattcgttctgccaaaaatcggagatgaaaaaaacaaccccgaaatccgtaaaaacaggagcaaaaagaactcccaattattgataaaggtatcaaaaaaatctatcatacgcgtttagctctttaagtaatcatgactgcatattcataaattctgcctgcaaattctgtcaggttgttcagcatcatccctccaaaaatcaacagtgccactaagattccgatgatcttagggacaaatgtcagagtctgttcgttaatttgtgtcgcggcttggaaaatcgatatgatgataccgattaccaaaccgattagtatcggaggcaaagcaactgttaaaatcgtactaattgcatcctgcattacagtaatgatcgttgcctgatcgattttgaccactccctcgttgtatagtattgaaaactgttatattcccggctatgtgaacgtattgaaggttgccaaaagcgtttgcatcgtcagcgtccacccgtcaaccaaaataaataataatactttgaatggcaacgagatcacaatcggcggcagcatcatcatacccatagccataagcgtgctggataccaccatatcaatcacaataaatgggatatatataaagaagccaatcataaacccccgttttagctcgctggtaataaatgcgggcataattgttgtaatcggaacctcgtcaatagattcaacatccgttacattggaaaattccatgaacatattcaggtcttctttataggtctgcatcaacatgaagtcacggatcggttcttccgctgcatcagccgcttcttcaaacgtaatttcctgcgcgacatagggatcgatcgcttctgttttaatctgcccgaacactggagacataatgaaaaatgttaaaaacagcgccaatccaatcataacctgatttggaggcatctgctgcagccccagtgcatttcgcgtgaacgacaaaacgattacaattcttgtaaatcctgtaaacatcaacaaaattgatggcgcgattgcaagaattgtaagaagacctacgatctgcaagctggttgaccggcttccaaccagttgggcaataggaccgcctcccgagtccaccgtatccccttcttctgtctgagtagcggaacatccggaaaaaacaatcaataccgccaacaaaacgacaattaaaataaccagttttgctgctgtttttttcttcaatctcatatactccttagtgatatctggatgccgtttctttattttttctcattttcctgttcctctaatttctgtcttagctccgcatcaaaggataccgtttttttattttttctcatgctttttggcaaatagctctccaaaacaattttcatacactttttaaatcgttccgcaaaagttccctgttttgtatccttcccgaattcttcggactgttcatccgtcggttcgcccggcaatggttcaacggttctatcagtcgctgtttccccgacaacatcagccgctatgtcaacggaatcgatgcattttatgtcctgcgcagttgtgccgattaagtaatgcctgcctttgaattcaacaaccatgattgttttatcccggtcaatcgcaattctgtcaacaaccgctaccaaatgtccaagttcggcattcttcttacctgctcccctacccgttgaagagtttttgcttctcattccttttcgaagggatttcctggcaataaatctggtcagaaaatatgccgcgataataataagtaccagatataggatgatcaacagtacattggaaacatcgattccgggcgcaaacgctactttactttcgtctatcattcacattacccgtctctgcccttataacgacatgcgcatgacttcgttgtaggcatccagtactttattgcgaatctggataaccatattaagcgaaagctccgctttcgttccgtcaatcatgaccttggcaatgtcgtctacttcgcctgacagtaatgcctgggttccctcttgcgaaatagtctgcaaatcatctgcctgcctaaccgcatcagataacatattctggaaactggcattccctgtttccggttcattagcggttttaaccggtactttatttgcctgataaatttcagatggtgatataattgatgtaatattgctcattttccattgttcctccggttactttccaatttcaagggcattcatcgccatacttttcgtagaattcaaaaccgtgatattcgcctcataagaacgcgtcgcggacatcatatctaccatttcccgcgctaaatctacatttggcatacgcacatacccaaactcatcggcgtccggatgtgtcggattataatccaacttgaatgcagatgtatcttccagtatttctgttacacgcactccgcttccggcatttcccgccaaggattgattgagctgttcggaaaaagacgccttttctttttcctgaaaaattacatatctgcgccgatagggttctccctccgctgttcttgtcgtgttgatgttcgctacattttccgccactacatccattctgagtctctgggctgtcagggccgaacctgaaatatcgagtgaagataaaaaagccatatgtttccctccttactgtcctttgatcgccatacgcaattgtgtaaattgaccattgattttccgcatcaaagtattatagtaaatcacattttttgcaaaatcagtcatttcctgatcgatatccacattatttccatccatcctgtatgttgtgtcagctttgggaacaacgaccccctgcaccccctccgcatcacccgtcccgccgatgggcatatgggtttcgcgggtctgtttaaattgaaaatcatcgtcgccaagcgcttgtttgtatagttcctcaaattctactccggaagctttaaagtccggagtatcgttatttgctacattgtttaaaatcgtttcattcctgagccaagaggccgcaataccgttttccagtccttttaagctatcgaacattcccatttatatcgcctccttaaaactgcaatgcactttttgcttattgttcaaaatcccctggcatctggaacgatgaaagttccagatggtgatctattaccgataccaagtgcccgatttccggttttgaaagctgctcatccgcgccaatttctttccctttgatccgcatctcgtcgttgatcagcgatgaaaaaataataaccgggatcgtctttaaaaactgatcggtttttgttaatttcgtcagatgatgaccatccatctgcggcatctcaatatccgtaatcatacaggccactttttccctgacgggagtattttgctcttcgcattctttcttcacagacgttaaatagtcccaggcttcttttccattatcttttttcacagtatttgtatagcctgctttatgcagcgcttccaatatcattgatgaaagcagcatcgaatcttccacaatcaatatcggcctttcatcccgcgggcgttcccccatttcttcgatttcagataattgaatccccgtctcgggagcaatatccgcaacgatcttttcaaaatccagtatggtaatcaaacggttctcaaactcggccagtccggtaacaatcccttcttgtccgccgtaaatcgttttgtccggcttttggatcgcctgccacgaaatccggtcgattccttccaccgtatccactcgaaaagcaatatgcatattgttaaaattagctactatgaataaatctttagaactttcgtgttcgctttccatgtccaaataccgcggcagattaatgacggtaattagaatattgcgcggtttaaacacgccctcgattgccggatggacatgtggcatgggttttacttccgccgaattcataatctcccggatttttgcgacattaattccaaatgtattatttgaaatggtaaattccataatctcaatttcatttgttcctgtttccaaaaggatctcttgtttattttcccggctcatttttttctccttactcatccttatcgtttgcgtaacagccaaaattattatccatttatatttttcagatatgttccaaacgcgccgtcttcgcgtttaatatggtttaacagccacatacctaccttagaattcaatttgcctacaagcgctatggaagcgccggcagtacgatattctttaatcaactcgttaaccgtcagcttgaaattctcgtgataattcttatgttttaccctctccggataattatattgcgcgtgcattttctcttcatctccaaaatgtttcgcaatgtaattattgagaaaattaagcattttttcgatttcctgccgacccgttccttttgcacatgcgtcagccaaccggttcatagcctcgaatatttccctgtgctgtgaatcgattacagcgatccctgtttccagatcttttgtaaaaacatatgccatatcttttccctccgatcatgcctgtgttttttcactcattgccgacaagttttcccatgtttcattcatcatgtctacgcattcaaaatatttttgcgagataatgttaacaggtattcccaattcttcagcattatttgacataccgatccagttaccttgttcatagtacaagaccagactgtatagcaaccctgccctaccctcctgtttcagcaaagcatctatgatacactctgagatactcaactctttcagcgcttccgcaagcggaacatcaaggagagagcccagcgttgagaacatacccatgaggtatgcttctgattttgaaatcggcatatcctttgcaagcggtaaaagttcggcgcaaaagtttgctctcataaacgatatttttataaattctgacggaagttcgctgtccggctgaaaactaagtaaataaatccattgtcgaagttgccccagacccaaaatcaccagcgcctgctgaaccgattctactttattgcgcaaggcaaaataagaagaatttaccagtttcaaaagcgcatatgtcaatgtaacatcgcgcgaaatcaaattctcgatttcattgaagtcaacttcatcctttgtgatcgctatcattaattggaaaaagttgctctgaagatgctgcatccgatgtactttttccggaagaatcgtaccaatatagctgccctgcatatattggacgcctattttttttgcgagatcatacgtctctatatcctcgatattataagctacaatctcttttcccagtcccttcgctatttcagctacactttctttcggaacagacttccgcttgaaattcagcttgattatgtcaatgttgtccagcgcagaaaggtacctgccgttgaactcaaaacctttcaacgcaatcttataattctgcttgcgatacttctggatcagcttcattgcaagcgggttcagcaatacgtcctcttcaatctggatcacaagtttctcagcatcaaatatttgcggcacattacgaaacagcaatcccggcgtaaaattaatgtaggcggtttttccttccaaaaatccgtcgtctttaaactgcatcagaagggtttcgattgcattcgccgcagcagagtcctccacaagattatttccaccttcttctacatataaaatctcatatgcacacaggtcattcttcacatcatgtatgggctgcttaacgatataagattgtgtttgcattgtcggtcactccctttctattcaaacttctgtttccagtcccgcataacgcagaacgcggtctacataatcccttaccgattggggaattgtcaggtattcggtgctggaactgctcgtaacattccgctttgcaatatttccaggtccggtattataggcggccagggcaagcttcagatcgccattataggtttttaaatgccgagcaatttcgtcaacgccgcagaatatattttgccgcggatcaaacggatccgtaactccatattcttcagcattttccggcataatctggatcaaccccattgctcccgcacttgaaacacaatccgggttgtagtcggattcagctttgataacccccataattacattcactggaatcccataggcttccgatgcatcttcaataatatccatatagggcgcagctttttccaacatgccatcgccagtatcaaccgccgctgtatattgtccgctgcttccataggcattcagtacttccggtatcccgcatttactgcaataccggcctgttgatgcaatatttcccgaagacaaatattcgttgccaaggcttcccgttgcagccgccgttgacgattccgtattattatcctgattcagcgtttgatttaaaattgattggaacatagcatttttcgatgaagctatgctgtcaatccttgtctgtatttccgctacgcgcgcttgtacgctttctattcccacgtatatcttcccctttaccgctttttcctgtaaattgacggttgcacatactcaaaatttgtatggtgtttaagcaaggtttccgacagtcctataaacaaataccccccgggcataagtgcatcataaaaccgctgcgttaatttattgatcgtattggcatcaaaatatatcattacattcctgcaaaatataatatggaacttccttttaaaccggaaaacaggttccattaagttaaatttgcggaaaataatttcctgtttaattttaggttttacttcaaattcatctccgccaagatgcttgaaatatgctttttgccaattcggaggcattctcgtcatgcggtcgtcatgatagactcctttttgcgcaatattaagcactttatccgaaatatccgtcgccaatatccgcttgtccagatccgttcgccttccctggaaatattcatccagaaacatcgcgatcgtatatggttcttcaccggaagagcagcccgcgctccaaatattgaggttgccatcccgaatcgttggcaatatctcattgagggcaacctttttcatgaattcaatatgttgttcttcacggtaaaaatatgtgaaattcgttgtcagctttgttacaaccaaagacaggtcttcccctgtcttatccttttccaaatgatcaataaattctgtaaagctcttaaagcctttctctgataacgcattggaaagccgcccctcaatcagagtttttttctcactcagattgatgccaaatttcccatacatgaaatctcttaatctgcaaaattctctctcatttaaatccattgcgcccgcctttaaagatacatatcgacgagtaatccccggatatcgtcgatatcatccagtaaatctatattttccttttcttcagtcaggagttttctggtcatactgtccagtttttcattgacagttttaatcatcgcaaaaattttactcctgccgtttatcccaatttttccttccttgtgaaaagcaaacccattgctaaccgtttcatggagcaactgggtaatcatctccctatacttttgcatctcgcccatgtcggcacgctcagccagacgcttgccctgagcttcaatcgttcgcaccaattcgcgtatctgtctttcatacacggattttgactccgcagtgagcttgcttctaaaaataagctctgtttcagggaaattaacattttcgtcaatatcatttcttgataacgactcaatgggcatattgttgacattttgtatcttcatggaatcatttgcctatctcagtttatttaatatagtgccttccggttcatacatctgcgtatttctatatgctcccagcgtttcccggctttgcttattggacctcattttccctttatattgctcaatggcatcttccatctttcttttatttctcttttctatctcatcaatttgtttcagaagctcatggcatagccattcctgttttttctccgcctccgttatttcactgtcttgaagtgtatgaagcagatcggcgacttcggatatttggggaataagtatgctgcgtttttcaacatccctcgccatttgtgggtacgcttcatcgatattttcgatcgtatttaaacactcctcaatatgttctgtcagcgctaaaaactcttgcaaatatgtcgcattttgtttccacagcgtaacccggtctttcatacaagatctcctcattcttcgttttgcgtatatatatcgctttctgctttcaccttaatctcattccatgcttcatacagtgatgtcatcatctcgatcaccggatcaacccgttccatatctttggtaatatttgcctgcacaatttcatccagcatgaactggtaaagttccaacaggttctccgatatggatattgaaagatttaaactaccaactaattcgaggataatatcttccgccttttggaaacattcggatactttatcaagttcattgttttctttgtgaattttcgctaatttaagctgctttatgcagccttcatacagcataataattaaatcaatcgggctggccatcgtaatataatcgcgtttatactgatcctgcaaattagccgttgcgtaaaaagccatactatccaccttctttcaaaagagctaaggaggcacgcatttatgaacgcgcctccctcatgctgcgctttgttacaacgcagacaactgctgcgtgagccacgtactttgtgactggtattccgacaggagcgtttccatctgcgcatattggatatacaggcgctcctgttcctcatacattttcgcaattagattgttcatcgaatcattggtatcatctatttgcttatttgtattcttcaggttttgtccttgaatcgtgcttttgaaatcagacatctggtcgaaaagccgcgaaaccagccccgactcctggtactccgtcaaatcatcaacggcatctgaggttcccgccattacctttgcgacagcatcaggatccttctgcaacatctcccggaatttatcttcatcaaaagtaatttgccctccgtattgcccctgggagtacttgctggtattaaagccgatatcataagcggaaagaccgctcccctcgactaccgaaaagaaattggaccgcaatttagacaatagatttttaatggtattgtcattcctcagaatcccttttttggcttcagtttcccatttttcaatatcctcctgggataaatccgctttctcatcctgggttaacggagaataatcataatccatttcttcggtggtaagcgcatacaactcctgggtgagcttattatattcgctgacaaattgggttactttttcaacaacctgatcgatgtcctgttcgaccgtgaaagttgccggtcccaaattgtccctgttattctctgcatcaaaatccgccttcaaggtaaattgtatgccgtccagcgtgaacgtattcgaggactgtgaaatcgtttcgccatcaatcacgattgttgcatcgctgccacgtgcctctccttccgcgacaccaaagaaagaatccgcgccgccaaacgcattggctccgtccttgtttccaactgtgacgaccgcatttcttccggtttcgctgcttgtaaagacaaacgaatccgtgatttggctatacgtcagttttgcctttgcatcttcgttgctgttcacctcgttcatcattgtctgcaatgaatccgtggccttaaaagaaaaatccacaccgttgactgtaaagctgaatttaccatccttatccagttgaaggtcaattcccatttttgcagcggccgtagcaatcgtatctgtgctgcggtctattgtctgatactttgtcgtggtatcctcaataattcctgtaaccccgtcttcaccaaagaaattgcttccgtcgatatttttggttgttatttccgttccgctgccggttacatcgctgcgcagcataaatctgtctttatcctggtcatacgtcatagtgactttcgcatcaggatcatcattcacagtatcaagaacgtcttttagtgtagtgttctgatcaaaccggaattcttttccgttgattgagaaggatacgcttccatctgtaccgccgagctttttgcctgtagcctcggcaatttcggccaaagtcatatcttcattgatgagacttttgggcgtaattgaagtatccttaattccaaacgctccattttttccgaacacatccgggccggcaacattcttaaattccaattttgtctcggcgcctttcactttgctttcaaagtgaatttttccatcggcaacggacatcttcgctttggcggatgcggaatcgttcacctcccggataacatccgatagggtttcatcctggtcaaatgtaaaggtagtgccattcacagagaacgataccctgtccgatgaactgctgaaatcaaacaccttggttccatccgcatattctaaatcgctgagtttttccatttcccagtcagcctgtaattctttcgttccggtaactgacgccagcgagttggcattagacacccctgtcagccccgcaacgcggttcctgtacttggctccttctatcgtcgcatactccgccagggttgcctttgtaatttcgtgccgggaattcatggcgtttgaagtaccggaaatactgaaataagtatcatatttatcggaaatactgattttataagctttataaacactggaagagaaaatattattttcgcttagctggctcataaatttagatgtaaactcattaatttttttgtttacatccgtataggcatcgcgcttccattccagctttgtcctgttttgatacaagcggtcgagctgcgactgctttgactgcaatgcctgttgaatcagggaatctgtatcaaaccccgatgacaaccccgtgattctcgttgtggtgtatccattaattgaactaatcgccatattgtacacatcctttcactgttttccagataaaaactatatagccgcctatcaatttctatcggaaaaaacctcgaaaactttagcttttccatcctcttccgcaattaaatgtggacaaaatattccacttctttcagcctttcttggccatacgaatcagttgcataaccatagttgatcagctgccgtcctgcctgagcaatcgccacccccttatcaggattatatccgccgtcgatcgacgggctaaccacttgcaaatgaccgtgcccatttcgatttttccaagaagtgaccgccggcattccctggtttgcataatactgcgcttcttcggcagtgacctttttccatccatatttcgccccataggtattaagccaatcattcacgtcgttggctgtttgctcgctgattccagctcctccggcctgggcaggctctcctgtgctttcatacacataatgtggtatttcagcccccatagcccgcgtcacatcccacgcaaaaatattgcagtaggtatcgcttccattgacttttccgacgcggtagcgctcattattttcaacgtgaaactgatcaatcaccgctcgataggtctccgcattcctatttcccacatggtttgtcaggggcggattggacgctatccatgaggaagaaggaattccctgcgcagctgtatttgcatacgcatcaacaaaattatgttggcaattcgaattgccatgcgccccgaccgcgcttgccaaactggtagtgccactttgttgtccctgctgcgccagaagcataagcatcagcagcataaacattgtatcgccgccgcccatgcttccgcttccgaacaactgtgatgttccccccatccccataattccatccatataggaactactggcgccatccgaaaaattcccaatggagcctgcggataagcccatatacgtttttaacaattcgccaaatacattgctgctttctgagcttccagtattctgggctgaattcaattgtgaaaatgaaccaattccattcacaaaatcaagtggcatttcaacttctcctccaatcaaatctggatatcaattcccgctatcgcgacagcgccattaccagattccaagttctccattacattcaagggcgtaaccggattttctatcatgcgaaccgttatattttccatatcaaattcattctcacgcatcatttgcttaaaatcctgtattgaatccataaacagtcgctttaccttgctattctccacacgaaattctaccgacaactttccttcatccgaatggagcacggtttcaacccgtcccatatattccgtatcgagaccgaccaatattgtaacttttcccttttcttcatacttttgtccgggttttcgctttaaaacataaagctccgccgtattcttttgtccctggttttcaaacggaatttgacagtaataaaactgttccatcctgccggcaatctgcgtttgcgttacaatcgtttctgccttctgcattgcaggggcagagtcccccaaaaccctagcgacgctttccttaacagtcccggccaattccgcttgattttttacggcatcacggatatttgcggcgtcatctgacaaggctgcattattcacagaagcaaaaaatcgattcaaggtctgtattaatgtatccactccgccgcgtcctttttctgttaatcctgctcccaccgtgaacgctgttgcgtgatgccccttttctgttaaaagctcctcaggcgtattttgcaatacctccggattcctcccccccgtattttgtatggaatctccttcagatgcattgttgtcaattatgtttctgggggttgcttctctttgtccgccaatgccttcctgccctgctacagccttttttgcgtccaggaagctattgatcataagaatctcaaggtattgtctttcctcggaagaaacaagggcgtccgccaagtatccccttataagaagtttcgcatcgccgacctccatcttgggatttgccagctctgccaatagtgtttggtacttttcgccggtaaatgcctcctgtgcagttgcattcccctcttttagtaaattctgttgaaaatattcagggaatccgttttttgcattctctcctcccaatatatcgagcaattcattgatataatttcccaaatccgacgaatgggctgcccattccgttagggtttgaacggtttcagaagtcgccggaatattgtttgcagctataaaaacggcgagggattccggcaagtcgggcattgctgcggcaatctccaataatgcagacatccgttctggggtcgggtttatatggtatttaataaataggttcgcggcagactgattgacacgtgaaggctgaacccccatattcataaggagaacctgcaactcgtttgattctaaattcacagtttgtccgttaacagaagacagtttcaaatggatcggggaaacatccttgctggacaccgtcagttcaatcatatcgccttccctgacagcaatcccttccgggaataccgcttttgcatcagtcccatccggcagtttcaagattacttcccggcctgagacggaaacgacttctgcatgtaaggtgtctccattggaaaatgctgaaaacaactgtccttgcgggttattattgttattgccaattttcgcgggttggatattcaccattcctgatattttcattccgttcccctctcttatcctatttttattgtctccttcacaaatcttgagtataatatataaatatcaaggtgaatggagcgataaaatcttcatggaaaacaaacatcccccaaaattaccacaggccgcagccctgaaatatgatccattttcgaatgatgcccccattatatctgcgctcggtgttgggcaggttgcagagcgaatcatcgcaaccggtcaggaacatgccgttcctattgtcgaaaaccgccccctgtccgatttccttgcaaagctgtctgttggcgatgccattcctcctaagctatacgaagcggttgcgcaggttttagtatttgtcagccaaaaagataaagatttcagtcaaaaaatccgctattagccatcaaatccttttggaggataaataaatcatcaaggcgtccggaatcttttcgagcgaagcctgaatcgtcaccgcccccattttttgcgctaccatgggcattccgtatacaacacaactcgcttcatcctggccgattgtataggcgcctttctctttcatctcgagcaggccttgggcgccgtcccctcccattccggtcaaaataattccaactgtatttttgttggcaatcttcgccacagaacggaacatcacgtcaaccgaaggacaatggccattgactttctccccctggttcaagtgaataaccaaatccgccccacattttgaaaccaacagatgcttatctcccggagctatatatacatgtcccggccggatcacatcgttttcctccgcttcttttactgatacagtacattcattgtttagcctttgcgcatacaattttgtaaaaagaggcggcatatgctgtgtaaccaccatcccagggatattctttggcaggcgttttaagattgcacaagttgcttccgtgcctccagtcgaagcacccaaagcaatcaggccctttgcaggcaaggtgtttttcatttcggccgaacctactactgtccttggtatttgcttgccgaccaattcgcacccatgctttcttactgcctttatgcctgccgcaatcgttactttttctgtaatttccaaaataaaattgtctaatgtctcgccaatagcagagtgtggtttctctacaaaatccaccgcaccagcccgcatggcgtcaaacacaattccatccaaagaactgacgaccacaaccggcattggatgctgcggcatcagtattttcaggaattcaatcccattcattttcggcatttccacatctaaagtcataacatccggctttagctgcaaaattttatctcgcgcctcatagggattttccgcagcgcctaccacccgaatcttcggatgattcgtaaaaacatttgaaatcgttttacgatagaatgctgaatcatccacaaccagaagtttaatttttgaatcagtttttacgttctgcatgctcatacttaccttatgtataatttttacaacaattcctgggcgttcggcatattgatctccgtcacacgaataccatagttgtcgtcaataacaaccacttcgccctttccaatacattttccatttaccaaaatgtcaaccatctctcccgccggacgatccagaacgacaaccgatccaaccttgaactcaagaatatctttaattttcttttttgcgcgtcccagttccacagtcacgttcatcgggacatcaaggatcatttctatgttttcaagtgatgggatcggcatatttccagtcaccccattgaagctggggaactgcggctgctgcacccggacattctgctcctcatggatcacattcggtactgaaggagcctgcggataagcagcctgcgcggaaaactgcggcgcttgcggagccgccgcagctgccgccgtagccggagcctggggaaccgccggtgcgctttgcactggctcgggtgcaggcggaaccgcctgtggcaccgatacagacgatgcatcgctgattcccgcatcgatctgcatctgctgccatacggtatttgccatctgctttgcaaaatcaacggacagcacttgcatgatttcgcttaccagcaaattttcaatttccatactaaagctgatctttacgaacggtccgctccgctctgcaaaagattccgagagattttcatcctttatcgtaagccgtctggtaattggggtagagatatccaccatcttatgcaggatatccgccagggccgtagcggaagaccccaccatttgattcataatctctccaatggcgctcatatggatttctgtcaattcgatgttgtcaggatcgattttctcatcttcctcacccagcattacgcttgtgatgagggcaacgtcatattcgttcagaatcaggagattatctccctccagcccttttgtatatttgatttcagatataaccaacggagccgggtattctttgcttagtgtttctacagtgtggatcgaaagcgttggcgtagtaatatcgacctttctccccagcagggtcgacattgtcgtagcagacgtgcccatgcaaatattgcctatttcacccaataaatcctgttcatcggctgtaagatacttatcgacagaaaacatatctgcatcttgattcgtctcttcaatctgccctgcatctaccaacatctgttcaatttgttcctgagataaaacttcgttactcaatgttttcgttctccttgataatcttcgctatttgtaccgcatatttgtggttgtctgttcctattacgcctttaaacttaggaatcgattcaacattgacatcgatgcaatcctgtatcggatgatcgagccgtataatatcgccaatctgcatccttaggatttcccccaattgcgccacggtatcgtgaaaagttgcgcctatcgttacataagtattctgcaattgttcctctattgttttgtcctgatcatttttcccgctttttccttgttttacagtttcggcaagcgtccaattcacagtgctcagttgttttgccacaggctgtattgcgtagtgcggaatgcaaatagaaataattccctcaatatcgtctatttttgcatccatggtgacgattgccgtgggttcgttcattgcggcaatttgcgtaaattgcgaactgttttcgattgattttacaaccggggaaacatccacaattttcccccacgcatctttaaaaacacccatcatctgatgaataatattgcttatgattgacatctcgatttccgtaaacgatttttcgttttgggaataatcggcaactccgccaaaaagcctgctaatcaatgcatatactaaagtagcggaaagttccatcaataaagaaccctgaaatggatccatatcgataacgcagagaataacgggcgatggcagagagttgttgaattcaccaaatgtctgctcctccagggaaatcacttcaatattgcaaacggtatgcaataaagcggtcaatttattcgtcagcaagtacgaaaaactatcaaataccacattcaaagtgcgcatttgctcacgataaaatttatttgctgttctaaaatcataaacgcggacagcatgcgcctgtgcttctccctcgtcttcaacaggtacgtcttcccctgcattcaacgcattaagcagcgcatctatttcattttgtgataaaatatccgacaacttgtttcctcctagatgttctgatacagactatgtaacaagcctttactgaatcacaaaatcactgatataaaccttttggagcgtctcgatccccaaagcgcttttcagcgacgccgtcatctcatcttcaagcatatcgattgcggatgaactcctgagttcttcttccgtgtggctgatgagtacttttatgacagaattgcgtaccaccgcaacattggtatccaggaaggaagattgatcttttcctgtcagggccaatgcaacgctcgtcttgcacagggccagactgtcattgatattcgttacaaaataatccccgggcacataataatagacgtcttcaagcgcgctcatctgcgggtcgtccgtctcttgcgaggtgggtttcaaaaagttaaagtagacgaaaaatgctgcaatgactacaactatcactataataataggcacaatcttctttttcataatgtcctgttcttcctttctgtttgtaatcaattgattacatttgtgctttcaagaataaattctacccttcggttctgctgtttcccttcttccgtgtcgtttgacgctaccggttcagtctctcccagccctaccgctttcacattttttacatcgggaattccgcagttttcctgcatatagagcaaaacttcattcgcacgggcagttgacaagaaacggttgttcttatataagtacgtattgatcggcacgttgtccgtgtggccttccaccattatcagctggacgctgtcccacgcggacatgaacatgtctcccaaatccttcagtatttgttcggccgtctcgtcgcgtatttccgcccgtccggaatcaaagagaatcccttccaatatcgtcacatagacatactgcccgttgccttccttttcaatcacgaccgcggactgcaggttattctcttcaatgtattgtgtcagcctctcataaaggtcgttgaacttcgcttccacttcatagctgtgttgctgctgctcgtcgccgtctttcaggttggaatcctggtcgttgctcctgtcgctgcgcggcgttaccttgggaatataatccgaaggagcaaaccctgaagttgggttcaaaggatcgattggctccacaacagtgcttgccggcgctcctgtgaaagattcaacgatccgcatccatttcgattcgctcatctgtgaggatgcaaacagcataatgaaaaaggtaagcaaaagtgtaaccatgtcgccataggtgtccatccaataggcgcctttatgctcccgctttttcctcttcctgtcagccatcttgtacttcctctcctaaatcttcctccacatcttccgtttttttggttttttgggtatctattgacgctacaaacgccttcagcttatcctcaatcacacgtggattttcaccatcctgtattgatagtatcccttcaatcacgatatccttacacaacatttcttcatcattttttgcttgtaattgttttgcgattggattgaaaaccaattgcgcgaataaaacgccataaagtgttgtaatcaacgccaatgccatcgacgggccaatcgtatccatatctcccgtcaggttttttaacatattaatcaggcctatcagcgtcccgaccataccaaaggccggagcgctggaagaacctgtttcaaaaatactaatgtatttcgaatgccgctcatccgtaaaataggattgggtttccagcatacttttcactacttccggatccgttccatccattatcaacatgatgccgttctttatgaacgggtccttgatatcgtcaagcctgtcctccaaagccagtatcccgctttttctggccacattcgccatctctacgatctcgtcaacctgttgcaaatagctggtatcgctctttttaagcgctagtcgcagcagtgtaggaatctttttcaggtcctgcatcggataagaagcaataatggcgccgatcgttccgcccgctacgatggccagcgaccccacatccaggaagtttccaatctctccgccattcagcattccgtaaacggtcatgccgaatcctacaactatgccaaatattatcgataagttcaaatataatcacctctgatattagctttccccgccgattcctttcgcattctttataaggacttttttatttccacaggcaaccctaaatagatcctctgtttatatgcaataatcttttcaacaatttcggatggcggatccagcaccaggattttttttcctgatgccagaaccaaaaccgtatccggaatcgtttcaatcaaatcaatggcttctgcatttacaatacaggtctcgccgctaattttagaaacttctatcatcccctgctatcccttacctttttaggtttatcagttcctcaagcatggaatccgtcgtggtaataatccttgagtttgcctgaaatcctctttgggtcgtgatcatattgaccatttcttcagacagatcaacgttcgacatttcaagtgaagaaggcgtaatggttcccgtcccgccatctcctgctagattgtgtgtcacacgccctgaatttgttgtagcagcgtagagattagaggatattttctccaggccttccgtatttgtgaaattagacagagccaaatatccaagcacaactttttcgcctttggccatctcctgcgcgccgttgacgcctggcggaaccccttggctcttaagctgcgcaatgaccgcgccctcttcattgatcgaaatgttttcatacgcatcctggtcaatgatcatatcgccgattgtatttcctgctacaaacgtatcattgttggtgatttccacgctcgcattctccagcacgcccgccagttcaaccagttgtgtggcaaaggtgtcatccgggttcgtccctgtcgctactttgacattaaattcgatggttcccacatccgtatcgatatggtaagttccagccgcaaacgcatttgtaacagcattatccgtatcatccagtatatcaaggtcttcctgtacaagaataccgtttttaaatacattgatcttattattttcattgatttcaaacgtatagcttcctgaaggcgcaacagtaatattcgcattcccttcagcccaggagaatgtatcaaaatatgtcttggtttgttttccattgattccgacagatgtcgcctcccccgcatttccctgctggtaaaccgaattaaagcactgtacgaaatacccgctcgggttcaccaagctgccattgctcgatacggaaagatttcccgcacggctatagcgctccccatccgacgtccgcaacgtaaagaaaccgtctcccgtgattgccaggtcaagcgtatttccggtatattgcgccgcgcccggcgtgtgtttaatcacaatggaattacacgtaacgccaaggccgatctgccgcgcgttaatcccgccttggtttgccgtcggcgcggaagccggcgatactgtctcgctgtaaagatccgaaaaatttgccgcgctctttttaaatccaagcgtatttacgttggatatgttgttaccaattacgtccatccgggtctgatgggtacgcaaccctgtcacacccgaaaaaagtgccctcatcattatgagtttcctcctctgtatgtatctctatatatcaattttgttgttaccatcattattaccctgctgtcattgcaaataatgcgtaacttgccttctccatatatcatcctgccatcattggcccgtcaattgcttaactaatttttgtgatatatgctacagggacttccttgccctcttctccgtctacgcctttcagttttgcgtaaaccgttccatccttcacgagtatcgcttccacttccccgctgatctcctcgggcttttcatccggtatatttgccggcaatgttgcctcaacggtttttccaaccagatttgcggattgcgaaatcagcgagttggaatcgattcccgtatcgtaaatctcgttaatcgcacccattggcagcagataactgccaacctgtaaataatccgtgcttccctgccggaccacgccggttatccttccaaaaatttctgttgttccgccaaatccgtcactcactgcgccaactacatttttcccaatcagggaatacagctgcgatgaagtgaaggtagtattcagttcctgcatttgttccagcgaactaaattgcgccatctgggcgataaaatccgtatcttccattggctgcaggggatcctgattggcgagctgcaccgccaaaatctgcaaaaattcatttttacccaattcctgggtcggcgtcctttgttcggcgccggacggagtaattcctcctgtcgttggtgttatagcatttgttgccattttaaatcatcctttctgtgttcctagttgttcaccctttatcccaaataaaaggttacgcactaaattccacagaacctccttgctctgcaagcatgtcataatatgacatgtcatcataaaacgccatcgcgctttctgctgtttccggaactcgtccatgagaattaccggtgtttccatcccattttcggccttgtcctccattgtctttggcagtggagtttgctgtctggttataaatcacttccatttggacaacatggattcccttttcccgcaaggcctcctgcaattgattcatatcactttgcagcatatactgtacatcgtggctagaggtcatcatcttagccacaattcctttgtcatccgtcgacagcatgatggataagccgccaagatgttcaggtttcaactgtaggaaaaactcagacttttctttgtttacatttgtcctgacatgctcaatgacttgtgaaagtatgctgtctttctgctggacctgttgaaattgtactggttccgtcctgttctcctggaagtggacctttccatcttcagaaattgctgccgtaaccatattttgttctgccatcgcgcttccctgtccggctgaatcctttttcccggatcgctcggaagacccttcttcctgtttcgataggttcacggcttgttcctgtacgacgggctccccagcagtttgggcgctttctgtcgcattgttttgtttttgaaggatttcatcggcttcgtgcatcacttgatggacaaaatccagcgactcatctccttcttggccttgcacgatagtttccatggctttcccttcaatactgctttccgtttccagaagcgcctgcatatcttgttgaaaatttcccaaagaaaatacagaatcaccctcttgaccgccttgattccccagcccttgcacttcatgctgattaatgaccacgttggacataacaatcgttgggttacccaaattcaagctgtcagaatcctgccctgcatcctcaggctttttaatttcttcctgatccgaagcggaaggatcttcatcctctttggcaaccggtggctttttctctggtttctgggttccttccgttttatcggcttcattgccaatattgccggttgccttatccatctcgctggaaaaaccatcccctgcggcttcactggcctttgtgttccctttgatcagggtatccataatagcagtttcttcaatacgtatcattctcctcacctcctttcctgacgaaatatttattttcactttgcatatcgccctgcaaagggaaaatcaggatatatagcttgacactgcagatgctttcgcagaatccatggcccctaatatctgcgccgcctttttttcatcaattgcgcttaatattttggcaatccatgcatcatttgtcgtattgttaaagatttccgccgctgcgtttttatccatattttcaaatatgtccgctgctacagaggtattcccgcccgcggatgcgcttgtagcgcttccagtcgcggtgctttgctgttcctgctcctgtaactgcttttcctttgacgccaaagattgctcttttgcatccagttccgccgttttttgttcgtatgcctgcctttgttcttcataattagccacgattgcttgatattcgggatcttcggaacggaaaaattctataacttttgttttaacgccaaataaattaaaatagtaagaaatgccggcaaaagctatcagccccacaataatacatattgcgacaaccttaccgttcacctttcttttggccgtttccgtctcgaaatcattaccccgattcatgcggctattcgaatttttaccgttggcctgttttgctgcaggctgtttatccgccataatttcaccactactcgcttatatcttttttagagacgcgcttgtataaagtcctctatcattttgtcgtcattcttttgtacttccttgcgatattcctgcaattgctcctcgcgcatcctgtccagtacattttcttcattgatcagccgcaggagaccctttttgcatatttctatattcgcctcaaattttgagatcgctgcatcctgatccctcatttcccgttcaagatattggaaataatccccatactgctttacttcactcattgtcaagccagttttgcactttttgtcataaatgccatgctgtttgttaaaaacgttctggttcgctttcctttgcttcttataagccaaaagcgtgcggttcagttctttgagctcaacccgtttttgtttttcttccgactgttttacgtcgtataacttttgcaatgtaaaaacaaattttttcatttcatatccttcgctatcacgcccagcagatttaacatctgatcaaacgtcacttcttcatccattccctgcttaagcagcccgagaattggctcccgcagccttattgccatatccgtccttgggtttgagccttccttataagcgccgatactgatcaaatcctgcacgctgtcgtattccatcatcatattcctgacataatccgccatcgttcgatgttctgccgtaacaatgtccggcattaacctgcttatgcttgccagaacgtctatcgccggatattggttattgtttgccaactttcttgacagaacgaaatgtccatccagaatccccctcactgtatctgaaatcggttcattcatatcgtccccctcaaccaataccgtatatattccggtaatacttcctttacgggacgtccccgacctctccaacagcttgggaagcatcgagtataccgaaggaggaaagcctctcgaaaccggcggttccccaactgtcatgccaatctccctttgcgccatcgcaaatcttgtcagagagtccatcatcaacatgacgttatatccctggtcgcggaaatattccgcaatcgccgttcccaccatggccgattttagtcgcagaagggccggttgatctgacgtagcgacaacaagtacagattttttcaatccctcttccttgaggtctttttcaataaaatccagtacttcccttccgcgttctcccaccaatgtaatcacattgatatccgcgcttgccctgcgcgcaatcatcccaagcagggtgctcttacccacgccgcttccggcgaaaatcccgattctctgtcctttgccgatcgtcagcaatgcatcaatcgcgcgtactcccagaggcaacacctctttgatgcgtacccgctccagcggatttggcggcatgctctcgatggggtaaaaggcatccggttccagggctgcaccaacatccatcggcctgccaagcgcatcaagcactctgccttttaaacaatcgcccacgcctatcttgtattcttcccctgttgccactactttatttcccgcgccaacgccagaaacatttccaaaaggcatcaatataacgctttgctctttaaagccaaccacttcagctaagatatattctgtttcttcgtttttatcaaggtatattttacaaatatcccccattttgacaaccgggcctctcgactctattgtcattccaaccacattttttacggtcccactcgcttctgtatagtctcctttttccagcagtgccttatatttatttatcttttgctctaagttcatctgatttccgtcccatacaactcgttctccaaaaggctcaactgcgtttggattccggagcgaagcgttccgaactccgtttccaccatacattcgccgctttccaccgccagatcaggtttaatcgaaactccagagctttctaacagcgacacaaatttctcctgatccgagtaaaaaaattcatcatactcctttttgtttactttcaaagtgatatcactgcaatttttcactttttccagcaaatctttcacaatattcatatatatgccgttgtcgtcttcaatttcttttttaattactttttttgcgatacacatcgataaatccagtacactttcgcctacttcccggaatatcgtttcttttgcatggaataccgtagcaactgcactggcaaaatctttattaagcatcgctttttctttttccagctctacttcagcctgcttccatcccgcctggtatccttcctctgctgcattggcttttatttgttccgcatccttctccgcttggcctaggatagctttgcggtgctcctccgcttccagaagtttttttcggatctcttcaagctcttgttccttcctcctgatctgtgcggctattttttccagttccccgcctgcgccgccagacacatcgccttccagctcatttacaggttccggcaattctgtaatcacatcatcgagtaccggcgtcgcaactgtgtctatcttactgatattgatttcctgattttgtagaagcgtcctgtcgatcctaaagaatgagctcatcttcagagcctccccgcgatatctcgatttctcctgcatcttcaagcttcctgatcacatttacaatcgtctgctgcgcctgttcaacatcgcgcacacgcaccggccccatatattccatattttcgacgatcaaatcgtgcaaacgcttggaaatatttgcatatatctttgcggcgatttcatcgccggcgcctttcagcgcgatggtaagaacatcattgtcaatttctttcagcaccttttgcagctcgatatcaccgagcttcacaatgtcttcaaatacgaacatacgcctgtgtatttcatccgccagttcaggattatcaacctcgaccgtatccaatatatgtttttccgtacttctgtcagtcgccgcaagcaattcgaccaccatgtccacaccaccgacagatgtgttctcctcctgtccaatgctgctgattttatattccagaatgcgctccgcctcacggatatattccatggagacgactcccatatcggcaatccgttcaacaaccttggattgcagctcctccggaagcagcgaaagaatactcgccgccttttgcggtttcaaataggaaagtattaaggcaatcgtctgcggatgctcattctgtatcaggttactcacctgtgtatcgtctgctttccgcacaaaatcaaacggccttacctgtagcgccgccgacagttttccaattaattcatccgcccgttcattaccaacggcatccaccaatacttcacgcgcgtaatcaattcccccctcggaaatatacttctgcgcgacgcacaaatcataaaactcatttacaacagcatcacgtgtttccttatcaaaagaacgcaggcctgtgatcccgagggtaagctgttctatttcgtcatcgttcaaatgtttgtaaatctttgatgatgcatcttttcctaaagcaaccattaagattgcagctttctctttgggaagcaaattttcaaccatcagctattccctccaaaatcatctgacagccagttccggagcagttgtgcaattgcgtccggatttttatcgacaatcccttgtacttgccgcaaaggaaccttctcatcttccttcagcaaatcttcaacagatatttcttcatcggcaacatagtcaacatgctgctcggcaagccgtacctgttcctcttcccattcccgcatccgccgttcttccagttcctgccccctcttctttttgatcgaattccagacaacaagaaaaacgattacgatggctgccacaattaccaacagcggaatgatagacttcatcaggtcaaggcgctgcatttcctccatctgcttctgttgttcttccattgcctgctggtaagcttcattttgttcaaacggcatagccgatacggtaatcttcccttccggaacaccgatggcagtagcaatctgctgcctaacttcaggaagtatgtccgtcagttcatcgccgccgttaataatgagcgtagcggataaatcagtaatgtcgccttgcgctttctcaatttgctcactgatttcattgacttccgcattaacttccgtgaccgcattgtagtacgtgctgtcttgagccgcctcgtctatttcctgataggtaggcgcgccgccgttcggatccatacccggctccccctgcggcgtagtgccagtattttgcaagcgttcttccgtcatcttcatgctggttatgattcccatattctcagcatcattcgtaggcggagacagtgtcagcgagttcgtcgtggatttatcgaaatccaaaatcacattaacgctggctgataaattttctgccccgaatacaggcgtcagcagcgcaacaatctggtttgccaattcatcagatactttcttctgcaaattgatttgctcatcaacttgagtcgctccgcctgtttcttccagcgcgctactgccatatgaattcatgttttggtcaacgatagcgacattttcttccttcagcgctggaactccttgtgccacaagggaacgtattgcggcaacatcgctctccgtcagctttgcgtcgctggatttcagcgtcaccatcacggaagccgtcgattccttattcgcgtcgctcgataaaacgaaattgctttcatcggccaggttgagcaaaacagtacagctctttatcttgtccagacggccaatcatttgcgctaaattctgctgcaattgcgcctgctcataatactttttatctttatcggttgagccaaaacttgtggcgttctccgcatacaaagaataatcaagcgtgtcgcccgaaggcagtcctgcggcttgcagcttatatttaagcccatttatctgatctttcggaaccataagcgtaccgttcgggccggaggtgtaggaaatattcatttcctccagctccgcgattacgatccccgcttcttcatcagtcaacccggtaaacagagtctcatactccacctgattcgacatagaaacaactacgctcaaggcaataattgtcaataccacaacggcgacgatcaatactttttgtgatttttttgtatttttccatgttgtcagaacttttttgccaacatttgcgatattactattcgccagggggagtcactccttttccgctttatcctttacacagccaattaccgacagtattgaaccgtcggtaattggtgtatcatatctattctgtatattgattattagtatttatctccggaaagctcgaaatcgctgaaatcatttccatcctgttccgctgcgggcatatgtatcgtatcgcccaaatccactcctcctgcatttttgatgcggaaccgactcaccatctgtttcatcatatcagcctggccggaaagctcttcgctggccgccgcgctttcctctgccgtcgcggagttcgtctgtaccacagtggatatctgctcaactccctggttgatctcgcttgcggaccgtgcctgctcggaagatgccgctccaatttcttcaatattctggctgatcaatcccgtctttacaacgatctctttcagcacctctgctgtttcagtagctgtcttacttcctgtctccaccttctgtagggatccttcaatcagtgcagacgtttctttcgccgcttccgcgctcttggtcgccaggttccttacctcgtccgccacaacggcgaagccttgtcccgcagcccccgcacgtgctgcttcaacagccgcattcagcgccaatatatttgtttggaaagagatatcgtcaattactttaatgatttttgaaatctcagccgaactcttatcgatcgcgtccatcgagtcaagcatccccgccatatgctggttgcaagtttccaccagatctgccgtttcaccaatcagcgtttgcgtctctgcgacatttttagcgttctgctggatttgttcgtttacattagaaatcgaggccgacagttcctgtacggagctggattgttcagtagccccctgcgccagcgcctgcgcagccctggaaacctcgttggagccgatggctacttgccctgccgactgatccattcccgcgaacgtagagttcagcgcggaaataatcttctcgagcgacgtcccgatcagttggaagttgcccatgtagttttctttcgtttcaacatccaggttaccgtttgccatctcttccagcacatcggaaatttcaccgacataactcttcagcgtgccaatcatagagcggacgttttctgccatttcaccaagctcgtcgggagcgcggtattccacatcgatctccaggttcccctgcgcaatttgggttgtagcctcaagacattccgccaccggcttcttcacgctcttcgtgatggcaagcgcaaggcaaatggcaacgatagcctcgatcgcaatcatcgcgatgatcaggatcaggataaactggaaagtacttcctgcctctgcataggcgtccgcggcctttgcatctacgttgttccaaatctgctcaacctgctcctgcacctgttccataaccggtatatattcgccttccaggatttctcccgcttccttggagttatccacatccgccgacgccagattcataatcttatccagtatgggcatactattttccatcgtggttttcatctcggaaacaattccttcgagatctggatgaatcgatacgattttatcaagattgttattgatctcatcgatccgcatcgttgccagcgatttcagttcgtctatttcgtcctggttggtggaaagcgacatttgatatagatcgcgcgaaatgcgctctacgtccgcctccacgtacgtcattgcgtctgctgagatgtaggcgtcgttatacagcacctccgacgactcattcagcacgttggccccgtaaagggccacaacaccaagcacgccggtgagcacaatggcaacgataaatccaaacaagattcttgccccaaccttcattttctttaacatcgtgtcttcctcccaaaaattttctttaataaatataatgtagtttcaataatttttaaatttcaaagaattcatcgccgataatcttttcacacgacaacaacaagatcagcttttccggcaggaccgctatgccgtttacatagtgatccgcctccgtccccgtatttcgcgttgggggattgatattctcgtcgcgaatatcgattacctcgttcacctcatccacaacgaggccaatctcgattccgtccacagctacgacaatgatgcacgtcttgctggtatactcttgctcctggtatccaatcctaaggttcacatcgataatcggaacaatcagcccccgcagatttataatccctttcgcatagtatggaaattccggtacttctgcaatcttttgaattcctataatttccataaccagagaaatcggaattccgtaacattgaccgttaataaaaaatgtcaggtattttttggatccgccctcatcattttgcagcgtcaactctttttcctccaaaacacattcctcctcacttcaccgtcaattcccatcaagtcagcaagttgttaatgtcaaggatgagcgcaattcccccatcccccataatgctgcatccgcttatgcctttgatgcgtccaatcgtcttggttacataaagaggcataggcttcacaaccgcctgctgttcccctagcagtttgtccgcgaacaggcaggcctccccggattcgctctccaccaagaccataattccctgcttgaagtcctcgatcccccctgcacattgaaaattttgtgcaaacgtacaatcgggtagcacacaccacggataatgatcatttcgtttccgtttggctctgtgataatctcgtgcagtcgcggctccagcgattctctgatggaaagcgtagggataacgtatgtggaactccccaccgtaactttcatgccatccataattgccagcgtcagcggaatatgcattgtaatcgtcgttccttttccccactcgctgtctaccacaatgcttccgccaatattatccagattcttatggaccacgtccatcccaacaccgcggccggaatattccgttacctcatcgttagtcgaaaatccgggcatcagggtaaacccatatgcttctttatcggtgatctcgttttccggctttaccgtaagccccttttcgtaagctttttgaataatcttgttccggtccatgcctgcgccgtcgtcggaaacacgcacgataatatccccgctcgtgctgttggcttccagcgttacggttcctttttccggcttacctgccgcaatacgttcctccggcgcctcgatgccgtgatccatggcgttacggatcaggtgcatcaacggatccgacaggttgtctataatatttttatcgacttccgtgtcctccccaataatcaccaactcagctttcttattggtttttttgcagatatcgcgtacaatccgctgcattttgtggaacgttgtcgcaacgggaaccatacggatagacatcacaatatcttgaagttcatccgtcaatttccgcagctgccgcgcctgcttttcaaaattttccaagtgtaggtttgcaatatcggcgtttttggttaccatggactccgtcgtgacgatttcgcctaccaagttcatcagtttatcgattttattaacatttacattaataaagctctgcttaaccgccttgtcttcctttgccttgcccgaattttgggagcttttttttgcaggagcttccttcaccgacgcctggcctgtttccttactcaaaggcgcgtcattttttaaatgctcctctgctccctttgcttcctcccggatttcagcatcctcttcaccaaactcaacggaatccaccagcatagtttcttctattttttgctttataaaatcctcatattcttccgtcgtggaatacacaatccaaaaaccattttccgcgatttcctcgtcgtggttcgcatcaaggtcctcgggatgtgtcgcaatgcttgaatacatatcttttatggccatcaggatgctctccgcgcgaatcgtttccatttggcaaccatgctcaaaggaaactttcgcccagcattttcttccattttcctgcgtcctgaccttgtccatcaagctttttaatatttgcgaagcagacgtgccctgcctctgcgcccctgtggtgttttcttccgtatcaggtgcaatgccgccttcaaggtatttgcgtatatcctctaattccagacaaagttcttttgcatttccatcaggttgatccccctcttgaagcttttcgatttctcctttaaagaaatctatggattccaggacaacatcaaaaatacgctcccacccggaatcttctggagctttttccctgattttcgaaaacaaatcctctacggcatgcgccaaggttgtcatctcgtcataatccatcatcgccgatgagcctttgatcgtatgcatgacgcggaaggtttcgtcaatttgttcttttgaaagcccttcactcttttctccacccagcaacagctcttccaactgctctaaaagctggctgttttcaaggacatacatcgataccatcgagtccatttcgcccatgtatcttcgcctccttatgtatcagtcaacaagcaagccccgcccgccagcgtcactgaaatttgctaagcgcggccacaatgatatcttccttaaacggctttacgacaaaccctttggcccctagcattaccgcttccttcaccataccttcctgtccaagtgccgataccattacaacattgacctgcggattcactttcataatttctttcagggcgtcgatgcccgtcatttccggcatagtaatatccaaggttataatgtccggattcagctctccgcacttttggatcgcctgcacaccattttcagcttctccaacaacttcaaatccgtttttggataacatgtttttaatggtgagcctcataaatgcggcgtcgtccacaaccaacacttttttcataacttccctcctgtattcccttcaaattttgcctcaaatctttttcaaatgaccttgctgccttttccaaccgtcttgaccatcagcataccgtcattcgtatcaagctcaattgtccttccatagctgccacccaagtcttctgctaaaattggtattttcaatttcaagactgcaatcttgctgttatacgcgtttctttctcctaccctcagtgcgtcgctcctgccggcgcctccgaacatatgagcgcctccggctagttttgcaccaatcatcctccggtttgcacctgctttcagcatctgctgcaaaagttcatccacccccgtatcggcaaactttgcccgcagcacatccgggcgtttcccactgtccggcattacaatatgtaccattccgccaatcttgttcattttgtcatacaacacaacgccaacgcaggacccaagccccaatgtcgcaatatgctgcggcgcctttaccacgcccagttcggccataccgataatcatcgtcttcataggctacctaacaacgcgttcttcagcacttcaagtgattgcaccgttggtatcataaaaaattcgcccttgatgctttctgcgtcttctccaaactccgtattcatcaaaagaaccgattcccctaactcgccatataccataaccgggacattcataatggccatagccatatcgattgtcatttccggcactgtgggcgtaatattcaattgaagcatagaggatatcgcggacaaataggtgccgaccaatatattgcatacttcgcgcatcggttcgtagtcttccagatttatatcttcgcttagtagttcctgacccaaaagtacacgcaatgtgttgcgtgcatcttccagcctttgagccaataaaatatacccttcaatgtctccgctgacctgtacgagcattcccaggataactttctcggccccgcccatccgttctgcaatttcagaataacctatcagttcacaatccggtacttttatgtctactgattgacccgtcattttagacaaagctgaagccgcattaccggccccaatgtttgccacttcttttaacatgtctaaatcaagcgcactaatctccacaatagtccctctttgctttcagttattttcctttctttcaacggtcattcatgcaccgtgccgctcgcaagctttttccgtaaaatccagtccatatattaacttttggatttttccacttaaaattttcaacatatggaagcaaattctcttccagttcaatcacttgatttgcaacttttcagcagatcttccaacgaatctatgatattgccttgctccggcgcgatggtatacggcactgcggcgtttattcatctattttaatccgcagtgtcactttctctttcgccagcgcggcaatctccgccgttttcgccagcgcatccggaagcgcttccatgaccgctattcccatatttactgataatatgatcaatatagctaccgccgcgagtttctttccgtctttcgtttttctatccatcgcttccgttcgcgttctatttttttgtatacgttgtctgtttttttcttgacttttttcctttacatctataaaatccaaagtgtacagcatcatatgctttttcgtataactactttttcatttaataccaatgctattgagtatttattcgaggcaaaaaatatgattgaccctaagcaaccaaataatatacacttttttgaatgctttttaaacacatcttaaagtccacagcccgtctctctccctgttcttttaattgctataattagcattaacaaaataaacgggggaaatccgcatggctattgaagttggagacactcctttatgcttccatgcgctggaaaagcagacggcaaagaattggaaaaatgtaatttagcagattttacgcaaaaattttatcgccagccaattaattctatttaaaatttctggaggaatgagcttcagtcccgcgacgtcaatccagttaacgtcttcccgcacggaaagcaagtgctcgggcactcaagcacttgccctgcaagacatttctgtcaaaattcaataacaccagtgaattatccaaaatttcgggaacaacgattatttaagcgacaaatattatgccccaaaagcattgaagaaatacgcgcgcaccttgatgcgctgaccttaatacgctgaatttttaatttacgcctgatacaatattgacacaaaagattaacaatgatattcttattatgcaataaaatataagagattttttggtattttaaaatgctaattatagcaatcagacaggtatatttccgtaaagatttataccctttttctgaattgttactatcatatcatcatttcacgcgtaatataaatacagtttaaaacaggaggctggaaaacaatcttccagcctcctgtttttatatttcctatctccttttccggagcggcttcaaccccattatatcgcaaaaaagccgatgtacaaaatcctttatactaccttcaacgaccaacgaaccgtttgccatccgcgccgccatgcccgacagcgtggcgcgcaccaactggtacatatcttccagttcctcttccttgattccgcaacggcgaaaatagtcatacgcatttttccggtagattccatattgccggtcgaacatctccgtttccccttccgtgtcatatccggaataccggggtgaaaacgcaaccgtggcatatcctttattttccgataggtagcataatatttcttccgccgcaaccaggaacggttcttcgtctttgcgctgcgcaattctctttttattgtgcgcatccagcagcaggcgtattttccgtgtcgccgcatcgatcaaatcgtctttatttttgaaataattatatggagtagcatggctgatattcagattctccgcaagtttcctgaccgacaggctctcaaggccatcgttccggatcatttggactgcggatttcagaatctcatcttctgttattttcatttgttcatccccctggcacggcggtcaaaaagcttttgctggaaagcaaacaacttcctcgactgtttcaaaaactcttcttcgcccttctttcccccatacttaacagaagcggaaagccctacaattaaggttcccatcaaaagcttctcataccgctggtcgttgcggctttttccctccgcgctggttgatgggagcggaaaatccatagaaaattggcgcactgttccgtcttcttctattaaatattgcacgcttggggaacgctccaatatttcagccacaaagtaatattccttcaaatgcctgtaatagattctcgcaagctcgatcatacgctccaatggatcttcaatatccagaatgtcgtccacaacaatcttatccgcaagttcccttatggcttggaattttaccgcttccgccaactccttagcatccctgaaataatgatacggcgcgcgtggggaaaggccgcatttttttgcgataccgcgcatggtcagctctccaatgccttccttccgtatcaattctatcccagcggcgatcaaccgctttttcgtttcttccgatttctttttgtttatcattttccacaacctctcccacctataagtccactgcttcaatcttcgcacgtttttccgcgttcgtcgtccgcgtatagatgcgggtcgtgtcaatgcttgtatgccctaacacatccgcaagcgtcacgatgtcattcgtcttttctataaactgcttcgcgaacaagtggcgcaggttatgcgcaaacaatttatctttcttgatgcctacccgtgtccccagccttttcattgccgcacagatatacgaccggctgattacttccctgcccctttggccttcaaagatcactcctccaaggatatcgttattttcgcagtaatccgccagcatttccctgacgctctcctttagaactacgttccttattttccctttattgataatcctggcttccccgtgcctgattgcatcaaccgtaatatatttcaattctcccacacggatgcccgttcctgcaagcgtcctgatgatataatacattttttcgttttttaccttggccgacatcaacagccttttgtattcatctaccgtcagtacattttccacactgttggatttttgctgcttcagcttcataaaatccattcccgcaaaaccgaacaggccgtttaacgcgctgatcactaggttgattgttgccggcgcatatttcgttagcagccattgtttgtattccacaacctcgatcttgccgaatacatccctgccaagctcgtcacggatatagcgaataaaggcgtctatatgccgtgaatacgcattcaccgtatttttcgtcctctcctgcatcaacaggttatccagatattcccttttgattttgtctatttctttcagggttacgttcttcttcatttcttcctcctattaattgcgttaatccacgcatagtaaacataacctcaaaaaatggacaaactatgtatagtttttgaacaggatatttccaacagattaaattatttctgtaaagtgatcaacggaggtttttgagggagctataagaaagagagccgcaaagcgtggctccttcttctggatacctgcttttccgccattgtttcagttaagtctgtcttattcatactacgatctcctttcctttgtttctaaaaagcgtgataaaatgcattatattacagagacaaaaaaattgcaattttaaccatgcgattcaatgatatcgccttccttgaaatcggccacatccctgaccggtattcctatgatttccgtccactccagtccatgtatcgtaaatctcgaaatggccggcgccttctcctccctctttccctatccaagaggcgcgcatatcaatcaaattgccgtttagggggaatgctgtataaaatatatttatccgttatattcagcataacgggaacgccgtccagcataggcccttgtccttcaagccggtcacgaatcaaccctgttccgccgtcaaagaatacagtaagaggaaataaaatcgctttatctgtcaaattttcattcttgttgtcagtcataattactcgcctcctatatcaatataactatacgtttcttccatgaaagcgtctcacttttttcaacttttttgtataaaaaattaaactgcttcctcctgcgtgccttttccttccgcactttctcaaatatttctttgctgatcagtgcgggatggcgccgaatcgttattctcattccttacctgaacgccgtcttttacaagggtctttccaaggataacatcaccggtatacttttcgttgttcaaaagcttggcgatggcttccctgttccacacatcccttcctgtaggagatacaacctttcgtttcgccaattcatttgcgatttgccctaggctgaatccttccagatacatccggaatatttcccgtacgacttttccctcgatttcattgatctcgagccgtccatcctgtgattgccgctatccgtaacacttcaccgatgcttttctgggattgctgcttcggaagctatgctgcaattcttgcctgatctgttcacttcttgattgaaacataatttcacctttccttttttactgttaaatatttgatatattagatggtcgtatttataatatttattccattgattggcatacaaaaaaacgcagcaaacgccgcgtttcaattaatattaccatagtcacaagttcgagtccggctgtcactggcttttttcgttttgatgggaaaacaaaaagttgacaaaccttttattaagccatttttaggcaatcaggtttgtcaacttatcttggtgacccaccggagattcgaactccggacaccttgattaaaagtcaagtgctctgccaactgagctagtgggtctttttttgaggaacgttcattattatatcacgggcctaatatcttgtacagtattttttaatatatactgtcgactttttaaatggctggggtagctggatttgaaccagcgaatgcaggaatcaaaatcctgtgccttaccgcttggcgataccccatcgcggatcctcagtcaggcgcgcgcaatgcgcgcgtgaccggatactccgtaaacaaagtggggtgagtagtgggattcgaacccacggcctccagggccacaacctggcgctctaaccaactgggctatacccaccacgtagtttacatatccaatggcgcgcctgaagggattcgaacccctggcacacggcttagaaggccgttgctctatccaactgagctacaggcgcataaccggatatatgccgcgtaaaaataataatttacgcctcggctgacaattaaaaattatagcaaataggctttgaaaagtcaacaatatttcgtttcgatatatggtctgcaaataaaatattttgcaatttgaaggataaaagccctaccctgaaatgctgatatttgtatcttaattattaatatttattgaattatcattaaaacggcttgtaaaaccaatttaatgtgattataatcagttacggtttatgtatggggttaatgaatgtcattttttggcatatgaataaagtttaaggcttgatgtactttttgtgcatcggggaaaggattgaaaattgttatcgtttattagcacgtttaacacggcgctgtttattgcgtttacagcgttgtatgcttatcaaatcatttatgttgcggtagcgcttttccataagaaaccaatgcctatgaccgcaaaacaaaaccatcgatatgccgtcgttattgcggcgcgtaacgaaagtgctgtcatcggtaatttgatagccagtatcaaaaagcagaaatatccgcaaaacctcatcgacatattcgttgtggcagacaactgcacggataatacagctgatgtatcccgcgaaggaggcgcaattgtttatgagcgtttcaatacgcagcacgtcggcaaagggtacgccttaagctatgttttaaaccaaattgcacaggattacggcgcctatacctatgaaggatattttgtgtttgatgcagacaatcttctggatgaaaacttcgttgcagagatgaataaatccttcgatcaaggctaccgcatcctgacttgctaccgtaattcgaaaaactatgcatccagttggatttcggccggatattccctctggttcctgcgtgaatccaaatacctgaattatccgcgtacccttctgaatacgagttgtgcgatttccggcacaggctttttgatccataacgacatcatacgtgccaaccacggctggaaacatcacctgcttacagaggatatcgaattttccgtagataatgtcatccacggcgaaaagatcggttactgtggaagcgcaaagctgtatgacgaacagccttgtacctggaagcaatcctggacgcagcgcctgcgttggtccaaaggcttttaccaggtgctcggaaaatacggcaaaaagcttgtgagagggttcgccgtcgatcatcactttagctgttatgatatgtttattacggttgcgcccgcgatctttgtgacgctcacaagcattttcatgaacctgatctttatggcaagcgcttttcacggtacgtgggtcaatatgctcgtcattaccacaacggcgactgctatcttctcatcggttgcaaatttctacctcatcctgtttatcatgggcgtgatcacgacgattacggagtggaaagagattcatgccaagccggtcaaaaagatactatatacatttacgttcccgttttttatcctgacgtatattccgatctccattgtggctctctttaagaaaatcggttgggatccgatcccccataatattacgaagtctatcgaggatttcgaacaaccccaggggtaaatatcaaagattcaaaaggcggcaaagaatttcttttccgccttttctttatgacattttaattttccgaagctattccataacaccatctttatttttcctgtcctacaataagagataggaaaggagatagatgatggcgattctgattatcgttgccgttcttttaggaatacctgccctgatctttttggctatacggcattattgcaaaaaacattcgtttttcgatctgtaaatacgatttctttcggattagtctatctttcttagcttaggcacaacccccatctcaccaatcaaaagcgtggcatattctatttcgccgcttcccgcttcccctgcgcttccgggattcagcatccaaaggccgcctgcatactcgcaatattgcctgtgtgtatgtccgaacaggatcgcgcttgcctcgtgttcctgtgcatagtaaagcgccctgtcgtaagaatacttcactttcaaacgatgcccatgcgtcaggatgattttctgcccttttaagacgatctcttcaaaatcatttgcgctttcccccgcatcgcaattcccttttatgaaaatcacctttgcccgcgtgttttcatcaatataacgcgcgtcacgaacatagtcccccaaatggaaaatatactccgcttccggacatgctaaaaggacggatttgatcgccccgcgattaccgtgcgtatcgctgattgccaatgcatgtacgtatttgctcacagtttttcgacttcctctttaagctttgaaagcgcctttgctcggtgactgatcttatttttcacctctgcggggatctccgcaaaggtctggtcgtattcttccacataaaaaagcggatcatagccgaagccgttttcgccgcgcggctcgtcgatgatcttcccttccgcatagtcttccacatacagcttctcctggccattgttagccatcaccagcgcgcagacgaaccgtgcattcctgttttcttcattttttaccagatccagaagcttttggttgtttttttcatcagttgcaccttcccctgaaaagcgtgccgaataaatccccggcgcgccgtcaagaacgtctacgcacagtcccgaatcgtcggccagcacgtctccactgaccatcctgctgatctcaatggcctttttagccgcattctcatgaaacgtctcgccgtcctctactacgtccgcaacgatccccgcatcctttaaagacagtatctcgtcataaaacccgcctaaaatcgccttgatttcccttaccttaccctggttgtttgtcgctataatcagtttgctcatatttcgattccttcgcctttcagaatttctttttgcttttcaatgatctccgtgattccttttttgcataatactttcaactgctcgaattcctgttccgtgatcgtacgtttttcgccgcacacctgtatctcaccaatattgccgtcgtccgtcgctaccatgttcatatcggcctgtgcgctgctgtcttcctgatagcaaaggtcgagcaatggttcgtcgttcacgataccggcggaaatcgccgcaatatgccccgtgagcggtgatttttccagaattccctgcgcaatcgccttttggacacataaggccaccgctacaaaggcgccgctgacagatgccgttcttgttcccccgtccgcattgcatacgtcacagtctacatagatcgtatattcgcccataccgtcaaaattacatacgctccgcagcgaacgcccaatcaaccgttgtatttccaccccgcgtccatccggttttgcgccgttacgctttttacgcgttggcgtggacgcaggaagcatcgcatattctgccgtaagccatcccttccctgtccctgtcaggaacggcggcacgccttcctctatcattgcgctgcacaatacctgcgtatcccctgtggagatcataacgcttccctgtgcatttttcagtacgttgctctccaattggagcggccgtgcctgctccgcttttcttccgtctatcctcatatctttctcccttaatttgctgcaatcattttagcatacattgcatgcgcattcaattgttgtggtataatgataagcaggagaaaattatgacactggatggtttgactttaaaaatatgcgtccatgagctgcaggaaaaactaaaggacgcaaaaatacaaaaaatattgatgcccggtaaagaggaagtcgttttccagctttattccgccgctgaaggaaccttgaagctggcgctttccgccgatgcaggggattgctcgctttacctgactgcgcaaagcaagcccaaccccaaaaccccgcctgttttctgcatgttcctgcgtaaatatttgagcggcgcacatattctggacattgaacaaaacggtcttgaccgtgtcgttacttttacgcttgcatccaaggatgaaatgctgcaccccgtgaccttgaaactcattgtcgagatcatgggaaagtattccaatattatccttacagacgaaaacggcaaagtgctcgacagtatccgccgtgtttcggtcgacgtcagcagcaagcgtcagatccttcccggcgtttcttatggcaatccgccgcaggaaaagtataatccgttggatctatccgaaaatacgctcagggaagtcctgacgaccagaaaagctacgaaaatgacctcccatatcgtttcgtctttcgacggtctttccctacagacggcacaggagatattacatcgtgcagggattaaggaacaggaaacgacttccctttcggaaaaacagatagaatggctcgcgcataccatgcaggattttctgcaagacgcgatacgtcatcccaaaccttgcgtgcagctcaatgccgataagctgcctgtctttttttcatgcgtaccctatgagacctatccgcaggaaacgcggatatactttaattcggtcagcgaaatgcttgattactactatagcaaacgcctcgatatctttcgcctgacccaacaacgcgacgcccttttaaaaacggtgggcaagctctattccaagctgcaaaagctgatccatatttatgaatccagcttgcaggatgcgcaaaaggcgcaaaagctgcaacagcgtgcagattatattactgcgaatatttaccgtctccaaaaaggcttgaaatcgtttgataccgtggactacgagacaggtgaaacgatcaccatcccccttgatgtctcgcgtacgccgcaggagacggctcaaaaactttataagaaaatagcaaaatataagaccgccgccgcgctcaataaggaaaaacttgaaaaagcccttgaagaacgcgagtttttggaaggcgtcctgcactttacggaaaatgcggaatccaccgacgagatcgcagatatcaagcatacattggtgcgcgcgggttacttggctgcgcccagtaaaaataagaaagaagaggaaagcacgtcgcagccccttacatatctttcccccagcggatatacgattttggtcggtaaaaatgaccgtcagaacgatatacttaccatgcgtattgcttccaaaacggatatctggttccatacacaaaaaatccccggttcacatgtgctgctgctgaccggcgggactgatatgaacgatatcgacgacgatacaatcgttatggcagccgagcttgccgccgcgcattcccgtgctaagcagtccggcaaaacaccggtcgattatacccagcgtaaaaacttaaaaaaaccgccgggcgcgcgtcccggcaaagtcatttacgacgattatttcacagtatatgttgacgccggaaaaggccatattccggcagtggaggaaatacattgagtcctgaagaaatttatgaaatttttgctcattcaggtacggacatgaacgaaaacctgaaccggaaaattgtcgataaatatatcatcaaacgcggccattccccgaatggctggttttctctttcgaataaaaaccgtattaagcttcaaatggcccccgtttgcaacaactgggaatatgtgcaaataaatgatacgatgtttttgtggtacgaaaataagaccgtcaaaaaacttatcgcctatgttttttatccggacgatacaacgcgcgtttattatgaatgcgatttccatatcgaatccatcattcgccgccgtatcccgcccacggtcctgacccgtaaatattgcatgttatgcgcggataacctgtttggccgtgaaatacgcggattttatgtcgacctcggcgctaaaaacagcggtaagggatttttgcagcttgccctttacgataaaaaccagtacttccacaaagtgttgcccgaaaatatcaaggcgatttggccgtttaacaaatggtttcagcgctttatgcgccgtcccggcgatgttcccctcttggatctgccgcagcgcagtccgcaggaacatttcctgcttcccaaaaaatgatatcaaaaaagcgcgcatacatgcgcgcttttgtttacttatttcatcggcaaagccctgctgcccggttttacaagcggctggtccgttttacagatcggacattcctccggctcgtaagatttcacttccatagacagtaccgcacgaaacggcacaccgaaatccaccgcgcccgcgctcctgtcaacaacgcttcctacgcctactacttccgctcccatggatttcaaaagcgcaatgacttccttaaccgatccaccggtcgtcacgacgtcctctgtcaccagtatttttgtgccaggctccacgctaaagcccctgcgcagcgtcatattgccgttttcacgctctgcaaagatattcttcactccgagttgccgcgacatttcatacgccataataataccgccgaccgccggccccacaaccaaatcaatttccatatccgcaaactgctcggccagttgcttgcagatcatctcggatacatccggatattggaacagctttgcacactgcatatatttatcggaatgcctgcccgacgtaagcaaaaaatgtccttcaagcatcacttccttctctttaaaaaccgcaataatttcttcacgcgtcatcatatcaccttaccaccttttttatatactcagcgtccccgtaagatcgctgatcctatctattttcatatcatttgcataacgctccagttcttctgaaataaccagtgaagccgaagggttgcgcatcgtcgccgcaccgaccatcacggcgtttgcacctgcgatcataaattctgccgcgtcctcgccgcacaggataccgcccagcccgatgatcgggatccccagctttgcctgatatacttcccacaccatacgcagcgcaacgggttttaccgccggtccggaaagccctcccgttacgtttgcgaggatcggcctgcgcgtctttgcgtcgattgccatacccgtgatgcaatttataagggataccgcgtcagcgcccgcgtcgcgggccgcctttgccatgtccgcgacttttgtcacgttcggcgttagttttacgatcagcggtttttttgccacgcgcttgacagcccctacgatatcgtttatcgcacatacgtccgtgccaaagctcacgccgccctgcttgacatttggacaggaaacatttacttcgaaaagggaaatattcgtatcgttcaatcgctctgcaacgtaggcatagtcctcggcgcaggcccccgcgatattcgcgatcttgaccgtatcatagtttttgatacgcggataaatggaacgtaaaaattcatccacgcccgggttttgcagtccgactgaatttaataccccgcttgccgtttcagcaatgcgcacaggcggatttcccagccgcggagcctttgtcagagccttgagcgtaaccgcgcccagctttgaaacgtccatatgcaaattgtattcctctgcatatccaaacgtgcctgatgccgtaatcacggggttcttaagctctactcccgcgatattcactctcatgtcactcataaagcgcgtctacctccctcatgtcgaataccggcccttcaatacatacctttttatgttgtccctttattttgcatacacataccgcgcagccgcccgtaccacaacccatatgctgttccatggaaacatatacggggatatccgtattttccatcacacgggcaagtgacttgaaaaacggcatcggcccgcaggacaatacgacatccggtttttcttggcgcagcctctccttgagcaggttggtacaaaatccatgctccccaaacgttccgtcgtctgtcgcaacgtacgtttgcgcaaacccttcaaagtcctgcacctcatatacacagcctgcattgcggtatccaagaaaagcgctgtatttcctgtccggatattttactttgagcgactttaacggtgcaatgccgattccgccgccgaccagccacacttttttcatatcatccttgagctggaacccgtttccaagcggcatcaggatatccagcgtatcgcccggcgctacgagggatagcagcctcgtaccttttcctaccgtacaatacgcaagatgcacttcccgtttctcttcgtccacatagttgatactgatcggccttcgaagcaagagctcccgcgcatgcggaatctcgatgtgtgcaaattgccccggccggaaataacgcaaaaaatcttctgtgcaggtcactttcaaaagatatgtattatctgcgatcagctcgtttgacagtaccttttctatcgtgtgcttatttaccattctttgccttctctctgtcgatgatctcgataaaatcgtcaaataagtatgctgtatcctcgggccccggcgcggcttcaggatggaactgcaccgtaaacatcggatagccgatgtatttcacaccctcgatcgtctggtcgttccagtttttgtgtgatacgaccgcgcatgcgggaagcgaacggctcatgatcgtatatccgtggttttgggatgtgatatacaccttattgcgctgcatgtccttgaccggatggttagaacccctatgtccgtatttcaatttctccgtatccgcgcccatcgcaagcgccaccaattgatgccccaaacaaattccgaagatcggaagctttccaatcaactgttttaaattttcgataattttgatattgtctttcgggttgcccgggccgtttgtcagcatcaacccgtcaaagtttccctgcaagatttcccgcgggtctgtaagcgccggaaagactgtgagcgcacaatcgcgtttttcaaggctgcgcagtatattgcgctttaacccaaaatcgagcaccgccagtttgcggctgccctgcgaatactggtatgtctccctgcatgttacctgctcgacaggcaactgcacctgatagtttttcatttcctcaatctgcatggaagaaggcggtacctgcgtgataatcccatgcatcgtgcctttatcgcgcagcttccgcgtcagctcgcgtgtatcgatacccgccagtccgatgatctcattcttgatcaggtactcctccaatgtcattttacaattccagttggaaggctcgctgcatttttcacgcatgacgaacgcgcgtacctgcgggccgccggactccgaaacgttctcatcgatcccgtaatttccgatcagcggatacgtcatcgttacgatctggccgcaatacgatgggtcggtaagcacctcctggtatcctgtcatacccgtgttgaatactacttctcccataatatccgcctgttttccaaaggaatcccccttgaaaatcgttccgtcttccaatgttagatacgccattacttcgtatagcgcgggcggtaattataattttcccgcgcgccccctttgcttaaattagtatgcaatcccattctttgcaaacgtctcgagaatatccgcctgcatatccagcgtcgcctgccgcgccgctttcgcaaaatccatccctttgtatttttcgttccggtaagcggtcaggatcgcccgtgaattgttcacaatgccgccaagtccccgtttatcaaaattcgggatcaacccctgtgcgcttcccccctgcgctccgtaaccgggaatgagcacaaaaatcgacggatgcttttcgcggattttttccgcctgctccggataggttgcgccaatcaccgcgccgacttccgaatatccatattttccgatgagatctcttccccattcgtccaccatatcggccatgtattcgtataccgtctttccgtcgatctccttatcctgcagttcgccggagctctggttggacgttttcgccagcacaaatattcccttgttatatttaccgcaatcagctacaaacggcgcaatgccgtccgttcccaagtatccgttgaccgttgcaaaatcggcgtcgaaaacagctacttcctcttcccctattttcgttcgtccaagatatgcgctcgaataagccgttgccgtcgcgccaatatcgtttcttttgacgtccgcgatgacgaccagtcccgcatcctttgcataggcgatcgtatcgcgaaacgccttcatcccctcgcagccgtacatttcataataagccgcctgcaccttcacggaaggaacgatatccgcgatttcatcgatcaatatcctgttgaactcgaagatgttatttgcagcataagcaagcgcgtccgtcccatattcacccgataaaaattcggacggcaaatactcaaacttggtatccagccccacacaaatcgggctttgcttttcgatgatctgctcaatcagcttgtctatcataggtaatctttccttcccgtatcgtcatcatgaccctgcccttcagctccattccgatgaacgggctgtttttggctttggatacgatgctttcttccgtataaacatagtttgcatgcggatcacacagcgcaatatttgctgtgcttccttccgcgatcctgccgccgtcgcgcccaagcaacgcgtggggcgccgaggacaacagccgcgctaaatctttataatctattatacccgcgtccacaaggtttgtcaccgtcagggtgaaagccgtttcaaacccgataatgccaaacggcgcttcctctattccctttgctttctcttgtggactgtgcggcgcgtgatctgtcgcgatcacgtcgatcgtaccgtccttaagtcccctgcagatcgccagcctgtcgctttcctcacgcagaggcggattcatctttgcatttgggtttttttccgcgatcatggcgtccgtcgcagaaaaataatgcggtcctgtctcgcatgtcacacgcacgccgcgctctttcgcccggcgtacgagctctacgcttcctttcgtcgatacatgacaaatatggatatgcgcgcccagtttttccgcatacataatatcgcgggcagtcatgcattcctctaccgcgcttgggatgccgttaagccctgctttttttgcgttctcgccgtcgtgcacaacgccttccccgcgcatcgcaaggtcctcttcatgcagcatcaaaaacgttcccaactctttcgccttttccatcgccggcagaatcacgtcgtcgtccgctaccggcaatccgtcatcggaaaaagcgaccgctcccgccttcaagagttcttcaaaatcggttaattcttttccctgcatcccctttgtgatgcttgcgaccggcaatacgcccgcaaaacctgcgcctgccgccttatcgatcatatagtgaaccgtttgggcatcgtccgcgaccggctttgtgttcggcatacagcaaacttccgtaaacccgcccgcagccgcggctttcgtaccggaaacgatatcctccttatgtgtaaatccagggtccctcaaatggctatgcaagtcaaggaatcccggaaacgcgtaaagccctttcccatccactgttctgtcggctttcgcgcataattgttttccgattttttgaatgatcccgccgccgaccagtatatcgacgtccttttccataccatcggcattgcaaatcattacattttgaatcagtaaggtcatatttctcctgaccggtgatatccggcgaaacaggtttcctgtcccgccgaaaccacacttgctttaaatattttttggcaataccgcgtttaagataataccgacaagagcgcttaagaaaatgtttgacagtgtaaaggactcggagaactgaatgccgcccgaaagccccaggccaatcaccagcatcagggatacgatgatcaggttacggctgtgcgaaaaatcaagtttcgcttctgcaagagtacgaaggccgatcgtcgcgatcataccaaacagcataatggacactccccccatgaccgcccccggaatagaaccaaggaaagccgtaaatatcccaaagaaactgatgacgatcgcaaatacagcagcgatacgcagcgtcgcagggttgtagttcttcgtaaccgcgagaacgcccgtattttcgccgtatgtcgtgttggcaggaccgcccaaaagacccgcgaccatcgttgcgatcccgtcgcccataagcgtcctgtgcaggcctggatcctcaataaagtttttgccaacgactgcgccgttggtggtgatatcaccgatatgttccataaaagtaacgatcgcagtcggcgcaataatagccactgccgtcgccaccttggccggttccaactcgtgtgtaaagaaaatgttgaattgcggcacctggaacccgaggtttgcgccgttctggaaaccggaaaaatccacctggcccatgagcgccgcgcaaacatagcctacggcgatcgcaatgatgatcggaaccagtttgaaaaatccttttgcaaagatcgaaatggcgaccatcgtcgcaacgacgatgagtgcgatcacccaacgcatccataaaagatccggaatgccttccgccgccggagcagtcacgatattgttgaatgccgtcggagcaagcgtcagcccgatcaccatgatcatcgggccggtcacaaccggcggaaatactgccatcacgcgtttgacgccgatcaatttgacaatcaatgccaggatcaggtacagcgcacccgcgcccatgatgccgatcgcgacatacggcagcgccgcttggtaggccggcgaagcaagaaagccctccaccgacggatcaacgccgctgatttgcgttgcaacaatgatgataacgccaatgaatgcaaagctcgagcctaagaataccggaaccttcccctttgtgatcaggtggaatatgagcgtaccgatacccgcgcagcaaattgccaccgcaggattgaggcctgttaaaagcggcaccagcaccgtcgcgccaaacatcgcgaataagtgctggaacccgagaatcgcttttttgccccatccctgctgttgctgctgaattgtcttgtccattatgatacctccccaattaatatgaataaatccatctatgcaaaagccttattccaaaatatgaataaggctttaagcatcttttttacggtcgcaaatatcgacgctttcttctccatcgaaatccgttaccttgaccgatattacctcgtgcgccgcagtcgggacgttttttcccacaaaatcggcgcggatcggcagttccctgtgtccgcggtccacgagaaccgcaaacttgatacaatccggccttcccatatccataatggcgtccattgccgcccttgccgtccgtcccgtatagagcacgtcgtcgaccaatatgattttcttgtcagtcacatcaaaatcgatgtgcgtcgcccccaccacgggctgctccgaatcctttgagagatcatccctgtaaaacgtgatatccaaagtcccaagcggaacctctacgccctcaaattctttgatgtatttggcaatgcggtttgcgatcgtgacgccgcgccgttggataccgatgaggtaaagcaccttggcgccgtccgtattttcaatgatctggtgcgcgatacgttttaaagtcctttgcattgtttcgccgtccatgatcgtcgtctttttcacgccatccattttaagactcccataaaaaacaccttgtcatatccggcaaaggacacagcaaggcacacaaaaaacgtttcttatgtacaccttacggcctctcaacggaccagtttaaaggttttatttttctcttgtttcagtatatcaaatcaatgcgttggattcaatcagtttttcatatttttttgagtgaagcgagcacgcgttcaaaataatcgggcattggagccaaaaattccatttgctcccctgtgcgcggatgtgtaagcccgagcttataggcatgcaggagctgtccttttagcccaaacttatccttttgccgtgtgtatacgccgtctcccactaccgggaaacccagatgctttaaatgtacgcgtatttggtgcgtcctgcccgttttcagcgtacattccaccagcgtataaccttcgtacctctcgagaaccttatactgtgtgactgcctgtctgccaccgctgcgcacaaccgccatcttcttgcggtcacgcggatcgcgccccaattgcgtcataataacgccttcgtcctttttgatgttcccatagacgagtgcaagatatacgcgccttgccgttttttcctcgatttgggcggaaagcgaccggtgtgcatcgtcgttctttgccactacgagcagccctgaggtatccttatccagcctgtgcacgatcccggggcgcagttgcccgttgatgcctgacaaatctttcaaatgataaagaagcgcgttgaccagcgtacccgtataatttccgacagcgggatgcgttaccatgccttgcgctttattgaccactgcgatgtctgcgtcctggtaaacgatatccagtgggatattttccggcgctatgttgatttcctgcttctcggggacatcaaggtctatttcatccccttgttttattttcgtacttgcttttgttgcttttccattgagcgtcacatcgccgttgccaatcagttgctttaaatatgaacgcgtatactgcggaaatgcttctgcaagaaaagaatcgagccgtgcgcccgattcttttgcaacgatcttatgattgtctgtcatcctgcttctccgcctttttgtgcttatcccagaaccatatcacaaatataccaagcataaccgcgccaatacagacaaaggaatccgcaacgttgaagatcgcaaagttaacgaaatcaaattccagcatgtcgacgacatacccatgcgctaccctgtcgatcaggttgccgatcgcgccgccggcaatgaacgccatggacagattaaacaatttagaattgagacgctttttatatttgaacagaatatagatcacaaccaccgccatgacgcccgacaaaatggcaagtatccatgtcgcattcgaaaagaggctgaaagccgctcccgtattttgcacgtaggtaatatttacaaacccgggaataaaggcaaaggattgccctacgctcatggtcgacgccacgatcatttttacaatctggtctcccgctataatcgcggcgatcaatatcacatatatcattaacatttctccgttcacaaatctacgtcgtattataccatatccaaaggcgaaaaaaaacaccgcctgtaaaaacaagcggtgcctgtcatttcatttttatcaatcgtctataatttcattcacaatatcctgcaaatccgccgtgctcttgcgcaggtcgttcatcgtatcctctttggactgtttgagaatctcattcaaatggatggactcgcgtgcggaggacgtgtcaaggtcagccatctgattggtcaggttactgatagattggctgatttccgctgcctggtgccccaccaacatttcatcgtcaagctttgtctccacataggacatctgatcctcaagaaacatcctgaaacgtttcttatagtcggtaatctgcttttcgtactttttcagttcctgcttagccgcttccatacgaagctgcgtgctctcaatcacagtctttgcattctggtttgcaatgtccatgattttctgcgcctgcatctccgcacgttcaatatatagcgttgcattgcgctgcgccgtgatgactgtcgacatcagcttgtcctcaatattgtcaagcttgtctgttttctgcttaagacgcgcgatctcagacttcatttcctcgtttttggcaataatattttcgttttcctccatcaaggattcaaactgcttgattacttcgtctaaaaattcgtcaacctgttccggatcgtatccattgaactttttggcaaactctttttccagaatatctttaggcgttatgttcatccggcgttcccccgcttactttattgttattcccgttccagatagctaaatccaaattcatcagccgcttccgctgtatttgtcgatacgtccacattatacggcgcgacgacaaaaatattccttgccgctttcctgatgttgccgttaagggcatatacagcgccgctcacaaaatcaaggatacgctgcgcgacatccgtatcaagctcgtcgagattgacaatgatcggctttttctcctttaaatgatcgatgatgctttgcgtatcttcataagataccggtttgtaaatcaggacccgcactttacttgtatcaggaatgccaaccacttttgctgtctctcctcttttttttgttttcttctcttccacaggcggcacaaagtcatcttcagggaatcccatcatatcgctttgcaaatcgtcctgttcatcataataacggtcgtccacttcctcatcggtcggttcgagcccgataaaggatagtaatttgtcgcccatttttcccatgaattaaagcctcccagcgtttatttgtaaattctttcgccaaatatcgcggttcccacgcgcaccatattagcaccttcaagtatagcgtctccataatcgccggacatccccatcgagagataatcgaatcctttaaagctgggtttccaatgatcataaagcgcttttgcctgtgcaaaaattttccgcaggtaagcatgatcgtctgtgtatggagcaattgtcataaatccgcgtatacggattttatcataatccgctatcctttcaaaaaagtcgtcgacttcttctaaatacaaaccggatttggtgtcctccctggcaatgttcacctgtactaatgcgtcgataaaagcaccttttttatcacactctttttgtagttcctgcgctaacgaaagcctgtccaaagagtgtactaaatctactccattatcaattatatacttaaccttgtttgtttgcaactgtccaattaaattccagttaatatcttttggcaggacctcgctcttccgtaaaaattcctgcacacggttttcgccaaaagtccgcagccccaggttatagacctgcctcacaacatccgtatcgaccgtctttgataccgcaaccaaagtaatacccgctgccggcactccggccttgcgcgcatacccttcaattttttcctgtacctgtttgatgttacatgctaaatccattttaaacctctacgtgctggtttaccgttaagatactgtttgcgtccaccggcgctataatcgcgctgccgtccttaatgatcttcacctcgatgggtacaaatgtcttatcacggcccgctactaccgtaactccggtaacgccatccttttcctgcaatgccttttccggcaccttcatcccttcaaatttcgaaaatacttttacgtccgtccgacgtgcgttcagcagttgcccgatatcatctgtaatctcgagggcgtaaacatacgcgtcttcctctttgaccgtacccaccactgtgccgctgtagggcttgtccaaataatcgtcaaaagcgatcgaaaaagtgttcccctgcgcaaactcgggaatttccgtatccgactgcgtgactaaaaaccattggtagttattgaccagccggaataacggcttttcggcagcatcgtccgtcgccgtattctggttttcctccgccccgccgtttaatatctcgcttacatcatctgacgtgatcgtagaaatattatctgcattgatcttcgtttccgcaccgtcaaaataaaaacttaccacgcccgcttccggagccgtaacagcctctttccactcatttacacgtccctggagctcgctttccttactatagaaatcattgagggtcgcatctgccgtggccgtatcgcgcagatatgcctgcttctgcgccatcaaggccttcaactcgttttccgcagtgacgatatcgccttccagctcaccattcacaatctggcgcatatcagccgatttctgtgtgatctggtcatttaaagacttcaattgctcatcaccggcaagcaggttttcctgatattcttcgatcttagcctgcacttccagcagttccgtaatcaccttatcgttatagccgcccttatatacctctgcaacatctgcgcccgcctccacgcgttcgccttccgctgccaagtaattcggtttaccatagctcggagcagaaatcacctgttcgtcgcgcacgacaaccacaggcagcgctttttcaaacataatctctccctgctccactaccgccgtgttcacattggtaataaaaaaaacaatagcaatcactgccgccgcaacgatgcccaaaaacacataaaacttcggattgattcgccttgctacacgtcttgcaggaggtcttctcttaaccgccataaaaaacccttcttcaacagtacgttcgtattgaaaataaattctgcatcctgtcgatactttcctgcaattatatcacaattatctcgtttcgcacaagtttctaccctgataattatccaagcttcaaggtgactgcgacggtgtttccaatttcgctgtactgcaggctgtccgccatgattttcaccaaaaaaacacccctgccgctttcgcacatcaggagatcgtcgctttttacgtcacgttctatgatctttttgctttcgaatccgcttccattgtcttccagtttgatgtttaacagcatgtcgcaataattcgcgtaaatgctgatcctgtccgcatccgaatatttaaagatattcataacaagttcattaagaacaagcctgatccggtactcctgctcatcatcaagccttgtctcctgctctacacccgcaataattgattctattgtatcgttcagctccgcaaagctgtttagtaactttttaatttgcacgctttctgtcctctgtaacatatactaccactatttgttatatctacatatagtatgtcactaccatatatttaaccaccggcggtatcctaaaacacatccatgcattaagttttcgtaaacgattactttctatagactgccgcaagctttccaagtattttgcgttccatacgcgaaacctgcatctgtgatacgttgagcaaatcggcaacttgcttttgcgtcttattaccaagataccgttgctctatgatctgcttttccgtatcgtttaaaaggctcatacagtaatttataaaatcatggttttcaatatgttcaaagctaacgtcttcctgccccagcacattgcccagcgagaagttctcactgtccgcaagcgcactatcaagcgaaagtacattatccgcctgctgcatttccagtacctcgagcacacgctccaccgtcatgtccagatactccgcaatctttttgggagacggttttgtgccatgctgggccatatactcctgcacatacaattttattttcttgagttgctccgtatccctcctcgggagacgcatcacacgtgaagaatccctgaaatagttcttgatttcaccgatcagcgaaggtgttgcataactggagaatttgattccgcgttccggctcgaaacgttcaatcgcttttaccagcgcaagacttgccacctggtaaagatcctcataatcaacgcccctgcctgcaaatttcttcgcagcgatctccgcgatatataaataccgttcgatcaatatatttctgatctcgacatcatgtgtttttacgtataattcaaacagcttgtcgctgtccattgccgaataatccgtcactttttagccctcgtttctacttgcgacttcctcataccgccggtgtctttttgaaagtaatctcccgcaacatcccatcctgctccaaaaactctgcatcctcacttaaggactggatcatcagcttgctgatttcctcattgaaacccgtgcagtcgtcctcacactcttcgcaaacaggactgatttcgagaccccttaccgttataagcatgctgtctgcgcactcaatcttcaactcgatccctttgcatgtttgtccgcatagaaacagaatacaggactctccaacacatgttttcaaatcctcgatttcatccacatcgtaatcaatattgcacgcaataccggaaaccgcgagcctgatcgctttcatatactcccgcttggcaggaaacttcatctctatgatttcagccatcgttaagccacctctatctcaaatacttgggtcaaccccgttacgtcgaatatcttaaataaataaggttttaattgcagtattttcatcgtcccaccgtattccttcacctttttcaaaatgctcaccaatacgcctaatcccgtggaatcgatatatctaagctgcgaacaatcaatggtaacacctgctttaaactcctcaatattctcatccatacaccgtttgaaatcattgacactgttaagatccagatctccgtccagcgttacaaaaatttcttttgcctggtcgtcatactttacttgaatatccaactttcgtacctccatcatagaattacattcagggataagtacatactacccctagtattaattataaacaagagtctttttcattaaacgaaaaaagcggggagagtaatttccccgcttttattctttcattttttgccgttatactcaaacgattccctgcgccatcatcgcctttgcaaccttttcaaagcctgcgatattcgcgccaaccaccaggttatcctcatagccgtattcttttgcggcagaggaacaatttttgtagatattgatcatgatctggtgcagcttttcatccacttcctcaaacgtccacggaagtcgcatgctgttctgcgtcatttcaagcgccgatgtagcaacgccgcccgcgtttgcagccttacccggcgcaaacaaaacgcctgcttccaagaacacgttcgtgccttcgatcgttgtcggcatgttcgctccctcgcctacagcatatacgccgttttccacaaggattttcgccgattcttcatcaagttcattctgtgttgcgcacggaagcgcgatatcgcattttactgtccagatatttttacagccttccgtatactgtgcgcctttcacgatatcggcatattctttaatcctgccgcgtttcacttctttgatctctttcacaacgtcaagttggataccgttcggatcatacacataaccgttggaatccgaaagcgctacgacctttgcgccatactgctgcgctttttctgttgcatagatggccacattgcccgaacctgaaacgacgaccgttgcgtccttgaacgattttccttttgcctcaatcgcttctttcatgaaataaacaagaccatatcccgtcgcttctttccttgcaaggctcccgccgtattcaaggccttttcccgtgagcacgccttcataacggttgctcagctttttatacataccgaacaggtaaccgatttcccgcgcgcctacgccaatatccccggccggaacgtccgtatccgcgccgatatggcgatacagttcagccataaatgattggcaaaaactcatgatttcgttatcgctcttgcctttgggatcaaaatcactgccacccttgccgccaccgatcggcgttcctgtcagactgtttttaagtacctgctcaaatcctaggaatttgataatgccaaggttaacagaagggtgaaatctcaagccgcctttatatggcccgattgcactgttgaattctacgcgcataccacggttgacctgcacctgtcctttatcgtctacccacggcacccgaaacatgatcacgcgttccggctccaccattctttcaagcagtccagctttttcgtactcaggatgctttgcaagaacaggctccagcgccggcaatacttcgctgacagcctggataaattccgcttgtcccgggtcttttgcttttacaccatctaaaactctttgtacgtaagacatatcatgacctccaataaatttttcgtaatttattatccaatacatgacattataccagtattaaaattcaaaaacaaggtgtttttgagtatttttcaagcaaaatattgtcttttttgcaatttgtaaaatattgtctttcatttcacaggaaatttttgctttttttgtttggatattgcattttcatgccttttttgttagaatagcaccgttgacatagttatattggtggggaccaataaatacagaggcggcgctttttataaagtgttgcttttgtttttacaggataaatgaaaggccggaaacgaattgtttcggcctttttggttgcgtgccatcatgacgtaagagtcatccatgcaatatctttttacgttgctttcctgacagccattatttattcagcagctttttcttcaaattatacaagtcatccgacagatccaccttataaagatgcggacgcttgatgcgcttaaattcatcccagaaagtcgccatatcgcggcgcgcatattcctgtatttcttttaaggacggcgatgtatatacttgcttcccatcctcaaatatcggcaccagcagattccgtatcgtaaaatccgtgatcgtcatctttttccatgtctctaaaggatcaaaaatcgtcagtggccgcgattcatcaatatgctcgtcctgtagcataatcaggtccgcaattgccatcccgtccgattttccataaatacgcgctatttttttgatacccggattagtgattttccagaggttttcgctgatcttcagcttaggtaccattgtgccgtccgcctcgtttgcgctcagcttataaacgccgcccagcgcagggcaatcatgtcctgtgatcatctttgtccccacgccccaaacgtcgattttagctccttgctgctttaaatcggcaatcgtatattcatcgaggtctccggatgcaaaaatacgcgcttttttaaatccggcgtcatccagcattctgcgggcttgcttggaaagatacgcaaggtcccctgaatccaaacggataccgaccggttcatatcccttttcgctcaattccctgaatacctgtatcgcattcggtacgccgctcttaagcgtatcgtaagtatccaccaaaagcatacaatttgtcggaaaggtttccgcataagcacggaatgccgtcagttcatccggaaaactcatgacccagctatgcgcatgcgtccccgccgccgttgcgccaaacatctgcgccgttaatacattggaggtcgaactgcatccgccaatgagtgctgccctggcaccgtaaatacccgcgtccggtccttgcgcacgccgtagcccgaattccaaaaccgaatccccctgcgctgcataaacgaccctgctcgctttggtcgcgatcaacgtctggtggttgataatatttaaaagcgcggtctcaatgagctgcgcctcgcaaatgggcgcgcacacccgtacaagcggttccatgggaaagacgaccgttccctccggtatcgcatagatctctcccgtaaaacggaagtccttcaaaaagtccaggaaatcctcgccaaacaggttcaaggaacgcagatacgcaatatcctcttgttcaaaacgaatattgttgatcaattcaatgacctgctccaatcccgcacacactgcataattcgtctcgtcaccctgtctgcggaaaaacaggtcatagactgccttatccttatgcttgccggctttgaagtacccgtacatcatcgtcagctggtaaagatccgtcatcatcgttaaatttctcacggcacacacctcttgcagataaaatttaagggcggaaattcatccccgcccgttttcgcatatttccacacgccagctccccagcgtgcatcatattctcatgcttccgcttttttataatctttgcagtatttcccttcataaaggacatttggcttgttcctcttccgcatggccagtatatagatcacccctattgcgatcaataccaacgacaaaaattgcgaagccggcatccccggccaaagctgtagtgtcgaaatacgtattccttcgatccagaaacgtccaattccataaccgatcaaatacatagcaaatacgtttccgtcgtgctttgcccgacgcgcataaacaagcagcagcaccaggactcccaaatcccacatgctttcatagaaaaaagtcgcctgcacccattggttcacgatccattcggtacctgtccaccgttcctggatatagaccgcatacggaaaaaactggagatttgggtctgtcaccacattgccgaacgcttcctggttgacaaaattcccccacctgccgatggcctgccccacgatcaatcccggcgcacagatatccagtaatcttccaagcgggaattttcgccatttcgatagaataacagccgcaattacgccgccgataatcgcgccgtagatcgcaattccgccttcccagatcgctacgatctgttccggatgctgtgaataataatcccactcaaaagcgacataataaagacgcgcacccacgatagcaagcggcagagccagtatcatgaaatcgaccatcagttcggcctgatatcccctccgctttgcttcatacacggcaacagctacacccacgataataccgcatgcgatcagtatcccataccatgcaatgtcgaggccttctattcccaaaaagttatgtaccgctatcttatctaccatgtcatgctttctttatccgggctgcttttcaggcagtctctatctttgccgcatcctttaaatcaagttcctcgattgcccattcacgcattttgtatttctgtattttaccgcttgccgtcatcgggaagctatccacgaaccggatatagcgcggtgctttaaaacgtgaaaggccgtttttgacaaaatcgatcatttcttcttccgtagcggtctcgttgtctttcaaaatgatgcaggcaagtacttcttccccgtaccgcttgtccggcacaccgatcacctgtacgtcgcgcacctttggattggtatacaaaaattcctctatttcacgcggatagatattctctccgccgcggataatcatgtccttcaagcggccggtgattttgaagtatccggcttcatccattgttccaagatcccccgtgtgcagccaaccgtcctgatcgatggcctgcgccgtagcctcgggcatcttataatatcctttcatgatattatagccgcgcgctacgatctcgccctgcacattgtacggcgcatcttcgcctgtctcggggtcgacaattttcgcttccacgcccggtatctttttccctaccgttgcaacacggacctcgagcgggtctgtcgtagtcgtcatcgtgattgcgggcgacgattccgtctgcccgtatgtaatcgtgatttcgctcatattcatatccgacatagcgcgtttcataaactcaatcgggcacggcgatcccgccataatgcccgtgcgcaaggtcgaaaaatcatacttgtcaaaatccggatgatccagcatggaaataaacatggtcgggacgccgtgtaccgccgtgcatttttcctcttgaattgcattcataaccttaaccggattgaaatgatcgatcaagaccatagtcgccgcatgcgtataggatgccataacgcccaacacacacccaaagcaatggaacagtggtacattgatgcacagaatatcattatgcgtgaatttcatgcaatcgccgatcgccatgccgttattgaccagattataatgcgtcagcataacgcctttggggaatcctgttgttcccgacgtgtactgcatgttgatcacatcgtggatatccaattcttttttgcgctgtgcaagctgcccgggcgtgaccttttttgcaaattcaaacaggtcgtcccacacaaacattcccggcttatcttccttatcaaggtagatgacattttttaaaaaaggcagtcgttccgactggagttctcccggcgcgcaatctttaagctccggacacaacccataaatgtggtcaagataattattatcctttaccccctgcatcataatcagcgccttggtatcgctctgctttaaaaggtactcaagttcaaactgtttatagttcgtattgaccgtaaccattacagcgcccatcttcgcggtcgcaaactgcgtgatgatccattccggataattgctcgcccaaatcgaaaccttatcgttcttttgcaggcccatacccataaagccgcgcgcaactatatccgtcaattcgtcaaattctttataagtatagcgtataccaagatatggggaaaccactgcttcgtggtccggatactgctttgcctgcctcgtgagcaaatccccaattgttatttccatcaattcagacatacatctgcctccttgaaactattcaaaacttaaccaatatattttatcaaataagtgcgtttttcgcaactgatcctgcaaatttttaaaacgctcaagaaaaggcctgatatgtttctgccatcccgcgcgcaaacggcgtatactcaaatccaagcgtcctgccgatcttccccccgtcgtaaagttcgtcctggtcgagtggaaacgggagcggcaggttcatttcgtatacatcctttaccgtcacgttccgcatacgcaaaggtcctcctttgatatcttccaatgtattcatgaggctttcataagttacccgctcgggagctgccagattaaacgcctgcccgtacgctgcaggatttccgacacatcccatcaaaatacgcgcaacgtccttcacatatacaaaagaaaacccgcaatatgaatccacagggaacggaatctctttgccctccgccatcaaccggaaataataagattccctcggcgcataattgaaaggcccgtatacaaaggccggccgcaggatcgtgcccgcgatgttgccgccgcatacatccttcaattccttctccagcagcattttttgataagcatactgcgcgcccggatatgttccctgcttcgtgatcaagggcgcgtcttcttttgcgggcattcctgtcgatggggcaaacacgctgcaactgctgatataaatatattgttttaccgcatgcagatttagcgccaccgtacggatatccccctgctcatatgcgcaaaaatctattaccgcatcgtattctactttcggcaatataccggcaatccctttcggatcatgcctgtctatgacaaattcctgtatccggctgttctttaacggaaaacgccccctgttcataacatgcaactcaaaatcggtttcccgcgccgccaaaatcgagaatactcgcccaatgaagtagctgccgccaattaccaacactttttttgccattttttacgctcctatgtcgtccatcaattcttcaaatgaatcaactatcctgtcggccgatgaaaggtcctggtttcctgaatccggattgcgaaagcccaccgcataaaagcccgccgcttttgccgcctggatacctgcagtagagtcctcaattgcgatgcttttctccgcctttattttaagcgcctcacagatattgagataaacatcgggatacggctttccgcgctccgcatcctccgcactggaaaccgcatggaaatattgatcgatgcccgcgcttttcaaagacaaaacaatatttttgtttgatgaagacgatgcaactcccattttgatcttttttgcactgatctttttcacaaattcgcggacgcccggcaataccggcggatcatccgtttcatcgaaataacgtgtgatgctgttcttgtattgcgccatcatttcctcttccgtaagcgtaatgccgaatcttctcttgagcacgccgcagcaatgcttctcgcaccggcctacaaaattatcatgataatcctgcatgtcgagcggcgcgccatagggccgtatcatatcatttatgatgtccatatgtatcggttcactgttgatgatcacaccgtcaaggtcaaatatcacggcttccacaccatcaaaaagattattttccatgcctgcctcccgatcgtaaatgtctcttaaaaagaaaaatcggaacaaaacaagctttgttccgatgtggcagccgaataaggattcgaaccttaaatgaacgagtcagagtcgttagtgttaccgttacaccattcggctatttataaaatataacccaaagtgccgtacgccttgaattctaacacccgcctctcggcaggtgggtatcctgcttccagcattaggcttcctgcgcgtagcagacgtgctcaccgctgaatagacgctggattcccgaatttagaacgtgggtttaaaacacaaagcattacgcacaccccaggaatcttttttcgtgtattataataacacagcctttctaagttgtaaaccctcatttcgaacttttccctttgattttccatctgcttttttatttatataatattatacatttctttacaggtatgctattataaatgttattatgaattattttgggggaatgtagaattgtacaaaaacagaaatatttttaaggttattgccgttcttgtggcagttgtttttttcatggcaggatgttcttcatccgcatcaaattccaagctcaatccttcagatccggtaaccctggaattatggcattattataatggtccgcaaaagattgcctttgataacctcgtttcggaattcaacgacacggtgggcttggaaaaaggaatcattgttgaagctttcagccagggcagtatcgacgaactgttgaataaggttgttgatgcctccaacaaaaaggtcggcgcagacgatatccctgatattttcgccgcctattccgatacggcatacgcggtcgaccagttgggcctcgtcgccgacctcgatccttattttacacaagaggaattggatcaatattttccttcctatattgaggaaggccgtttcgacaaagaagaatccctcaagatttttccaatcgccaagtcgacggaagtcatgatgatcaataagacggattgggataaatttgcacaggccacaggcgctgcctacggcgacctttccacgatcgaaggcgtaacgtctacagcccaaaagtactatgagtggacagacagcttgacggaggcccctaacgacggcaaagcatttttcggacgcgatgcgattgccaattatattattagcgggctgaagcaacagggcgtgaccgtatttaacgtcagcgatggcggcagcgtacagtttaatttggatcaaaatgcactgcgcaaggtttgggataattactatgtcccgtatatcaacggttattttggcgcatacggtaaattccgctccgacgatgcaaagacgggagatctgatcgcgcttgtttgctccaccagtggagcggcctatttccccaccgaagtgaccatcaacgataacgaaagctatcccatcgaatgtgaagtcctgcccaacccatgctttgaggacgctgctgaacgctacagtatccagcagggagccggtatggtcgtcacaaaatccgatgaaaaagccgagtacgctgcctgcgaatttcttaagtggtttacggataccgagcgtaatattgatttttccatcggttccggttatttacccgtgaaaaaagaagcaaatgatgtgtcgctcattgaaaaggcctttgcgaaaagcgaaagtgaatccaacgctcctttggaagcatctgttgtaacctccatcgaacaggtcaatagcgatcacttgtataccagcaccgcttttaataacggtcttgccgcacgtaacgttttagaatactctatttccgataaggcaaaagccgaccgcgaagctatagaagcaatgattacagccggtacaagccgtgaggaagcggtctcatcctatgagacggacaaaaacttcaatgcatggcttacagaattgaaaaataagttggatgcaacccagcaataagtagggttgcattgccgctgcaagaggtaactatgtccgtcaaaataagggaaaagtccattttcagaaaatttatgattccccttttgatcatcatggtcattcaggtgattttatttgcctgtatttttctctttggcggaacaatccggcatcttgataataattcatttgatatcctgaccgaccgtacaatgagccgtaagaattatttgcagaatgagatggtgcagcattggtcaaatgtcggtccttttgaagaatcgatcgcggcaaaaatcgaatctgtcctgtccacacagaatataacgccggatcagatcaatgaaaataacgctcccgctattttaaatgtggcagcggatgatcttttatccatgctgcgcgaaaacaacaccggcggttcttttctaattttaaatggtaaagacggttctgcgtcaaaatccggcatatacctgcttgatatggaccctactacaaattctgcagacaattcggatttgctgatcgaatatgccccttcctctgtaaccaagcaactaggtttgccgcttgacagtacctgggctcctgatttttcactggacccatccgatcctgccaataaatattactataatccttttaatgcgggcagcgagtatcctgacgtaaataccgaggatctgggttactggagccttccccatcaggtttctcccaattcttcacagactgtaattgcttacacgcgtcccctgcgcctgacagatgggagtgtgatcggcgtcatcgggaccagtatttcaacagattatatcgcttccctgcttccttatgaggaaatcaatttggaaggaaaaggcgcctatcttttgggcattggcgaaagcggatcaaccagtatccagaatgccgtgacaagcggaccaatggcaaaaatgtttattggcagcgcaacttcgacatctctcgttgaccaaggcgattatgaaggcatttacgagttccaaaaaaacgaccgcgtaagtgataccatatatgcaaacgtgcagtcgttgcgcctttataacagcaatacgccttttgaacaggaacagtggacgcttaccggttttattgaaggccgttatctcctggattcctcttatcaggtcatttttatggttttagtctctttggccattgccattgttttcggcttaatctgtatcaatattgtcggacggaagctgacacgccctatttcttcgctggtggatattatgcggaacagcaatgctgaactccctgttgcttttcctaaaacgcatatcagggaaatcgacagccttgccgatgccgtggaaacgctgaaccatgatgtttcacagtctgcttccaaactttctcaaattatccagactgccaatatttccattggcgcattcgagtattttcctgtaacgaatcaggtgctcattaccggccattttttctcactgtttggtttgccggaagctgacttgaattcctactatatgcccgcaaatgaattcgaaaagcaaatgaaggagtttcgtacttattacgaacccagcaacgaagaccatacctatctgtacaaaatacctttcggttcaggcgatatacgctggctgcgtctgaaaatcatccaaaaggatgaagcaattttaggcgtgctttccgatatcactcaggaaacacttgaaaaacgcaaactggaattcgagcgtgattatgatttgctgacaaatcttctgaaccgacgcgctttccatgcccatatgcaggatcttttcagacatgactcggacatcaaaaccgctgctttcatgctgtgggatcttgataacctgaagtatatcaacgatacttacggacacgattacggcgatgcatatctccgcaatacagccgatatcttaagacgttttgtttcatacaacaatgcgatcgtttcacgtatgtccggcgacgaattttacattttcgtgtatggttatgataataaagatcaacttcgtgagattatccattccatcaagtcggacatggacactacgttgctccagcttccaaattctgctgaaacccacatccgtgcatccgtaggtgttgcatggtatcctgatgacgccagcaactattttgacctgatccgttacgcggattttgcaatgtacaccgtcaaaaacacggggaaaggcagggttgctgaattcgaccaatctctttacgaccgtgatgcgttcctgctgcacagtaacgaggaactcaaccgccttttggagcaggaatttatcgactatgttttccaacctatcgtcgatgctcgcacgggtgatattttggggtatgaagcattgatgcgccctgcttcccaaacgctgatcactcctgcggatgtactgcgcatcgcacattcccaggctcagttgcatcgggtcgaaaagctgacgctcttttgttctatccgcgcgtttaaacaatatcccgaaatcgtacaaacacgcaagctttttgtcaataccctgcccagtcaaatgctcgatgctgaggatcttgaaaagttcagcaacgagtttgacgggttactcggccatgtcgtttttgaattaatggagagtgagcatttgaacgaagcttttacagaagaaaaaatgcgttatatcaaaaaatggaatgcccaggtcgctattgatgattatggctccggctacagcaatgattccatgcttctgtcggtccatccggactatgtaaaaatcgacatgtctatcgtgcgcaatatcgatacggatcaaaatcggcaaatgcttcttgaaaccatactcgcttatttaaaaggccaaaatataaaaaccattgccgaaggcgtggagacctctgccgagatggaaacgttgatctcctatggcgtcgactacctgcaaggcttttatgttggtgctcctgctcccatccctgcttccacatgctcacgggcgcaggagatacgcgatttaaattaacaattagtgcaaaaaagaaagctgcgtaccatcaacggcacgcagctttctttatcccagttattggtaactgaccttttttatacgccttggcgttttagcgtagcgtctacgaattttttcgcccgcgggatgtccccctcatccagatgctcaatgatgagcggaatattgggatgatatttccccagtaatttcaaatacaaatcataattgagaactccaagtcctgctgccggaagctcgaccgctcctgatccgcggaaactatgggattcgtccgcatcgatatccgcatgcttctctcctgtatcctgcgcaagccttatatcctttgcgtgcgcgatgaccattttatcttccagcgcattgaatatgcgctcaagctgtccgtctacatcgcttatattattctggtcaaaataattcgtcgggtcgcatatcagcttaaggttaggcatgttcacatccttgaacacgcgctgtatctgctcgatggagccgatcacgttgttcacatagttttccatgataaacgtcgcgcctacctcgcgtccgaatttcgtaagttcatagatcgccgcacacgcttcctcataagcctgttgtgtcgcattcttatcatcccatacccagtcgctgtctttgcagtatgtgcccgtctcgcttgcgacatagggacttccgagatcaagcgcacgttccatcatgcttttgatataatccatattctttttgcgctgcgcgcgatcgttgtgcacaaaatttgtatacgcagacaccgccacaatgggcaggttcgcatcgcggaacttatcgcggatcatatttgccttttccctggtaagcgtttccctggtcgcatcgcagtctttgaacgaaacgtcaagctgtacgcaagagaacccgcccgctttgatttttttgatcgtatcgtcgatcgtctccggataataacccgtgaaaatacctgttgaaatcatttgccttttcccccttatccaatgatctcgcttaaataaacgctgcgttcctcttcaatggatttatagcatgcttccacgcacgcgatcgtacctatgttgtcttccgcgctgatctccggctgcgtgccgtcttccacagcgcagagcaggttcgccatcgtcccaacgaatgcatcgggaaaccactgtgtgtcccacttgggctcgatccactcatcagggcgcgacttgcatgtcaattttaatgtgctgcctgcaaacccttcgcgtttatgccagccgaattcgccttccgcaaagccgtcaagaccttcgatgcgccaacggatatagttgtcctttttgcacggctgctccggccatgcccatacgtcgtcgaggctggtcgccatcaggccgtccttatattgataggtgaactggacgatcccgtccgtatgctcaaatttcgtacgcgggtctgtgcggcataccgtcgtaattttctccggatcgccgaacaggtatcgaaaaatatccacatggtggatgcccatagaaaatatctccaatttgttataagcacgcaggaatccttgccagtccggaattgcgcgcatatcgatggtagcgatcaccggcgcgccgatcaagttctggtctaagatatatttcattgcccgcatggactgatcgtagcgcatatttgaattgaccgcaatgggtattcctgcctctttgccgagacgcacgatgtcccttgcatcctgcagggacatcgcaatcggtttctggcacaaaatccctttgatatgctttttactgcaaatataccggaccatttcaagctgcacatgcggcggtacggcgatatcgatgatctctacctccggatcgtctaccatgtcgtgccagtcttcgtatattttttgcagtccatgcgcagcggcaacattcttactctgctctagatcaagcgacgtgattgcatagggattgaaaccggctttccgataagcgacaagatgacagttctttacgataaatccggcgccgatgatgccgatcttataatcttttttctttgggagcttaggcagcgtcgcctcttccaatctcttcaccaaatcctgcatattagcctcctatttgtacagtgagccccattttttcgcccatgtctttgtatggttttaattcttctttatcgatcattttgcagtcgcccattgcatagcttaaaccaagctgttcatatttgcgctttccaagcgtatggtatggcagcagatgcaccgttttcacaccgtaacgcttcaccagtccaaatatacagcgcagcgtttcttcatcataattgaatcccggaatgacgggtatacgggctatgacatgcccttcccctttggaaaccgcatacgcaaggtttttcagtatcagcgccagatcaccgcccactgtctgcttcaatttctctgcatcgcaatgttttacatcaaataaaaacgtatcaatgtacggctgggcttctttgaatttttcctgcgggacattacctgttgtctccaccgcagtatcgagccccgcttgcttcgcctgccgcagcaattccaaaaatccgtcaaactgcataaacggctccccaccggacaccgtcaacccgccatttgttgtttcataataatctttgtcgcgcagcgccgttttaacgatatccgcaacatccatgccttcgcccgcataatggatcgcttccgccggacaatgcgctccgcacgtcccgcataccacacatttttcgcggtcaaaaacaggtttgccttcccgcatgctgatcgcgccgtgcgggcatacccgcgcacacgtcccgcagccgatacacttatgttccatatagcgaagctgctttttcaatttttgtgattcgggattggaacaccatgggcagaagagcggacagccctgcaaaaaaacagttgtccgtatcccttccccgtcatgtatcgcaaaacgttctatttccagtactttaagttcctgcatcgtttattgtgcttccttatcgtcatagagtaccctgctcatcaattcctgctggatatccggctccaaatccacgaataccgccgagaacccgctcacgcgtacgatgaggttcgggtaattctccggatgcttcaccgcgtcctcaaggtcgcctttattcacgaccgtgaccattaggtggcagccgccctttttgaagtatgtcttaaacaacgccttgatcttttcacggttttcattgaacatcgatggcgagaatttgatattctgcaccgaaccgccgtggtatttcgcttcaaacttcgcaagcgagttgagcattgccgtcggaccgttttggtttgcgccgccctgcggattgttcgccggattcatatactgccccgcgtaccgtccgtcaagcgacgctgcggttttcctgccccattccgtattgagctggttattggaaatcacaatcaggaaatactgcattcccgccttgatccctctgtcacgtatgccctgcgcgacaaaatggtacaagtcaagagccataccgtccgcagtatcaaggtcgtttccgtatttgtcacattcccagcagtccttgcgtatctggtcgtacccttcgaaattggcaagcgccgcctcattaagctgttcaagcgtatactttttcgtatcatataccaaatgcttgatcgcccacagcgcgtccgatgtgttgatgttcccatacgtttcgttcgtaccgccgaggtaacgcacgcctccatccaaaagagccttaccacgcgcgatacagtcgtccgtcaagatgctcgtgaacagaaaggatacctgctcgttcatcagcttgtaggaatacatctgcgcgtcgatcgcaaggtcgaagtagtaattcaaaagctccttataattgccgtacaggtcttcaaacgtcttgaattcgctaagcggtttgatcttgattggcccgcactttttctgaccgtccgttggatcgatcccttcgtttaaggtaatggtcagcattttcagcagattcatgcatacgttcggcgttcctgtactttgcccctggataacaaactctgtgcatccaaacggcacatactgctccgccgccttttcatctaagcgcatcccatacataaccgccggaatgttcacatcgtcgttataaagcgtcggataagtggctcccgctcccagggcgtccagcgcttcatcccaaatctgctcggacatgtcctctgtgacacgcagcgtaaactgcggttccacatagcggcagtttttggcgaccttcatcgcaatatgcaggaacacatccgccgcttccggatccctgcgtccgcgcccgcccacgatgatgcggccgtttaccgtggtcctgcggttttcgatcatcgtccacagggattttacatattcatacgcttcgtcctcgctgatcagtcccgtttccagatcgtgcttcaaaaacggccccagatagtcgtctaatcgtccatagttgatcacgcctgcaagcagcgcgtacagccagaataactgcaacgcctggtggaacgtttccggtttgccatccttgatcttttcaaggctgtcccagatggtctgtaattcctttttgcgctttgcgtccgctccctttatatggcgccatgccatattctgcaaatgctccgcacacgatacaaacaaatccagacacgaaagcgccgccgtataaaaatggttgtccggcgatcccttcatgtgatcctgtatttcttttctaagcccgccgatcccaaggtcgatcagtttctggtaatcgagcatcatgcccgaaagccgcgccgtcgcaatcatcggataattcacatcgataaaacgcccgatggtgtcttccgtcagtacgtctttgcaataaagcgtctttacatcgtgatccagccagtaatcgtaaaggatatctacacgttttttcaggctttcgtccgtaagctcgtctttaaaagaaagcagcttattgaacacgcaataatgtccgactcctccaagggatgtaacgcatccaaaaccaatgggcaggaaatctatcctcccgataatcttgtcttccggctctatttcacggaaaagtgtcgggtagagcaccttaagacactctacctcgcgcgtttctttcgcctgccccgtgaacgccttatgcgccgccgtatactgctccatgatctcgagctgctttaataacggtttttcgcacggcagttttttacttacttctacgttttgcgcgccgttcacgtcaaattttaccattctttgctcctttttgttttactccaattagtgtttcttgcgctctgcttcgcgccagttgtcctgatatccgcccagcaggtccacaaaacgtttcgcagtcaggtgcggacgcgtgatcgcgcttcccacaacaacgctgtgcgcccccagataaatacatttcatcgcgtcttccggcgtatagacatggccttccatcaccatatatgcttcatcgcccatttcgcggcacatacgtgcaaactcacgcaggtcgggcagttcgatatgctttgtttcagcagtataaccgtaaagcgtcggtcccacgatatccgcgccgttatcgatcgcgcgccttgcttcctcatagttggatacatccgcaaaaagcattgcttccggaatctctttcttaacgataggtaaaagctcgtaggccggtctgcccagatgattgatctggtttgtacagtccatcgcgatgatctctgctcctgcttcccaaacctgcactgcagcttccagggtcggtgtgataaatacatccgtattatcattccatatcttatacaggccgatcataggcaggtcgactttttccttgatggaacgaatctgctccggcgtattggcacggatgcccactgcgccggcccactttgccgcttccgccattttcacaaccatttcttccgaataaatcgggtcgtccttctgcacctggcaggatacgatcaacccatttttgaatgattccagtatttcacgttttttggggtctgttgttttcattgcttttcacctttctcttatagataaaatatagatatattctttctatatttagtatatacccgtcctatgacaattgcaatccatttttatcattttttatcatttattcacaggtttattctgagaatccgtttaaattcaagacatttccctttatcattttttatcatccaattccaaaaaaaggccgcttatcccagcggcctttttccttatgtcagattttttatctttctttcatttttatgtatcttactgccgctgccaagcagccccctgctatacctacgagaaagatcaggaattcgactccgttcccctctcccgtaagcggcgctgtttgacggactttcgtcccactttccggctcggctggcttcgttgtcgattcagccggcgccctttctttgacttcaaagacaatgtccgccgtttttgtcccatctgccatgcttattgccgttgccgtaactttccctttcttacgtgcggaaaacaatacgaccgtctccccgctcgtacttaccctgttttttacctccaccgcatcaaggtcgcctgcgaactgccaatataccgtctcattcccacctaatgactgttgcacacgtgcaagcgcaacggcgtcctctccgggtgcaagttctgatacggcggcatctatggaaacagatgtccccgtatcaaatccggagtctgctttcaacagtacgctctctgtgctgcccatcgttgcaaatgtccagcaggtagggggattcccctggttctttaccgatgtgaccgcaccaatgctccttagatcaaaagactcaggcagtccccccgcagtcgcagtcacttcagcttgctgcaaaccgacgaatacctgcgcctgcattgtcggcatatcctcctcttttgtaccgaaaacaggaccgcctcctgtttcttccgtcactaccacacttccctgcgcatttttatcatagccataaaccttgatacagttattcgcagcaaatcgttctgaaatatcctgccattcaccgtcgcctatgcgtaggaaactctgccctgctgttgccgtcgcgttggacgcataaccgggcgcgggcctttccagcgccgccgtcacattattgccatagagatttttttgccgcaccgtcacggaaaaggcacttcccttttcaatctccaccccttgtgccaaatctaccgtataatagcctgcatgctggtgtataccgcttgccgcaagcgtttcggtttcttctgttccgatatacaaatcatattcctgatccataccgagtgcataaaaggatacggactttatggtctggtctgaagatgcggtaaaaatgtttcttgcccaaatttcacttccttgaaaaggttcttttctatcgataaatcccgtataaccatacggatcatgcatatacaacacgttgatatcttccctgctgcgctccgccttcaccactgcggccggattgtttgaaaaatagacgctgcaataggaaatataaaaatacccattatctcctgaggtttccccatagctgttcttcgcaaggaacgcaccgtcgtatgcgggaacatattcctcgccatcaacctgtatacggaatttttctttggataccgtgtcgtcccagcctatgaccgtaatcgcatgccctgaaccgttcgtaagctccggcggatggtaaaaatatgttttgttcccgttataatattcctcttcctccatgatgccgcagtatagcgcgccataggtatagattgcgtttttataatatatattgtcaagcgcgccagtacgctgcggcagtaatatcatatccttcaggcggtaggcagacatccccgtatggtaaaaagaatccgacctgtctacgatatcatcttcatcataatataggacgtacggatcctgctgctccgttaaatagccatcccagcgcgaaaggcaggctgccgaggtataaacagctcccgcatttaaaatatcgccccgcctgcctctgtcgaacgcaaaccgtgagtccggatgataggcggcattcaccagattgtattcggaaaaatcgtacggatcgctcttaagtgtcgatatatttaatccatactccgttttggaatatgaatgatccccgctttttaccattacataataggttcccggcgccagataacgcacgattcttgcgtcgccgccattcattgcaacgtctattttgtttccattcccatcgaaaagccgcagctcataaaaaaagctctcatcctgcggttgtatgagcacaataccggtccgccctccctgcggcagggaaaaagaataataatcgagatcatttctatttgatatcgtcgcacgaatgtccgacggaactgtaagggcagtcgcctgttcgagggcatcgtttggttcatacgcatcgacgccgctcgtgccataccatgcctgcgtcatttcaccatcctgataacctgccgcccgtgaaaatgcattgatctgcataccgtctacaattgttaaggcgcccgtatacagcgctcccgaggtcaatggatctgtaccgtctgttgtataccatatctccgcgcccgccgtagtacaggcaagctctacctgcatgccgtccgtataaaaaccgctgtccggcataaagctgaccggcgcacacaatgcctgttcgaactgctgttcagcaatatttccgacctccgtaccaaggtatgcccgcgcctttaagaggaatcctcccgcagtatgcgcctgcgcaatatcctccaccaacaacggcgtatttggttcatacaccgcactcgcctccgtaggatctgttccatcgaaggtatagcgaatgacagcttccggcgtctggcaggtcaggtatatctccgtatcgtcatagattcgccaggatgaagccgatatttccacgtcatcggccgtgttgggctgcgcaaatcccgcgtttccgcctaaaaccaggcaacatacagtcaataacgccaccaaacacatcatcttattttgctttactttacgcatagaccgttatcctttcgaattcccctaaataattatacgacaattttgtaatctgtgtccataaaaaaagcaggtcgccttccggctcctgctcttctctttatttcaaacaaatacgatgttctccggcaattctccttccggcggcttaccgttacatacaacagtgctaaagtccgcgatctctgcaaatttcaaaaaccccctcatttgcagcttactattatccagtaataaaatcccctcgtccgtattttgaagggcaatgcgcttgatcagcatactttccatttccgtggtatataccacgccttgtgccgcatcgatccccgtacacccaataaacgaaagattaaaatggaactgcttcaggacatcctgtgcaatcggccctacagtcatgctgtaatatggcaaaaatttcccgccaaccacgattacttctgcaacaggattggttaccttccgcaatgcaagttcattacatgtaacaagcctgatatgcttggccatcaaatgctctgcgagcggtaccatgctagtccccgcatccacaaatacgcagtctccatcttcaaccagactcgcagcataacgcgctaccgcccgttttgcgtccatgttgatggaaattctttccttcatcgtaagctccgcgtcttccagaacctcctccagggcggcaccgccctgtacacgccgcaatttcccttccttttctaatttttcaaaatccctgcgcacggtaatttctgaaatagcaagctctttggcgatctcctttaaattgatgatcccctttttgtttaagcaattcatgatgtataatttacgttcagaagcaatcatttttccataccttcccccatccgtttgttcttctatttctttactcaatacatttttcgagaaaggccgcgccaataatacccgcgtcgtttcccaaggttgccgccacagcccgtggagcgcccacgtccgccgctccgaaaacataatcctgtagtttttcattgagcgggcctaaaaggcattctttttggttgcaaatcccgccgccgataataacaatatccggtctcagcaccgtcgccagatttccgactccgactgcaacataagaaatatactgatcgacgacatcctgtgccgccttatcgccctgcttcgcggactcgaacgcagttcttccatctaccctgtttagatcatggccgcaaaattcatgcataagcgactgggggtgcgcttgcattgccgcttttgtctggttgataaggcccgtcgcgctgccgtaagattccagacatccttttttaccgcaggtacacagtacgccatcatagataatgacggtatgtcccggctcgaagcccgcaccgtccgcgcccttaaatattttcccattcaatatcataccgccgccgactcccgtaccgagcgttatcatcagcgcattttgatacccctttgccgcacctgcaagcgcttctccaagcgccgcacagtccgcatcgttgtagacgagcacgggcagatccacatgcttattcagttcctgtacgatgggcacgttatgccaccccatattatttgcaaagaccagcaatcccgtcttgggattgatgcagctcgggcttcctacgccaagcgatgtgaaatcagcaaaggtaaatccggctttttcagctacttccctggcggcgcgccccatatcggcaacgatttcctcgaacgaacggtgtgcgcccgtcgggatactgtgccgcgcaataatattataattttcgtcaaccacacccgctgcgatattcgtaccgccgaggtcgatccccagataatatttcatccaattctccctaaaattttatgaaattcgttaatacaattttacaataattatcaaaaaaaatcaagtatgatcaatttatttcatcacacttgattttttattcactcgtccgctatgtgttgtccgtctccgctacaccgtcgtcttgataaacgtacaatcgcctgcgatacttattccgccgctttccgcaggcgcaaacaaactgtctcccgccataaacgcaagtttttccccgtcattttccgctacccccgagccttcgaggatcaccaccgatacaaagcttttttcgtccgcatcgattacagtacatccctgtgtcgtgacaagctccgtcgtgaaataatcgcagcttgcaagcggtctatgcagtgcgccgttttcgtcgctccattcttttgacggcaggctttttgcagagggttcaaaacggctcaccgcaagcgccttatcgacatgcagctcacgctggcggccatttaagtcccgcctgccaaaatcatatacgcggtatgtagaattcgaattttgctgtatctcacagatcatgatccccgcgccaatggcatggatcgtgcccgcagggataaagaacacatctcccttatgcaccggcaccttctttagcagatcacatacggtatcctcttcaatcgccctgcgaaactcttcttttgtcgttttgcggtttacgccatagtaaagatatgcgccttcctcgcaatccagaatataccacatctcagtctttccatattcatgctccgtacgcaatgcatactcatcgcttggatgcacttggacggaaagggactgcttagcgtctatgaacttaatcaataccggaaagtcttcaaacttttgtgcattttttcctaaggccggtttacctattttactcaaatattccgaaaattccagccctgcgtatttccctgtcacgacgctgctctgtccgtccttatgcgtggaaagttcccagctttctgcaagaggctgcatatccgtgtctttatggtattttgtcttaaggttcaccccgccccacaaatagtctttgaacgccggattcaactttactattcccatttcatgcctcccattgtcattttcctgtcgatccgaacccgccgctgccacgctgcgtttccaaaagttcatttacttcacaaaactgtgccgcaagcacaggcgtcaaaaccaactgtgcaatgcgctcaccggatgtcaccatttgcgcttctgtggaatgattatggagcgaaaccagtatttctccccgataatcactgtcaataacgcccaccttgtttgccggagcaagcccgcgttttgtggcaaggccactgcgcgcatagacaagccccgcatacccaaccggtatttccatagcaatacctgtcggcacgagccgcgtttcgcccgggccaataatcatatcctcgctaatgcaggcgtaaagatccgcccccgcagaatattccgaaccatatgtgggaacaaccgcttgcttattcagttttttgataggaaccgtttgtttttccattgctttactccctaaaatttgatttattatccgccataaattgtagcacagtcccacaaataaaaacaacccttcactcgaagggttgtctcttctcgttttattcggcctggcgtttttccctgccgtgcgtataggtcggcagcaacaatggcgaaaccttatcgcttttgatgcctgccgcgctcatttcgtttgcatatttcaaaacgtgctccagcgtcagcttgccaacctctaccgattgcgccttggcagaagcatgctgccctgcgttccggccaaacacgatcacatccagcagcgaattccccatcaaacggttcctgccgtggattccgcccactgcctcgcccgcaataaataggttttctatcccgctctgcccgtctaccgtgatattgatcccaccgttctggtaatgcagcgtcggataaaccaggatcggtacttttcgcatatcgatatcgtatttcatatacatgcggagcatcgccggcaagcgtttttcgagcgttccctcgccgtggatgatgtcgatcatgggcgtatccagccacacgccgtatccttcaggagtttcaacgcccatatgacgctcgttgcattcacgaataatggacgccgccgcaacatcgcgtgtttccaatggatgcataaatgcttcgccctcggagttgatgagcatcgcccccatggaacgcaccttttccgttaccagcgcaccgaaaatctgctccggaaacgctacgcccgtcggatggtattgcaatgtatccgcgtaaagaagcggtgcgcccgcacggtacgcgaggatcaatccgtccgccgtcgcgccataatggttagacgtcgggaacccctggtaatgcagcctccctgcgccgcccgtcgcaatgatcaccgtcttggcacgcgcgatcatgtattcgcacgtttccatattttgcagcacagcacctgcggccctgccattttcgtcaagtatcaactcgatcgccgccgtaaaatccacgatcgggatctgccggttcatgacttcatcgcgcaatacgcgcatgatctctgcgccggaataatcgcgcgccgcgtgcatccttttgcgggatgtcccgccgccatgcgtggtgatcatcgttccgtctgcttccttgtcaaacatcacgcccagttcattgagccattttacagcgcccgggccttccgttacgagtttctttaaaagctccggcttgttggcataatgcccgccgcccagcgcatccagataatgaatcgcaggagaatcgttcggtttgtctgccgcctggataccgccttccgccatcatggtattcgcatcgcccatccgcagcttggtaacgaccatgacgtttgcccccgccttatgcgcttcaaccgcagcggacgcgcctgcaccgccgccgccgataaccagcacatcgacatcgtatgcgatccggtcaagatcaaggtccaggcctgataccctgctgtttgcctgcaaaagcgccgccagttctttcgggaccttatcgcccttgttcgggcctatctgcaattcttcaaagctatcttccctataatccggatggaactgcttcaataacgcatctttttcgtcggcggtcattcttctgggttccacgccgatccttgcctgtctcgtctcctccacctttttgatggatgcaagcatttctggtgtaaacataatgtccccgcctccttattgttcgatctctctatggttatagagctcttttagttcttcaatcggtttattcgccacgtcttccaaaagccggataaaatcgccgtgctcgatatcattgacacgctgcgtcaaatgcttcgcctcgggcgcaatatattttccggtcagtcggcgcgcaagcagcgcgacctgcggatgggaaatttccgccggacaacgcgcggaacatacgccgcacatcacgcaatcaaaggatttttccgcacacttctcatattccccgcgctgtgcatgcgcgatatactgcatgaccttgagttcctgcgtgcaggcctttgtgcatgcgttacagccgatacaactgtagatttccggataaagctgcatcatgatctgctctgtcggttttactttttccatgtcgtaaaccggctttacgatcgggaaaaacggcagcatcgcaacatacatgttgtcttccaccgtcgtctggcacgccaagcagaattttaaggtgttgtcgcctttgattcggtagatcgtcgcgcaggcgccgcaaaagccgttacggcagccgcagccgcgcacaagctggtatcccgcatattccattgcccccatgatggtaaggcctgacgggacgctgtacttcttgcccatcagaaagacatttaccatttcttccattacctgtctctcctctcaatattcgtccggaagttcttccagttcatcgcaccggaataccggaccgtctttacacacatattttgaaccgatgttacaacggccgcatttgccaatcccgcatttcatgcgaagttccatcgtcgtatacacctgttttttatcaaatcccagttcttccaaagcctgtagcacaaacttgatcatgatcggcggcccgcacacaagcgccgttttatctgtcgtaaaaccaagttcttttacatagttgggtacaaatccaacgtgtccgtcccattttccctcttccctgtcgatcgtcaggtggacttgcacgtcttttgcattggcccattcgtctttgatctcattgaagtctaccaggtcttccatagaacgcgatccatatacgatatcgatcttaccgtaattctcacggtaatgcagcacgtagttgatcacagaacgcagcggcgccaggccaatgccgcccgcgataaacagcaggtcttgcccttttagttctgtttccaccggaaaggcgttgccgtaaggccccctgatcgtgatctgctgccctacatccatttggtgcagccaatctgtcaggcagccgcactttttgatgctgaattccataaattccgtattcgtcggcgacgaggtgatggaaaacatcgcttccccgacacccggtatggaaagcatcgcgcattgccccggcatgtgctcaaagcatacgccgccgtcgatcccgtttgcgcggaatgtctttacgtccggcgtgtccttcctgatgtccgtaatcacaccaatacttgggatgagcgcgtctttcctgttcatatccgtattatttgccatcttctttctctcccaaagctcttattacctttacgatattcatggatatcgggcatttggaaacgcaccgcccgcatcccacgcaggagtattccccgtcgttatttgccggaaaatagaccagcttatgcataaagcgctggcggaaacgttccaactgcgtcttgcgcggattcccatgcgccatacgcgtaaaatccgaatacatgcacgaatcccagcaacggtaacgccggataccttttccggtatcaaaatccctgatatcatagcactggcaggtcgggcacacaaaagtgcacgttccgcaaccaatgcatgcacggtacaattcttcccactttggcgaatcaaacagcttgtctgtcgcatctccgtcgataccttcaaggctcaaatccttgagcggcagccgttcgaggatctcctttgtcctggcaaccgcgccgccaatctcgctgtcgtctgcgtcctcaaacaatgacgatacctgcgccgtcaattcttcgcccttttgcgtaaccggcttccaatacagggtatcgtttgcgatccatgtggcaacgtcgccattcgcctgcgtcgcgtcgattccgaaagtggaacagaaacatgtttcctccggctcactgcacgccagcccgaccaccacgccgttttcacgccgtgccttgtaatacgtatccaccggatcgctcaaaaaaacccgatccagtatctccaaacttttgagatcacacgggcggacgccaaataccacaaacggcgtatccggttccttgggcggcagtatctcgatgttttttttctgcattttgaaagccaccaggtcttcgctttgcgggaagaacaaatccttgggggatttgaccgtattaagcgcggaaagtttgaccttcgcgccttcctgccacctgttataatttaccttgcccgtctcaaagatcggcaagtacaattccttcttctcgtcaatcgcggaaaagagttctccgatacggctcataggcaattttttcattatttcccgcctcctttttccgcatgcttaccaggttctatatcatcctgcgtatattccacgagcggccaaggggattcgtcgtccgatcccgcctggtagtccccgtaaaattcattgatatccttgatgaatttgcggtttaaaagatgcagcggtattccctgcggacatacacggctgcattccccgcagtccgtgcaccgcgccgccacatgatacgcgcggatgatgtggaacatattttcttcaaacgtatctacattcgccttgctgctgatccccgaagcgtcgttgtcaaaaacgcacttcaggcacgagcaggcaggacaggcattgcggcaggcgttgcagcggatacacttggaaagctcgctgcgccagaacgcaaagcgctcgtctgaggtcatgttctccaaacgcttcaccatgccgaagcggtcatactcacgcatgtccacagggttctcatcttcgatcatctcatcgaacacgacgcattccttgcctttgcacgccatacatttttcaagcaatacatcctgcgacctgcacgtcttatcgccataaagcgtttttacatacagcgtgccggctttttcttcgatatcctcgatacctttgatccccttggcatgcaattttccaacgtccgccatgccgtgacatgggatgcccagcacgtataccttggaacggtcgatcctgtgttctttgataagctggttaaagctatacgtatcgcacggctttaacggaaccaatatcttgccttcctttttgctttccgcgatcagatacttacttaagtttgcgccgcaaaaactgttatataccaggtcttcaaggtcctccgcatggaatacggcgggcgtattgtcataacaatattcgccttttttccatgcaagcacgcggtctacgatcccttccgaaagcagacgcttcgccctgtcttttatgactttttctattccttgcatctcaaatcctccaacctcttgttctctcccagctcgtggatggtcttagagaattcgttcattacctgcgcaaatttttgtccttccgctgcagatacccattctacgcgcgtccgtccgcgctcgatccccaaataatcgagcatgctgaacatcagagccattctgcgccgcgcataatagttccccgttgaatagtggcagtcgcccgggtggcatccgttgatgataaccccatccgcgccacgctggaacgcccgcaggataaacatggggttcacacggcacgaacacggcacgcggatgatcttgatatccgccggataagaaagcctgctcgttccggcgaggtccgctcccgcataactgcaccagttacagcaaaaggcaacgatcaacggcttgaattcgctgttttttgtctcgctcaattcttgcatatcgcatctacctccgccataatctgcctgtttgtaaatcctttcaaatccatcgcgcccgaaggacatgtgaccgtacacgcgccgcagccctggcataccgcctcgttgacgaccgcgatcctacgtgtctcacgcacgccatggtcgtttacttctttttcaatgtagtcgatcgcgccatatgggcatacgttctggcaagcgctgcagccgttgcacagcagctcgtcgctgcccgccacgcatggattgcagctcagcttgtccttggccagcaaaccgatcacctttgccgcagcagctcctgcctgcgccaccgtttccggaatatccttcggcccttggcatacgcctgagaggaacacgcccgccgtcgggctttccaccggcctcagcttgggatgcgcttccgtgaagaaatcattggtatccatactggccgtaagcatcgttgcaatactgcgcgccgttttatccggctcgatcgccgccgcaaggacgacgaggtctgcatcgatcacgacctgcgtattgcttatgaggtcgctgccctgtaccatcagcttcccatcctgctccgcaactttgcccaccatacctttgatatagtttacgtcatattgttctgccgcgcggcgctggaactcatcaaagtttttgcccggcgtacgcacgtcgatgttgaataccgtcacttccgtatccggatatttttcccgcgtaagcatcgcgtgcttcgcggtatacatgcaacagattttggaacaatatggtttgccgcagcccgacgtatcgcgcgagcctacacactggatgaacacgatctttttgggatgctcgccgtccgatggacgcaaaagcactcccttcgtcggtcccgccgcattcgtcagccgctcgaattcgagcgatgtgatcacgtccggattctgcgaatatccatattcgtcaaatttttcaagcgagatcggattaaaccctgtcgccgcgatgatcgcgccgtactcccgcgtcatgatttcgtcctgctggtcgaagtcgatcgcttttgcgctgcacaccttttcgcacaagccgcactttccggttttgtaatggatacaggcgtcatggtctatcaccggaacgttcgggatcgcctgcgcgaatggaatatagatcgcgcctctgtttgaaagccccatgttgaattcgctcttggccttgcgcgacgggcacttttccgtacacagtccgcagcccgtacaaaggtcgctgtttacattacgcgccttttttcggatatcgaccttgaaattaccaacgaaaccggacacgctctccacttcgctgtatgtgtagatattgatcttttcatgcgccgccgcatccaccatcttcggtgtcaaaatacaagccgcgcaatcgagcgtcggaaacgttttatcaagctgcgccatcttgccgccgatcgtcggtgatttttccacgatgtcgacttcgtatcccgcatccgcgatatcaagcgccgtctggatgcctgcaatgccgccgcctatgacgagcgcacgttttatgaccggactttcgcctgcgataaggggggcgttcagattcagcttggcaacagccgcctttgcaaggatgatcgccttttccgttccttcttctttatccttatgtatccacgaacactgctcgcggatatttgcgatctcaaccatatacggattgaggcccgccgcgaccgccgtttttcggaaggtcgcttcgtgcattctcggcgaacaggaacaaacgacgatacccgtcaggttgtgttctttgacagcctctttgatcttcgactgtccgccttcgctgcacatatactggtaatccgcggtgtagacgacgccgggctcgcttttcactgcctgcgccactgcttcaacgtctaccgttgccgcaatattgcttccgcaccaacagacaaatactccaattctctgcaagaaaatctcattcccttctcgttacttgttatacttccgcagggcgcttgtgatcgcctgctgcggcatatcttcatccaatatttccggaatctgcgtgaccttcaaatggttctcgccttgggagcggacctttaaaagcctcaccgcctcaatcagctttgcgggctccacaccgcgtgggcagcgctcaatacaggcaaagcatgacaagcaccggaaaatcgattccgaatccatcagttcctcgatacggcctttcctgaccatggaaacaaactgatgcgggtgatactccatttcgtcgtacgcggggcacgtgcctgaacacttgccgcatgtcatacatttccttggatcaacgccgctcatgcgcagcacttgctcgcgcatatcttccttgctcatgttcactgcggctcgcccccttccttaacccccagcgcttctgccagcagttccgtaaaataataaacggaaacgccgtgtcctgcgctgttcttgtcaaggttatacctgcataacggacaagccgtcacgatcgcttccgcgccctttgcctccgcagaagccaggatgttcgcacaagtctttttggacgcatccttgtcctcgatcacaacatatccgccgcagcattcattgcggtacggatagatcaccggctgtgcgccgatcgcatttataaaatcctctatgatcgtcggattttccggattatcaaactgcatttcatcgttcgggcgaagaagcaggcaaccataatacgcgccgatcttccttcccgtgagcggatttttgactttctttttcaactcggcaaatcctactttatcgcgcagcatctccagataatggatcacggatgtttcacctgcataatcttcttcgagtttcaggtaattgttgaccttcacacggatatcgtcatccgtttgcatatcattgttcacgcgctttataacatgatggcacgcgctgcataaagtaacaagctccccgcctaaggcctttgcgctatctaacgcgcgcactgccgaaagtttcgttgcaatttcgtctttagccagaggatataccgcgccgcagcactgccattccggcaattcttccagcgtgatccccagggcctgcgcggattttctcgcgtattcatccagttcttttgcttttgttttcagcgtacatcccggataataacttaaaaccatattgatttccaataggacctattggaacctcctcccgtgttacaattcttatttttcttataccatttcctcaggatggaatacctcgtcgaacttttcctccgtgaggaattccagagccacgcaagcctctttcagagaaatattctccttgtgcgcttttttgactgtctttgcggcgttatcatagccgatatacggattgagcgccgtcaccagcatcagtgaattatgcaggttgtgccgcattttgtccctgtccgccttgatacccgatgcgcagttgtcgttaaaggagcgaagcccatcggataaaagccttacggactgcaggaaattgtagatacataccggcataaatacgttcagttcaaaattcccctgcgaagccgccatgcctaccgcaacatcgttgctcatgacctgcactgcgatcatcgtcatggactcgcattgcgtcggattgaccttccccggcataatcgagcttcccggctcgttttccggaatgaaaatttccccaaggccgcagcgcgggccgcttgccagccagcgcacatcgtttgcgatcttcatcatattcgccgcgagcgcttttaacgccccgtgtgcgaacacaaggtcgtccttggacgttaaggcatggaatttatttcccgccgtgacaaattcttttcccgtcaggtttcccacctgttttgcgatctcttccgcaaatcctttaggcgcgttaaggcctgtcccgacagccgtgccgccgagcgccagttccttgagccccggcaaggccgctttcagcatttcctttgttttttcgatcatattgcgccagccgctgatctcctggctaaacgcgatcggcgtggcatcctgcaaatgtgtgcggccgctcttgacgaccccctcgttttctttttcaagacgtttgaaggtctttatcatgcggtccatttccggcatcagcttgtcttcgatgttcagcaccgccgcaatatgcatcgccgttgggaaggtatcgttggagctctgcgacatgttgacgtcgtcattcggatgcagcagcttttctcccgcgatctcgtttccgcggttggcgatcacttcgttcgcattcatattggattgcgtaccgctgcccgtctgccaaaccacaagcggaaaatgctcgttcaattttccggatattatttcgtcgcacgcctgcccgatcaccttgcatttttcttcgctcagttttccgagatggaagtttgcgatcgcggccgccttctttaaaatgccgaatgcatgcgtaatttcccttggcattttttcgtcgccaatttgaaaattctgcagacttctttgtgtttgcgccgcccagtaacggtcggctcttacttgcatctcgcccatcgagtcacgttcaatacggtattccatttgctttccctcccacaatggctcgcttattataaattgatctgtttgattacgccttttaatacatccgcactatggcgaagctttccaatttcctcgtccgtaagcggcggaagtacgttcccgcagataccatccggccctacgaggaacggtatgctgaggcatacatcgtcgatcccgtattcgccatggagcatagacgatacggtcatcgctgtatttgcgctgccgaacatgcactgtacgatcgtacatacggaaatcgcgatcgcatagaacgtcgctcccttacgcccgatgatctttgcgcccgacgtcctgatatagttttcgatctcatcaggatcgatctccggattccaaacctttttatagtggaacctgcgcttataatcaagaaaatttacgcttccaacctgcgcgatggaccacggtacaaaagaactgtccccatgttctcccatgacgtaagcgtggatattcttctggctgatttccagatattccgcaattcttgagcgaagacgtgccgtatcgagtatcgttcccgatccgacgatcctgctctccggcaagccggacaccttgcaaaacgtgtatgtcaggatatctaccggattgctcaccagaatatacagtgcatccggcgcgtgcttgacgatctccggcgcgatttgcttgatgacgtcgacattggtctgcgcaagatcgatacgcgattgccccgccttccttggcataccggacgtaatgatgaccacgtccgagccttttgcatcctcatacgtccccgcataaatcttcatcggcgaacaaaacggcgtaccctgccgcacatccatcgcttctccaagcgccttctccgtgttgatatcgatcatcaccacttccgaagcaagacccgttactgccattgtgtatgtaatggtagacccgacgctgcctgcgccaatgattgttaccttcctgctcataacgactttccccccttatacataaaaagcaggcattccacaccgcctggaacagcacctgatccataacggcatgtacgcctttttttgatacctttttctattcttgtttctgcaaaaaacaattccaagcataacaaccgtatgcaactccgctatcttaaacaagtggaatattgcacgtctggaccgccccacagcggaacaccatttctccttcgcataccatttcgtctctcgtttttatcatttgtcaattttttcacattaacaaagtaataaaatactagattgtgtatattttaacaaattatttatcctttgtaaataggtatcagcataatcgtgcaaaattgcaataaattttaacgataatattgtctgttatttcacagatgtgcacattgatacgattttcactggttttttcagaaaaatattatttttttgtacttcctttaaggtatgccaatttactgtcatatattttttaaaaggtaaatacccacaccggcagcgccgcaaagcagcataaccagcataggattcattttaaatttgcgtaatacaaacagtgatatagcaaaaagcactgctgtaaaaaggtcgatatcaatactggcgggttgcgccgttccggtaagcgcgatcaacaaaatggtacacgcagaggatgcgattaagcctaccgatgaagcacgcaggccgctcagcacgtcgtttaccccgtcgatcccgctatattttcggaatagataatagagcgtcgaacaaagcaggacgccagccaaaatacatccgaaggtagcggccagcgcgccggggaacccagcgatgcgcgttcctacaaatgttgaagtgttaactgctataggccccggggtcatctgcgatatcgtcaggatgtccgtcaattcctggaatgtgatccattgctgcgcatcgacaatgtattgctggatcagcgggatggttgcatatccgcctccaaagctgaagagcccaacttgaagaaaatttatgaagaggctaagcagcagttccattctgtcgcctcctttgaacccaccctacgataaatgcagcggcagcgctgcccagtatgacgagaataacattgacctgcaaaaagaataccaatacaaaagaaagcggcagcaagacagatagaaccggctgtttttccttgaaaaccgcacgccccatgtcgatcaccacgtctaccaccaaggcgcatacccccgcttccatgcccttgagggcagccgacacgatcagattatcgcggaaagcagcataaaatgccgaaattaccgttagaatgataagcggcgggataattgctgcaatacaaccaatgaacgccccttttttacccgcagtatggtaacctgttaccgttgccagattgacagcgatcgcccccggtgacgactgggccactgccgcaaggttcatgagctcttcttccccaaacaatttctttttctcaacaaaatatttccggatcataggaacgaccacatacccgccgccgaatgtaaaagcgctgataaacaggttgatcccaaaaagccaaatcagtgatacctttttttccattgatgcccctctttcctttctattttaacaattgtatatccataaataaaatgttattattttattatattcataacaaaatagtaatgtataaaggagtatattatgaatctgcgccagctaagcgtattttgcagcgtatgcgaagaaatgaattttaccaaagcagcccaccgtctctatatgacgcaacctgcggtttcccacgtgatcgcggggcttgaacaggaaacgggatgcgtactgtttgaccgcgttgcacgcgggatttccctcactggtgcaggccgggccttttatgagaaggcagcggctattgtggaattatataaggatcttgaaagaagcagcggcagttttgaatttacttcgccaatccgtatcggttccagtattacgatcgccaactttttattgccgggtatcatgcatgaatttcaggaaagcttttgcaatacgcccgtacgtatcgaggtcgatactgcgcgtcataatacggaaaaattgcttgcgggcgaaatcgacgccgcgctcatcgaaggcgcgatatccgataaccggctgacggcccatccattttcttcatttgcgattgtcacagtctgcgcgccggattatcctgcgcctgttcccctgacgccgcgatccctggcctgcgaaacactgctgctgcgcgaaaagggcagctctgtgcgtgacgttttcgacagcgcgctgatgctgcatgggcttgtttgcgatcccacatggacaagcgttgattcgcaagcgttgatccatgctgcacaaaacggctttggaatcgctgtcctgcctgaacttttggtgcacaacgagcttgcaaacggcacgcttatagagctgcatgtgcaggatatgcatttacaaaacaataattatactgtatttcatcgtgaaaagcatctctctccgcccctgcgcgcttttttggagatcgccgagcatcatacctgccaatctgcaacataatacaaaaagggacatcggataccgacgtcccttttgtttgactgctataattatgcgtcttttcttgcttcaatcgagcgttttacctgctccgtaaacattggaagtatcttcagtacatcgccgaccacgccaaaatccgccacctcaaaaatcggtgcggtttcatccttattgatcgcgacgatcacatccgaatcctccatgcctgcaagatgctggatcgcgcctgaaatgccgcatgcgatatagaggttcggacgaacggtcttacccgtctgaccaacctgtctgtccttttcaacccagcccgcgtccacacaagcacgcgaggaactgaccgtcgtatcgccgccgaatgcctgtgcaagatcctccaacagcttgaagttctccgggcatcccatgccgcgtccgccggacaccagaatttttgcatcttggacatccattttatcgtttacctttttgatgatatccaaaatctccacatttacgctctctttcggaacgttcacgggataattttctaccttagcatgggattcgatgggagaaatgcgctgcattacgcccgggcgcaccgtcgccatctgcggacggtagtccggacagatgatcgtcgccatgatattcccgccgaatgccggacgcgtcatgcgcaggttctttgtttcagggtcgatctcaagacctgtacaatctgccgtaaggccggtatgcacacgcgccgataccctcggagcgaggtcgcggccgatcgccgtcgcaccgtacaatacgatctccggcttctttgcctgtataatctccgtcagtacatgggcataaggctccgtcatatataccttgagctcgggagcatccgcaagaattacgttatccgcaccgtaacggccaagcttctccgccattgcgccaatatctgatcctaaaacgactgcagttacttccgtatccaaatccttcgctaattcttttgctttgccaacaagttccagtgaaacgcttgtcaacttgttatcttcctgctgcgcaaatacgaatacgcctttataatcctgtatattcatcatatcaccactttccgtcaaataatgaacttgctgcgaagcttttccatcaggaactcaaccgactcctgcgcatctgtgttgaccactgtacctgccgccttaagcggtttggtgaatgatttgaacacatgcgtcggggaacccttaagcccgatattgcttctgtccacgtccagatcttcaagcgtccagatcttgacttcctgctcacgatacgcgtcgaagatgccccttggcgtcatataacgcggctcgtttagttccgcaagcgcggtgatcaggcacggcattttcgctttcagcaagtgatacctgtcctcatactggcgttttactacgatgctgtcgccttcaattttgatttcttccgcatagctgatgttcggaagctttaaatgctccgcaatctgcggaccgacctgcgccgtatccccgtcgatcgcctgacgtcctgtgatgatcagatcaaatggcagcttcttgatcgcagaagcgagcgtggaagacgtcgcccatgtatccgctccgccaaacgccctgtccgtaaccaggatcgcttcgtccgcccccattgcgagcgcctccctaagggcaaggtctgcctgcggcggccccattgaaataacgcttacttttgctcccgtagaatctttcagtcttaaagccgcctccaggccggctttgtcatcgggattgataatggatggaacgccttcacgaatgagcgtccctgtattcggatccagctttacttcattcgtatccggaacctgtttgatgcaaacaacaatattcattgtatttcccccttccgtttacttgagcgcagcgcctgcgattaccatgcgctgcacttcgctggtaccctcgtagatctccgtgatcttcgcgtcgcgcatcatgcgctccaccgggtattccctcgtatatccgtatcccccaaaaagctgtacgcatttggtcgtcacttccattgccgtttccgccgcgaaaagctttgccgttgccgcttccaccgaaaaacgctcctgcgtatcctttgcgaccgccgccttatacaccagcaactgcgccgcgtcgatcttcgcctttaaatccgcgatcacaaactgcgtattctggaatttggaaagcggtcttccaaactgctttctttccttcacatacgcgattgcttcgttaagcgctccttccgcgatccccaatgcctgcgccgcaataccgatgcgtccgccgtccagcgtattcattgctattccaaatcccttgccttctttcccaagcaggttttctttgggcacgatgcagttttccataatgagttctgccgtcgcgctgccgcgaatgcccattttgcgctcttttttgcccaccgagaagcccgggaaatccttttcgacgataaacgccgagatcccgcggtttccctgcgatttgtccgtcatcgcgaatataacgtagatatccgcatatcccgcgttggtaataaaaatcttattgccgttcagtacataatggtcgccttccagcacagctttggtctgctgccccgatgcgtccgtgcctgcccctgcttccgtaaggccgaatgcgccaagcttttcaccctttgcgagcggaacaaggtatttttgtttttgctcttcgctgccgaactgcttgatcgggttagaccccaacgatgtgtgtgccgatacgataacgcctgtggtaccgcataccttggaaagctcctctacgcacataatataactgagcgtatcacagccctgtccgccatactcttttgggaatggtatccccaaaaagccatacttcttcatcttctctaccgtctcgaccggaaagcgttcttcttcgtccaggtcctcggcgagcggcttcacttctttttctgcaaaatcgcgaaacagagtttgcagcatttgatgttccttgcttaatgtgaaatccatatctctctcctaaacataacgtttttttacaatatcttcactcggtgatacaccgattcgattcccattttcatgcggtatttggcaaccgtgcgccgtgcaataccgatcccctgcgcatttaaccttcgggcaatctccgtatccgggagcgaaggatctttttcaagcattttccgcatttcgccgcaaatataatcgctgcttacctgcgccgtctgcgcccgaaaactccccgtaaagaaatgctttaagggatagactcccctgtcgcaaatcagatatttccctgcaaccgccctgcttacggtggaaacgcttacgtccatttcttctgccaggtcgcaaagccgcataggcttaagcggcgcatgattcaggaaaaaatcctgctgcttgaaaacgaccgtttctactaccctatgcatcatcgttttccacagcttcagggaactgatcatacggtttgcttccatataacgttcctttaagtatatcttcgcctcatcatcggcattttccaaatccttatattccggattgatggaaagatgcggaagtctttcttcagccactttgactgtaagcgttgtcccatctttttcaacaatgatctccggatgtatatactgcgttgtttcccctgtttttatgccgttgatgctcggccaaagcgaacgcacaagcgcacagtatttttcgcattcggcttgggatatcccaagcgttgccgctatccgttcctttttgttctgcgccagctcctgcagatggtccttgatgatcgcataggggtaaacttccctgacgccctgtcgtttaagctgcaaggtcaggcattcccgcatattacgcgcgccaatccctgccggctctaaggactgcacaattcccagcgcttcttttacctgtttcggcgaagcatgatagccaagagcaaattcatcataagtttctgtaaaataccctttggaatccagactatgtatgatcgctgttgcgatccccttttccagggtgctcaattttttaagtcccagctgccttaaaaggtcgtcggtcaaggtccgcttatccgccacctcgccgcctgcttccttaggggtctgagagacgcgcactactttaccgccgcgcgccaggcggaatatctcgctaccctgcgtcagtctggcctcttcgagctccagaacaggattgtctattactgcctgttttaagtaatcgttcagttcaagcgcattcattttcagcaggaacagcgcctgctgcatttgctggcccaatatctgggactgtacctgtttttgctcaatactgatctgaaccatgtttccctgctcttagataaatccacgatggagccaagggtcggctccatcggtgggtatcattgtttttgattacgcccagatttcttcgtccgtaggaatctttttgtctttgttgtaaaggccgatctgcgaaacgttgatcaggtgcgtataattcaagttctcggaaatactgttgttcccccagctcccgcagccaagcgtcgtcgtcggcgaaaaaccgttggtcagcgcgccaccggctgtcgtagaggacggctggtttacaacgatacggcttaccggcatatgttcgccaaccatgcgcacgtgctccatatcattggaatggatcgcgcaagtatgtccctttccttcataatccagattctcgtaagcgatgtccatcgcttcttcaaacgtatcgtaaggaatcgcgatcataaatgggcacattttttccttgcacagcaggtctgccctgccgacaccgcgtgccttcagtacgacaacctttgttccttccggaacgctgacgcctgccagtcctgcaatcttctgtacgctctggcccacaacgtctttgctgatcacgccgcccgggaagatcgtctgtgcaaacttctcgacttcatccggatcttcaatgtagtaagcgccatttttttcgaacgccttaatcactgtatcatattcatccttcggaacgataatgcactgttcgcccgaacagatgatgccattatcaaatttacggcccgagatcaccatatctgccgccgcatcgtaatcgataccacggtcaatgataacctgcacgtttccgggacctacgccaagagccggtttgccacttgaatacgcggattttaccatgcctgcgccgcccgttgcaaccacaacgtcagccgttttcatgacttcctgcgtcatatcgagcgaaggattctcaatggtctgcaccaggtcttccggcaagccgagctttttaagctctgcacggaataagtccaccacgtacttgttgaggttgcttgtacgcggatgtggagcaactacgattgcattttttcccttaagcgcaaacatcgcgttacacataggcgtaaccaccgggttggttaccggcgttaccgcgcccacaacccccttcggctttgcaaccttgatgatacccgtgtccttgtcctcatcgatgataccataagactttttacctttcaggctgttccaaatacatttggattttcctttgcactttgcaaccttgtcttcgtaaacgcccatgccggattcttccaccgccattttagcaagctcttctgcgcgcgtatagacaacctgtccgattgcttttaccgctgcgtcaacctgctcttggctggcgcttttttcatattcagcttgcgcgatacgtgctttttcgaaaatttctgccacattagccattttctttgtcctcctaaatatattaaaaaattacatattgctcatgtaagtttatcctgtcttattatagtagctttttcataaaaagcaatcttaagtaactaaaaaaagccagttgtatccgctttgcatttattagttaggtaactccttttgtgcggtgaaaagatgcaaaatcctttcttccagtgtataatatataattgctaaagatatgcgccgccagaaggtcggcggaaggtgccaatgatggagggtaactatgaacgaaagaatcaagtgcgaaaagtatctcagcaaggtgatgagcgccgaagatgcggcaaaactcatctatccgggtgcaacgattggtatgagcggttttacacccgcaggccatgcaaaagctgtgccgcttgcaattgccaagcgtgtggaagaaacgggtgaaaaactggacctgaccgtcatgacgggggcgtctgtcggcgacgaaatcgacggcgcattggtgcgtgccggcgcaatgaaacgccgcactccctaccagacaaattctacggtgcgtaatgcgattaatgcaggcgagattgattattttgacgtacatttgagccagatggcggtatgggcgaaaaatggattttttggcgacatcgattttgccatcgttgagatcaccggcatcgacgagcagggacatttgatcccctccacgtccatcggtatggcaaatacatatatcgactgcgccaaacacgtgatcttagagatcaacacttcgcagcctgagtctttgaaggggattcatgacgtatacacggtagaacgtgttcccaattcacagcccatcccgatcattaaggcggaagacaggatcggcacggaatattacccctgcgactttgaaagaatcgcggctattgttttcaccgacatccccgatcatggtcgtgcggttccgcccgttgatgaaatctcgcaaaaaattgcagataatattattgaaattattcaaaaagaaacagaagccggacgccttcccgttccgcttcccccgcttcaatcaggcgtgggcggcgttgcaaacgcggttctcgcggggcttaaaaaatcagattttacagaccttaaggtctattccgaggtattgcaggatgctgtattcgatttaatcgacgcaggtaagatcagctttgcatccggtacctcccttaccgtatcccctgatttcgaggagcagtataatgcaaattttgaaaactaccgcgataagatcatgcttcgtccgcaggaaatcagtaaccatccggaggtgatacgccgccttggtatcatcgccatgaatacggcaatcgaagcggatatttacggcaatacgaattcttcgcatatcaacggtactcgtatcatgaacggcatcggcggaagcggtgactttgcacagaacgccggactttccatcttcatgacgccatccaccgcaaaaaatggaacgctttcctgtatcgtgcctttcgtcacccatgtcgaccataccgagcatgatatccattttctggttacggaatacgggtatgcggatctgcggtgcttaacgcccaagcagcgcgcgcatgtaattattgaaaattgcgctcatccggacttccgtcccatgctgcgcgaatatgtggaacgcagctgcaaagaatgtgttgcgcagcagacgccgcatatcttaaaggacgtattcaaaggcaaataatatagacaaacaaaaaaccggcgtatcaagcgccggttttctattacctttttatgcgaacaatccaggattatactggtagagcgaacacggccgcccgcctgtcccgtaatgcatcttctggatcagttcattgttctcacgcaggtattgaagatatctttgtaccgtgatgcgcgagagattgaccgttcccacgatatcctcgcaagaaaaacgcgccttgggactgctgttgaataccgcacggatcatattgagtgttttgcgctgcaatccctttggaagttcaagagcgctgcaccccgccccgcttagatatgcgtcaattgtttcctggctgagcgcctcttcctcccgccacagttgcgcacggtgcaggaagcgctctaccgcttggttgaaacggtccgtatcgagcggatcgacaaggcaatccaacacgcccagtttcagcactgtcctaagcgtatcgcagtcattgcgcgcgatatacgcaatcatttcggtacgcacgccagcaaggcgtaccgcacgcatcagagcaagcccgatctgcgggtcagtgcatacatcgaccaccagcaggtccgtgggatggctgataaaatagtccgcagccacatcctcgccaagcggcagcacttcgatcctgaaacggttatctttcaggatcccgatcacatgattatacggtttttgatattctcttttcagcaccgtcatccgatacataattgactcccaatcaataaagtttgctataaatttcgtataccttatccctgtccaaaacaacatagttgtttgccatcaggcggccctgcttttccatgacattgtccgtaaacgtatcgatttcttctttctttacgccatattcgtgcaagggcttgcactggataatctggttcaaaagcttttccatttcatcataaacaacatcctcgctgcattctaagatgtctgcgatgaacttattcattttgcgtatctttccattcggatcgatttccatatatgctttaaatacgccgatcaaaagcgcataatttgcttcgccgtgcggaacatgataggtgccgccaaggggataactcatcgcatgaaccgccgcgcagcccgcgttgccaaatgcgatgcccgcatagttgctggcgatcaggaaatcctttaagagcgggatacgcgcgtcctgtccgtttttcgcaatctcctgataccccttcagaatcatttcgatcgctttgtaaccgaacatttccgtgtatggtgttgctttgggcgaaaggctggactcgagagcgtggatcagcgcatcaatggaactcgttgcaaaaaacttaaagggcaggcccttcaaaagctcggggatcagcacagcgctgtccgcatacatttcatcgaccgcaaggccgagcttcgtgtgacggctcttgagttccaggatcgcgatatttgtgacctcgcttcccgtgccgcatgtcgttgggaccagcaccagttccttatccttgatgatatctgccttcctgtcgtaaaggtcgaggatcgggctgacgttcttgagggcaaaaatcttggagatatcgatgatcgtaccgccgccgatcgcaatgatgcgcttataatcgcccttcatgtctgcatacattgcctccgccatttcatcggacggctcgcccataccatatttttcctgatacagcacgtcggctttaatgtccaaatccgtaaaatatggattgaaaatgtactcgttcgtgatgatgaggtctccctcgcctattttgtattcctcgcaaaattccttgcaggtatcaaacgagaatatttccggtttaattgacaattctttcataatttttctccttaatcctgatcctcatatttacatttaaatttattctcaaaaaattcgatcaactgcgggcggaaatccggatgtgcgattcggatcatgcgcactgcgcgttcacgcaaggtaataccgcgcaggtctgcaatgccatattccgtcacaacatactgtacgtcatagcgcgacgtggttaccgcggccccctcgtcaataatgctgacgaccttggaaatcgtacccttggcggctgtagaaggcatcgccatgatgctgcgtccgcccttgctcatcgtcgccccgcgcacaaaatctacctgcccgcctacgccggaaatctgtttgtggccaacggacgtagacaccacctgccccatcaggtctacctgcacacaggagttgatcgataccatgttgtcattctgtgcgatcacgatcggatcgtttacataatccaccggatagattccgaccgccggattatcgtccaaataatcatataacctgcgcgttcccatggcgaatgtcaggatgctcttgccctgatgcaggttctttttcttgtttgtgataacgcctgcttccgcaagctccaccacgccgtccgagatcatctcgctgtgtataccgaggtcttttttatctttgaggaacagcagcacagcgtccggaatcgccccaataccaagttgcaggcagtcgccatcattgatcagcgacgcacagtgacgtccgatctcgcgctctacgtccgtgatcttcggattcggcaactcaaggatcggttcgtcaaattccacaaaatcagaaatttcagacacatgcacgaaagaatccccgtggatacgcggcatatttttattgacctgcgcaatcaccacttgcgcttgcttgaccgcttccattgtatagtcaacggaaataccaaggcttacataaccgtgctcgtccggcggcgtgacctgcaccaaagccacgtccggcttgcagtttgtgcgcagcagttcaggctccttcgaaaaataaacaggcgtaatatccgcacggccctccgcgcatgcggcgcgtgtcgaaccgcccaagaaaaatgcgttgtgcctgaagtgtttttccatccccggcgcgcagtaccccgcttttcccatagcgaccatgtggatgatctccacattttcatacgcctccgcattcgcggtcatcgcatccgtgatatgtaccggttcccccgttgcatgcgcgatcacgacacggtctccggatttaatcttctttaccgcttcttgtgcagtcgtaagtcttgatttgtatatttccttccaatccatcggctgttttctcccctcttattccaatcagtttgtttgatttattttttcatttacgtgattaagctcttctttcaaagccgcgtaaccacttgcttccgtcaatatgattttgccatagcgcccctcaatcgtatcgtgcaaagcgcacgcgcttcggcatccgcatatgattaccgcgtaatctgtttcttccgtcccggcagtcacaatccggctgtcaggaaaatcccgctttagtttttgcgcgatttccgtacgctcataatgctggttgcagccgccgcagtatttgatccctatcgtcatttcttctctcgtccggcccgtctttgcatcaggatgctgcgcgccatatcccatgtctcgtcactcactccggtcacaagcacgacatcctttatttccggtatttcttctttgattgcttctgcgacaattgattccagagtcaaagaagcagagggacagttactgcaattgcctaaaaaccgtaccttgagcacgccgccttgtatatcgactacttcgatatccccttggtgctcgcccatcgccggccgtactttatcatccagtacctgcttaatttttccaagcaattctgtttgcattcgctgtcccctctgcttttcttatactctgcctgtttttattctttgatatgcgcaattgtttttgcgagttcctttttcatagcaaggttcccctgacgcgcgatcatgatgcgctgtgcctgcgggctgcccgcgccgtgcatggattccgtgcggtaaccgaccgccgccgttcccagcgaaaggttctcgatcaagcgcaggatcctcaggcggttttccgtcgaaacgctgtccacgcctttcaaatatttctcaacatatttcccgagtttcggatcacggaaatccttttcggaaggagccgtcaccatgatgccgcctgcgatatcttccgcaaggcggacgatctcatacgggaagcgcgttacgttttgtttacatacatttgccagaagcaggtcaatgatgtagttgcccgattctgtctgatgtccctccgccgagcaagcgataccgcatgcatacagcgtctcattgaggtgcgtcatttcgatgagtttgtctttgatgtgcgaagcctttgcagcgccgttatagtcggcggcaaccgccgccgcgccgatcagaacgtcgcctacgccgactttgcagccgccgtagctctggcggtgatatccggcaaagcgctcaacgagcatgcccgcaaattcggtttctccattcaggaagatgcggtcgttgggaacaaatacgtcatcgaaaatcgtgagcgcttccacgccgccgaattccgcatttcctacgtcaagttcactgccttccagcttacgtgtatcgcaggactggcggccgatgatcatgaacaagccgggagcatccagcggaaccgcaaacgaaacagcataatccttgtcctcaggcctcatagcaaccgtcggcataacgattacctcgtgggaattgagcatgcctgtctgatgcgctttagcgccgcgtacaacaataccgtccggacgtctttccactacgcgcaaatacatatccggatctgcctgcgcatgcggagccagcgagcggtcacccttcgggtccgtcattgcgccgtcgatcgtcaggtcgttgtcctggcagtatttcatatattttacaaaattctcatggtaatttgtgccgcatgccttatccgtttcaaaggtagtactgtaaacagcgttaaaagcgtccatacctacgcaacgctggaagcaagctgccgtcttctgtccaagcagcctttgcatttttactttcttgatcaggtcgtctgtatttctgtgaatgtttgtaaagcggttgattttgcgtccatcttcaagcgtaaccgtcatcaggtcttcgtattccggcatctgcgccaggtcatacgtcatgcggacggaattcagcgagggacgaaggatcggatcgtcgacgggactttcgatcttcttgccaaacatgtaaacttccatattgattttgcgaatactctcaatgtattcttcgccagtcataagtgccataattctgtttcctttctcttttcgagtccattttggttgactgcccgatctgcaggcagtccctgtccataaaaacctcttcactatatatttatatgcaaaaatcatgccaacatatgttaaatatatcacaattccccaaaaaatgcactgtttttcgctttttttatatattatttaaaaatttcaaaaaaaaataccaccaattttggtttttgatggcattttcatttttcaattgtactatttcgacaaaaaagatatactgtttcaaatttcgtttcatttttgcaacgtttatgttttatataacttcaaaattaattgtttttctgtttaaatatgtgatttttttatcaacgttttttattcgtttcatttttgcaacaagtttcatttttgcaacgacgtatgcttttgctgatactttttacgtttgcgcacgaaagtcgcggcatccatgcctaagcttttagccgcatcccttacattcccccacctctgataagcatggttaatataatccagttccatacgctcgacaacagactttaggtcaatcccttctccgctcgacaaaagctgcgcttctgcggacgccacatgcaggaacagattgccgacggtaatttcattcgagttgctcatgatcattgcgcgttctacaacatttttgagttcgcgcacattccccggccaccgatattctgcgagtacgtcctgcgctgcgggcgtcaaacgtttgtccataccatatttgtggtttaattcatccaggaaacggtcagcaaggggtaatatgtcttccctgcgctcccgaagcggcgggatcatcaccggaaaaacattaaggcggtaaaataaatctgcgcggaacgttttatctttcagcatttcctccagattcctgttggttgcggcgatgacgcgcacatccaccttgatcggcttattagaaccgatacgttctatttcctgttcctgtagcacgcgcagcagctttacctgcatatcgagcggcagctcaccgatttcatccagaaaaatcgttccgttgtccgcgacctcgaacagtcccatcttcccttccttattcgcgccggtaaaagcgccgcgttcatatccaaacagttcgctctcgatcagtgtcgccggaatcgctccgcaattgaccttgatgaagcgttcttttgccctgttactttccttataaatataagaggcgatccggtccttaccaacgcccgtctcccctgtcagcagaaccgtcgtatccagtttacatacacggtccaccattttcataacggacagcatcgaactgtcccgcataacaagttcgctgtctcccaacagctccctgcgcatcgcttccaactctgaaacatttgcctcgttttcccgcaagcgcatacgcaattcatgcagttccgtgatatcgcgcacatttgtcattaccatgacaacttcgcctgtctcatccagtgtgggcgtacttgtgataaccgcgcgtttacccgtctggaactcttgctcaagcgtcacgctctgccgtgtgcggatcgcttccagcgtccccgactgattgatgatatcatgtgccaccaaatcgcgcatgttctttccgattacctgttcccgtttcaatccggaaataatttcataggatgtgtttgccatcagggtatttgcattaccatccgtaatataaatgccgtcgtaagaaccttcaatcaccacttcgaggattttacgcgctttatttaaatcacttaaaaaatttgtggaaccgccattttcatagtacgcgggttctcttgttttcattagggcttcctcctgttcaaggcaacctgtaccgggcacgcggatgcccgcctgtctggtaatcgatatccgaaacgacgcgccctgcgtcgatcaagcgcttcaaataccgccgtaccgttaccaccgaaatacccagcctatccgccaattccttagcggtaaaatcacgttttgcgccgctttccatatcgcctaagatcctctgttcgataccgcttcccgcatttttagcaacgcccgtttcctgcatggagggcgcgtgcagaagataatcgaccgtctcctggtctaccgtgcgcaagccggctaccgtttccgcataatcagcatatttatcaagcgcctgcaaaagtcgcggatacgaaaaaggcttgaccaaataatcgattgcgcccaggtgcatggcggacgcgagcgaccttgcatccctggcagcggtcaccagtattatgcccgtcttactgtctgctttgaaaagttcttcgaaaagtgtattctcgttataatccggcaggcaaaaatcaaggatcatgagtcctgcaccgctttgcttaaggaacgtaagcgcaccgcccatctcctgaaattcccccatgacctcaaaacgcccgtcacgttccagatattcacggatcagatacgataccatcggatcctgatcaacaataaccgccttatgcatgccaaacctccagcatactatcattgtaagagatttcatatttactgtcaatcaacaagcccgcataaaaaaagcatcctgctgccaggatgcgctgattttccaaacccatatcaatccttataaccaatcggttcaaactgcatttccgtatactttcttaagggctcgtcccaaatccaatgcaccggatgcatgtctatgcgttccacgctattttggcttgaattctgccatatggacgaatattcacccgtcattatttttgcctctgccatcccaaacaacgaaaactgaaccatgattctacccccgtgccattcaccacaaacgtccgtggtcgccccaaacgttgttttattaatttaacacaaagcatatcggaattcaatatcatttttcttcacatctgtcctttgcaacatcaagaaacaacaaaaagcccaccaacaaagcgtttatatttccggataatatatattttcccttatccggcaatcttgcgcgttatcttgttcgcagacttaaaatgattcgtgtagttcatgcaagcgaaatcggcatgacgcatgtatatttgctgccgtctaccggtacgtcgcatattttgacgtttacgccaaacgcattttgcagcaaggactctgtgatcgtgctgcgggtcgttccgcatacgctcgtcccgtctccctgcaaaagcaatgtcatatcagaaatagaaatcgcatgttccggatagtgggtatttacgatagaagaaatatgcttttctttgctaagctcacgtatagtattcaacacaatcagttggttacgaaaatcgagattggattcgggttcgtcaagaatcagcatagacggctgcgccgccaatgcccgggcgatcaataccatctgcagctcgccgccgcttattttactgcacagtttatggcgcaggtgttttacgccgatacagtcgaggcagtcaagagcgatctccctgtcgtcttcattgggcatttctgtcattttcaggtgcgcattgcgtccgagcagtaccatttcctcaacagtatacgcaaacgccgacagcttggcctgtggcacatatccgatcttcttccagaattcggtatgcttcatattccccacttcctgtccgtcgatcagcgtgctgccgctagtccatttcagcagcccgagcatgcatttcacaagagtggtttttccgacgccgtttgatccgaggatcgtaaggaccgcatcgtcttccagagtaaaattaatgtcacgcaggatctctttccctttttcatatccaaaccttccatccactacttcaaatttcatgatttgattcctcctgttttcctgagcaaaacgataaagaacggtgctcctatcactgccgtcaggatagacaccggtatttcagaggtcgtcgcgcttcttgctaccgtatcgatcgcaagcataaagattgctcctaaacctatgctggccggcaccacaaatttattatcgtttccaaaaatcatccgcgcaatatgtgggatcaacagtcccacccatccaatgagtccgcacatcgaaacgactgccgccgtgaccatggtagaaccgataatcaccaggaaacgtaccgctttgacattgacccccagcgactttgcctcgtcctcgtgcagggacattgcattgagcttccagcgcatcaggtagatgatcagcgttcctgctatgatgaacggagaaccgatcatcagtgtctcgaatgttgttcctgaaaggctacccatcagccaaaacgtgatcgacggcaaggtatcctgcggatctgcgacatatttgatcatagagaccatagcctggaaaagcgctgccactaccatacctgccagcacaatcataataagggacgatgttcctttgatcttgctgaccgtataaacgatccatacagccaccattcccatcacgagagccataatctgcacaaggatcatatccataccgagcagcaatcccaacgccgcaccgaaagatgcgcctgtcgccacgcccagcgtatccggcgttgccagcggatttgagaaaacgccttggaaggatgcgcccgccactgccagccctgcgcctgaaagaagcgccagcaacacgcgtggcagcctgatgttaaacagcacagtatacatattctctgttacttcaacatcagggaaggtgcccggaaatactgtttccagtatttccggcaaggtaagggagaaccttcccattcccagtgcgagtatgccaaacacgacaatcgctacaataatgcctgcactccagatcaggcttttctttttttgtttctgtcttaactgtatctccattattttgtaacaaatccacccgccgcatcacttgaaggattgaacatagaagttacatcctcgtccgtgagctctactccatagatttccttgtaatagtcttttacttcctggttcatgtcgatatccgcgaacagatccggatacattgtctttgccatccacatcagcgtaagcggcgtgtctgttccgggcgtataggtgcgataacttccaagcggcattttatgtacgttttcattttttaccgctttaacgttactccagtcatcgccgccgatcgcattattataaagatcgtccggctgggtcggcgtgaagtttgtgatatagatgatatccggatcccattcgtatacctgttccatatcaatcgttgcggtagaattgagttcatccattccttctgccacgttgacgccgccgccggccgtcgcccaatactgtccgaagaaatgcttgcccgaggtgatcatcgccgaatcgtcatactggaacaaaaacaatgcacgtgtcttgtcctcttctgccagattcgcagtccgctcctggatcatatcatagacttcctggctgtaatcggatacgagctgcgttttatcctgctccgggaacatctggctcaatacgctgatccattcgtcataggttttgataatatcgtaatcccaggctgttgccgagatgccgaccgcaggaatacctgctgtatccagcatttccttttgtgcagtattttctgctgtgtagaacacaacgtccggctttaattccatcagagcttcgatgttcaggtcgtctccctgcatgtatcccgtatccgcgtcaaggaattcaggaaaaagctttgaaaggacaccgctttccgccgcgctcatcgaaacgggatgcacgcccactattttctctgccgatcccaaaaacatcgtgattacggaaggcaggggataaatggaaagtgtagcaatcctgttgatttctttaggcacgaccacctcttcacccgtatgatcgacaaccgttatcgtatcgccgctgctagcctgtgcagcttcactcggctgggaagattcacttggctcttgagattctgtcgtgggctgtacggatggctctgccgcatctgtttcctgcgcggcaggcgcacagcccatggcaaatgccacgatcatcaaaacgcccaatagaagtgctgtcagtttagtttttcttttcatttcactacctcttttcctataaattgattaaatttgtttgatatataatcgtccgcgcaatgcgtatagaacttacttgatatcgcataatgcgcaagatcgatatatctcttctccgatggatccctgatcaatttgttgaccagaggatcagcaataatcagtttgtatttttcatcgtttacaagccggattacctcttcttcataatccattgcaatcgtttgtcccttatgtggattccccttgtctgtgaaaggcgtcgcgctgtcagcccaaatgccataatccttttgcagcgcatttttgaccgattgtgccgcaaccgcatcccctacgaccaacgccgttaccggttcggtgttttggccgctttcttcttgattcggatcgcgcagccggctgagccaatcaatagcgccttgcctgccgatcgggatgcccgtaatgtacggaatcccaaatttgtctttcatatactccgcaatcaacacgcctgcttgtgacacggcaatatttaacgcgctctcgcttgcatgctcaatttgctccagcgtgaatcccatcgaaaaacacgcgccggtctcataaccgttttctgccagtaacgcctgcatgtcttccagattggaaggcgttaggtcaagcggtgtggctcccaaaatattgaccctgttttcctgcttgctttgtggtatccgcgtaaatctgtcgatcagtgcgatacacgcctgcgcaacgccttcatgataaagctgcgtaccgtttgtcgcaaaaccgaagctcggcaggccggttatgttttccaactctgcgctgaaaccgtcaaaatcagtaccaatcaccatcggtacaggacttccgaccacggctataaaatcgggttgctggattttcgccgcagcgtttatacgctcaaggaatttttcttcattgcccatgaccacatcgatcttgcgcagtcccgagcaatatactgcctttctcgaaccataccagcgcggttcgtcgaagcccgtataatttccggtgcatcctgccgcatcgtgtatgacaacgagaccgtttaaatcgaaaagcgccgagcatacgcctgaatagtcaggggaaaaaggcggcaaatacatacataattttctcatcagaccaccaccccatattcttcgatcagttcctttagatcggactgcgtattcagcgcttcgcgcatttgccgcataagcatctgcacgccataatatccaaacatcttttggtctcccgagagattgacgatatgcctgcttcccgcgatatatgccgcatcgaatccgattgcgattgcatccggcatgcggtttttgaatagtatcacatccggatgctccggctgtatgatacgtatgtctttctccatgctgagttgcctaaacccttcctcgtcgattggaagcacttcctgcgtcatcactgtcgaaacggcaaaaccatattttcggagtgcgcaggcaagctcaaagggcttgacgacagcccccgaagatatcacgatgggcgtatcctttagcatctcccgcgtgcattcgatctccttttttgtttcaatgatatcatcctcaagtatgctcgcttcccctcccagaaaagccgccaatgccttgtactgctccccgatcttatccatatcgtaagaaacgggtgacaaacaaaacggcgtgcccattttctgctccatatgttttgccgcaatcaaccctgcgggagacaggacgatattatatgaactctttgacatttcctggaaatcctcaaaggtatggtaatctgaaatatggcgtaccttcttgatcccaagcccttccaaaaagcggaaaatctcgtttttcggttcaaccgcttccaggttccccagcaagttaacggcattgtccttttcctttgccggctcaaggaaggaatacatggtatcctgtatcgttaccggcggtggcgattttgtatccagcgtgatcggattcatgtgtcctgctcgaaactccacatccggatggttttcatgcagtgtttccatcaacgaatcaaggtccgtgccgatgaggtcatccagacagctcacaaataccatgaccgccttggggcgttcctctacacgcgtcagtaattcgtcaaccccttggatgatcgtattaccatatccttcgataatatcttcctgtgtaatataaatataagaaagcttgtttttgaatccctgctgtatcgcccccagcgcgccatgccttccgcatgcgaacgggcatacgaatagggcatagctttcgggtaccaatgatgcaatccttacaactccccagtcgccgtgacttggggatgtataacggaccgtatcctcaaacacgttatcctgcatattcgatccctctttccaccgcttcaagatcacaaatctgtgcgattttatcagcgatcatacggtaatcctgcgcaatgtcgctctctggaaaatcgccaacgaccgagcgcatggaatcctccgccttttggacaaaagggcttcgccttattttgccaataatgaccgagcctgtatcccgcgctaattccgctacgagctcgtcttcatttttcaccttgcgttcattcaagatgattcctgaatatttcgcataactgcgtcccttaaaattttccactgcacgggcgatatttgaagcggcgaacagagccatcatttcccctgaggtcacaataaaaacgttatccgcataacccttgcggatcggcatagcaaatcctccgcatacgacgtcacccagcacgtcgtagagtactacgtcaggtttatatacgtcgtaggcatgcagttcttccaatttattgaaagccgcgatgattccaagccctgcgcacccgatccccggtgtaggcccgccagactccacacataaaatgccgttatatccttctactacaatatcttcaagcgtgatatcttcgcccttatcgcgtatttgatccagaactgttttgatctgctttcccccaagcaaatttttggttgaatctgccttcggatcgcacccaatctgcataaccttgtatttttccgacaacgctgccgacaggttcgacgccgttgtcgattttccaataccgccttttccataaatagcaatctttttcattccgatatcctttccttgctttattcagttagcccaggctaactgaatcgcttttaaaaagcgcttctccgaaacgcctcgtagttagcctccgctaaccattaactaatttaccatgttacctgcgaattgtcaacacccaataactttctctatctattgttgccaatgctctgttaagatgcaaaaacgccggtaaaaaagaacctgtccgcagaacaggctcttatggtcatcagtttctttcgttcacgttttctctcaaaaatacttttttatcattctttgccattccagcaataggtacacagtttgcatggatcgatgccgatcgacgcctgcacatcgtccagccgatgataacgcagagagttaaaatgcaattcacgacagacgtattcggcgagatcggtttggcgcgcgctgtcaggatcggcatactcctgtagcagttccatagaaacgttctcttcatattgcgcgatcagcttgcgtgcgatcaaatccagatccgaggtcgagcgtgaaaaattcaggtatttgcagccaaacaagatcggcggacaggccgaacgcacatgcacttcgcgtgcgccgctccgatacaaaaactcggtcgtttcacgcatctgtgttccccgcacaatggaatcgtctatcatcagtaattttttgcctttgatcagtccctcgaccggaatcagcttcatgtgggcgatcaggttcctcaaattttgtttttgcggcataaacgaccgcggccatgtaggcgtgtatttaataaaaggacgcgcgaagggaatgcctgacgcattcgcatatccaattgcatacgccgtacccgaatccggcactcccgcaaccagatccggttgcacacctttatcgcgcgatgcaaggaaccgtcctcctgcatagcgcatttgttccacgtttacgccttcataataggtggttggatatccgtaataggtccataggaatgcgcagattttcatttcttctttcggcggcagtacctgcttaatgccctccggcgtgatcaggacgatctctgccggccccagttcccctgcatcgtggtagccaagattcaagtaagaaaagctctctgacgctacacagtagccgtcctctttttcgcctaataccagtgaagttcgccctacgttgtcccgcgcggcataaataccgtccttggtgagcacaagcatcgtcatggatccgtcgatcaattcctgcgcataacggattccctctgctatcgttgcctggctgccgacaagcgccgcgacaagctccgtggggtttaggtgtccgttacccatttcagaaaactgtgcaaaatgattatggaaacaggtatcgataatctcatcggcgttattgatacgtcctaccgttgccacggcatacgttcccaaatgcgaccggaaagtaagcggctgcggcgcggtatccgaaatactgccgatccccatagggccggtcaaatcttccacatctccttcgaacttggtacgaaaaggcgaattctgtatcccgtggatcgcacgaaggaactgtccttgcgaatacactgtcatcccgccccgataggtacccaaatgcgaatgataatccgttccgaagaacaggtcatacgcacaattatccttttttgccacaccaaatacgccgcccaattcactgatcctccgtttttcatttcttttccacaacaattatatcatcttaaggaatccgagactacaaaaaagcaaatttcttctgttaaagattttatgaatacgatattattttgcttacctgtcctccgtaaaatctattccctgcggcggtttttccttcattcgctgtgttctgtatttggcaggtgaaattttttcatactttttgaataccctgataaaatagcttgtatcgctgaatcccaggctggaagcgatattgcaaatcgtcatattgcctgacaatagcatttgttttgaatattcaactttttttttgttgataaaattgatgaatgatgcattattttcgctgctgaataccctgcttaaataattagggctgataccgcattcggcagctactttatttaatgataaattggaaaaaatattcttttcgatatagtcataaacaggttttaaaatattatttttatttttttccgtattcgtttcggatccctgcttaaattgcagtttattattgatcaatccctttaatgggtcgaccttgctttccatatatatattgcagattgtatacagcatatgcgaagccgcaaccagcttttcaaggctcatcttaggtaattcctgatatgcctcgtaatatttttggtttcttaccggcacaatactgtcgtctttgtaaatttgttccaaatgatactgcgaatgctccgctcctccatcctccaataaaacctgccccgccatcaatgctcctaaataatatccgttatatacaatgggtatcgcaaagtcaatgatcccagaatgacatttataaaggtatggctttttgatgcgggccgcttccagcccccccctggaatcgcatctcgtacacaattcaaagtaactgttgttggaacgtaccattgaacaaaacttcgtacattcgctgtgcgccgtcacaggctctcctgaataattaactacaataatcgcaaggccggtcgaaatcgccaaatcatcctgtagcttttgaaattcaagattatcaaagatatccgtaatattaaaatcaagcatatatttttctcccgattatcttaaaataagggaatcctccccatgtagcctgtaggaagcagatccgttttttgattttaacatatcaaaatgtatccgtattttcgcaaataggaaaacacgaatccaaagcataaccagatgcatttcattcgccttagatagtttccgtctatatttttcttaccggaacgtgatacgtaacagaatcattctttgaattgctttactaatattgtaccactgccaaaccgtaataggcattaaatctgaattttccataacctatttattcaggattcatcatatatataaaatccttgtccggtttttctcccgtacatgcctcccctcaccattttttgcagcaataaatgcggcctgtacttatcttctcccgtttcctgctgcaatgtctgcataatcgcaagcaccacgtcaagcccgatcatatcggcaagtttcaatgggccgatgggatggttggcgccaaatttcatcgccgtatcgatatcctcggcacatgcgatcccctcggcgtatactccgatcgcttcgttgatcatcgggatcagcacacggttcacgacaaacccggggctttcctgaacacagatcggcgtttttccaatcatttgtaccatgtgcatcgcttgaccgattattgtcggatccgtgtgtatcccgcttaccacttccaccagcttcatgacagttgccggattaaaaaagtgcagccctaaaaaacgttctttatgcgttaaagcgttccccatctccgttacggaaagcgatgaagtgttcgtagcgagcatggccttcggcgatacgatctgttctaaattgcaaatcaactcttttttgacctgcatattttcataaactgcctcaattaccagttcgctgcctatgcatcgtttcatatcatccgtaaataggatacgctctgttatctcgcaggcctgctgccttgagaccgtaccttttgcggcatatgtttttaacgcccccgcaatcatattcctgcttttttctacctgggtttgggattgatccgtcagcaccaccttccagccattcattgcaaatgtctgtgcaatccccgcacccatagctcctgccccgatgatcgaaactgtattcatgctatttccccttgaaatattccgttttttgtttgtgcagcatattgttcattcccgttttctggtcttctgtctcaaacagcttcccaaacaaagcaatattcactgcagtatcgtgtgggctcttcatcacttttttcgcggctgcaaccgccaaaggcgcattcctgcagaatgcatgcgcgatgcccagtgttttttcccaaaattgcccttgctcaaaacatgcgtttacgattccggcatcccgcgcttcctgcgcagtgatcatcctaccactgaataccagctctgccgcttttgcatatcccgccagttgcattagcctctgtgcgccttcaaatcccggcatgatccccagcgtcgtctccggcaacccaaccatcgcatccattgccgcgatacgtacatcgcatgcaagggcgagttccagcccgccccccagcgcatatccgttgatcgcagcgatcaccggtttttccgtttgctctaaaagatcaaaggtttcgcagccaagttttgaaaacacggcggcttgcttttcctccatcgacgccatttcaaatacgtccgcgcccgaagcaaaagcatgcgtatctttatttccggttataacgatgcaacgtatttcgctctgagggcccagtttttgcagcagggctcgcaattccaaaagcatttcagtattcagcgcatttttttgttttaccctgttcaaggtcaaaaccgcaatatcgtcgtttatttcaacctctatcgtatttgccctcacctgcaaagtccgtccctttcaaataccgtcgcttcccccatacctccgccgatgcacagtgaagccaggccatagcgtccttctcttttttgcatctcgtgtaaaagcgttgtcgcgatcctcgctcccgaagcgccgatcggatgcccaagcgcaatcgccccgccattcacattgattttttcatcggaaagcgaaagttcctgcatcacagccagggcctgcgctgcaaatgcttcgttcagttccagcaattctatgtcttttaacgtaaggcctgtttgtttaagaacttttcgaatgcttgggaccggcccgatccccatttcctgcggcaacaccccacacgaagagccgccgatccactttgcctgtggttttaaatgattccgctccacgaattcgccggaagcgactaccattgccgccgcgccgtcattgatccccgaagcgttccccgccgttactgtcccatcctttttgaaggctggacgcaactttgagagcgcttctaacgatgtttcacgaatatattcgtcggcatcatagcgtacttgcttattttttccttgcgcgacttccacatttacaatttcatctttaaaccgtcccgctttactggctttcaatgctttttgctgggattttaacgcaaattcgtcctgcatctcccgcgtaacgccccatttctcagcgacattttcggcggtcacacccatgtgataatcaaagaacgcatcccacagtccctcatgtaccatggaatccgtcacctgcatgtctcccattttttgtccccagcgcgcattgaggaggtgcggcgtacgcgacatattctccatcccgcctgcaaccatacattccgccctccccgcgccgatcaatatggctgcaagattcactgcataaagtcctgacccgcataccttattgatcgtcgctgcagggaccgcatatgggatttcagccttcatcgccgcctgccttgcggggttttggcctaaccctgcctgcagcacgtttcccatcaacacctcgtcgacctgcctgcctgaaatatcactgcgacagcatgcttccgcgatgacgattctcccaagctccaccgcgccggtgtttttcagcgatccgccaaaagcgccgattgccgtacgaacgctccccaaaatatatacatcccgcattgtttccctctcccgtcacggttttattgcgcaccattttgcaaactggtattcgttccagacctgtggatagtttttataatgcgcaaaaaatttattgcatttcgcttccgcctctatccactttgtgaccaattcaggattgtccggataaatatcttccagccgtctgctttcattgacattaggcggcaaataatttccatgataatcgttagtcattgtttccccgttgatgatatttctctgtatcagaaaggtcagctcgtcctcgtccagatttttcaggcgatggaacaacgctgcaaaatgcgccccctgcgacgacatccaccggtatgcatattcccataatgtactgatggaaaaatccctcgcgcgccttaggatttgtgctgcaagcagcgcacccatgtatgccgttgaaatcccgcagccatgcgtcggatggatttgtgctgcagcatggccgatcaccacaaaacctcccgtgacaattgcatcgggcggcagacacttgagatttttctctgttgcctctccgtatttttgttctgtaacgcccggaattttggaaatcacatcatttacatttacctttgcttcctccaacgttacggccccgccgcctacgtcaaactgatgatcgttatgcgggtgcatgaacagatatcctttgggcgtgcgcaaacggtaatggttacgcatcggcgggtgctcccagtccgcgtccttcgccaccacttgtgtattttcacattttttgtgcgtcctgtatactgcgccgtattggttcacttcaaaaggattgcttatttgaggcgcacctttcagcatcgtccgcagcgcagcctgctgacctgttgcgtcgattacgacgtctgcttcagtgcttttttcagtaccgccttgttcaaacaggacgccttgcacctgtatttcatccagcttaccgtcgatattctgcccaagcaatcctgtaaccctgcttccgtagaaaatcttcgcgcccgcttcttgcgtttgctttacctgatatgcctgcaatgcgcttcggtcggtgagcacgaagcggaaatccgcatccgttatcgtgtggcagcaataatccggtgcatacagtcccagctccgttaccctgcggctttggtataaatcgagtcccgtatgatccccgatcacgccgtatccataccaccggtcgcctttggcgaacggaaccggcagccctgcatcctgcagcatagaaagctccaccgcatccgtccaattatattttttcagatacgtttctttttccagcgtttccagaattgttacatcaaatccgcttttggccagctctttcccaagcagtaatccgcccggtccgccccctgcaatacaaacagcctttttcatagcgatcctccttgcctaaaccgaaacaaagcttctgaaaataacgccgatggcgactgctccggcatccggccagttgatgctccggtcacctaagtacgacgcgcgccctttgctcgccacgatctctttcgtcttctccgctccggcctccg

SEQ ID NO: 10 - DNA, 116863 bp, Christensenella sp.
aaatagtatttagccgtatttttgattataatctcatttaaatcgcattaattaaaattatttataaattatgctaaaatatcaaaattgtaaaagtattaagaaattgttacaattattacacattatagattgggagatttttaggaggcagtatgtttaagaaagttgcagcagcagtaacagtagtctttgcagttatggcgttttctcctatctctgcatttgcagtcgaaagatacgaggtattgcagattggtgatgaagacagtaaggattcctgggtatatgactttcagaaaaccttaaacgatatgggctatcttaaaaccccggctacgggttattttggtacggacacacaggccgctgttattcagttccagacggaaaaaagcctcgcggtcgatggtaaagctggccccgatacaagaaaagcggtttacggcgattcttactatgccattgacagctccagaaatatcagcaatcgtcttgcgggccaaacaaccgcatctgccgatccctctgctgcatccacacccactacagttactaatgcattaaatcccggcgataaaggtacggatatttctaatttgcagcaaaggttgaaagaccttgaatactacgattattccagcatcaccggttattatggccctgtaacgacagaagctgtcaaaaaattccaaagaacgcagggccttgaggccacgggtgccatgacagaggatagtctttccctgctttattcagacagtgcgaagtattatacgatgtatcctggtgataacggcgacgatattaaggacatgcaggatcgcctgaatcaattggggtattttgacacaagttctactggttattttggaagcatcaccactaatgcagtaaaacgcttccaagacaccaatgggctttctgtagatggcgttgtaggtaaaaacacgcggaaattgctttattcggatgatgcaaaggcttcttcgggcggttcttcctcctctgcttcttctgattccggttcatcgtctggcagtagttcttctgattcttcatcctcggcgtccagttctaactcgacgatccagcgcgttttggatgtagcgaattcacaaatgggtaaaccctactcttatggttcgagcggccctaactcctatgattgctcaggctttgtttactactgcctgaaaaattccggtgtggctaccgggcgtttgagttccgcaggatattcgaacgtttcaagctgggagaatgtttcggacatgaattccctctccgtcggtgatttaatttatttcaaatctgacaagagttctgttgtaagccatatcggcatttacattggcggcggcagtatgatccactgtgccccctctagcggcggcgttaacatcagcagtatcacctccggatattataacaggaactttctcggggcaaagcgttttatttaagcaaatcgatataaaaagccgcttgaaaaaagcggcttttatttttcatttttatcttgtatttttattttgtttttgataaaatatatcacgcacggagtaaatctttcgtgggggtatagctcagctggtagagcgtgttatgcgttgacctatcccccgttaactaaataatagacattcgtgggggtatagctcagctggtagagcgcttgcttcgcatgtaagaggccagcggttcgaatccgcttatctccaccaagaaaaccgattcttttaagaatcggttttcttatgcctcgtccgtgatatctaatccattttcatattgttgacggctgatgtttaatttaatttctatttcataacctttttttaatgttaccctttctatcaaatatgcggctatcagtcgttttgtttctatatccgcatcctcataaacatcagcccattccaatatttttgttctttcttcgcgtatttgcaccatgaccatttcctgttcttccaacattctgttgcactcctgatatttttcctccgcttccgcaatctcttttgtaacattattcaataatcgttccaaatggcttgcgctgatactgccctgcccgtctattgcttctaatatacatgaatcgagctttttttgttcttttctcttatttatcaaatttctttccgcctttctttttttatcggatatctctttcatctgcctttggtattccctgcggataatttcttcttgcttcaaactcttggtattacggaatattttttttaatacacggtcaacctctgcgtccaccttttccgcaatatatgtcgtttgcccgtcacactttcctttatattgtgtgcggttataacatttatatgcccgcttataagtgattggtttgcctgtacctgctctataatgcccgtccgctctaagcgttggagaaattttaccgccgcaatgtccgcaatatacatatcctgataacaatgttttgccgttcgtctttgtgggaatacgccttttttctttatatgcgacactattttgttgaataattttctgaacttgctcaaatagtggaatagagatgatttgcaattccggtataatattagaacgtactgtattacaacgcaaaactccggtatataactcgttttttaacattttttgtatgcttgagtaatgaaatttctccccattgcgccgtttatatcccaattcgtcaagcttacttgcaatttttcgtccgccataagcatattttgaacaaagctcaaatatcatcttaacaatttccgcctcatccttatctggtgttaagtcgtgtaatacctgcccttttttaccacgccgccctttatccgttaacttatatccataaggtactaccccgcctcgaaatccgccgcttgccgttatctgcctatgacgttccgatgtgcgcattgatattttttcactttctccgtctgccatccaataatacaggtaattaagaagctcatcatttttgttgtcgcattttaattgtccttccttaacgctccatatttcaactccttgttttataatccactttaccacttgcggcgtttcatctgctattcttccaatcctgtctttcataaaaaccagaagaatatcatatttcttttgtttgatatcttttctgatgttgataagcgcgtctcttttttcagccgatatcttatgtcccgaacctgcctcaacatattcattcgttatttcccaatcagggtgttcctccacaaatgtatgacaggcttttttttgaactggtatcgccgctttttcattttgatataactgtcctttcgtagaaacacgataaagacagcataccctttttttattctccatttactttttcctccgtactgattttgtgctttaatatactgtcaagtaaaatatttcttatgatttctcctgctttataatctggttcatctgaaaaaatcaaatgcaccttgttctcttttatttcattcttcatggactatttctttggtttagatattatccttgccatttggtttcatgtattcgtccgtttcttctgtttcagccatctcctttcaatattaaatttttgtgtgttaccacatattggcaacataatgtcttaacaactccgcgccccgtttagagccatgacctaatacaacattggtctttgcaaccgcttcacgctttgaacacccattccctcgaacaaggtcataatattcctgcgcccatgtcttgcgctgaccgtgacatcggttgcccttgtaggcgttcccgtatcttttatcgagatattcacgaaaacacctctgcacattatccgccgtcattctgccgccgtttcttttcgcggcaatgtaatcgtccggctttttgccctcaacggacttcataagctccttttgcgcttccatatttaaaatgggtatcactctgggtttgccgccctttgcgccgccctcagggccttttgcaacctctatatatccatatccgaattcaccgcccgaagcatgcaggcatttcactttggtatgcaccgcttcatttgcccgcatacctgcaaacgcgcacaaccttaatgcgttgggcacttccgattgagacgatacggataatcccatgattgcctttttcgatacgtccaatggaacaggggtattcttcacaaaatccgcgttttttgtggagacgggctttacaagcccttgcgtattccatgcgaaatcagattttgaataagcatgaacgcatatatgttccagtttttttatcctgctgatgattttatcgagcgtattatccacacaggacgcggatttgctttgcaaatatccctgaagcattacgggcgtgattttatacgctttctttacatcgggaaatccacttcggatatattttgccaaatcctttgccaaatccgtcatatcccgctttgaagaagtagaatatattttccatgaggtgttgacagccggattcattttatccgccctcttggattgcccgggcgtgtagcacacatgaacggcgtgctgtaactgacgggataatgtgactgacattacaatcctcctttctgaatccgccggtaagccgctttatcgttttcaaaaaccatgaatctgtcaaaaacggtcgtttcctgcggattttcatattgtccgattcctcattgcagtaactccacaggcataagcctgttccgttactgcaatgaaaatcataatctgcgctttttcgttcaacgctccgccctgatgggcggaaaaatgagcctatgcagcaaaggggagagcgccgccccaacaatgccgctatgcgcttccattcttttcgatgctggaagaaaacatctgcctttctgatgatatattgaattctctgataaaagagaaactgaaaacaggattacccctgcggcagccggacaggggcgcggcctcataccctatatatcatcagaggtgcatacagcacgggtatgacgaaccgcttttaagctagctccgttcatcttgaatacactccattgaaagcggctgcctgaacggaaagagtattgctcctttgtcgttctattaatagtatgattgttttgctttcaaaaaatggcgagagcgtatattctgaataattcggacaaaaaacgccttgatatagccgttttcatcctatagatattatgattaatatttgggaaatataagaatcatgtttttcggtatagtttttttgtgatataattcatacaaggtctttgaatcaaaaaatatggataggaacgattttaattttatgctaaaaaagtttttacccttgctactaattagtgtgatagtattttctttgacgggttgtaggataggcggttttgacatgaattttgtcaataatcgtcaggaggaatatcgtttatggaatggcattgtatacagaaatgctgaagaaataaaggaagcagttttattaggtgtagatttagagaattatgatattccgagcaaatattacaagaccaactatgggacagcaagtaaaaattttcccaaaacagctattggctttgcattggctcttgggaggtcgccatctgttaacgccttaattgataatggggcagatatacattatcttgataaagatggaaataattacctatattacactgcaaaatataataacgacagttggaactgtataaaagccttattggaaagcggcatagatgcttcatttatttctaaagaaggctttagtatgttggattatatgcttgtaagagataatgaaattacgccagaacgtcttcaagtattatggaaatacaatgttccaattacagataacaccttaaaacttgcttttgctgatgacccaaatgacatagagcttgattctatccatgaaatcgctgtaaaagcggcagaggcaggcaaaacatccagcataaatcaggtaatgagagcagcgttacttggtgatgaaactttatttcttaattcattgtcagaaatcgacgaagataaccggaactttatattatctgctgtcgccgcattcggtacccctgccatgttagatgcaacaattaaagatactgacctatttggtgaagataaaatagtttactatgggaatagcttaatagcacaagcctctttacatggtaatttggataatacaaaatatttagtagaagatagaggtgtagaaatacaaaataacgctacaatattagcatatgcggcaaaaaataattattatgacgtagtagaatatttattaaaaaaagatgtgccatttgtggaagaaataaaaaaagaaaatgagaattaccatgaaaaggaagaatcatattatgctggatacaatggtaatattgatatgatagaacttctgcttcaatatgcagaagataaagatgaacttataataaatgctttagttggagcaatagaagggaatcaaaaagaaacagtagaataccttatgacaactgttcctattgccccagaaggatttatggttcgcattgcgacagagaaaggaaacagtgagttaactaaatattttattagcttgggggcaggagtgaacgaaaaaaacggtgatgctgaccttcctatttggatagcagtacagtctggagaggaaactatagttgatatgttattagaaaatggagctgaccctaatttgccttatgaagacaatggccgaccaaggccacttaatactgcgattacaaatggacagttgaatatagtgaaggcattgttagaacatggagcaaatacagagtcgctgtatgcaggagcaaatgcagctcatgttgccgcaaaaaatggtagtcaaaatattatggaagcagtaattgatgctggagcggatattaatttgcgatttcaaggaaacagtattgcaatttttgattcttatatgacagttaatggcgatacgcctttacatactgctgttaaaaatggttttatccacaatgtagaagtattattagaagctggggcagatgctaacatagaaaatgaaaatggtaaaacgccctatcaagcagcaaaggaacttggggcaagtgccattgtaaatctatttgaagaatacggaataacagcataaaatagaagaaaaaatgtttctcaaatactaccaatagtcaaatagaaacaatgttgatacaaattggatgaaaaaaggttctctaagaaacgagatatttttacgatgaatatttcgtttctttgtcacaactacgcctttatatacctgcggggatttttcgattgccttgaatccgtttcccgcaagcttatcgcaccaatacaatggaatccccgcctttttcagttcattaaaataacgggcgtatcttcgccgctctttgcttccggtggcgggcggctggaaatccgggcggttgatttcttcgagcaagccccgcaacatctcctttttattctctcggaaatggctgttatccaatttttcaagcacctcgtttctgctgtagaacctatccgcgccaaatacgtcgcatagcttcccatgctttttacttcctaaatccatgatatcctccatatccgccgccgtccgttctttgcggcagtatgcctgccggaggaacggggctttcatcctcagttcaaagcgcaggaagtggttttcttccttgactgcctcttgtatttttccttttgcttccagttccgccgattttagatatatggttagctcgcaggatttattttcaaaccttacgcccgtagggtagaccgtctttttataccggggaagctcgaatttttgaaaatatgaaatggccgcgagcaaatattcgtcattatgcgaatgctcgcgcaatgccatatcttccgttacatccgtccgaacggaagcaagcgaatagatatccgcttctgcctgtggaagaatacgccgcatttcatcatggtatgcctttgcgacaagcatgaggcaatcattttcttcccgcccggataattggcgcgtatttgtgccatacaaagcaacgccggggcaatattccacgatgatgcttttataatatgggtcaagctcaatataaacatcgcggcgggttttatcgccatgaatggagaggcgtttataatagcacctatgccctgtattattatcttgtttatggtaatactgccaatgattccggcgcattgtgtgataatctatatctgcggtataatatccatgcaggcgcaccttatcattgaacgtattgacgtttgattgaatcatttgccattgtcctttatgaatacctgatataataagtatgtaagaagtgggagcagtttgattttccatacaaaaaaagagcaaccttttaagagctgccctcacttaaactttaattcttttgtgatactggggataggttagcgcatattacagtagagcgcttgcttcgcatgtaagaggccagcggttcgaatccgcttatctccaccaaaataaaaaagcctgtttctcaaagaagagacgggcttttttattttagcggacatttttctattattttttgtgaatgattcctgcaaaggactgatattttatcctcccatttttaatgtaaaaagtatctgtcccgaattttgcttcataaaactgtgattctgccgtccagacaacgtaagccagttctccctcaacctgtatgcataccgttttccaacttgaaggaacaggaaaaacttcattcattgactccatgaaaaactgcctgatctgtgtcaatccctttacaatcccatcctgtgtcaagatgacggagtcttcacaataatcgcacaatacctcttccaaatttgcgttttggttatgtaataaatgatgctccaaaacttgtctggtgcttctgccgcttaattgctccatatttgtcctcacatcttcttatctatgctttagattcctgctcctccaccagcgcgacagccctgcacgggcctgcttccgctccttctaccaatagcggtgccgcaaccaaaaggaatgttttgtccaacaatcggtccaggtttgtcaatgcttccattagtattttcgagttgtttccgaggaacgccctatgcaccggaaacgttgcgtcccccaccacatcgcagttattggtttcgatcccaatgcccttgagcgtctggtggcttcccaaaaaactcgctaaagcaacgcttagcgtaggataatcccgatattgcttcttcgtcccgaatttcaaaccccagttgatataaaacaacaggaagtcgattccttccaggtcaacgctatccaaaacctccatgccgattttttcttccggtccatatgccgtacaatctacgacccttcccttaccaacaaaataggaagctggtttatcttccacacggaacccgccgtcgatcatatgtcccgggcaatccaggtgcgttccataatgcatgcagaaggaatccatggttgtcagttccgtggaaccatcctccgagatgtccctttcttttcttataataagaggctctccaccatcaaaaaccttgatattttttgtgtacttccatgataaatccacaacttcttttataatcatcgacttttacctctctcttatatattatgcaagcgcccgtagtgtaccgccaaaaattcccagtctttcagacactgtttgggctccattgactacacgaagcagtgttacatatggctcgtcgcttcccgcctctccagcgcagcaatcaatttcatcaggaaaacaggacgaaatttccggcgtagcgcaaattccgataactggagctactgccgttcccacaaccgcaccatttcccagtccaagcagcaccacttgtgcaccgctgcaaatgaggtccattgctcggcttgcagcgcttgcagcggcaaaaccattttcaaaatttttatccggcaggctatcgacaaaccataatcccgcatgttccggcgtttgtgttaccttcaatgtgccgcaaatcattgccgttcccgtactaaaataggcgcttttgcttcgaataggtccattcagcgcatggaaaccctccaacttgtcaagcgtttcctgcatttcctcctgcctctgggcgcgtaacaaaatctctttcctccgcaattcgccgccatcaagcccgtccatcaaaaccgtagccccatccgcaagcattcggtctgacactacgcccagaaggatacctgcggcattttcatactgtttttccgctgttgttgtgatgccgatcgtcagggctgaaagcggcatgttctcccgctcggcatagcggatctgctcccacaactcgtccagggccgcactgcaggcttcaatacttttttgggttccaagtttttgagtcattacaaccttcaccggcttaccttgtttgcgggcaaactcttccaagggttgcgcttggatgaattcgcatccatggcctacgatcagcacggcacccacattgccatgggcgatcaatcgcagcatccggttaataacaatttgattgtcaaagcagcttccatttcctgctacctgtgccggaatttttctttctcgtgcatctgcgcccgccttatacgctacaaaagcggaacagttcaccgtatataagaccagaatattattacgtattcccgtactgccgtttttccggcgatatcctttccaatttatgttatccatttcgctgtcccccgcatgcatcgccgctaaaccagaactgctgttcctgattgatatatccatcctgatgccccaaggcttccccttttgtaagctgtccgtttacaatcctgcatatcagttccgtcaactcgtttgtcagactatccagtgacttttcctgatataaaaccggacttgcgtcgaaatcgatatcgttttgcaaatgcagcattgtctgcctgtttccggttattttaagcgtaggcgtgaccggagtattgatcaaatgtcctctgcctgtggtcagcagattcaacgttgtcccacatgcagcatagagtaacaggctcgttgcatcttcgctgacatacgggccgcagccttttttttcatctgtcatcccatccatcatccataatccgggatatgacggcctctggcctacctgaaccaccccctgtataggccttgtaccgcttttgattactgcgcccatactcttttcttcaatggtggtcaggcctcccttcatatttcccggtgtaataaaaaattggtttttactttccgaactttgaaaaaatttatcataggtatcggctattcgcatttttgccgtcatgtttgcacaccgcgaaatcaagtaatccttcaatccgactgcttcatacatctcttcaaaaaggactgtcgcaccaaggtccgccatccggtcaaaaaagcgtccgatcaacggatttgccgataatccggatgtaaaatccgaacctccgcactcagaaccaatcataagatctgagaaatgaagtgccgctttagggcacatctccagcctttgtagcaatttttccgcaaattccctgccttttttaatagaagcggcaattcccccgtctttttggatgacgatactttttacttccctgccggaagcagacgccgcttcggcgatctcttcccccgaaatagcgtcgcatccgttctgcaccaccaacaccgcgcctatattgggatgcgttgcatagcgcatcagcttcatctcaataaaatcactggtcacacatcggtccactccgatgagatcaattgcagctccttccattgaagatacgatctcccgcgccgtaaaacttgcgcattccgaagtataaagtaccaataaccgattccttatccccagccttccgtccttccgcagatatccgcttccaatttcttcacattcttttttcatctatccttcctccggaatctcatagctcatatctgcgggtgccgcggtttccgcattaaaatctgcggaacgcttgtcaaacaagcttgccgcattgtgtatgtgcacgcaatcccctgcttcaaccgttttcagcatctttgcaatcggtatcccatatttatatactttattgccttccctgatccggcgaatcgctattttaaatccgaaagggatatcttctttcgcaataataccgtctgcaaccatagttccgaccttaatcggtttaacggccgtaacaacattgtcattttcgtctaagagcaatgcaggataattgttccccatcataatcccccattcctagaacggcttcagaaagccgttctgatcaaactcgatttcctgcgcttctttcagcaattcaatatcgtctctgcttttgatttcatcatataaagccggcgacacctggacttcaaacagctctagcgtatttctgatacgcgcgatcctgatcttttgcggatcacatcccacacaagtgcgtatcccaagaaggattgcatctttgtcgttattcatatagaagggaatgcttccacccctgatcccacctgaagtgacgatattcgtccatgtggcggtccagtcgatatcattcaggcatcgacgcgttgttaaatccgcggatgcaattcccgcaccgttatggtgcgttttttctgtcagtccggcaatgaacagtttgtttaccttgagaacatctgcaaaatctttttgtattccattggtacgccctgtgacattcgggtccgcgccaaacccgctgatctctttgccgattttgtcgatgaccagtaaatcaacttccttaaatttaaagcgggcgattttttctttggcctccgccagcagccgccggtccatagataatacttgctccggcaacgccgcttctattctgcacacctcatcataagcattctggacaatcccaatgccgcataccaccggaaacacattcaagaatatctgtgccgcttcgggcacgctggtagcaaacctctcgaatcccagtttgtggaatgccgtcgcccctgcatggtttgcaatcccaatggcaatcatctttgcaatgccactttcgtgttttcctctgaagtcagtgtgaggctttaccttgtgcatgaggacgattccatccgccttggccgctgttttatcgcaataaagctttgtgccgtccgctagcttgccatattccaccacttccattgagctttcaatgggtacgcccatcctctccggcgtaagtccatagcccttgaggatttccaactgtccttctgcggtgccgcttccatggctgcccatggccggaataataaagggctgcgcgccgtacgttttaaggcagtcgcaaaccgaacgaaaaataatatccatatggggaatgcccctactgccggccgtaatacaaatgcgcttcccttccagtcccttcagtgcaagggcacttatccggcgcttaatatgcgatggtaagtccccaatttttcttttgtcatatttttgcctgatcaaaagcatgggcggtatttcaatcccactcatcccttcaatttttacatccatcggtggaaattctattttcatagactgcccccgtcctttgggcatcgcatcggactaattctttgtcctgcggccataaaccgctaccaaaagcacgacaatgatcaaaccctggatgatctgcttgaccgcttcttccatatgcaggatcgtaagcaggctgttgatcagtaccatgatgaatacgcccgcgattgtaccaacatatcctccggagccacccataatgctcgtgccgccgataacgacagctgcaatcgaatccatgttatagccttcgccggtagacatgtaactggtacccgtgtatcccagcagaaaatatccggtcaaggcggccattacgcttgcaatcatataaattcccagcgtaaccccgcaaacattaatgcccgaataagttgcgcttgtcctgttcgacccgatggcataaagcgagcgtccgaatgtcgaacgatgcaggatcaggatcgcaacgaccgtcagaataatccagatgattgtaacgccgctgaaaatattcagtgttttaccattgacaaattcactcagggccgtggatgaatgcccgccgggggcgccattgcaataaataaacgcaatcccatacaagactgtcccagtcgcaagcgtcatgatcataggcggaatattcaggaaataagcacccgcgccgtttgccagtccgatcaaaagtccaatggccaaaaccaccatcaaagcaacaaaggtattttcatcccttccgccgatgatggctgcgctaattacattactcagcagcagcgtatagcttagggaaagatcaatccctcctgacaggatcaccagggtctgcccgatgcaaaccaatcccagaaacgaaacttgcttcaatatcgtataaatatggtctgccgacaaaaatccggcgctgataaaattgattgcaaccgccagcgcgactaccaccaggtagacaaaaattataggcaggattttctttacttcaaatgatttaaaactaattttagactttatcatatccacaccctcacttctttgctttgattgcactgatcgcaagcgcaatcactaaaattacaccctggatgacaaactggtaataggaatagacccccatcagattcagcatgttgttgataatccccataatgcctactgcggcaatacagccgattacgctacttttcccgcctgccagtaccgcgcccccgacgaccgccgttgtgatagagcgctgggtataagcatcgccaatcagagggttgccggatgtggaataaaaggtaatgtacagtcctgcgattgcagacatcagcccagcgaccgcaaaagccaaaagcttggtccttcctacgctgatgccggtacattctgccgcttgctcatttccgccgatcgcataaattgcccgtccgaaatttgttcggttcatcataagccacatcagcagggttacaacacccatcagcaaaatcgggaatatgtagttccagcctttggagacaaatttacacaactcagacggtaacgtcccgctgggagccgacatgatcagcaatgctacccccataaaaattgtctgcgtcgccaatgtcgcaataataggttgcatgttccccttcacgaccagcaggccgttgatcgcaccgatacctatccccagccccaggcaaagcaggcatgcaaccaaccatgtagccggatcatccgtaatcagcgaaaccgccgtaacgtttaccatagatatcgtcgcgcctaccgacaggtctatccctccgagcgatattacaataacttgagcaaacgtaatgaacaaaaggccaatattggaggtcaagagattccttatgttcctcgccgccagaaaattatcgctgataaaggatgttacaataatcaggacaagcaagatcaggaaaacaatcacgacctcgctctttcgtttatacagtagccggagattgtgttttgataaaaacgcaccggaagctttcacctggcttttcattgatttaactcctccgtttctgtggaatcatcatgtatcttctggttcatggctccacgcataatcaattcctccgtgatctcgccgcctgatagctctccggtgatacgtccctcatataaggtcagcacacggtcgcaaagcccgatggtttccatcatgtcgctcgtatagcataggattgccacgccttcatctgcgagctcacgtataatacggtaaatctcctgcttcgcttcgacgtcgatgccgcgcgtcggttcgttcagcaccagtaccttaggctcatcttccagactttttcctatggaaaccttctgctggttgccgcccgataggttgatcaccggctggagcaaggaagcaattttgatgtttaatttttttgacattacttccgcctgtttccgctcttcttttttacggataaagctcattctttgtcttttgcgcaggcttgccatacttaggttttcctctaccgacatttccaggcacagcccctgtacttttctgtcctccggcacgtagccgataccgtgtgcaagcgcactcctgacattccggtaggaaagcttacgctcgttcaggttgatgcttcccgtataatgacgcaaaccggcaattgcctgaaacatctgcgtttgcccttgtccgtccagtgcgccgatacccagtatttcgccttttcgaatggagaaatcgatatcaaaaaaattcctgttatcgctcaatcccttcacttcaaaggttacttctcctgcatttttgcatttcggcggaaagatattctgtagttcccgccccaccataagctgtatgatgcggttttcatctacttcatccagctttacggtatcgattacattcccatccttcaggattgtcgccctgtcgccaaactggaatacctcttccagcctgtgggagataaaaatcaccgttttaccgtcattttttacttcacgtacgatggtatatagtttatccacttctgtttgtgtcagggtggaagtaggttcgtcaagaattaaaacctggggatccatcgaaagcgctttgagaatttcgatcatctgttggcttgcaatcggcaaatcgcccgttcgtgcatagggatctatttcaatattgtattttttcgcaagtacccttgctttgtccatcagatccgtctcattgatcagcatacctttatgtgtctggttcagataaatattctgtgccacagtaagctcgggtaaaagcgacatttcttggtaaaccatcgcaatcccacaatcctgcgcctgccgggcattgcgaaactttacgttttttccgttgatggccatctcgccttcatccgccctgtatatccctgtcaggatttttagaaccgtgcttttccctgctccgttttcgccctgcaatacatgtactgtgcccggataacattcaaaggaaacatggttaagcgcccgtactcctacaaacgattttgttacattttttatctcaatagaaggtttcatatgtattgccctttcatcttgtgataatgaagcggacaagcggctggccggctgacagccaaccgctcatccgatcaagcattaacttactttcaaagctatagaccttttatcactttccgaacagttctaacaatgtttcgtcgggcaaccatgtatggacccaaaaactatcatttaagtcctcacggtaaaagtcagccgccgtatcgatggtaaccggatcttcattgacgacgatttccgcttcaacgtcttttccattcagaatatcaaccgtgtaatccagtgcgatcgcgctgatgtaagccggattggaaaacgccatcgtgtcaataccattatctacgttttccagccaaacgcgcaggaatccgttgcttgcttctcccgtcatgggcaccaagtcgcgtcctgcctcgaggaacgcatcgattgccgcctgtgtcatggctccgccctgagacaagacgccgtcaatttgcggataggctgagaggatgtcctccatcgctgcttttgcggtcgcataatcccagtccaggttaagcgtcgcgataatttccgcattcggtgcagtttccttcaaaccgtctacgccgccttcatgccgtgccgcattgattgcattgccttccgtaccgtcaagaacaactacttttccattttccggaatacgctcgcccagccatgtgccgcttgtatatccaaggtcatagtcggaaaccacaatcctgcaatcaacgtccgcagtacagctctggttgaagttaacgacgataattccttcatcccttgcttcttcgataatgtcattcaggccatccggcgtaatgcaggtaacaacaatggcatcgcatcccatcgtgatcagatcgtcaatatcggaaatttgtttgacctggtcaccatttgcctggagcataacataatcagcaatggtaccgtccgctttcatttcttcagcatggtttttaaattctgcttccatttgtactctccaggagtcgcttaaagagaaattggagaatccgatcataaaaccgtcgtcattgcttttggcttcctgagcgctttcggccggagcatcgtcttgtgcttccggcttttcaaccggctgttcctgcgtcgctccgctattgcatccaaacagtgcaaataccattacgacaaccagaatcactgcaaatactttcttattcatttctttcctccttgaatttttatacttaagccccttgggagcttctcgcctttaaaccaccggatagaccggctttcccgtgagcagtgccgatgcgacattcgccccaaccttacgctgcagttccgcaagcgcctcttccgagcaccatgccgtatgaggtgtaagcgtcacctttggatgatgcaggaaggaactggaagcaaaatcttccgtcgaaatgacatccagaccgcaaaacccaatcttccctgcgtccagcgcatccagcattgcttcttcgtcaatcaacccaccgcgtgcagtattaaccagcaccacaccgtctttcatagcagcgaactctttttgggagatcatttttttcgtagccggactcagtggaacatggatagatatgacgtccgcgcgcataagcgcctgatccagctccacaaaggcaacctccggatattccgccacgtccttgaaatatggatcgtaggcaacaaccttaccaaaaaagcccttaacctttttgtataagtcacgtgcaatactcccaaatcccaaaagcgcaagcgtcatcgtctccgaacgatggatcggtctgatctttgaaaaatcaaacgagtcggtgagcaaaagctcccttgagggcgccagcttgcggatgccgtttaagatatgtgccgcagcatggttcgccacctcgctaatgcagtaatcgggaacgtttgctacggaaattccctttgccttcgccgcgtcaaggtctaccgtatccataccgatgctgtaacgtgcgataattttgcattgcttcaagctattgataaattctgcatccagcactgcaaactggcaaaccagcgcatccgcatccgccgcatattcgatcagcttcttcggatccttgatcccgccctggacgatttttgtgcagtcgaccacctcgatatcgtctcccagttttttcagttcttccatttccgcattcagatttggataatagtagtcagagaatacaattttgtatttgctcatttcacaatccctgctttcttcgcaattttcagcatccctacaatgctcaaccggtccacagcctccatatcacaaacagaggttaccgttacgccttccatcagcgttccaatgatatattcgtacagcttgcagcgtgccttgttgccaaccagataataattgttgatcgcctgatcggtaagcatgcctagctgcttgacagacaacatatcctccgcagcaaccagcgcatccagaaacagtctgcgctcctgccattcagtatccagcaggacgtctaaaaaacgtgggaacatcagggaacgcgccagcccgacttcatttagccatttgattgcatcgcagattaccgcttcattataataatcgtcgtttaccttttccgcatctgtcggcgggactactgatttatgcaaaaacgtatgattgactaccgaatcaaagagctgtccgctcatggtagagaggcttccccttatcataccgttttcgtcaaccggaatgaactttgtatgtgaggacaacacgaccaccattgcgggaagccgaaaccctgggtctgccatcattccaacaacctgggtttcctcccccctcataaaatccagcctgccgactatcgccgtaggatcttttccattattggggatcgggttcttgatcccgcggacaaaatagaccggtatcttttcgacgataccagcgtcttccacccttgtgatcgaagatgccagcatttcttccccacacggcgcatctgcatgtggtatttcgcacagtccgatttcagaagtaatcatgccgctggaaagcaccgctgcaacgtcgtcctttagaatccccgcgttcccgatcgccttggcgacaatttcctttaatccgctccgcaatgtgtccctgctgcccgtaatagaagtatcttttacaccgacagttttttttgcgaccccatacaccttgccgccgctgtcaacgacataagcccttgaatttgtagttccacaatcaataatcacataatacatggttaatccaactccaatgcacttaaagcgtttttcaaattacccatttcttccttagtagccggaacaaacggtgaacgtggataggccttcataatgcccctgatttcagcaattgcgtaaatcgccaactgagtggaacgggcgaggtacataacgtccctcaactggttgatcttaaattgaagcttgagtgcttcttcatactctccgttcatagattcctgccacatttttttacacaactcaggatatacatttccgattcccggaatatatgccttgcagcccagcgcgtgggcagatatccacatcgcctctgtaccgagcgcaatgtcaaactcttcgtccgcaagctccctggtatatgttgcatattttaaaatatcaaaagttgcatccttgatgccggcaagccccagttccttgagccttttcagcacatccatactgatttcataaccctggaaatttggattattgtatatataaaaaggaaagtcctttacctcagccaatatttccgaataatattcaatcaattccttatcttggtgcttataataatatggtcctactgcggaagcagcatcacatccgatcgcttttgcatgctgcgtaagctcgatcgtatcgcgcgtgtttgttgttcccgtatgcacaacgacctttgccccccccttggcgtatttcctgacgatctctgccgtacgcttgcgttcttccagcgacatcagcgcgccgcaaccataggatccgcagatgaacaagccgtccaccgtttccgaaaggtattcaaccaactttctgagcgtctcttcatccagttccccgttttccttaaaaggtgtgatcatcgggggaacaactccattgaacttaaacatactttattctccttatccttatataattatttgtacttttatttctctatgatcgctaccatagatacaggcgccgcctccagtccggtccagcgtaccggaaaagcgcaaatactttttattcctttacagcccagcaatgtttttatatttacgtcctcaaaaatcagtaacgttcgctccctgcagtcatcattttgatccagcaatgcatggtgggatggaaacccattttgtgcactgctcaccgcgctgtccacgcttaaggtatcgagtgcgaccgccttcaggctgggaagttttttcctgagatatatagccagttccggcgaaagcgacgggaaatcatccatgaatttttcaggcgcactttccctcaactcagaataacccgtataaatcagaagaatatcgcattgcttgatctcattttcatgaaggagtatatcccccaggtcaatggtatctcccttccccttttttaagacaagcacgtatggttttgtgtaataaaaatcttcaatcggcaattgctcgatggtacttccatctgcatcgaaatgccgcggggcatccacatgcgttccattatgtaaatgatgatataccgaggaagttgtattgatatctccttttgcaggcgatgttatgtcatagtatttttcctcagggttagtcggccatttaggcgaatgttcatttaaaacgtaactcaattccagtaacaatgtctgtccctccactcaaaaaattgtaatcaaaaccaacacagggcactactgccttttgcgtaaaaatagtctgtcttttttctggtatgcctgtcgaatgccttagttcaagtaaatttttataatgcaagtatttagtaagtgcccatatacggctggccggtatgcgccgtaagccctccgtcgatgggaatattcactcccgtcaggaaatcacactctttcgaggccaagaacactgccagcttggcaacttcctcaggtcccggaatataatgcaccggataagcctctttaaatttttcttctgcacccggtacggatgaaaaggtattttccacaatttttgtgcgtatcgcccctggacagattgcattgaccctgatccccatgtccgcataatccagcgccatgcacctggtcatatttgtaatcgcaccttttgccgtattatatgcaaccatatccgtatcgcccagcaaccccgagacagaggacatattgatgatcacgccgtctttttgttcaagcatttgcgggataaaatagtgattgcacagatatacgccccgtacgtctacattcataatgcggtcccattcctccggcttggtttcgtgtatcttaccagtctgatggactcccgcattgttaaatagtacctgacaactgccaaattttgttttgacatattctgcaagttcccgtacttcgctttcgttgcttatgtcgcacgcaaagaatagtgcctctcctgaatatttgcgggtcaggatctcccttaaaagggcttctccagtttttttatccggttcacaaaaaactaccttagcaccctcttccaaaaattgtagaacggtcgctttaccaattccgcttgttcccccagttattacgcataccttttcttttaggcgcatgtatgcttcacctctttcatttaattgtattaagatttagtatgttgatttaacaaatatgaaaaaattttttctttatgactatattatctaatcattcgtcaaatttgtcaagctttttgtaaaataattttctattttaatgtttttttccttttcgttgacgcagcagaattattttggtatcatttagtcaataaaaacagtactcaaattcacgtaaatttaagtatactaacgacacaatttataaaggtaaacgctatgaatcctgaagaatctgtttttgatatgatccgttccaattacaacaaaatgacgaaaacaaggcgcgcaatcgctgatttcatcctgaattgcccgaatgaagctgttcaattatctatcagcacgcttgcttccagagcaggcgttaaaagcgaagcatccattgtccgtttctatactatgcttggctttaacagctttaaaaattttaaaattaaattggcacaggatattgtagggaaaacttttttccattccacagaagacctgaatatcgacgataccctgcatgaaataagaaagaaatttattgccagttctatgtcttgcctgtcggttgccgctgaccagcctggcgatgaagtgtttgaagccgccttagaacttatatgcaatgcaaaccgtatcatattattgggctatgccgcttcagcggcgatttgctactatgcccattttcgtttgctggagcttgggatcgactcccatttttcgcctgatccgcatatcaatgcgacaatccttactcagccaaacccttcggatcttatcatgtgcatctctgtatcgggagaaacgacggatatcgtacgccagttaacgacacttccgccccattcggcttctattttgtccctgacaaccaatcccgattcgacgcttgcaaaaatgtcagatgtcgtcattgccacccctacccatgaatccagtatcgtcacagatgccatgaacgctaggttggttcagatgtgcgtagttgatgtgctttattcaacaatcagcatacgaactgcaggtaaggcttttacccgattgtcaaaaatcaggaatactttccaaaattataaaaccaaattttagattttagcggctaaccgctattcccttcctccgcaaagcctgtgccgctttttcaaggaacgcctgccgcactaagacataatctgtattataggtagaaacacaaaatattggtatctgcgcctgcgccaggatatcgcttatcttcgccaggatccctgtcagagaaaaatccaacactccaacaattttcagcaatatgaagccgctttgcagctcttcgcacggcggcattttgtcctgcctgcatactaccgaaacttcatccggcgttaccgtaacgctacaaaacgcattctcctgcatcaatccatcggcatcgtttggatcgcgcagctttccgatggcataaatcccctgctcaatactgatttccatatcaaaaaaacataccttccatgtatttttccataaaatacggattatgcccaagctcaatgtggcgcgccctgtcgcacattttttgcatctcaacctggtatccgtcgtttaaaagagcgatgacagcgcctgctcctgccgcatttccaatattcacaatacgttgcaatcctgcgggcaaaaggccgatttcctgtgcgctatccttgttcatatagttgccgaatccacctgctatatacgtatatgccatatctccagtttccatttttgcgctatgcaacagcgtcaatactcctgccgcgattgccgatttcgccatttgtatctcacggatgtcctgctgtgtgataaagacgttatccgtgattttaaaagccggttgtccttcgatttcaaattgcagatcagcccgttcccctgttatttttcccgtttcgtcgataacgcccatcctacgcatcagcgcggccgcatcaagcaaacccgaaccgcagatccctcttgcctctgtatcgccgatgacttccacagcaatcttcccctgcgcttcgtaaacgcggtttacagcccccgtaatccccgccataccacacgtaatatgcgcgccctcaaacgccggacctgcagccgtggacgtactgtacgcaatgtcggcattgccaaggaccacttcaccgttcgttcctatatccattaacaaacaaggcgccttgccttccaaaaatccggcgcataacaatgcgcaagaaatatcccccccaacaaaagccgacatgcacggcggaagatagcacattgcctgcggccctgcctccaatcccaattcggacatcagaaccgattctccgaatttagagagtggcttaaaaggtaattcgcccatagaccgcggcgaaagaccgacaagcaaatgcatcattgttgtatttcccgttatcacagcataggagatttctcctggctttatttgcactttttttgccgcggtgccaatcatgtcatttaactggcgaatgatcgccccatgtaaacgcagcaagccgtcgttttgctctttgcaatactggatgcgcgaaaccacatccaacccgtattctatctggctgttcatacggctttccacggccagacattcctgttttcccatatcatacagataacaggcaatcgtagttgttccaatatcgacagcaataccatatccactcttatcgcttttgatatcaggcaaaataagttgtgtcatgattgcggacattttgttcactccttaaaagaaaagctgcctgatacgccggcagccctcgtttcacttcacattatacaaatcgaatcattcataaacagacaatgccacatcgctcgcgctggatgcatctgcggtataataatccgctccaattttattcttaaaatcttccgtcaccggcgcgccgccgaccatcaccttgatctgatcacgcaatcctttttcattgagcaggtcaacaacccgcttcataacagccatcgtggtcgtaagcagtgcactgcatgcaataacctgcgcttcattttggagtgcggtttctacaaatttctcggcagatacatctacccctaggtcaatgacttccagccccttgctctccatcatgatcctgaccaagtttttcccaatatcatgcagatcgccctttacagttccaagcacaaccttacctttggattccatcttctcgctggcaagcgccactgccagggcatcgatacccgcctgcattgcgcgcgcagcaatcaatacttcaggcacaaatacctggttgtttttgaatttatccccgacaatcgccattcccgcgagcagaccattttggagcaaatcctttgggttgcttcccttttccagttcagcagcgatgatatcttttatattattgacgcgcccttgctgtacatacatacttaaatcgtcatatacgctcatattcttcgctcccttgtttcctgttttacaaaggtattatatcacaaaatactttttcttgtcttttctattattcatctaatattcacaaatcattcatagagggttaaaacttttccattaaaattaaatcatgaaaagaaattgataagctttttcatcagataacccccataaaaaggccggcaggccttttgcaaataatcgccttggcgtttaaatatatatgatacttccgaaaaaatctgctgatcaatcagcagatttttttttcttctttttatataccgagagccgcagcgaattcaaaacaacgcatacggacgaaaacgccattgcaagccctgcaaacatcggcgtgagcgttggcccgccaaacgcgtaccatacgcctgccgcaatcgggataccgatcacattatagataaacgcccaaaacaggttttgcttgatcgtgcgcatgatccgccgcgacaagaggatactttgtgcgatgctgtcggtatcgtccttcatcaggatgatacccgaagaatctgccgcaacgtccgttccgccaaaaacagatatccccacgtccgcagtggcaagcgcaggcgcgtcattgatcccatccccgacaaaggccacctttttgcctttgtctttttctttttgaacctcagccgctttttcttccggcaatacatttgcgacaaaacgatcgatacccgcctgtgcagcgatcaaatgcgccgccttctcattatcgcctgtaatcataacagtctcaatgcctacgctgtgcaacaaacttaccgtgccggcagcgtcttccttgatttcatcagcaagcgcaatcacaccgagcatgtcgccgttgaaggccacataaacgcgcgtcgtccctggcgtacgcgattcctctgtgggaatcttctgcaagtccataaattctttggtcccgatcacgatctcgccctgctttacctgtgcaatgacgccccgtccggcaacattcttgatgctttcgggctttttcgcttcgatctccataaactttgcatactcgatgatcgccttggcgatcggatgcgtcgcgccatactccgccgttgcggcaaggcgtatcagcgtctcctcatccccattatccgctacgacattcgtaacatgcaactgtccctttgtaatcgtgcccgtcttatccatcagcaccgtgtctaccgcgcccgtagtttccacgacgtcgccgccacggaacaatatcccaagctgcgcgccgcgccccgttcctaccatcactgcgatcggagtcgccagccccaaggcacacgggcatgcaaccactaagaccgaaacaaagatattgaccacaaaattcgcatccttgcccgtgatcgcccagatcaccgcggcaataatagcgatcgccgtcactgtcggtacgaatacggaggatatcttatccgccaagcgcgaaatttttgcttttttctgctgtgcctgtacaaccagttttaccacttgcgaaattgctgtattcgatccgacgttcgtcgcttcaatatgcagcacgccgtctgctacaagcgttcctccggataccttggaattgatccccttgaataccggcaggctttcgcccgttaacgtagattcatccacactcgcctgtccctcgcgcacaattccatccaccggaatgcgctgccccacgctgacaagcacaatatctccctgctttacctgcgtcgccttgatcttctgttcttttccatcctttatgacgacggcatcctgcggcacgaggcttgccagattggaaatggcgctcttggcccgatttttgctgctctcttccagatattttcccaaaagcaccaacgccacaacaacagccgcgctttcatagtaaaggctgtgcaccgcatgcggatcggaagggataaagcacgtcatcacgatactatatgcaagcgcgctgcccgttcccagcatcacaagcgtgtccatcgtcggatgtcccttggtgagcgccttcgttccgttgataaagaaacttcttcccgcaaaaattacaggaatcgtgataatcagttgaatcagcgcataattcattggctctgccgaaggagaaaggaacgcaggcaaaggccagttccaatgcgcacccataccgatatacatcaccacgatgccgcacacgattgcgagcacgatctcccatttatggaacctgtgctcatcctgcgtaatcatttgtccatcctttgccaccgacgctccaaagccggccttatcgaccgcatcgatcaattgctgttccgaaacattctcttcggatacaacgaccgcgctgttggctgcaaggttgacgcttgcataaataaccccgtcaacgcgcgatagagcgccttccaccgaagcggagcaagccgcgcaattcatgcctttgatatttaaaatagtttccttttgcattactttcacccctatctattgatgcggcaggtccgggttaatatgaacgatgacatcgtctatctccggcctgttttttaacatttccagctcgatcgcctttgcgattttatgactttcgatcacagtcatatctttatccacagatacctttacaatcaaaataattttggcgccgaccggcttcgtactcacactgtcgatatggtcgatcccattgattttcaatatctcttcttggtattccttaagtgttcctgcatcgctccccgtatccatcaatactccggcagactccttgatgatcataaaaccgctgtagatgatccatactgagatcgcaataccgatcataccgtctgcccaatgcatgcctaacacgcttaaaaaaattgcaatcaacgtaccggatgttacaaaaacatcattcctgtggtcttgtgcgttggccttgatcaatacgctttgataacgtatgctctttttcacacaaaaaatataaaggctcgcctttgcaacaatcgtcgcgaccgctacgccaaccagccaccatgaaaattccaacgcagattgcgtcatcagtgaatcgaccgatccgctgatcgtataaatcgccattacaatcatggaaaacccgatgatcatagacgcaatgtattctgcttttccatgtccccagacatggtcggcatcttttggctttgccgcatacaaactgccgaatagcgttacggtcgaagcaaatacatcgcccatgctgttaaatccgtcggcaatcattgcctggctccccgcagcatacccagccgtcaacttggatatcaataatagaatattgattgcgatacccagcatcgcaacctttttgccagccgaaaagcgatcttccaccgtgatactaccccttgtatataaataacccggaaagcgttttactaatctgtattataccatatttcatcaggatacatacaaaaaagagaccgctttcagcggtctctctgattccatgcggttttatatgtttagtttcccccgccaaacaagtttacaaagaaatcgccaattcctttaaagaaatctcctacgcttgtgaagaatccttctaccccctgcttcgcctggaacaaattcaaaaacgtatccggatcaatattcaactcgttaaactttttgaccaaccccagaatctgctgaatctggtcttctgtcaaagtaacttcatacttggcggccgtttcgttgataagctcaacgatctggtcgtccgtcatgttctttgtttccttcagcttacccttcaagtcgttgatgatatccgaagaaacgtcccccagcgcatcctgcagctcacctgttacgaccagttcttcaacagccgtgctctttgcattctcatccagctgcttgccggtcatatcctcatatgctttataaatcccggccaaagcgcctgtgccggaaaccggcttgtatgctgaaatctttacctttgcatccgtgattcccgccgtagcaagcgctgattgatacatcttttccgttacccagttgatattattgatgctcatatcgattccgccgccatcgttcggttcaatatatacgcacgaaagcgccacattaccgattttctcattgggaaccaaaccgtccagataatgccgctcctcactgttcgtcacctgcagctctttgacgtcgcccctgttgatattaaaaaagccgtatacatccgatatttgcgattccgtattatcagcgccaatcacgacgcgcgcctcttggtctgctgcaaaagccggcgaaaccaacagccctacactcaataccaaggttaaaacaataagggtaattttcttaaacattttcaaataccttcctatttgttattttgtttctttatcataaacccgcaggtctccctgaagatttttcaactttgtaatatattccttcccgcatattatatcatttccagctatatagcgcaatttcataaattgcggaacgatgtaatattaaagaattgttaagattcgttcatattttagacgaactcgtctccaaaaaggttccctgcttttgcagaatattttttcataaaacagttgatttttatttgaaatctgataaaatattataagtcagcacaataaacggtgccaacgtggctcagctggtagagcagcgcattcgtaatgcgcaggtcagcggttcgaatccgctcgttggctccaagtcggggtgtagcgcagtttggtagcgcgcttcgttcgggacgaagaggtcgcaggttcaaatcctgtcaccccgaccaaacaaaaaacctgataaccatgcggtttgtcaggttttttgttttgcttaagccgattgtatccggaatgaaaaaatgctatacttttgctaaaatatcacatggaggtaaaactatgggtgctgctttttttctcatactcgttatgatcggcatcgtaacagtcgtaaatgctatccttaaagcaatcataaacaagaatccacagtttcctaaaccacacgctacactatggacaattctcggtgcagtggttagttttttttgtttggtgaaatgcccatttttctctcgcaattgtgtatgctcggttatccaatccgaattgacactccgtggatattcttaccgtcagcaatcatatcatcgcttttggggatttttctgttggtttttataagaaaaacagatagagaattgaaaaagtccttataaatcaagcatttaaagcaatataaaacaataagaattagtgaatttacaacgaaattacaaccaacgaaagagcctaatataccgacttatgcaaagaaatacgatgattataaattgacgcttgaaatagagtgcctttttctatgttatgaaataacacagtatttcatttctgcttgattaacctaaaacttattaggctatggtttgtcaagggcttgttgtataagcaatgcgaaaagcaccctttacaaatcgtaggctgataagtaatttatcaaaagcagaaaagaagtgacgatattatctacacatggtataattgcatcatagaaaacgataaattgaaagttgcggaggtgattatatgagaaaaactgtaataatggctttgctacttgtattgcttttttcttttgtaggttgttcagataaacctcttacatataatgccaatatgggttatgatttaagtgaagttgaatatgaaaacgttgagtttaatgtttatcattctaatacagaaaatcatacatgggaacacttaaaaacattttcatgttcaccagataaaaatcatttcgttgatgtgagagtggagggcgaaaaaaatcgtataaggattacttctgaagataatcgtgtagaaaaaacggagaatacggtatcttattatactgatgatacagatacatacgaatttacgattgatggatttaatgggtggattagtttgtttaaaacctttgaaataaaagatattgatgaggaacaattctaccgtttatatccgattagcaatgatgatggtggagcaatttttcaagacttaaagatggatacgccttatgatgaggacgaagaaaatcttgataatatcttaattactattaagatacagtaaattatctgttgatttgcaaatcccagttaatgtaatggataggttggaatttcataaacagacggagtgagccagccacggtgacggaaaaatctttcagatttttttcgtcatgttggcaaggggctggttcatttcggctgggagcgagcctgcgagcgactataatcaataagttactctgtttttggtatcaaaaaaacggataaaccaccggtcgcaatcagcgcttgtttattcgggttcgcagcaatagcttactttttcactattctatccatgtaatagcaactcaaacctctcttcccatttcttttgcctgccctaaaacgccggatttttcaatggcgccttccgcgtctatcccgcctgtctggataacgccttggtccttcaaacctaagaagtccaccgccatgcggtagcttgtcaggatcggctcatattccgccttgtccgtatccccgccgcacacaaataaataacattccttgacagcaagcggccgcaatccgccagatccgccataggcgtatagcttgtcaatcgcagctttgacctgcgccggaaatccaaaccaatagagcggtgttgcaatcaaaagcacatcgcagttttccagtaatgccgccagttgattaaagtcatccggcatcacgcaagcctcgcccttgctccagcaagcgtcacaggcattgcagccctcaatcctgtgctttgccgcatcgaaccaatgaatctcatgccccgcctcctgtgcaccgtctgcaaaggctgcggccattttcgtggtgttgctgttcttcctggggctggatgttaagatcagaatttttttgctcattacaagtttctcctgtctaaaaacaactcggctttttcttgtgatatctttccaagtactatatcatttatgttttttgcgaaaatattgataataaacgcatttcaaatttccgttatataattttctgcgtttgtcggctttggcaccatacttattttcaaattgttcatctgccgtaatcacaaataccaaggtgtccgaaagcggtaaaaaggccttccccatatcgcggtacaaggcggcgacttcctttacttctcccatgcgcaccgcatacggcggattggtaattaccgtagccggacggcttggctgtataaaatcctttacatccttacggtcaaaacggatccattgtgcaacatccatattgtgcgcgtgctcgcgtgcgagatccaggcttttcctgtctacatcgcttgcaaaaatttgcatctgtggatcgaccaccaggctttttgcatagtcacgttccagttggaacgcttttttaaaatcattgtcatagctttgcgcatcaaaccgacgtttgatccccggggccatcttgctcgccatcattgccgcttcaattgcaatcgtgccgcttccgcatagcggatcataaaactcccgcgttctccatctggaaatcataatcagcgaagccgccaaagtttctttcaaaggcgcctgggcatttttcagccggtatccccgcctattgaggcctgcgccgcttgtgttgagcgccacagtcacattatcctttaaaatattgacatagatattaaaaatattcccgttttccgcaaatcgttcctgcttgtatacacgctgcatcgccctgacgacagcttttttagcgattgattgtacgtcggatacgcttcccagtgcagaatgtaccgcgtttccatctacaggaaagcgggcgtcagacggaaggatatccccaaatgggatactggcgactccctcaaaaagctgctcaaaagtgacggccctaaattcgctcagcacccaatatatcctgtcagccgtacgcaaaaacacattcgctttcgcgattccctgcatatccgcgtcaaaataaacccgcgcgtcctgtgcgcaaactttctcaaatccaaaatcgcgcagttcgtttgcgagaattccttccataccaaacgcgcatgatgcataacaccggtatatcacgcctgatgtcccccaattttattcataaccagtccgttgatcaccaatttgaaggtacaccctaaaaaccttgcgctatcctcgcacatttgcatacgctttaaatagatttgcaaaaattccattggcgttgcatgttccttcatctttaattcaaatgtaatctggtttttttcctgcgaaacccttacatccgtctcataaatggaaaggttaaccctgtcatggatgtcattcggatctgctttttgtacgcgttttttgtatgcatccaccttgtccgcaatgatcagcgccgccgagatggtactgacaggcgcgcctgtttcttcgtcatgcgctcccactgccgtacagatatcgcacacgtcgccaaaatccatgccgatctcctgcaattcgtcaaacagcatcgttgcacctgtaaggggatgaaatttcctgtttatcatatttccgacatcgtgcgtccaacctgcaatttttgcaagctcaatttcccgttcgctatatccgagtttttcgagtatttcgccggcaatccggcttacatacccgacatgcctcgggccatggtctgtataccctagcgtttccaggttctcgttcgccttctccaccaatgtccggatctttatattttccttgatatcgtcaaatgtaatcatcctctactcctcattatcgtcaatcgcactgatcatctccataaccatgactgacattctctctacatccgcatcaaatagctttgcaacttctgatggttcttgtgtcatctcactaaaataaagcgtcacaaatgtaattgccgcggcaaattcattcgtctcggcaatatattgatctgccgtgcctattttttttaacttttgcagcaggcttgccgccttgcctgccaactgctccgaataacggttgctcacggttgccaccaataaatcaaacaaggtggtatatcccgcctgctccttccctgcggggtctgccattccaacattgacttccacaatactgccgttaaaatatgcaacatacggctcgcgtgcgttcatgcgcttcaggataacaaaaatatcatttttcacctcgtccggctgattccggcgcagaagataacggcgcagcacgcgttccgactttgcgctggcaaatccgcccacgatttcagcgatcgcacgcttgataaaaagatcgccatattccagtccccaaagcatcacgtccgaaagttttttatcattctcccacatgtctctaaaaaccgcatccggcaattttatacaatcattcaggtatttcatcctgtcccttgcctctttgggcggcacctggtaaatatagctgatttccgaaaatggcagttcacccttcatgaccgctttaatatggctgatataataagccgcaatactgtcgtccggctctaatttaataatattggagagatagccgactgcatccgtataacgcttgagattataagatgccactgctgcaaaaaacaacgccttttcgtcgtacggacttgtcgtcaggaaattcgtcagatactttaaggcttcctcgtgccgtttcagctcgcatagcgtaatcgcgatcttaaaaatatcgtcctgcacgtcaagcggttgcttgatcgcatttgcaagatacttttcctgctgctcaacgtccccctgctctgtcataaacaaagccatattgcaattcgcgtggatgttatttgcatcgatagccagtacatgctttgctgtttccatagctttatcaagctccttgatgcaataataggacagcgccagattgttttttgcgaacagcagttcgggattactcgtttcgatcttgctcagtgccgcaatggcctgttcatactctccattgtccagcaaccgtttcccgtcttgcgccagcttctggaactcccgctccttcgcatcttccaaaaagggatcctcatattccattgcatcgtcaaacatcatcaggaaatcttcaatttcttcgacaaactcgccatccggctcctcgtccatatatttttcaaagctctcctgggctttttcaaaatcattcaaccctatgaaattgcatcccatgccaaaaaagcattcattccgcatatcctgcgcatgcagtaaaagatcgaacaaaaggctgttcgattcctcatattttccaagtcctgtcaaaatttcggccatctgcatcgtatattcagcattatcctgatctttttccaatgcacggcgcatcatagataatgcccccaaataatctgcggactccgtcattttttgtgcagttttcgaataaaattcggccggacggctgaattcaagtatttttgcgtttcccattcctattcctttgtggcttgctctaacaaggctgccagttcctgcgcatcaaaccaatattttttgttacagaacctgcatacaatttccgctccctggtcctcatctatcatatcctggatctctttttttccgagggaaatgaccatttgttccaaacgctctttggaacaaccgcattcaagaaccggtattacagtgtcgagtatttgaaggtcaaggccgctgaagatgttcttaagcacattctctaccgaatccgacaacatatacattgcaaaattcttgatttccggcacacgctgctcaattgccttaagcgtttgttcgctgcaatccggcattggccggataatgattccccctgcgtttacgatactcatatccgtttccagccatgtgttgacataaacaatcgacggctgttgctcggatgtcaaaaagtaatgcgcaatatcttccccgatctctccgctgacaataggcgtcttgccgatataaggatctttcatccccatatcacggatgaccgtcacaaaaccgtccctgccgattgcatccgcaacattgaacgttcccttttctgtcggcggcgtattgacctgcggattcgcaatataagccttcatgcgaagttccgcgtctcccacaaccatgacggtccctgcggggcctccgccgttcagcatcaacgtaaacttatcgtttttatttttcatcatagacgccatcattgttcctgccgcgatggtcctgcccaaaatgatagttccgaccggcagcgtattatggatcacacgtgcttcctccgccatgccggatacctcgcatgcgcataccgctgcttcattattgatcattgccctgattaaaatatcactcattgttttttatctccttgttgctgcaaattgtattctgtcgctttctttcgttggcgggtccatagataaaaaggcataggcgcgcacatctgtaaatcccgcgtcctgcagcccggatgtcaattcctcaattcgccatgcgcgctgcacatgtctttcatcaaatcttttataaacgccctcttcctctacaaacagcgtaatatccatggtcaggagaccctccttctcatcataggcattctgccaaaaataagtttcccgatccccgtcatcaaaataaaattcgtttcccagaacatattgcagcttatacgccgaactgatatcaaagagcagcacgccgccctgctccaagttatgatatgccttcttaaaaaaactgcccagactatcgttatccagaatataatttaccccgtcacaggcgcacacagccgcccgcatcggtttgttcagttcaaatatgctcatatcgctgcacgcatattttatctgtagcgcacctttgcgcgttttctcctgcgcccgaagcagcatctcttctgaaatatctacagcagtcacacgatatcccctgcgtgcgagcggaagcgtaatgttacccgtcccacatgcatattccagtaaccgtgcacccgactcaacgccggagtccccaagcaggcggatgatatagtccgaccattcatcgtaccctatatcgtacatgagcgcgtcatacacgcttgccagcgcctgatactgcttattcaaagtccgtaaccctcaaaaaatattctacaccatttaatagtgcctcttcgttaaaatcaaaatcgcttgagtgcagcggcttcgtcttctcgccttccccaatccctacaaaggtataaagtcccgggatccggcgctggtaattagagaagtcctccgccatcataaacggcttcaccatttcaatctcatcggatgcaaacctttggcgcgcctgatcgaataactgtttatcatttactaccgcaggataacccattggctcggcatactgatagcgtataccataagcaacacgcaggccctccagcatttcatgcagcctttgcttgatcgtatccatcacgcgggcttcgaagccgcgcatggtgccttccagatgcaccgtttcacagatgacgttccttgccttcccgccttccgccctgccgatcgtgagcaccgccgtttcatatgggtctatattgcgggaaacgatcgtctgcacgcccgtaatgaactgggcggcggcgaccagcgcgtcgtttgcgtcctgcggcttagccccatggccgtcttttcctatgatatcaatattaaaatcacacatctgcgccataaccggccctgctttcatgccaacctttcccagcggtacatccggccacaaatgaatgccgtaaatttcatctgctttcggatcggaaagcgcaccgccttcgatcatcggttgcgcgccgcccaccgtttcctccgccggctggaataaaaatacgtaattgtatttgagctgctcttttgcactgctcacaagttttgcacacacaagcgcaatcgccatatgcccgtcatgcccgcatgcatgcatcatattttcatgcatggacgcaaattcgcagccggtgtcctccggcacgcgcagtccgtctatatccgcacggaccgccaccgtcttttgcgggtcctttgccaaaaacaccgctttgatgccaacgcctgcgcacgatgtaaggatatctggctcgcattttttcaaatatcccgttaaatattcagacgttttcgtgacgtcaaaagaatattccggaatcctgtggagctccctgcgtatttttttgagttcgtctgcgtattccaaaaccagtggtcttactttcacggcgatccctcgtttcgcataaaattactattatgataataccgttttctttcccctttcgcaagtatttcacgtataaactatttacacaggtgcaggtatgttgtataattaggcagaacagacagaggagcgttattgtatcagtacccagaatgatcaagtctttcggcgagacggttgcattttgtgggaaaggacgtaacgccgaagagtaagccgcccgccgtgcgcttatatctggggatacagtgaatatctgtatcactgtcaccgcttacgcggtgttgcgctgctgctactgaatcaaacaaatgatgcagaaaacggcgcgcatggtgtgccgttctttttttacaaaatttgtgcaggtcatcccctgctaaaatattttaaatgttgcgcaaacagcaatgcgcaggaatggagataggtatgagaaagtttaatgttgccgtcgtaggcgcaacgggcatggtcggaaggaagttcttgcaggttttggaagagcgtcagcttcctgtggagaattattacctcttcgcaagcgcaaggagcgcaggaaaaaaagttgtttttatgaacaaagaatatacgatcgaagaattgacggaaacgtgctttgacggtaaggacatcgatattgctttattttccgcaggcggtggcacgagtgaaaaattcgctccctgtgccgtcaaggcgggcgctctggtgatcgataattccagtgcttggcgtatggatcctaaagtcccgctcgtggttccggaggtcaatcctgaggacatcgaatggaatagcggtatcatcgccaatccgaattgctcgacgatccaggctatggtcgccttaaagccactcgacgacaaatataagatcaaacgcgttgtatactcgacgtaccaggctgtttccggtgcgggtatgggtggctacagcgatcttgaaaacggcatcaatggggatgccccgcaaaagttcccctatccgatctttggaaactgcctgccccagatcgacgtattcgatgaagacgattacacgaaggaagaacttaaaatgatcaacgaaacgcgtaaaatccttcataacgacgatatgcgtatcacggcaacgacagttcgcgttcccgtattccacggacacagcgaatccatcaatgtcgaatttgaaaaggattacgatttagacgaccttaaaaaaacgctcgctgattttccgggcatcgtcctgatggatgaggtaaagaaaggcgaaagcaaaggcgtatacccgatggcgcttgatatcgccggtaaggatgaagtgtacgtcggacgtatccgccgtgaccgttctgttgattccggcgtaaacctctgggtcgtcgccgataacatcagaaaaggcgcggcaacgaacgccgtacagatcgcacaggcctggatggacgcacaaaacaagtaaacaaaacaggagtgttatgactatgatttttgaaggatccgccgttgcgttggctacgccttttacggaaaacggcattaatttcaccgagctggaacgcctgatcgagtttcagatttccaatgatacggatgccctgctcgtatgcggtacgacaggtgagccttccacaatgacaatggaagagcagcatgatgtaatcaaattcgccgtggaaaagacggaccgccggatccccgtcattgcgggcgtaggcggtaataataccgcgcatgtcatccagtgtgcaaagatggcgcaggatctcggcgctgacgcgcttcttgccgttactccctactataacaaatgcagcaacgcaggattgatcgcacattttacagcgcttgcagatgcaaccagccttcctgtcatcctttataacgttcccagccggacgggcgtcaacatttgcccttctgtgttcgaagagctttgttgccacgagaagatcgcagggatcaaagaagcgagcggcaatatctcccaaattgccgaggttgcgcgtctgacacgcggaaaagcggctttatacagcggcaacgacgaccatgtcgttccacttctttcccttggcgggcacggtgtcatttccgtagttgcgaatgtcatgccaaaatatatgcacaatttggtgaccaattacctaaatggcaaaacacaggatgcctgcaacatgcagcttgagatcaatcccctggcaaacgcaatgtttatggaagtcaatccaatccccatcaaaactgctatgcggctgatgggctttgatatggggcctttacgtcttccccttacggaaatgtctcctgcaaacctcgaggctctaaaagtacgtatgcagcaatatgggctgatctaataaaggtggttaaaacatgattaaaatattactgagcggtgtaaacgggcgtctcgggcagacgctcgtgtcctgtatcacagaaacggaagatatggtagtcgtcgctggtgttgacaaaatgccgcaagcgcacgcgaatcccttccccgtgtatgaggatttttcgcatgtcatcgaatctgtggacgtgatcatcgatttttcgcgtccggacgcgctgcatgggcttcttgaatttgcgcagacaaaaaacatcgctgttgtacttgccactacgggctatacgtccaatgataaaatgatgattgttaaatatgctggacatattccggtctttttttccgccaatatgtctttaggcgttaatctccaaatggagctcgccaaaaaagcggctggattcttaggcaacaatttcgatattgaaatcgttgaaaagcatcacaatcaaaaggtcgatgcgccaagcggtaccgcccttgccattgccgattatatcaatacagcttttatgaataccaaagagtatgtttatggccgcacaccgcaaacccgcgctaagcgcgaacaaaaagaaattggtatacacgctgtacgcggcggtactgtcgtcggccagcatgacgttttgttcctgggaaacgacgaaatcatcgaagtccaccataccgctctctccaaaaatgtttttgccgaaggcgcaatacgcgcggcaaaatttttaatgggaaagcctgccgggctttattcgatgttcgatatcatttctgaatcgaacgctaccatgagcctttatacggaagatgatcatgcagtggtgcgcgtgaactgcgttccaaacaatccttctgtcttatccaatattttcgaaacgctttccaagggcggtgtagccctcgaccttgttcagcagtgttcgcctgatggacagatgatggacatctccttttcgattgctgtatctgaattgtcgcggacactttctatcttaaagacgttcaaggatttaaaggtcgattcagattacggtcttaccaaactgacgctggaaagcagcggtataccaaagcaagctaacatcacagcgaaattatttgcagccctcgcgtcccaggaaatcaggacttatgttttcacggcttctgcggcaaaggtttccttctgcattgataaaggcgatacgactaaggctgtgaaggtcatcaccgaaacctttaaactctaacatttacgaggtaactatcattgaaaaaatacgatgtcgtcattatcggcggcggaatcagcggaatcatgtccgcctaccggctgaccgagcgtaacccttccctgaaggttgcgctgctggaaaaaggccataccatcaccaaacgcatctgcccgatcatcaaaaaaacggcagaccgctgcattaagtgtccctcctgcgctattatggagggcatggccggagcgggcgcgttttcggatggaaagtatgtcatttccacggagtatggcggttggctcactgatttcctggagccggagactgtgatagattacatcgaacaggcggataagctgcttgtctccttcggcgcgaccacggaacgtttcatgccgaataacgacctgaagtcagaatgcctgaaatacgatcttcatatgtcgcaggcacaactgaagcatcttggtacggatgaaaatttcgatacgatgcgtaaaatgattgagtgcatctcagagaaatgcgatatttttacggataccaatgtaacggatgtagacgcttcgggacatattgtatacgctgagtccaaaaaagagaaaatggaactgcaggccacagatattattttcgccgtagggcgcgtcggcagccagttttttgccgcatggtgcaagaaaaacaatatcagcctgatcaacaatcaggtagatatcggtgtgcgtgtagagcttccatccagcgtgtgggaacatttttcacgtcacatttatgaacccaagatttggtatcgcagcaaggcctacggcgatacgacgcgtatgttttgcttcaatgagaaaggcagcgtcgtaacggaaaatacgaacggcgtactgactgtcaacggacattcttaccgtgacaaatcgcgtaagacaaacaactcaaactttgctcttcttacgacgatacgcttcactgagccttttaaggagccgatcgagtacgcccgccatgtggcgagcctcgctaacctcataagcggcgacagcgttttggtacaacgctttggcgatttgcttgcgggccgccggacggatgtaaaccgtttggcgcagtctacaacccgtcccacattgaaagccgttcccggcgacctgagcctgtgccttcccaagcgtcagctcgacaatattatcgagaccctttatgcactcgataaagttgcgcccggcaccgcaaactatgatacgcttctttatgggatcgaatgcaaatactattctgcacggccgcacgcaaaggattttgaactggatggctttagccgtgtttacgctacaggagacggggcaggctttacgcgttctctttcgcaggcagcggccaacggcctttacgtggcggataaaattttgaagcgcgattaacttaaataaaaaagcgcctacagaagcaggcgctttttttgtacccttttacttaatgccaatatctgtcctgtaatgtgcctggtcaaaggaaattttcttaacgtttgcatatgcttttgcacgcgcctctgcaatatccctgccggttgccgtcactccaaggacgcggccgccgttcgtgtagcaactacagttttcttccttcgtgcccgcatggaatacgaccacgccgtcctcaacatcctccaagccttcgatcaacttaccattatcgtacttctgcggatacccgccggaagccataacgacgcatacggcgctttcatccttccagtcgagcgaaaccctgtcgagcgttccgtcgatcgacgcatcgatgatatcgagcaaatccgtttccagaagcataaataccgattgtgtctcgggatcgcccagccgtgcattgtactccagcacctttacaccgtcaggcgtcagcatcagcccaaagaaaataacgcctttaaattcccggccttcggcattcagcgcagcaacggttttctcaaaaatctccttttgcgcgaattcctgcaactctttcgtaaacttcggagacggcgcaaatgttcccataccgccggtattgagcccttcatcgttatcatatgccctcttatggtcctgtgcggaaaccatcggcaaaatagtttttccatcacagaaggaaagcaccgaaacctccggccctgtcatgaactcctcgatcacgacacgcgcgccagcttcgccaaattttttatcaagcatgatgtcctcgaccgcgcgccttgcctgatcgaaggtttcacagatcagcacgcccttcccaagcgcaagtccgtccgcctttacgaccgtcggatattgtgccgtttccagatatttgagcgcctgccctgcatcatcgaacacttcaaagcccgctgtcggaatatcatattttttcatcagccatttagaatatgactttgaccattcgatttctgccgccgccttagtggggccaaacgcacggatccccgccgcgtttaatgcatccaccataccaagcgccagcggatcgtccggcgcaacaaaaaccatatccatcccgttttgctttgaccagcctacaataccgtcgacatcatccgctttaatcggtacattttgcgccaactgcgccgttccaccattgcccggcgcgcaaaacaactccacaggccgtttcccttgtttcaatttccataaaattgcatgctcgcggccaccgccgcctactactaatattttatacattacaaatatccttttactgtttagtgtctgaaatgacgaatgccggtaaagaccatcgcgatcccgttttcatcgcacttcttgatcgaatcctcatcgcgtatcgagccgcccggttgaatgattgccgtgatacccgcttttgccgcaacctcgacacaatcgtcaaacgggaagaacgcatccgaagcgagcaccgcacctttcacatcttcgccgctccgctcgagcgccatctccgccgcccagatacggtttgtctgccccgggccgatcccaagcgtccccatgccttttgcaatcgcaatcccgttggatttaacatatttcactaccttgaacgcaaattcgaggttttccatttcctcttccgtaggctgacgcttggttaccaccttgaactcgccgtcaaacattttatcattgaggccctggacaagcaatccgccaagcacttttttcgtatcgatgccgtcttttggaagcggcgcgtttatgtccggtaattggagcacgcgtaaattctttttctggcataaaatgtcaagcgcttctttggtataagacggggcaatcacaatttctaaaaatattttgctcatctggcttgccgttttttcgtcgatctcacggttacaagctacgatgccgccataaatagaaaccggatcgcattcatatgctttcatatatgcatcgtagaccgtgtccgcgcttcccacaccgcacggattcgcatgcttaaccccaactaccgttgtctcggaaaattcacgcaggcaatcgagagcgcctgctgcgtcgttgatattattaaaagaaagctctttcccgttcagttgcctcgcgtttgcgagactgccggcaacatatagcggttccctgtaaaaagccgcatgctggtgtggattttcgccataacgcatttcctgctgtttctcataagtaagcgtcaatttttgcggcagtgcgtccgcattcatttgctttctcaggtattgtgctatgagcgcatcatacgccgcagtattttcaaacaccttcgcgctcaagtaaaatttcgtatcccgcgataccgttccatctgcgcgaagctcttccagtactttatcataatccgcagcatccaccactaccgcaacgtcctgccaattttttgccgccgccctaagcatggtaggtccgccaatgtcgatattttcaattgcatcttcaagcgtgacgcctggcttggaaatcgtctgcttaaacggataaaggttcactgcaaccacgtcgatcgtctccacgccaagctgctttaactgtttcatatgttcttcattgccgcgcatcgcaaggatacccgcatggatttttggatgcagcgtttttaccctgccatcaaggcattcgggaaatccggtaatatcagaaacattcgttaccgcaagccctgcattttcgagttcacgctgggtgccccccgtagaaaggacttcaaatcccaagccaatcaagccttttgcaaactcaacgatgccggttttgtcaaatacgcttaaaaaagctctttttgccatttttatgatcctccaaactattttaaaatttttacaattctgccgtctgtctttaatttgccgtctgccatcaatgcaacagcctccggcaagatccggtgctctgtttggagcacgcgcgccgcaaggtcctgcggcgtatcgccgtcttctaccggaaccaccgcctgtatgatgatcggtcccgtatcggcctgcccatcgatgaaatggactgtagccccggaaaacttcacgccataagcaatcgccgcttcatgcaccttgcttccatacatccccatcccacaaaaactggggatcagcgacgggtgcacattaataattttgttgggataagcagcaagggttttctcgccgataatatttaaatagcccgccaacacgacaaaatccgcaccatatttctgcagcacaccgagcaccgcgctgtcgaattgatccagcgtatcaaacttctttttctgcaccacttctatgggaatccctgcattttccgcccgtgtaatcgcataaatatcaggtttgcttgcaaccaggcagcatatctccgcatgaatctgtccggatgcaacggcatcgatcaacgactggaaatccgttccgccgccggatgccattacggcaaatttcagcatagctctatgcccccgttaccttccacaatctcaccaatagggtaaaccttttcgccggaagatttgagcgctgtcatagcggcttcttcctgctccggttttaccaccacgatcattccgattcccatattaaacgtattataggcatccttctgcgaaagctgcgcatccttcacaagcttatcaaagacatacggcatatcccacgaaccaagcgtaatttttgccccaacatttttcggcagcacgcgcggtatattctcataaaagccgccgcctgtaatatgtgcgattcccctgacgtccaccttttcaatcaggctgagaatcgactttacataaattttggtaggcgtaagaagcatctctcccagcgtcgcccctgtctcctcaatacggattgtattgaggctatcgtccattgcgtacagcttacgcacaagcgaaaagccgttggaatggatccccgtggagccaagaccgatgatcttatcgccaactgcgatattcgttccattgatgatatccgccttgttcacaatgccgacgcagaagcctgcgagatcgtattccccctccggataaaatccgggcatttccgccgtttccccaccgatcagggcacagccggactggatacacccatccgcaatccctttgacaatatctgccgcaactcccggtaccaacgcgcccgttgcgatataatccaggaaaaacaatggtcgtgcaccatggcatattacatcatttgcgcacattgccacgcagtcaattcccaccgtatcatttttattcgttgcaaaagccgccatcagtttggtaccaacgccgtccgtccccgaaaccaggacctggccgcccccgatgtcatacattccgccaaatgtgccaaggtcggtaatgacattaccgtcgaaggtttttttgacgtgctctttcatcagcttgaccgcctcatagccacgttctacgtctacaccggcatctttgtatgttactgccatatattcttctccttccagcctctgcccctattctataccggacagttccacggcttccgttttttccaaagcctttttcatatcgatcggatagtgcccgttgaagcatccggtacaaaagttgcatcctgcgccctctaccgttttcaacaggtccccgatcgataaataatgaagcgtatctgccccaataatcttacgaatttcttccaccgagtttttagacccgatcagttgatcgtgcgacggcgtatcgatgccaaaaaaacacggacaaaccaccggcggcgaactgatctgcatatgtacttcccgcgcgcctgcaagacgcagcatttctacgattttcctgctcgttgttccacgcacgatcgaatcatcgatcaaaatcaggcgttttccatgaacatttcgcttcatcgcattcaatttcagcttcacaccgcgttcccgcagcgcctgtgacggctggataaacgtcctgcctacgtatcggttttttgacaatgcttttgcatatggaatccctgattccgccgcataaccggatgccgcaggcgtcgccgaatcaggcacatcgctcacaaggtccgcatcgactgggaatgcctgcgccagtttgatccccatattttcacgcgaccgatatacgctgattccgtcgatatctgaatcaggccgcgcaaaatatacgtattcaaaaacacaaagggccgtttccatcgaggactgtgcctgatatgatttcaagccatccttgttaatcacgatgatttcacccggacgaatatcgcgtacaaactccgcgtcgatcgtatcaaacgcacacgattcggaagctacaacataattgttatccagcttccccagcgccagtgggcggattccaagcgggtcgcgtactgcaaccaactcatcctgtgccatcaccacaagcgcataagatcccttgaccactttcatcatggcagaaatcgcgttcaacagaccgcgtttagaatacttggcaatcaagtttgccattacttccgtatccagcgacgtttggaaaacagttccctcgtcttccagcttttcacgcaaaaccgtagcgttgatcaggttgccattatgtgccaaagcgagctttcctccacggtaagacatcaccagcggctgtgcattatcgtccttgctctctcctgtcgtggaatatcgaacatgtccaatacctatatggccgcccagcagtttgtcaagattatccttaaatacctccgagcataatcccatgcctttatggtatttgatgtccttgccgtcggttaccgcaatgcccgtactttcctgtcccctatgctgcaaagcataaagcccaagataggttgcttctgccggatcgtaatgatgatcgtccataaaaatgccgaatacaccacattcctccggcatcacgtcatcctggggtttccagcgttcatattgcgtatttggtgcaaacagcatgcatcattctcccatcaagcgatgcagaatctcctggtaggcatcttccacatttcccaagtcctggcgaaaacggtctttatccagtttttcgcctgttttggaatcccagaaccggcatgtatccggagatatctcatccgcaagaatgatatcgcccttgaaacggccgtactccagcttgaagtcgatcaattcgattccgaactgctttaagtagtccgtcatgatctcatttaccttaaaggaatattctgcgatcttcgccatttcttcgggtgttgcaagccccatcgcgtagatatggtagtcattgatcatcgggtcgccgagttcgtcgtccttataactgtattccaatacggtggatttgagtttcgttccttccggaatacccagccgcttggagaggctgcctgcggcaatatttcttacgatcacttccaccggaacgatagaaacgctcttcacaaccgtttcgcggtcagaaagctcttccacaaaatgcgtcgggataccatgcttttcaagcattttgaacatatgattggataccttattattgaccacgcctttgcctacgatcgttccctttttcagtccgttaaacgcagtcgcatcatctttataatcaacgatcacataatccggatcgtctgttttgaaaaccttttttgcttttccttcatacatttgttctgttttattcattttataactcctctctgagttcagcatccgcagctacaactttgagctgcatatcttctttaaatttatataataaatcgcttaatgtatcatacttgagcgcgagaatttgcactgccaataatgcggcgttctttcccccattgatcgctactgtagctacagggataccctccggcatctgtaccgtagaaagcagagaatccagcccgtccattgtagaagatttgatcggaagcccaatcaccggcaggatactgtgtccggcaattacgcctgcaagatgcgccgcctttcctgcggcagcaatgattacttcaaccccattatcctttgcgttttttgcaaagtctgacgcgagctgcggcgttctgtgcgcagacatcacgtgcgcctccacttcgatgccaaaatccttcaatgtgtcaatcgtcggcttcaagaccggcaggtcgcttttagagcccataatcactgcaactttcattttgtttctcctttgatttcaaaactcattttatttccagtgaaaggattgagccggcaggtcgccggctcaacctcacactgatatattctttttagatcaaggccagcacgataaagttcagtacgaacaggatcgtcgccacgatcaggattggatgcagttcttttgctttaccgcggatgatcttaacgatgcagtagaacaggaagcctgctgcgataccgtacgagatgctgtagcaaagcgccatgaaaacgcctgcgaagaaggcagggacagcttcttcgaaatccccccatttgatatccttgaaggctgccatcatcatgataccaactgcaatcagcgcaggagcagtcgcttgggatggtacaatacccatcactggcgcaaggaacatacatgcaaggaaaatgaccgccgttacaacgctggtcaggcctgtgcgtccacctgccccgatacctgcggcactctcaacatatgtcgtcgtgttggatgttccgaacacagcgccgacagaagttgcaatagcatctgcaaaaagcgccttgtccattttagatttgaagcccttgctggtctccatcatcttcatatcttccgcgctgaaaataccgcttctgcggccggttccgataaacgtaccgatcgtatcgaaggtatctgatatgctgaaggcaaatatcgtcataatgaccataagtatcttatccggcaccgcaaatagcgactgcataccctccggaccgaaagctgcgccgaacgtcgtaccgagatcctggaaagaagcgctgaggctgtcagccgcaaagttcaccgtcgaaagatcaactacgcccatcgggataccaatgatcgtcgtagcgatgatgccgataaggatagcacctttaactttggcaaccagtaaaataattgtcaggataataccaataagtgccaaaataactgccggcgaattaaaagtgaccaaggccggaacagctccaccggaagaaacgatgcttgtaatgcccgaatatgaagcgtccactgcaaacggtgcaccgtttatcgacatgatcgttcccggatcggatgtaaactggataatgcccgcattcttaataccgatataggcaacaaagataccgatacctccgccgatcgcattctgcaaggattcaggaattgatttgatgattgcttttcttagtttcgtcaccgtaataataatgttaacgataccgcagatgaataccattgcgagtgcttgctgccatgtaaacccaagcgcaaaacataccgtgtaggtaaagaatgcgttaaggcccataccaggcgcctgtgcatacggtacatttgcaaacagccccattacgagcgtgccgatcgccgcagcgatgatcgttgcaaggaataccgcttgagaaggcatgcctgttgccgaaagaatactcgggtttacaaagatgatgtaagacatcgcaaagaatgttgtaaatccggcaattacttcggttgaagcttttgtgccattctctttgagtttaaaaaacttttccatatgatacctcccacaattaaaatatataagtataaaaacttataaaggtatcatactaaattgcacgaattttcgcaatattaaatcgaacttaatttacgcattagctataatagttcgcaatataacgaactattatgcgccgatgtttttttaatgcactgttttatgctatttttaccatgaagttgaaattatgaaaaagaagtatatttctgattaaactcttcttgtggaatagctttggaaaaataatagccctgcccgtaatcacaaccaatttttcttaagaaccggacgtcttccagatgttccacaccttcacacactatctttattcccagcgaatgtgccaaatccaccgcgcaagtgatgatccctttaactctctcgtttttgctcatttctttgagaaatgctctgtccaatttaataatttgcaaaggaagcttacttaacatattcaagctggaataacccgctccaaaatcatccatagaaatcaagaatccgtcgtcttttaaacggaacagcatttgaatcacagagtctgctacttcattgaaagcactttccgtgatttcaacttcaatatagttatgagggatttcaaactggtgggcaatttctaaaaaggtttcataaaatgcctgcctgtaaaggctcacgcgtgaaaaattgaccgagattgtaaaagccggacctccacgatccatttgatcccgcaaataggcacacgcttgtctcaacatataaaaatccaaattcggaatcgtgccattcttttcgaacaatggaataaaagcatcgggatatacaatgccatggtccggaaattcccaccgcaccaatgcttccgcgcccgcaacctcaagagagttcaaatcgaatttcggctgcaaatacatcttaaactctttctccgccaacgcctggtatagctggtcctttagtttcttttccatgcgcatttttcgcagcaattcatcgccataccagacaaccgattctttttcattcgtcttggccgttttgtgcgctgtatttgccttatccataatggtcttgatcaattcgtcatttttttcgatccggcatgcgccgaatataaagctcacacttccgaacgtctccaaaaagttttgcgccctgatcaccttatcaagtacattctccaattgctggatgatttcctctgaatctttaaccaaaagcataaaatcgtccgcgtcgatacgcgcacataatttattcccatcccattttgaaactgcgattgctatattacgcaataactgatcgcctaaagcatatccataggcattgttgatagccttgaaattgtctacatcaaattcaatcattacatatttttgttcagaatcttgacgcagcactgcagcagcagacgattcaaaacctttcctattgaatatcccggttagattatcagtataaaggctcttctccaacaccttgcggctgcgcatattcacaattgcgaaaacggtgaccgataaaaccaagctaagaatgtaaaatataataaaacggattaatttattatttgatccctgctcagcagccattaccatacggtcagcagcttcaaaatgctgttggctcaaatcaaacaacctggaaggcgttgtttccccggaacgaaccaagggtatttcttcctttatatcctcccatatttgtttcaaatcggctaatttctgttgatatgcaggatctgtattcttcgaaagatcatagtcgccttctccggtctgtagatcgtaaataataccgtcaagacgtgcaataagagtatcatccgcttggccattcagttcttccttgacaagcttttgtgttgctcctcgaacaatcccgctataattaatgatacgggcatcccctacattttgccacaaaagtatgattaaaataaggacggcaatcagccatatccctgtatatatttgaaattctttctgctttcttttttccagcacctttttgtttctatccttacatagtttttctaatgcaattattcgaggcgggtaaattggtaaagagaaaatagtaataatgccatattcacaatgtatctagtataccacccaagtagcgtcaaatcaaccaaaagcaagcatgcttgttcatattaaatcttttgattgtccttatatgttttgaaatgaataatagtaaatacctttatctttttcacttttcccctgcgccatttgtgtatgataacacgatgcacaatgacacttaattgctttaaccctatttgtatattctatccgtccgcccatagatgtacctgaataaatatttggcatagatattttcccctttcgtaatattttttatattctttccacgtcataacatccacctcaaaatatcttcttttttaagttgaactgttccaatggattaaatgtgtctaccacattcaccaaatcggcggggttaaactgatagtaattgttcagcatcttcatgctttgatgtcccgttatccgttgaagcaatacgggggacattccatttcttacgcttaacgtaataaacgtatgcctaaacagatgcaaactatgtttttccacgccccgccttttgcagtattttgtaacgcttatctgcaaggtggtgcgcggcagttcttccccatagatattacaaaatagcggttcttcccctgccccgtttcgtattcttagatattcaaacagatggattcttaaacttgtcggtatcggtacgatgcgcggctttctgtttttggtgtgtcttaaatggataatattcccgtccatatctatgtcccgtatctgcaatttccgcagttcccgcgccctgatgcctgttgcaagcaatacattgactatcatccatgaacggtattccgcaaaattatttgtttcagggcgttttaaaagcgtttccaattcttctttcgtgtaaatgtccttgatgtgttcctgttcaattaaatgcacaaacaggatattatccttgatatatccccgtttaatgccatacttgataacaggggaaattttgaactgataggaattgactgtttcgggttttaacctgtcttttagatacaacacatattcattgattaaatcctgcgtgatatccgaacagcgtaaatccttccccgcccatgtgcaaaaatacttatgtgcaaattcgtatcctttgattgttacgtcagcaagattctttaacctgcactcctgttcgtaaaggtgatacaggtcatcataaccgatatccgtcactttacaatccaacaacttttttcttcttgccaccactggctctttcgtctgtttttccataaggaataacacctccaaaaataaaaaataggtggtcatgattaccacctactttttgaatctcgatgctgttcccactcaaacgccgtttggctaaaacccgcatggttaagccaaaaaccttactcccactcgacaaatcctattatatgggggtgtattctctgtgttttcataggcaaaatattcgcaattttgttaatgtttcatctgttattttcggctgttaattttcttagtatcaaaatagtatcataaaaggcagggaaatgcaacagaattatgtggagctctacataattccggcacggacggacgctgccaggcatagcggataacagccttgcaaaaggcgttgtatctgcgctggatatactcttggtaggctttctggtcgttcatggaaattccccctctctgaataatagtgcagggcggcagcactccttgctgtcgccccttgattgcctaccagcaaaggcggggggggggggggggggggggcccccccccccggccaggctcgaaaggagattgtctgcacaatcaaaaaacaaggaggcaaaaggaaatagatgaaaatcctggaagcaaaaaacgttaccaaaatatttcctggagttgtggcgctggacgcgatcaatgtctcgtttgaacttggaaaggtacactgcatcgttggagaaaacggtgcgggtaaaagtacgctgatcaaatgcctgacaggcgtttacgagcctgacgacggcgagatattgatcgaaggaaaaccggcccttaaggataaaaagctgtttgaaaaggtcgcctatgtaccacaggaaatcgacctgttcagccatatgacagtagcggaaaacctatttattccattcgaccgttccaatatcaagggaacgatcaatcaaaaaaaactcaatgaaaaagcggtcccgatcatagaaaaatttaatatcaacgttgctccggatactctggtaaaggatatttccgtctctcagcaacaattgctgcaaattgcacgggcgactgtatttgaaggatatgacgtacttttgctggacgaaccgacgaccagcctgacaacagaagatacggaacgcttgtttcagacgatagaacagttaaaaaatgaaaataagtcgatcgtatttatttcgcataagctggaagaggtctttgccatcggcgacgttacgacggtctttcggaacggaaagcaggttgcggaagtgaacacctctgagatcgacgttacctggacggtcacgcaaatgacaggtcatgcgctcgatgaaaacgaagtgttttattcagataaggtttccggcgaggtgctcctgagcgtgagaaacttgacgggcgaacgctttaaagacatcagctttgacctgaaaaagggtgaaatactgggattctcgggccttgttggcgcggggcgaagcgaactcatgcaggccatattcgggtacttacctgtggtctccggtgaagtcagttacaaaggcgaaccgtggaagctgggggataccagctattccgttgaaaaaggtatgttctacctgcccgaagagaggcgaagccagggaatattaccggagctgagcattcgtgagaatacttccattaacttgctcagcgacctgctggtaggcgggctgatttccaaaaagaaggagacaaagctgatcaatgaagtggtggcggattacgacgtgaaagcgcccaatatcagcaaacaaatcaaattcttaagcggagggaaccagcaaaaggtcgtcatagcgcgcgctatgagctgcaaaccgagtatcctgattttcgatgaaccgaccaaagggatcgacgtcggaaccaaaacggaaatataccgcatgatgaaaaaaatcgctgaggaagaaggcattgggatcatcttaatttcttcggaaatgaacgaggtcaaacggtgctccaaccggatcattaccttatataaaggaagaaaggccggagaatttacaaaagatgccgatgctcaggatattttgcattcgatccttgggctcggcgaagcaaaggcaggggagaacgaacatgaatgatatcaaaaaaatgtcaggcaaagagaatattttaaaaaacagcacggtattgatcggtttcgtattgattctgttctgtgtcgtggcaacgatcttttcaccgtattttcttacattatataacttgcagtcgctgatgcgcgacatcgcctttatcggtatggtggcggtggggcagtcgctgctcctgttgctcggagagctggatttatccgtaggttcgatggctacgctgtccggcatccttggcggcctgctcatgacgtcggcgggggtgaacccgtacctggcctttgcgatcggcgtactcgtgggcgcggggctaggcgcgatcaacggcgcgttgatcacctcgctgaagctgaacgccatggtcgcgaccatcggtatgcagggggtctatacaggcatcacgcttgttattacaaagggaaaagcaatcacggagataccggaaaatattcttttcctggggcaggacaacgccgggccgctgccgatcccctttgtcattgcactggcggtcgtcgtgctggtctttatcttcgcgacaaaaacaaaaacagggcgctacatctatgcgatcggcaacagcaagccggcggctgagatcttagggatcaaagtcaaccgcatccgcgtactggtatttgcaatcgtcggacttctttcggcgctggcaggaatgctgtacgtagcaaggcttggttcggcgcaggcgaccatcggctcgaactgggcgatgaactccattgcggcaagcgttatcggcggcgtattgctgacgggcggcgtgggcaatccggtgggatcgttcatcggtgcggcgatcatatgcgttatttcaaacgttatcgtattgtttggcgtcaatatctattggcagcaggcagttagcggcattgtcgtggtcgtggcgatcgctttgccgtcgatcatgagcatcgtgcgcgagaaaaaacgaatcaaggtactcgcaaaagagtgaccgctttccttatatacaggcagaaaaaaagacggagatgaatgggaatgaaagataaatacctgatcgggatcgattccggcacatcgcggatcaaggccgtgctctttgacctggatggaaatgaactgtgctccgaaggaatggcgatcacggcatacacgccctgcgaggactggtatgaacaggatatgaaggaaatctgggacctgggcgtacagtgcttaaaggctgtatccgaagggatcgatccggaagacatactggggattggtatcacggcgcagggcgacgggctgtggatgatcgataagcatggcgatccggtacgcaaaggcgtgtgcttttgtgacgggcggacatctgagatcatcaaagcgtgggacgaggatggtacgcgggaaaaagcgtttgatatctgcgggaccgccgtattcggatcgtctatgagtgcggaaatcaggtggatggaacagcacgaaagcggtgcgatggaaaaagcggcgcacattttccacctgaaagactggctgttttataagttgacgcatgtggcatgcagcgacgatacggatatgtgtattccgatgctgaacgttgagacgcgcgaatacgacgacaggctgctggagctttttggtattaccaaatataaggacaggctgcctgaaatgcgcacagtacgtgaaaacaaagccatgatttcatcggaagcggcaaaaacgcttggcttttccgaaaggacgctcatcacgggcgggccgatggacatcggggcttgcatgctctcgtgcggcgtgatggaagacgggcaggcaatgtccatcattgggacggcggcgatccattctgtagtgatggataagccggatatcacaccgcgtatgctcggtatgacgctggcgcatttcaaacaggacaggtggatcaggatgatgtcctcgctgtgcggcgcgccaaacctcgaatggtttttagatacgctgggcgacggattgaagcagcaggcagaggaaaagggcacagatatttacgactactgttcggacctcataaaggacgtgcccgtcggcgcgaacggtgtggtctattatccctacctgctcgcaggcggcgaacgcgcgccgtttttcaaaagcaatatcaaagcgagctttgcgggcatatcgttcaatacccgtatcgaagagatgctgcgcgctgtttatgagggggttgcgctggcgatgttcgattgttacagcagcgtgcccacgccgcttaaggaaatctatgtgtcgggcggcggctccaagagcgatgtatggatgcagatttttgcagacatgatgggcaaggagatcatcgtatgcaacggtaaggaacacggcgcgcgcggcgcggcgatgaactgcggtgtcgcggcaggcgtattctctggctatgacgaggccgtgcgcaggatcgtaaaagtgaaaaaacgttatgcgccggacgcagagcggcatacacggtatatggagctttatgagctgtaccgctcgggataccggatgaatatggactggtgggatttaagaagccgttttttggaatgatattaaaaataaaagcaattgatgattgatgaatggagtaaggattatggaaaacttaaaaataaagcaggatattatagaaacctgtttgtggctgcaaaaggaaaaactggtgatcggtacatgggggaatgtcagcgtgcgcatagaaaacggaatcatcatgacgcccagcaggatcgcttacgacgcattgcagccggaagacatggttacgatcgattacgagggcaacgtcatcgatggtttcagaagcccgacgacagagcgcgaggtgcacaggatgatctatctggcgcgtccggacgtgaatgcaatcattcatttccatccggtatacgcctccgccatgtgtgcggtaggggaaagtatcccgccgattttcgaagagatgacacagcttgtgggcggggagatccccacgacggcggaatatgtacgcgccggtatgcatgaagagctgggcatcgcggcggcaaagtatattggggataaaaatgcggtactgcttcggaaccacgcgcccgtatgctgcggccagaaccttgaagatacgagaatctgctgccaggtcgttgaaaaagcggcaagatgttacatcgaactcaaaaataaatttgacttgaagatcattccggacgatttggtcgaggtggaacatgtgcgtttcttccgtgactacggacacgaatggtaagattttttgaaatttgtcccaaatcatttctaagaaaaaaagcaaaaaagaaattaatttcaaggttggaattttgcattcaaatcgattgacgaaacaaagccattacaactatcctaggttcataagaagcgggataccgcacaaaatggtatcccgcaaattcctccaaattacgagttgaaaaatgaaaaacaagcaaaaggaacttgaaaaagaaatccggaatgcagtgctgaaagaggtatacctgaaaagcgggcggcggtatgtgccgggtgcggtttcaaacaggcatgtgcacctgagcgcagcggacaaggaagcgctgttcggcgcggggtatgaactgcactgccaaaaggaacttatgcagccggggcaatatgcgtgcacagaaacggtaacgctcatagggccgaaaggacagattgaggggatccgcgtactggggccggaacggaaacagacgcaggtggaggtatctgtaacggatgcatataagctggggatccgcggtgaagtgcgtatgtcaggcgacctgtcgggaacgccgggcgcaatattggtaaacggaacgcggcgtgcagagctgcgagaaggcgtgatcgtctcggcgcggcacttgcatctgtcggcggaacaagcggcgggatacggtcttaaggatggggatattgtgcgcctgaagagtaacggaaagcgtgcggtggtgtttgaagcagtggcggtgcgcagcgggcaggggcatgaaatggaagcacatgtggatatggacgaagcaaacgcggcggggcttaaaaacggagacctgctggagatcatatagatatgaagacgaatgacaaggcggcgatggagcaactggtgcggcgcatcgcggaagagatcatgagccgccttaaggaagcggagccaagggacgagaaagcggaagggacactggcgcttgtgacgtcgcatgtggcgtcgccgaagagcgcaaagacggcgctggaagcaaagtatggaagcaaagtcacaggggtcagcttcggggaagcatatacggcgccggggataccgtgcgcgcggtatgaggacatcggggcggacggggtgctggcgcgggcggccgaaagcgcgaatatcgtgctggtgacgccgaagatcgtgcttttaagcaacatagcggccggtaacgacgaaggatttgtggaacacgtggtgacgcggtcgctgctgtggggcaggaacgtaagcgtacttctggatttcgaaacaccgcggtttaagcggaacactttttatgaaaagctgggagatgtgctgggggtgctgcgcgaaatgggcatgcagacgctgggctaccgcgtgagcggagcagaacagcgcgaagggctgggcctggtgacggaacgcgaagtaatagcggcgtggaaaacgggcagggagatattgtgcgatgcaaaggcaatcgtaacgccttctgctaaggacaaggcaaaggaactgggcataaggatcaattggtaggagagaagcatgcagatagcgcgggtaaaaggtacggtggtgagcacgagcaagtcggaaaagctgacgggcttgaagctcctgatcgtaaaaccgatcgacatcgagacattcgaagaaaaaggaagcctgatggtggcgatcgacgcagtcggcgcaggcgagggcgaggtcgtgatgtgcgtgggcggaagttcgtcgcggcagacggcagtgacggacggcaaaccggtggaccagtcgattgtagcgatcatcgatacggtggaagtggacggaaaacggaagtttgagaaattcaaggatagatagaggggaaaaagatgagtctgagcgaagagcagatcaggaagatcgtagaggaaacagtaaaagggatcggcacggcagcaggcggcggggcatggatgtgcgaagacgcgaatgaagcggttgaaaatgcaaaagcagcgcaaagacagcttgtgaagatgacgctggaagcgcgggggaaactcattgcggccatgcgggaggcggcgcttacaaacaaggtaaagctggcagagatggcgcacgaagaaacgggctacgggagcgtggcgcataagatattgaaaaacgagctggcggcaatgaaaacgccgggcaccgaggaccttaatacacaggcatacagcggggacgagggactgacgatcgtggaagcggcgccgtttggggtgatcggctccatcacgccgtcgacaaacccaacgtcgactgtgatcaataattcgatcagcatgatcgccgcggggaacgcggtggtgttcaacccgcatccggcggcgaagcgcgcatcgcaggaagcgatgcggatactaaatgaggcaatcgcagcggccggaggtccggggacgttgatcacaacggtgaaggagccgacgctggagagcgggcaagtgatcatgaaccacagggatatcaagatgctgtccatcacagggggcgaagcggttgtcggcgttgccatgaagacaggaaaaaaagtcgtagcggcaggcccgggcaacccgcctgtgatcgtggacgataccgcagtcataaaacgcgcggcgaaggacatcgtggacggcgcgagctttgataacaacgtgctgtgcgtggccgaaaaggaagtgttcgcattcagttgtattgcggacgagctgatgggcgagatggaaaaaaacggcgcgcaccgcgtatacgggaacgatattgacaggatcgtaaacacggtgctggtgaaaaaagacggaaaatatgtgatcaaccgcaaatttgtggggcgcgacgcaacatacatcttgaaggaaagcggcgtttcgtatagcggaagtccacggctggtgatggcagaggtagacaaaaaccatccgtttgtaatggtggagatgctgatgccggtattgggaatcgtacgggtgcatagcatcggtgaagcggtggacgaagcattccgcgcagaacgcgggtgccaacattcagcgctcatccattcgacgaacatccataacatgtcgctggcggcgtcagtgatgaacacgacgatctttgtaaagaacgcgccgtcctacgcgggactcggctttggcggcgaaggttatgcgacgctgacgattgcaacgccgacgggcgaagggctgacgagtgccaagaccttcacgcgggcgcggcggtgcgtcttaaagggcgacttgcgcatcatttgaggaaaaaaggatggatatcgcagaaaaaatacgcgaagcaggcgtggtaggagccggcggcgcaggatttccaacacatgtgaaggtggactgtaaagcggaatatgtgatcgggaacggcgcggaatgcgaacctctgctgcgggtcgaccaacaggtcatgcaatatttcgcggacgaggtagtatgcgggatacggctggtcatggaacaggtcggcgcggcgcatggcgtgattgccttaaaagaccattacaaggatgcgatcgcggcgctggaaaaagcaatacagggaaccggcgtgcggctgcatatcatgaaaagctattatccggcgggggatgaacagcagatcgtatacgaagtgacgggtaaggtcgtaccgacagggggactgccgctcgacgtagggacagtggtatgtaatgtgagcacactgcgggatattgcgcgggcggcggaaggcataccggtcacggaaaagtatgtgacaataggcggcgcggtcagaagtcctaagacagtgcgcgcgcccatcggtatatccggaaaagaactgatcggcgcggcaggcggcgtgacggaggacagcctatatatcatcggcgggccgtgtatgggtagggtcgcagacagcgcggatgttcctgtcaccaagacgatgggaggattgcttgccattccgaagaagcatccgcttcttgccgcaaaggatggcaggatgaacgtacaaatgatccaggcagtgtgctgccaatgctctatgtgtacgcagatgtgtccgcgaaatgctttggggcttaatgtgcagccacacaaggcgatgcgcgccgtggcaaacggcatcgatcttttaggcagcagcatgaacgggatattctcgtgctgcgactgtgggatctgtacctattacgcatgtaacttcggtttaaagccgtcccaggtgatgcagcggttcaaggcggagcttacggcggcgggcgtaaagccgaaaaaggaagtatatacgcaggcggatacattgtttgcggaaaagaaactgccgacatcgcgtatcgtgtcgcggttgtggctcaatgaatatgacacagacgcgccgatggacgggcagctcatggaaacggatacagtggttatccccctgaaaatgcacgtaggcgcgccggcggtgccggtggtaaagcaaggcgacccggtcaaaacggggacgctcatcgcggacattaagcaaaaggcgctgggcgccaaggtacacgcaagcatcacgggcagggtggaaagtgtaacaggggacaggataaagatacggagaggcaaatgagatactctttgggaatgatagaagtggtcagcataccggcaggcatggaagcggcagacgcgatgatgaaggcgtcggcagtggaacttgcgtacgcgcagccggtgtgcgcagggaaatatatcgcggtagtaacgggcgatgtggcagccgtgcaggcgagcgtaaaggcgggaagcaaaactgcggggccaaagctcatagacagtatggtgatcgcaggggtacatgaacaggtgccgaaggcgttaaacgcgtgcagtgagatcggacagatacaagcggtgggagccatggaaacattttcgctgtgcgcggcagtgctcacggcagatgcggcggtgaaggctgcggacgtcgacctgatcgagatcaggctggggcgcggccttggggggaaatccttcattacgatgacaggcggcgtagcggcagtcaaggcggctatcaaggcagggacagcgattccgcaggcacagggactcatatcagggagcgtggtgattgcttcgccgcatcccgaaattgtcaggacattcatttaaatatatttgggaggaaaacaggaaatgtcaaaagaagcactgggaatggtagaaacaaaaggcctgatcggcgccgttgaagcggcagacgctatggtaaaggcggcgaacgtgaagctggtcggcaagcagcagatcggcagcggtcttgtgacggtgatggtccgcggagatgtgggggcggtaaaggcgtcggtagacgcaggcgcggcggcggccaagagggtaggcgacgtgtacggcgtacatgtgatccccagcccgcacggggatgttgagctgatactgccggtggcggcgccaaaagcggcggcaaacgcgaagtaatgtatacaggcagggtcgcaggcagcgtggtatctacagtcaaggacgagaacctttgcaatatcccgcttttggtggtcaggctcatagagaacgggaaggatgcaaagtgtattgtggcggcggatgcgacgcggcaggcgggcaaaggagactttgtatacctgatcgggtctaaggaagcggcgcggatgtttcgcaagcaatatacgcctgtggacgcggcgatcgtggggttcatcgacaggtatatggaaaatatatgacaaaaggaaacgaggtaaaaaatggataagcaagcattgggaatggtggaaacaaaaggattgatcggttcggtcgaggcggcggacgcgatggtgaaagctgcggatgtaaagctcatcggcaaagaacagatcggcagcggccttgtgacggtgatggtgcgcggggacgtcggcgcggtaaaggctgcggtggatgcgggcgcggcagcagccaagagagtaggggagctttatggcgtacatgtgatccccagcccgcataacgatgtggaaatgatcctgccgaaaaaggtatgaagatcgccagggtggtcggcaacgttgtgtccaccatcaaggacgagtcatattatggctacaagctgatgatcatcgagtatgtagatgaatacggcgacgcagaaggtgtgcggcacattgcgtttgacgcggcgcaagcaggcgtgggcgatgtggtgctggtgaatgtggacggcggcgcggccaatatgtttttggaccctgacatcattgcggatctgacgatctgcggggtgatcgaccgctatacctatgccggcgatacaacgcggctcaattagaaggatcgtgaatatggatatacagaagatcgtacaggaagtcatgcaggaaatgggcggaaaagagacggacagcgtggtttcggcgtattgtccgcaggagtttgaggtgccggcgcaccttgagcattcgctgctcaatccggacattacgaaagacaagatacttgaggaatgtctggtcgcaagaaaatattgcgtggcggcggtatgtgtcgcgccttactatgtggatattgcggcagaggcgctgcgcgggtcgggggttgcggtttgcgctgccatcgggttcccgcatggggcgatgtcgctggcggcaaagcttgcggaagcaaaggaatgtatccgaagcggcgcggctgagttggatgttgccgtcaatatcctggcggtgaaatcagggcgcatggcggatgcgcgcagcgagctggagcaggtgatggacgttgcccggggcaaggcaaaggtcaaggcggtattcgagcactgcgtatacacacaggaggaaaaggcggcggtactgcatatggtaaagacgtgcggcgcagagtttgtcaagatacagaacgtattgagcggcaagggcgcggaggcagaggatatatgcttcgcgaagggcatcctcggcagcaatgtggatatcaagatcgacggcggcgtcaagacgcttgagaaggcaatggaacttctgcgcgccggagcgcagcgcatcggtctcactgctaccgaagtggtcgcaaggcaagcttgcttgctttaaaggagtacatcttgtcaaaaaatatggacacccgggaattgaatttgatgatcagtgtgatcaaaaagtattacgaacttgggatgaaccaggagcagatcgcgaaagaagagttcatctccaaatcttccgtatgccgcttgatcaaaaaggctcaggacaatgggtttgtaagctacaaaatcaactatcctatggaatccatacaaatgctggaggatgaattccacaaacggttcaagctggataaggtatttattacgccttcgtatacggaagacccccaaatccggctgcaggatacgtgcacatcggctgcggacgatatctgcaaaatggtaacggcaagcgataccatcggaatatcatggggaacgactatggagcaggttgccgcctccctgggagccattccaaacaataaaaagtgcgaaaagattattatgatgaatggatcccttgcgggggatgtgacgtcgctgaaatcgagccagacagtagaacggttcgctgaattcttttcggcggaaggatatatccttcccgttccattactggtggacagtaagatcgttgcaaaactgattcgtacggattctcacatccaaaatgtcatggatatggcgatagcagcgcaatttgcgatttttagcttgggcggggtttcgccgcaaacggttttgatgcgccgcaacgcctatactaagacggaatatgaagagctcatgtcgatgggcgcggtaggggatattgtcggcaggtactttgatatgaacggacgggaagtatgcgcaacgatagcggaacgtacggttggtgttgaactcgaagaactaaagaaaaagaaaatcaggatggggattgcagtagggagccataaaatcagggcaattatcggcgccttgcgcggaaatctcgtcaatatgctgtatatggacgagatgacggcgcaggcagtgattgaatttttgaaaaacgacgaaagagagaagcaaaatgaaagcagtaaggatgtataaacccggggacctgcgggtagaagaggtggagaaaccggtacctacagatgatgaagtattgctgaaagtaatggcgtgcggggtatgcggatcggatatcccgcgggtgaatacgtatggggcgcatatcgcgccgctcacgatcgggcatgagttttcggcgcgcgtcgagcaggttggaaagaatatcaaggcgtttaaggtaggggaccgcgtgacagtaccgccgctcatgccgtgctaccagtgcgagtggtgtgaaaagggactgtattcgctgtgcgaagactacgattatttcggatcgcggcgggacggcgcaatggcggaatatctgtgcgcgccggaagcaaacctgatgaagctgccggatcatgtgggctacatcgacgcggcgacgacggacccgtgtgcaaacgcgatccatggcttgcggcaggcacgggtgaaagaaggagacacagtatgcatctatggcgcggggccgatcggcctgtttgcgatccagtgtgcaaaagtatttggagcaaagacggtgatcgcggtggatttaggcgccaagaaattatccattgccaaggaatgcggcgcggaccataccattgattccaaggaacaggacgcagtagcggcggtaaaggaaatcacacagggcgagatggcggatgtggtgatcgactttacgggcgcgccgccggcacagctaaacgcgatcaactcggccggaaagatgggacgggtcgtgttcgtgggcatatcccacaagggtcttagcctcggtgagaaggaagtggataatatcatgcgcgggcagatatcgctgatcgggtcgtggaattcctttacggatcctttcccgggatacgactggacggaatcgctgaagttgtttgcggaaggtaagatcacgtccaaaccgatgatcagccataagctgccgcttaaggatgcgccggaaatattcaaaaagatcgcggaaggcggatttttcttcaataaaatcctgttcctgccaaatggggaagagatggagtgaaaaaagcgatgctggcatgtatatacaacgaaaacggaaaaatggagcttgtggaaaaggaaaagccgcaggcaaagaaggatacggcagtgatccgcgtgcttgcaacgtcgatctgcgggacggactttcggacttatctttacggcagttctaagatcagtcccggaacgacgctcgggcatgagatgtgtggggagatcgtagacatcggaagcggcgtcaaagggttccataagggcgacattgtaacggtgacgccggctcttgggtgcgggcaatgcaggatgtgccgaaaagggcacaccaatatgtgcgacgatttggagacgctgggattccaatatgacgggagttttgcggaatatatggagataccgggccggtatttcgagatggataacgtaaaccccgtaccgcagaaggtagcgcacgcagatgcggcgctggcggagcccattgcctgcgcgattaacgcacaggagtttttggacatcggagaaggagactgtgtggcggtgttcgggtcaggattcatcggatgtatgcacgcagaactcgcttttgcgtcgggggcggaaaaagtggtcatgatcgagccgaatgaggcgcggcggaaggcggcgcaacggcttgtgccgggcatccatatgctggagggcggcgcaggattggaagaaaaggtcatggagttgacggatggacgcggcgtggatgtagcggtcgtggcatgctcggtaggcgcggcgcaatcagacgcgcagaagatcatcggaaagcggggcagggtcagcctgttcggcggcttgcctaaggaaagctgcgggtttatcgacagcaatatcatccattacaaggaattgggcgtttacggcgtgcatgcgtcaaatacgccgcagaaccggaaagcgctggaatggatcgcgcagggaaagatcgacgcgggcaagtttattacgcagaagtatccgctgaaagacattctggacgcgctcgaggatatacggacaaagggaattatgaaagcagtcatcagctttgaataacagggaggaaaacgatggatatcagtgagatcatcaaacaggtcacgcaggaagtgtgcagcaaatatatgggagacaacggacaagggacctcccacggcggggatatggctccggcttcgcttgcgaagtacatcgaccatacgatcctgaaaccggaagcatccatagaggatgtacgcaggatatgcgaagaagcgaagaagtaccggtttgccagcgtatgcgtcaacccgggatatatcaggtttgtggcggaaaacctcgcggggagcggcgtgacgccgtgctgcgtgatcgggttcccgctgggggcgggtacgcccgaggcaaaggcatatgaagcgtcggacgcagcaggcaacggcgcgaaggaagtggatatggtcatcaatgtgggagcaatcaaatcaagggactggcagcttgtaaagcgcgacattgaagcggtggtcggcgcggtagccggacgcgcgatcgtcaaggtgatcattgagacgtgcctgctgacagacgaagagaaggtcaaggcgtgcgcggtatcgaaacttgcgggagcgcattttgtaaagacgtccacaggattctccaagggcggcgcgacggcggaggacgtacggctgatgcgcgagacggtcgggccggagatgggcgtgaaggcttcgggcggcgtgaagacatatgaggacgcagtgacgatgatcaaggcgggcgcgagcaggctgggaacaagctctggcgcggcgatcgtttcgggcggcggagatgggcacaagtgcattaactgcggcgcctgcaaacagcagtgccctaccggcaacgcgactatcatcaagaattgttattaaatgagaggtaaggctggacttccggttttataaagcttacagggaagtcgctggttttcgatgagactgctatgaagactgtaaaaaaacaaaaccaatgacttcacaatcatatttcataggaggtagatgaattatgggcacgagaaaagcagcggtaatgcagggcatcgacgatgtaaaagtgatgcagattcctatgcctgagggagaactgggggcaacagatgtgctggtacgtatcaaggcagtaggaatatgcggatccgatatccacttctataaggatggacgaatcggggatatgatcattataccgccgcacattttgggacacgagagcgctggtgaaattgtccaggtaggctctggggtcgaaaacctgaaagtaggcgacagggttgcagttgaaccgcagaagccttgctggtcttgcgaatattgtcagaacggtgaatatcatttatgtaaaaaaatgcagttcatgtctgcgccttcggaaggagcatttgtagaatacgctatgcgtcccgcgaatatgtgttttaaaatatcggatgaaacatcgtatggcgaagcagccatggcggaaccgttggcggttgcgttacaagcgcttaagagagggcatgtatgcggggggcagacggcggcgattctcggtgcgggtccgattgccctggcgatcctgatggcgtgtaaagcttatggatgcaccgatgtttatgtgacggaccttgtggattacagactcaataaagcgatggaaatgggcgcatccggcacgttcaacataacagaatgcgattacacggaagaaatattgaaggcgacagaagggcgcggcgtggatgtggtttttgatacgactgcgcatccggctacctataaaacaatgcacaaaattgccattaggggaggataccttgttttagtaggaatggggcccgacgaatattacgaagtcaatattgcggcgatccgcgataatgaaaatgtaatgacaggcgtatttcgctataacaatctttacaggaaagcccttgcacttattgcaagcggtcaatgcaacgtcaatcaattgatttcacaccgcatgcctattgagcaaatagcggaagcatttgatattgtgcacgacaaaaaagacggcgttataaaaattctgatcgaaatttaagtcctgatatctattatttattttgtcagcataaactgccttttttgaacaacgggtagttcccggttggtccagatttctaaaatattgaattttttgaagtttcacaatcagtgaaataaaaaataggaggaaaagaagatgaaaaaaaggaacacggtcattcttgttgtattggttcttgttgcagctatggcgtttaccgcatgtagcggcggaggcggggcaacaagcagcgcgcccagtgaatctgcggcagcatctgaaaatgcaacaacatccacagaatctgcggcttccgaaagcgctacgcaggaaagcggtaaaaagtttaaggtcggttatgcgaacaagacgctcaacaacccttactttgtagcgttggacgcggcattgaaggaagaggtggaagcgcgcggttgggaatacacaagccttgacgcaaaagaagacatcgcacaagaacagaaaaacatggaaacgttcgtttcccagggctttgacctcatcatcatgaactgcatcgattctgcggctgcgctgacgtctattgacgcagctacaaaagcaggcgtaccggtcatcaacgtagataacgctcctgacctttcggccaacaacatcacgtccgtattctctgataacttaaataacggacgcgcagtcggcctctatgtaggcaaagaagagttcgcgccggatgaagaaatcaaatcagtactcttaagcggtgtgaaaggcgcggttgtaagccaggaaagacgtacgggcctgatttgcggcatcatcgaagcgcgcacgggcgtgagcgaagacgaagcttgggaactggcgaaaaagatggaacaggaactcatcgacaatggtaaagcggtcaacgaagaagcgaaattctggatcaacggccagggatggggcaactggacctcggacgaaggactgccggcgatggaagaccttatcgttgccaacaaagacatgaatctggtactgggcgaaaacgacaatatgttgctcggcgctatgacggcgatcgagaatgcaggactttccgataagatcaagatcgcagcagcggctgacggacaaaaagaagcgatcaagctgattatggatggaacaaactatattgcaacaggcgagaacagcccgtttaagatcgcaacccttactgttgagatcgcaaacgacgtgcttgtaaacggaaaaactgcggatgattatgaagcagctacgctgacagagccgaatgcgattatcaagagcaatgcggctgaattctataacgcagattcgcctttctaagaaacactcgtagtgaaaacggttttgagctgtcccgctatcgtcgggacagctcaaattcaatacaaaggagttaagaaatggatgattacagagttgagctgctgaatatagacaagcggttcgggggtgtatatgcactcaaagatgtatcactccgcgttaaaacagggacgatacatgctctggtcggtgagaatggcgcaggtaaatcgacgcttatgaaagtactgtccggagcgatcccaaaagacagtggaaccattcgtattgatgggaaagaggtatccatcaataatccaagagaaggcagcgacatggggatcgctaccatataccaggaatttatgctggcaccgcatttaaccgttgcggagaatatatttatagacaggcttacacagggcggcgcattcatcaactggaaaaagctgaaaaaagaaacagccgctatattgaacaagctgggattcggaaacatcaaccccaatcagagggtatctacactttcggttgcctatcagcaggtagtagaaatatgtaaaaacctttcgcgcgaagcaaaagtgctcgtgcttgatgaaccaacagccgtacttacgtttagtgagattgaaaagctattcagcctgatccgtatgttgcgggaccaaggcgtcagtataatttatatttcgcaccggttagatgaaatcttcgagctttgcgatactatcacagtcttaaaagacgggacatttgtaaaagaggtagatacaaaggatattgataagcaggcactcatcaattctatggtcggacgggatctctcgacgctgtttccaagaagggaaacagaaataggcgaagtggttatgaaagtcgagaatttaaaagtagaaaaaaccgttcaaaatgtatcctttgaagtacacaaaggcgaagtgttaggcttcagcggactggttggctctggacgaacggaagcaatgcatgcgattttcggcgcagacaaacggcagagtggaacagtagaattttttggtaaaaatatatattttaaaagtccacagcaggcggtaaaaaataaactggggctattgcctgaggacaggaagcaacagggcgttctcttaagccagtctatacgtatcaatacgacgctgtcgtcgctgcggaaagtggaaaacgcgccaggctggataaacaagaaaaaggatatgtctgtgacagaaaaaatattgcatcagctttctaccaaatacggttccatggaagatgacgtttccagtttaagcggcggtaaccagcagaaagtcgcacttgcaaaatggctggcggcagactgtgaatgtattatactggatgaaccgacacgcggcgtagacgttggcgccaaagtagaaatttataaaaacatcaacgatctagccgcccaagggaaagcgatcattatgatctcatccgagatggaagagatcatcggtatgtgcgacagggcgatcatcatgcggcaggggcgcgtggtgggagaactgcaaaaagatgaattatctgaaaacaacctaattaatcttgctatgggggtctaagaaatggaagcaaatgtaacccagaaaaaacaaaaaaacggtttttcatcgtttctgatcaaaaacaatacatatgtaatgctcattggactttttattgtttgtatcattatctctccggacttcttcaatgaggcgaacctggtaaatataggaaggcagtctgcgggtgatattatcattgctcttggtatgctgtttgttatactgaccggtggcatcgatctttcagtcggttcggtggcggcgcttgggagcgttatggtcgcatttgcgttgactacgcacgaaatgggtatgggcatggcgattttattacctatcctgttcggcctcgcgcttggtcttgcgacaggcgtactcattgcttatgcaaaaatggcgccgtttatcgcttctctggctatgatgaccattgccaagggcctagccttcatgatttcaaatggacaacctgtcattacgccggaaaacacgattggcgtactgggaacgcattcggtaggcccgattcccacgttggttatactggcggcaatcattataatactgttctggataatagaaaagtatacggcgtttggacgtattgtcattgcgatcggcagcaatgaaacggcggtacgactggcagggattcctgttcgtaaatacaaaatgtcggtttacgctatttcgggtgtgtgtgcggcagtcgcgggcattatcgcggcatcacgtaccgcgatcggcacaccgatcattggctcgggctgggagctgaatgcaatcgcggcctgcgtcatcggcggtgcgagcctgtccggcggcgagggctccagcgtaaaggcggtcgtcggggtcttggtactggcactcatcagcaacatcatgaatcttcttgcggttccttcttatccgcaggacgtgatcaaggggctgatcatcattggctccgtgctgttgcagacctttacatcgggaaagaagagcaaaggattctaaatgaaccgttgatataaagcggtggggtataaggcagtttcttatgccccatagcaaatcaaaggagaaggatatgaaagatacgcttttgatgtccgttgacctgggcaccagctttatcaaagccgcgatatacgatactgcaagcaattgtatcgcgattgcatcagaacccgtaaaggacgagcgccccggtccggggatgtttatccaaaaaggagatgatctttatgcatctgccgtagcctgcatgaaagcggtatgcgacgaggtaggaagccgcgcacaggaaatagaggcggtggcttttaccggacaaatgtccggattcatgggtgtggataaaaactggaacgatatcacaacgtggtcgtgttctttagataaccgctatatgccatatgccgagcggcagatgaaggagcttcaaaaagactttctggcggtcagcggaacgaatgcaccgcagatggcgcctaaattcgaatggtttaaaacggaatttccggaagaaaataagaaaattgcaaaatatttgatgatcagcgggtatattatcggcaagctgggcgacgttgatattgaggatgcggtgctcgacacgacctatacgcagtggacgggtctcgcggacatcaaaaagggagaatggtcgcagaagatatgcgatgccatcgggcttgaccaaaattatctgccgaggatcgtgcagtccaactatatatgcggacacctgagtccccaagcggcggcaatgatcggtcttagaagcgggattccgctcgtttcgggcgcgggagacaaagcggccggctgcatcggtgcagccattgtcgatacggcggacatgatctttgaggcatcctcgtatggggaaatcagctttctggcggaggattaccggccagatatggataccgggcgcatcgactgtatcccgtcgcccattcccggatactttttcgtgacaaaatttgtggcgggctcgggtattacgattgactggtacatcaatacttttgtcaggaaagaaggagaaaaactttcggcggcttttgcgcatatagaaaaggaaatgcaggatattccggtcgggtgcgacggactcatggcgatcgggctgttgggaggaagttctatgccgcttgacggcacgctgcgagggatgtggatgggacatgactggagccataaaagcgcgcatttttacagggcgcttttagagagcttttcctatgattttgaattgactattaataagattgaagaactttatccggaatattctcctaaatccgttaaaatagtcggcggtggtgccaagtcccccttttggacgcaaatgaatgcggatgttacagggaaaacatatcaggtgcttgacagggaagatgttgcgatgtggggagttgcaatgctggcgggtaatgcaatcggcgtattcagcgacgtgaaggaaacagccaagaagcatgtaaacattgcaaaggaatatgtacccgatcctgtaatgagagaaaaatacaggcccttcaaggaattgtatgaggaatatgtcgtggctttgcgcggattttataaaaagatacaggaaacgggcgcgcggacggcaggcaaatgaagaatttcagactgtgctgccttggaaaggaattaattaatgggaggaatttactttattggtctggacttcggaacgcaaggcgtgaggtgcggcgtcgcggatgaagaaggcatgattgttgccatatcggaacaaaaatataatacaaaccatcctacccccggttttgcagagcagtcgcccgcagactggaaaacttgtatggaagctgcgattggggcatgctatgaaagtgctccggccggaaccttcggcaggatcaaagggataacggtatgtgcgactgcatccacggtaatccctgtgcgcgaagacggcaaggcactcagcaaggctattttatggatggatgtgcgtgcggcaaagcaagcggaaagaatcaatgaaacgcagcatgaaatattgaaatattgcggcaaggaagtatctgtggaatggatggttcccaaaatgatgtggcttagggaaaatcgtccggaattatttgcaaaagcagaccgcatcgtagaattgcaggattacatcaatcattttttgacaggaaactggtgtgcttcaatcagtcaatccacaggaaaatgtaattatgtggaaagtatgggcggttatagcagcgacttttttcacaagataggctttgatgcgtttttcgataaagcaaatcttgacgttataaagcaagcacaaccggtgggaaaactaaaaaaaagtttggcgtacgaatatcatttgccggaagatgttactgtttaccagggcgggatcgacgcgcatgtcaacgtagtgggattaggcgtatgcaggccgggcgaaacgggcgtggtgatgggcagcagttttgttcatcttgcagtagtgaagcatatgatgtttgaggacgggatatgggggccttacaaggatatcattatacccggacaatattgccttgagggtggacagatatccgcagggtccatcaccaaatggtttatccgcgagtttgatgtgcaaggggataatccatatatggtaatggcggaagaagcggataaaatacctattggaagcgacggcgtgattacgctggattatttccaagggaatcgaactccacataaagattcgctcgcaaagggtgtattttatggcttgacacttgggcatacgcgcgcacatctttatcgtgcgatcatggagagcgttgcttttggaacgcgcaacatactggaaacaatggaaaatgaagaaaattctatccgtgaaatacgtggctgtggcggggtggcctttaatccgatctggatgcagattattgccgacgcaacggggaaacccatcatcctgaccagggaatcgggcaatgcgggcgtcctggggggatgtatcatagcagcggtaggcgcagggcgatacctaacgtttgaagaggcgtgcgagaagatggtgcatgtaaccaaagtaataaagcccaatctggaaaactacggaaagtacacggaagcatatgaaaaatatctggaattataccaaagcttaaagcatatgatgaaaacgtgacggagtacgaaaccaagagggccaatacctgataaacctgaaagggttttatgagcggatacagaaggtaaatcagcccggagtgtgtgggtaaaaagcaaggagtagcaagagatgcaatatcccaaaatctatttggtactggataattgttatgcaatcaagcggtggatcaagccgaaggattggatggaactttcaaaggaaatcggtttcacatatatacaggcaagtacggataatgagatagacccgttatttgccacacaggactatatggacgactggttttgcgaggtgaaacgagcgcagcgggaaacgggtatgaaggtagccaacttctataccggctaccagacgtaccgcacggcaggattggcgcattacgacgcgcgggtacgggaacaccttgtggaagattgggtaaagaacctcgtggcgcgcatccatgatctgggggctgcagggctgggattttccctgtttgcagtgccgcataaggatttgcaggacaaagagaaataccgtaatgtaacggaaatgatttatgaccagatggcggagatcgcggaatatgcttaccggaacggtagggtgcaggtaagctttgaacagatgtatgcgccgcaccagccgcctttcacgatcgaaggaacaaaaacctatttgaaaagtatttatgagaaacgtaattgtccggcctatgtgaccatcgacgtggggcatatgacgggacagaaatgttttttgcggccggacgaagctgcggtactgcgctccttcggacaggaaaaatgcaacatatggctggggagcgaccatgcatatgaaatatggaaccgtgcaaaacgaaacggtaacagggcggaagccgtaagggcgattctggcggatatggacgagcatagctatttgttttcggagcaacaggacggggacatatatgaatggttaaaagaactggccgtttattcgccgatcatccatatgcagcagacggacggagaccacgcaagccatgcggcttttacacaggaaacgaataagacgggaatcgtaacgggcgaaaagctgctcatggcaatcagggattcatatgaaaagtatgccatgcaagccctccagccgccggtggagaatgtttacctgagttttgagatttttgcggcaaatacggaaaagcgttacgagatcgtcgataagttgaaacagacacttgcttattggcggcaatttgtaccggaagacggtatcagcctggaccggattatatgaacaggagaaatatagtatgagaaaaccaatcattgcagggaactggaaaatgaatcaaacaccgtcggaaacggtacaactgatccgtgagttaaagccgcttgttaaggatgcgcaggcagaggtcgtggtgtgccccatggcggtgagcctgtttgccgccagggaagcgctggatggctcggatatccgtctgggcgcgcagaacgtatactttgaggatgcgggggcatatacgggagaatggaactgcgacagcctgcttgagttgggcgtggaatacgtgattatcgggcattcggaacgcagacagtattttaatgaaacggatgaaacggtcaataaaaaggtgttgaagacgctgcaaaagggtttgaagccgatcgtttgcgtgggagagcgtttggagcaaaaacaaaggggcattacggcggaagttgtgcggatgcaggtcaagcttgccttggcaggggtactggcaaacgatatcggtaagacagtgatcgcatatgaaccggtttgggcgatcggaacgggaatgacggcaacgagcagtgaagcgaacatgaccatccgcgagatccgaaaggcggtacgggaattatatggagaagcggcggaacaggtgcgtatccaatacggcgggagcatgaatgccggaaatgcgggagagctgatggcgatgagcgacatagacggcggactgatcggaggggcgagcctgcatgcaaacgattttgccaaggttgtaaactactgaataatcataaaaaagacccttgatcaagggccttttttattgcaaactacctgaaaattcgcaggttattttaccagcttagaaatcgtcttaaaggtgtcgctgccggcgcgcgtggtcatctcgaagaggatagcttccgccgtagtcaggagagcgccctcttgcttggcacgttcaagagcgatctctttatcatacggaaaacgggagccgatgcagtcgcacacaactatcggctggaacccttccgcgacaagatcgatgacgctttgcaggacacacacatgtgcttctattccgcatacaatcacattcttttttccaagggaacgtaaatgatccataatctccgtttctccgcaggcggaaaaactaagcttgtcaaacggcgtataatcgcccacggcttccttgacctcagctacgatatcgccaaggcctttgggatattgacggggcaggataaacggaagccctaaggcgcgcgcgccttttaagagcattactgttttttcgacgatggaaacatcatcatggataacgggtacaaggcgttcctgataatcgattaccagaaccgccgaattttctgctttgatacgcatgtcattgatcctccgttttattttttcttcattatagcacagaatagtatatgaaaggcacaaaaacgtaatccattttttgggacatcataaacaaataaacaattttaggaaaacctgtcaaaaaatttgcaaaaaagtgttgtttttaaaaaagtatgagcgaataagctaacaaaatggcttatgcacacgttgtggaaatcacggtttgcgtctaaaattaaattaatgaaaatattccatagagaataagcatctacgttattttttattaccaatgttatccatcgtacgattttcatactgataaagttcttctgctttggaagggctgggttcgttattacctaaggcggtgtttcatgactgaatttgaagaaattgcgctgaaaaagatagtcaaagattatctgatagaaaatatttattacaggatcaatttgctgattggaaaatatggcatcagcaatgccgagatcagcaaacggatcggctgggatcccgcgggatacaaccagaaatataaccggagcaacgatcttcgcatgacgacgttcatcaagatatatgttgcgatccaggagattattgcggaaaaagaagaggaatacggctacgaagatctcgaactgagcaagatcgacctgaatgacctgatcacgcaggacgagttcgatcttggtcgcctgttcaaccacattagcgcggccgcagaaggaaagacgggatttttaagcagcgtatcgctgacacgcacctatttgtctctgaagtctttcgtgctgttgggacgaaaaaacaaaaagttcagcgagcgggaaatcgacgtgtatatatcgttctacaaaacggtatcagaacaataaaacgacagacataagatagatagcggaggccgatatgcaaaaatttgcgaatgatccaagtaatatggtgaatgaatcgattcggggatttgtcaaatgttatcctgatatcgtgacatatacggaaagtaagcgagtactcaaaagtacgtctgcccccgtgaaaggacgggtcggaatcgccaccggcggcggatatggacacgatccggcatttatcggctacattggacaaaacatgctggataccgtggcggcaggagatatttttttcaccccgacagtagaagactattacctggctttcaaacatgcggatgcaggcaaaggcgttgcctgcctctatggaaattatccacgggatacggtgaatgtggaacaggcgatcaagctggcggcgcgcgacggcattacggtaaaaacggttattgcaaacgacgatatcgcgactgtggatattgaaaaaaggagaggcagcgcgggcgagattctgatgtggaaggtcggcggcgctgcggcatcgttcggatatgatctggatggcgtcattgccgcggcacaaaaagcggtggattccacaagaagtatcagcgtggggcttgcgtcctgcatcattcccatggtgggaaggccgaactatttgatagaagtcggcacgatggagattggggtaggccatcacgggacatccagccgcgacacctgcaaactgcgcacggcggacgaaacggtggacattatgatggattccatcttaagcgatatgcctcttggggaaggcgaggaggtagcggtgctggtttcaggcctgggtaataccatgctgatggaactgcatattctgttcagccgtatctacgacgtgctggcggaaaaaaagatcaagatacaccgctcttacgtaggcaattatttcacggcgctggatatgatgggggcatccatttccgttatgaagctggatgacgagctcaagaaaatgatggaggtacctgtttatacagcggcatttaaccatttccacaacaaaaaataaacgaggtaaagaaaatgaaattggcaattggttgcgacgaagcgggcttttatttaaaggaagaggtcaaaaaacatttgcaggcaaacggtcacgaagtagaggacgtaggcgtctacaatacggatcctgcgatgtatcccgatgttgccgcggcagtagtaaggaagatcacggaaaaagaggcggagcgcgggatactcatttgcggaacgggcatcggtatggccatgacggcgaataagtttcacggaatccgcgcagcagtatgccatgacagtttttccacagaacgttctatcaagagcaacaacgcgcaggtcatgtgcatgggcgcgcgggttattggcagcgagcttgcaaagcagcttgtcagtatgtgggtcggctatgaatatgtggacggaccgtctacgccgaagatcgacagggtgatgtattacgacgcgaaacgcgactgaagcggaaagaggataaagtaaaatgggcaattatttggtaggatgcgacattgggtcgagccagaccaaggctgtggtgatcgacgaggaaggcaacgttcttggtaaaaaatatattgggtatccgacgcttaccaacagcaaaggttgggcggagcacgatccggagcagtattggagcacaacggcggactgtatcgccgaatcgataaaggaagcgaagatcgacgctaaggatatcaagggagtggcgatcagcgcgcactcgcctgcgtcgatattggtcgatgagaattttaatgccctcaatctgagccatttttggatggaccgccgcggaacggcggaggcggagtatatcaacgaaaagatcggcgcggaccgtgtatttgaagtgagcggcaacgtatccgatccgtattacgcaaccgttaaactattatgggaaaaaaataaccgtccggagctttataagcgggcgaaaaaattccagacggcggcagattacccgcgtatgaagctgacaggcaaaatggtgacagactattccaatgccagcctgatcggtgtgggcttcgatatcgtaggccgcaagtggaacacggatatcctggagacgatcggacttgatccggataaatttccggacctcgccccctgcgagcaggtagtaggcgaagtaacggcagaagcggcagaacgcactggccttaaaaaaggcaccccggtgatcgcgggcacggtggactgcaacgcggcatgggtcgcgggaggcgttcttgatgacggcgatatgtcgctcgttatgggcagcgcaggcgtgatgggcgtcgtacatgaagaacccacgtttacgaggaacctggtcacgatcatccacgcggcaaattctgaaaaaatgtatacgacggttgtggcgacatgcggctgcgggtcttccttgcagtatttcaaggaaaaattcggcgatttggacggcatcgttgcagatcagatcgggatgaacaaatacacttatctctgcgacaaggcgggcgaggttccggtaggcagcgacgggctcattacgcttccttattatatgggcgagcgtacgccgatctggaatccgatctcgcgcggggtagtgttcggccttggttattcgcacaccaaataccatatgctccgttctttcatggaaggttcggcgctggcgatcaagcataattttgaactgatgaaggaaacgggcgtcaaaatgaatatgccgctcatcatgggcgaaggcggcgcgcagagcaggatatggcggcagatcatttccgattgcctgggtattccggggatatacatgagcaattccatgggcgctccggtaggggatgcgatcctggcgggcgttggctcaggcgtatttaaggattgtaatgttgtaaaggattgggtcaagctgtcggataagaccgagccggatgccaagaaccatgaaatatatggggacatctataagatttaccgcgagctttatgaagaagtcaaggacagctataaggcgcttgtgcctctggtcaaaaagatcgacgcccgcaaacaagacaaagataattaattaagtttttaatatttactgtaaggtaaaaaaaagaaaatggaggaaaagaaatgaaaaaagtagttagtctcatcgtagtagtgttgatggcagtagcagtatttgcaggctgtacagcagctccggctacatctgaagctccggctgcgtctgaatctgcggctgcatctgaatccgcggcggctggcgctgcaacagacaaggaaaacaaggatatcacgatcgtcatggtggcaaagcacgaaggcatcacatggtttgacgatatgaggatcggcgttgaccagtttgcggcggacacaggcgtaaactgctaccagatcgctcctgaaggcggcgacccggcaaagcaggtgcagatggttgaagacctgatcgcacagggtgttgacgcgatctgtgttgttccgaacgacgcgcagtccatgatcccggctcttgacaaagcaagagaagctggcatcgtcgttatttctcacgaaggcccggacatcttagagcatgttgactatgacatagaatcgatcgacaatgcagagcacggcaggatctttggcgaaaaattggcagagaatatgggcggagaaggcaaatttgcttccttcgtaggcatgctgacaatggttccgcatatggaatggtggcagggtgcagttgattatctggctgaaaactatccggacatcgaatgcatcacaccggaaccgtatgaagacaagaacgacaaccaggtcgcttacgacaaggctcttgaagttctgaaagcgactccggacatcaaaggcttcacggacagtgctgcttccggcgctggtatcgcacaggcgctgcaggaaagaggtagacaggatatcgcactcgtcagcacggcagttccgtcgcaggcaggcgcttacattgaagacggttctatggacgttggtatgtgctggagaccggcagacgcaggctatgttacctgcgaaatcgctcttaaagtgctgaagggcgaagagatcacagacggtatggcttttgataagccgggttacgaaaaggttgctctgactggaaacgctctggttgcaaatgcacctatcgtgttcacgaaagacaatcttcatgatgaggcagtttatttctaagccgaaagcaaaattggcataaggccaatgaaaggttgttctgctgccccgcttgggggcagcaggacaattttgttaaggaggagggcttaaagtggataataaagttttggtagcggagcatatcagcaaaagctacgtgggcgtacaggcgctcgacgacgtaagtgttaccataaaacaaggtgaagtgaagtgtctcgccggagaaaacggaagcggaaaatctactttcgtaaagatcattgcagggatcgagccggcagacagtggagatatttatatcaatggggaaaaacaggttaagccgaatgcaatcagtgcaatcaacgccggcgtacaggtcatttatcaggatttatcgctgttttcgaatatgacggtggcggagaatatcgcgcttaataagatgatcaaggaaaaaaagagtttgatcgaccagacagaaatcaagaaaattgcggtggaatccttaaaaaagatcggcgttacaatggaccttgacgcaaaggtgcagacggtatccattgcaaacaggcagatcattgcgatttgccgagcgcttgcccttgacgcgaagatcctttttatggacgagccgacaacggcgctcacaaaatctgaaattgaaaaattactggaaattgtaaatacattacgggcaaaaggacttgcgatcgtatttatcagtcataaacttgacgaggtaatgtcggtcgccgattctatcacggtgttccgtgacggcaaacaggtcgcggacatcgaaaagaatgaaatcgaccgtatgaagctcatttattatatgacgggacgcgagatcgagtattcgcgttattcgcgcaacaataaggagacggacaatttactggagcttcgggacctttccaaatccaaacaatattcggacatcaacctttccgtacgtccgggcgacatcatgggccttacgggtctgcttggttcaggcaggacagagcttgcgctttccatattcggactcaatccgtgcgacaagggaaaaatttacttcaatgggaaggaagtaaagatcaaaagtccggtagatgcagtcaagatgggaattgctttattgccggaggaccgcagcacgcaggggcttttattggataaggacctcacagacaacgtttcctccgcagtatttggcaaagtgaccaacaagatagggatactgcatgaagggcgcaggcttgagctggcagataaatccatcaagcgtttcaaagtcaagatcccaaatgcgcagacaaagatcaaaacattgtccggcggaaaccagcagaaggtcgtacttgggaaatgggtcgcaacagagccgaagctgtttatcttagacagcccgacagtaggcgttgatatcggttcgaaatccgagatttatgagcagatacagcagcttgcgcacgagggtctcgcgatcatcttgatctcagacgaaattgaggagatcgtggcgaactgcaaccgcgtatccgtcatgtttgagggggctatcgtcaaggaattcgacgatgaggaaatgaaggacgaccagatcgaaacaaagatcatggacgtcatcaacagtcttcatctgcaaaacaagagtggggagagtgaagcggtatgatggcgaaagcaaaagcagtcaaagagaaaaaaggattatcaaccgaactgtttctggtcatgatcatcgtagtatattgtatcatcgtttcgatcgtgaaccccgaatttttgaatgcggcaacactgtttgacatggtaaaatcggcggcgccgacgatggtcgtagcaatgggtctgctgcttgtggtgatctcaggcggtatcgacgtatcgtttacggcgatcgcgatcttcggcggatatgtggcgacaacgacgctgatggcgacaggggtcaacaatatttttgtggcattcatgatcgcgtgtgcgatcggcttaggccttggcctggtgaacgcggtactcatccacgtgacaaaaatggaaccttttatcatcacgttggcaacatccggcctttatcagggatttttgctgacatttattggtacaaagaacatcggttctgtcgatatccccaaagcgattacagagttcggcaatgcaaagctgtttgctttcaaggacgaatttggcagcgaggtcgggctttcggtatttattatcattattgtggcggtcatcgtgctgacgtggttcatcctgcacaggacaatgcttggtaagagcatctttgcccttgggtgttcgcaggaagctgcgcgcagggcgggcttcgatatctggaaaacgcacctttttgtatacggctatatgggtatcttaagtggtatcatgggcatgctctacatcgcaggtatcaacgcgtgtaacccggttacgctggttgggacggagcttacgatcgttgccgcagtcattatcggcggcgccaaagtttccggcggccagggcaccatactgggtacgatccttggcgtggtgattatgtatttgctgaacacgactcttatcttcttaggtctttcttcctcgtggaacgatctgttcctggggctcatcctgatcttcagtatcgttatgacatcctggcaggaaagaaagaaaaacaggaagatgtttatcttcacagaataaggagagggaggaaatattatgcagaaattaaagaccttattacgaaaagatttgaatttcagcatcctgatttttgttacgataggcatccttattgcgatggctgtggtgctgggagacaaaatgtataatgagaggactctctcgagcatggcgttccaggtttcggaatttgcggtgctttcactcggcatggggcttgcgatgctcttagggggcatcgacctgtccatcgtcgcaaatgccaacctcgcggggatctgcgcggcattcgtcatgaccaaccaggggatcgcagcgtctatgggcgtgggcgggtccatcgtcctggctgtcatcgtggcgctcgttgtggcaacggcatgcggcgctttgaacggcgcgctgattgcaaagttttcagtcaatccgatcgttgcaacgcttggaacgatgatcctttacaacggcatcagtatggcttctacgggcggcaagggcgttaccggatttccgcaggaattcactgtattcggtacggcggagctcggcggggtgccttgggtatttatcttgtttttgatcacggcgatcgtcctgatgtttgttatgggacgtacgggctttggtaaaaaagtatatatgatcggtgaaaaccatacggcggcgcgtttttctgcaatcaacaacgaaaaagacgtgatcattatttatgcgatggcgggtcttatggccggtattgcaggcctgatgatcattgcgcgcgtcaattccgcaaaggtcggctacggggacacatatcttttgcaggcgatcctggtttgcgtactgggcgggatcagcccgtcgggcggcaaaggaaaaatactcgggatcatccttgcgctgatcgcggtacaggtgctgcaaagtgcgtttacactctggcagttcacgccgtatgcaaagaagatgatctggggtctcatgctgatcggtatcctgttcctcaataagctggtcgactccatggacgtcaaacggcagaaaaagttattgcaccagcagcttgaaaaacaggcggcagcggtaagcgagtgaggtaatactatggattttcacgcattgggatcaagtatccttaaggaataccaggatgtgtttgacaggatcgacgacaagatgatcgacgcgttcatccatgagattgatacgcataaccggttgttttttatcggcgtggggcgcgaaggcatgatgacgcgcgcctttgcgatgcgcatgacgcatatgggaaaagaggtccattggatctgggacgacacgacgccgggcatcggcaagggcgatcttctgatcgccacgatcggcagcggcgagatcgggcacatccgctacgtatgcgagcgggccaaggaacatggcgcaaggatcattatcattacaggctcgccaagcgggagcgctgtagccctggctgattttgtgctctttataccggggcaggtatacggtgggacggacgacgtagcgccgtctgtccagccgatgggaaatttgtttgaacaaagccttctcattgtcctcgatatgatctgtatcaaaatagtggacgagaatcctgatatcacctatgagaaaatggaaaaacggcacagaaatgtagaatgaggtagcatatgcaaagaattttgaaagacgcggacagaatggttgaggatatgcttgaaggctatctgaaagcgcataaaggagcgatagaagcaacagacgatccgcgtgtgttaaagtcttcatggaaatatgacggcgcaaaggtcggcgtagtcacaggcggcggcagcggccatgagcctgcgtttttagggtatgtaggcaaaaatatgctggatgccgtcgcggtaggggagattttttcttcgcctacggcaaaggcatttctgggcgcgatcaaagcggccgatcggggcaagggcgttgcctgcttgtatgggaattatgccggcgacaacatgaacgttaagatggctgtcaggatggcgcaaaaagaaggcattacggtaaagacggtcgttgccaacgacgacgtggcttccgccccaaaagaggaacaacaaaaaaggcggggcgttgccggcgagatcatgatgtggaaatgcggcggtgcgatggcggcaaagggcgcggatttggacgaggtcatccgtgtagcgcaaaaggctgtcgacaatacgaaaagtatagggattggcctgacgtcctgcacgatccctgcggtgggacatccgaattttacgatcgcggaaggtatgatggaattgggaatcgggcatcacggtgaggcaggcgtagacatagcgcctgtggaaacggcggataaaattgcggcgcggatgtgggatatcatacggaaagaagatttcttccatgcgggcgacgaggcaattatactggtttcgggactgggagcgactccggtcatggaacagtatatcctgtttaacgaagcggcaggcctgatcgaaaaagacgggatcaaggtccatcacagctatgtcgggaacctgttcacatcgctggagatgatgggagcgacgcttacggtcatgaagcttgacgaagagcttaaggaactgatggctatggaagccgtatgcagcggccttgtgcggctgtaggagttaaaaggagacgaaatggaacagtttaaaaacagcgacggaaaagtaatcgtcgaacagatgatcaaagtgatccaggagaacaaggattacctggggacggtggacggcgcgatcggcgacggcgatcacgggatcaatatgaacaaagggttcaccatctgtgccgaacggatcgcggggcaggattgttcatttgcagaagcgcttattattttaggcgatgtgcttttgagcgagatcggcgggtcgatgggccccatttatgggacgctttttattgaaatgggagaaacggcggccgaaaaggaaacgatagacagcgcgttgtttttagagatgcttaaaaatgcggaagcagccttaagcgatctcgtcgacgcgcgcgttggcgataagacgctgatggacgtcgtgctccccgcaaacgcggcctttgaaaatgccgtccgcgatggaaaatctttcgatgctgcgctcgatgattttattgcggcggcaaacgcaggacgggagggcacgaaggacatggtggcaaagtttggccgcgccagccgtttgggcgaacgttcgcgcggcgtccttgacgccggttcggtatcttgtgcattgctcttggaaagcatgggtaatacaatcaaggcaatgtagatggtaaaaataagctttccttctatataaatagatcactccatcaaaatccactgccaggagagaaatagccggatggtgtacggccccaagggccgtacaccatccctctcctcctatgtggaatggaatgagtcgtaatccgtaatccgctttcaggcggattttttgatgaaaaaagcaagccaataaaaaacggaacaaagcgcgctttgttccgttgtggagctgatgacgggactcgaacccgtgacctcgtccttaccaaggacgtgcgctgcctcctgtgccacatcagcataactacttgaatattatatgctatagcaggggctttttcaatgcttttttatagatgaacaggaattgtacgacagaaaagtatggtgttttcaggcgttttcaaaaatattttatgtaggatgccaagaaagatataggaactattaaaatttttaaaaattttcaattttccccttgcataaatataatttatgatgtagaatacatataacaagatcaataaaaagtaaaaaatgatcatgaatatgatcataataaactgtttatggatgatataaatggtttattataagaataagaaagagaacagaatcggcggacagtggttcggagagagttctcaatcaatgcagaaagggtgtgataccgatgtacagtgaagaacctgtaatgttgggcacacgtacactgacccgtagataagaggctttgaggtttcttaaggggatcgcagaataatatttttgaaaagtctatgacggtttgaaaatatctgtgacggcagccgtaaagaaggttgcagcagggcataggcccggtgaggacaccaacacaagcaagcgagaagcaaccgctaatgttgcatgggaaaagtttgcagaggtgtacggtgccgaaaaaaacatactttgtgggaaagcctgcatggagtaatactggaaaagttcgcttatgtgctaataaaatttttgaggaaatgaatgcggtgcataaatgaatgggcggcgagaaccgaccgggggacgcatgacccgaaggtatcgaaagagcggcggctgacgaaaaagacaaggtatagttgaaaagtaatgaaacgataaataagaataaaagtaattgagcggagtcttaaaaaaggctccgctttttattaataatattcggccgttgttttcagcaacacgaagacgataaacagaacagcgacaaagagaatattgtaagttgaccgttccgccgtacttttacggacgagcgggaaaatattctggccgataaaaggcaagagggcaaatatcgggacaagataccgtccctgcataccccagatttccagtaatccaacaggcgttgaagcaaggtacatcatcaaataggaaataatggtgatggcaagcataacaagaaggatccctattttatttccaactgatacgcgcgtatttccaaggataagttgttcctcattctcatagcgtgtgtaacagaaagccacaacagcaataaaagcaaaatatgaaattgtgatcaagctcggcatggaataactgagccaaccgaaggtaaataactgtgaaagcgtaccgccgaacatttcaaccagttgggtcaccagcatcgaaaggacagcgcccttattcgcaagcataaatttgagttgatcatacatatttgcgccaacctcattaatgcctccttccgcaagcgcgtcgtttgacccggcaagcgctactgaagtggcataaaacatagcgaggatagctatagcaacaatcgcaaaggtaagcagacatcccaaatatttggttttggcggaggcgtatcgttccctgggtataaaaagcagcaggaaaaggaagggagcgtaattatacttcttcattgaaatcaatacacatatcacagtaaagattaaaatttctttgtaagtgattttcttggtgcggtcaaaatacatattgatgaaataggcgatcaatacaagggacaagccataaagcgttgcatccggattatacgatccggcgatataaagagccattggcatcattgcaataacagacaggaacaacttgaattttttggccatttttacggcaagccacgcaagtactgcatataggataaggttcaagatacgtcccaaataaaaagcgggcagaatatcaaaatgaaaaagcttggcgatcgcaaggccaaggccttgtggtaagtaaccggtaaagagcatcgtcgaaccaagttccgaatactcggtttcacgacttatgggctgattatgcagcgtggtatctgcaagcgtatgccgtatatcgccataaatatcgttgaaactcgtcgtaatggcgttaccttgcggcgtagatacaaaaaaatctccgtttgacatcatcaaagatttggaaaaatgagattgttcatccggactatccagaatgggcgttgtaacagagaaaagtacgccaaagatgagaagtacaagaagcacattgcgcgccagattctgattccaaaacaggatgcatacgattgccgcaagcatgatcaatatgcttatcagccagatgttattactgatctggcggctgccgaacaccatgctgagctgctgaccggttggctggccatttaaggtgagctgcgtatgatcagacggttcggttacaggagaaagggcattgtccgagttgacggcatccgtagataaccggaaaaccaatgcttgtccgcgtgcgtcgtagtctgcggggaaacccagaaaaatcgtatcttttgcggcttcaccactaaattcgaccctatttagcaaggttccatcgcctgagagtaattcagccgtatacttggatgagacgatgcggttcccgtaatccatctgaaatcctatcatacttgggagtacgtcagaatcaatcgtgaaactctgttctaaaacatcattttgaagcaaaggctcgctctctgccaccttctcatgaggcgagagattcccatatgccgtatacggtgcatttaaataagcgaaagatatacacaaaactgcgacgaaaacaatcataaaaattcgttgtttcatatgatcgcagggcactatatttcgacattttgaaagaaaagacgggctctgcttatccatgtaattccacctttgagggagagtcaactaaaatcttactaaattatatcgttttgatgatatactgtcaatttgcagttgctttttggactttataatgaaaattgtgtatactgatattgtctaagtttaaagaaaaaggttgggttgtatgttgggatctgtcttgtatcttttttcatgggttgcgctttttggcggggcattattgtatcggaaaagcgacgtgaagcaacagattttttgctggctgcctatgctttttttagcggtgctggcatttgatgctttgcttgcgggggtaatatccgcagtacatattccggtaaatgttttatccattggtattttgaatatcctggcgtccctgtatttttggtatgatatcataaaaggcaagcaatgccaaaaatatacgttccatgttctggatatcgtctttgccgttgtcttatttttgattgtctttgcatgtgcttatcaacaattcggaccaaatttccggatcagttatttaacgattgatccggctgtgcatttaaaaaatgctatggatattgtcaatgcacaagcggtaagcggaatgtattttgcccagtttgggaatgcgatgtttattgaagcatttcagccgcttctggcttcaaattttgatgtttacaaactgtttatgattgcagatataggcatgctgtatatttctggtttaatgctttatggtttgatacgaaaatttttcggtacgaaatttttacaaattacagggatgatcctgacattcatttacatattaggatatccgctcaataatatgctgtatggctttacttatcttggaattggagtaaccataaccggattgattatatatggtacggaatgtttcttgaatagcgatatcaagaggcatgtttccaccgttatactttcattagggctgctcgccctgatgctttgctatatactctttgtccccgttgttatgcttggcgtgttcatttgcctaacagtttatctggtgcgaaataaagatttgtttaaaaaacatacattgatcgaatatgctgtgatttttttaatacccattatcttggggcttttatatagttattcagggattttcggtcaaagtcagggtggaggaacgacggtaggaagtgcaatcgcattggaaggtgcgatttaccgcagcctgattgctaattttattatctttatgccttttgcgatttatgccgtatggacccttatcaaaaagaaagaaatttcaccggctgtaataacattcctgttgctgatcgttttcatggcaggactgctgatcctgggattgaaagggaaagtctcgtcctattatttttataaaaactattatttgctttctttactttacttctgccttgcattctatggaattacgtacctggcacaaaaggcatttcggtttctgtgttcctactttttggtatggattttattggcgggggtggcttttaccaatttagaagccaggatcaatgcagtaaacccactatttgctcaggaagtgagtttaaacccattgtttgatatctacctttataataattattttgtttctaacggctttgaaatggatgagggaatgtatgagctttatcggtacgtagcggaaaaccgtgacggggcatatattccgagcctgaatggcggagacagcaggtattggtttgaagcgctgacaaaccagcgtatgggggatcaggaaatacttatgtataacgaaaatccggaaacatggattgaggatatattacaagatgatgatatccgccacatcttggttttcagagagtatgaagcggtacagccatatcttgaccagttgagcgaatggccgaaattatacgaaacaacggcggggtttgttgtggccaagccatagcaaaatacggtataatatgctaaagtaatgaagtaatcatgggcttggaggaatgcatgaaagagctgttggtatttataccggcatataatgaacaagataacatagaaaaagtcgtgcaggatctcagtgaaaactgtcctgggttggattttattgtgattgacgacggttctacagacgatactgcgcggatttgtgatgagaaaaacatcccatatttgtccttgccagtcaatttgggcttggacggcgtgttccagacaggcaataagtatgcttatctgaacggttaccaaatggctatgccttttgatggggatggccagcacaatgcagaatatatcgtaccgctggtcgataaaatgaaagaagggtatgatattgttgtcgggtcacgctttattgacaaaaaaaaacaccatagtctgcggatggctgggtcacggctattaagcggtatgttccggctgacgacaggacagagatttaccgatccgacatcgggaatgcgccttgtgaaccgcagtattatgaaacagatcgcgtttgatcccaactgcggcgcggagccggatacttgggcttattttgtacgcaagggagcaaggctcgcggaagtacaggtagaaatgaatgaacgggaagcaggaacgagctattttacattaggacgttctatcgtttatatgttccgtatgttgatttctatggtgtttatcaatttgtttcgcggaaaggaagaaaagtaatggcaatcgagttaaggattgtactgatcgttatatcggtgcttgtattgatttatgtattgcataaaatcagtaaatcaaaaatgagcataaccgattccatattttggattgtttttgcattgctattgttattgttgagcattttcccgcaaattgggtttttcttcgcagggattttggggatcgaaacgccgcttaattttgtgttgttgttttttattgcgcttatgatcctgaaactgttcctgatgtctatcaagatttcccggttggaagaaaaaaataagcagatggcacaaaagattgccatggatgaatttgaacaaaggggaaaagagaatgagtgaatgttcccatacgtttgctttgtgcgcctacaaggaaagcgcctatctggaagaatgtatcctttcgctcaaaaatcaaagcatacctgcaaaaattttgattgcgacgtctacgccaaatgattttattgaaaatatggcaaaaaagtatgatcttcctttatttgtaagcgggagggaaagcggaatcggacgtgattggaattttgctttatcttgtgcagatacggattttgtgacgatcgcccatcaggacgatatatatttgccggattatttaaaagagctgatggaatatgagaagaaggcgaaacgacctattttgttttttacagactatggtgagctcaggaatggcaaggaagtttatgacagccggttgttaaatgtaaagcgtaagatcaatgcttttataaagccccgaatattttggggaagcaagtttatgcgcaaccgtacgctctctgtaggcagtgcaatttgctgtccttcggtatgcattcataaaaaagcatttccggattttcagtttagtgaaacgatgacttgtgaccttgattgggatgcgtggagcaggctcgcgcgggaaaagggatcgtttgtatatatcccgcagcctttaatgctgcaccgcatccacgaaggctcggaaacgacaaaccaactggagggtggaaaacggtttcatgaggattatgagatgttccgcaggtactggcctgcgcctattgcgaagttgctgatgcgtaagtatacggccagcgcggacagcaaccaagtaaaggaataaaaaagaagcgccgatggcgcttcttttggtttgctgtaaattattgcttgcgtgcaagcttgccggagcaggcttccgcgaagagcgcgataccgccaataaccagatagaagctgaaaatccactcaaggactgcaaaaccagcgaacggcgcggcgataatcatgatgccaagtatcaggttgatgataccgcttgcaaggatccaaccggaaccgggctcgccagatcttttgaatgtaccgtaggaagcgagttgtgtgatacccccaaacagtgcaaaaaacccgataaggaacgagaacaagctgagcatatcgagcgcgccggcaaggctgccaagcgcctgcagcaggacgagtacgccgagaagcgtaaagataatgccgttagcaagcgtccagccgttccgcagctcggagggtgttttaaaatacataacaacctcaaagacgccgtagacaataaagcctgctgtgacgatataccccagtgtgaacgcagaagcgacaggctttacccaaatcaagataccgagaacgaccatgcagatcgcgataatgatacctgccgttttgttgccgccggtcatttttttcgccatgttgttgatatcgagcctggattttggtttttcattttgttcgttttgagaatttgtgttttcttcactcattggatgattcctcccataaaatgtggattgaaaaatagatatgccttataattcattaacattatataataccgaaaaagaattgtctatgaataaaggcacgaaataaatatcttcatgggctaaaaaagggaaaaaagagctctgccacactgtagacagggctctcttgatttattccagtattgtcccatccgtatcgacggtgacgatattccagggaatcatttttccggagcggtgcatggcgtctgtgaccgccttcacgatcccgccgcagcaggggacggacatacgaacgacggtgatactcttgatgtcgttatttgcaaagatatccgtgagcttatccgcataatccacctcgtccagttttgggcatccgatgagggtaattttacccttgataaaatcctgatggaaatttccataagcaaaagcggtgcagtcagccgcaatcaaaagattcgcgttttggaaatatggcgcattgggtgcggcaagctttatctggatcggccactgcataagttcggaagaaattccgttaccagccatttttccagggacgggagcaggagattggtgtttgatctgccggacctgcatcccagggcacccgcctgtgaggggcatctttttcatcgcaatattgcgtgctgccgcttcttcatcgaaaggcgccgcctcacgttcttcaaatgagatcgcatccgtagggcaggccggcaggcagttccccagaccgtcgcaataatcgtcacgcaacagtttggccttgccgtctacaagcccgatcgcgccttcctggcatgcggatacgcattggccgcagccgttgcattttgcttcatctattttaataaccttgcgtttcataaattttcctcgtttcatgttttgatagttttattataaacatatagcctggcgatagatgttgcaattgcaacaaaaaaggcgaaattactttcgccttcgttttggtttcttcttaccaaggttctcccggacatttatccgtcgggccttcacggttcaagtaacctgttgttccatcagccttggaaaagctgacatagacctgcttggatttatcatccgcctgcttggatgcttctgcaatcgccttatttttgtcgagaacatcaatatattcttctgtaccaaatttcggatctcttacaataactttataagtcataatcaattcctccttttcgaaaataactcctctgacatatatatatccacacgccaggcggttaaaaccgcattttcatgaaaagcaaaaatattcttaatgaaaaccgaatctttatacaaacttaatgctggccaaacgaaccctaacaccgtcttaatttgcttccaactataatcataacgtataagaaaatccggcgaaccggaaaagggaggagaatcaacatgggggatggtcatcatagcgatcggccttgtagcggcagcgctgtttgtctatctgtttgtagttcttatgcggggtgacaaacaatgagcaaccagatcaaaagtattggtaccggtagaaaatttcacatacaaagtattgcatgcggataaaaacgaggacatgggatggaaaaaatacgctgtatgttgcgtgctttttagtgcctttggatttgcggttttgttccttccggctctggcggcaggtcccattgcggaatacttccagatgataggttagtggtgagaaggtcatggatacgaaaaaacaaaatttgcaaataagcagatgatcgcacgcgcactcaaagattcattcttgaaactgaatcccaaaatacaggtacagaatccggtcatgttcgtggtgcatattgcatccatcctgacgacggtgctttatgtactggcgcttgtggggatcagggataatacgccgggcttcatcctggggatcgcagtccttttgtggctgaccgtcctgtttgccaactttgccgaggccatcgccgaaggccgaggcaaagcgcaggcagcgaataatgagggaagccgcaaaaaggattgacaaaaattcacggttgtgatttaataaaaaatgtaaagagcaacgacgcttttaagcgtcgttgctctttttatatcgaagcatccagccaaccgtatacgcgcggtgcggaaaagctgtgctaaatatttattttcaggaggataaaattatgtctatgacaccaatgagcaatgcagactatctgaccagggtacaatttgcagaagagacagccaaacttcaaaaggccgtcaaaaaatcaggttatacatatgaaaaacttgcggaacaattggggacaaacaaggtatggcttacaagcgccatacaagggcagcagtgggttccggaggaatactgtaaaaagctggctgatgtattggggattccgcaagaagaaacaatgtttttaaacaatcatccctataaaggaaatacggatccgatcttgtaccgcctgcatgaagtcctggatacatatggtccggcgatcaaggaattgatccatgaaaaagggggaaacggcatcatgagcgctattgatttcgcggtcgatgtggacgtgatacctgacgaacacggcgaccgtgtcgtgatcacatggaacggcaaactgctgaaatacagtaaaatgggagaatatccctggtaacaaaaatttgttgggagagcaatgggagggggatatttccccttcccatagaaaggaaaatatgttcagcgaagatattatgacggcggcaaatgccgccaaagggaagtaccatttattaaaatcgaacccgggcggatattttctcgcatccatcttggccggcgtttttatcggctttggcgtgctccttgcgtttaccgtaggcggtctgctaaacgggaatcctatcggtaagatcctgatgggatgtgcgtttggaatcgccttgagcttagtcgtgatcgcgggcggggaattgtttacgggaaacaatctcgttatgacaataggtgccgcccaaaaaacggtcacgccggcagcctgcctgaagatatggggcgttagctatatcggcaacctcgttggatcgatcttgcttgccgttatttttgtaggatgcggccttgcaacaggagcggtcggcgagtttatgtcgggagcggcagcgacaaaaatggccttatcgccgcttgcgttgatctgccgcggggcgctttgtaacatgctggtgtgccttgccatctggtgcagcttccggtgcaagtctgaatcgggcaagctgattatggttttctggtgcttgcttgcattcattacgacgggctttgagcacagtatcgcaaatatgacactgcttacggtcagtctgcttgcccctgctgcggatgcggctgtttcgctgggaggagaggtatataatcttctgcttgtcacactggggaatatgataggagggattgtgttcgtagcgcttccatatctggggatcgcaaaagccaagcgggaaaaggctgcttgatgcaatcaaaaaaggcgagccatgctcgcctttttttgttataccggattactcagccgcttggtttgggttatcaacctgtccgggcatttcttcatttgcttgctcggcgggcgcctcagccacagcggtttgctcctgttcgggaacatccactgttgccaccggtgtatcgctgattttcttgcccagaaattcgggcaattccatgcccgccatctcgaagatttcattcatgggcgggatgcttttcatcaatccggacaggaaattcgccgtactggacttgccgtccttgccggctgcgccgccgtcccacaccgttaccttgtcgatcttgaggtcgcggactgcttccacctgtaccttcatgaggtcttccatcttgtccgcaagcatcagcatgagggcgttcttggcattgccgcccgccgcatccacgatgtctgcaaaaccggaagcctgttttttgaggatttcctgcataccgcgcgcttccgcttccatcttggcataaatcgcgtccgcctcaccggctgcctgcctgcgcaggcgctctgcttccgcttcggcctccagctcgatctggcgttttctgatctctgcttttacgatgacgtccgcttccagtgtggctttttcacgcgacgaacgcgccagctccgccagtttttctgcggcgtaggcctcttccaaagccttggcggcctgcaccttttccgccgccgtcgcaagccttgtcgcttccgcttccttttcgcgccgtgcggcgtcggactgtgcaatttcgatcttggccgtgttttcaccggtgatcgccttggagtttgctgttgcgacctctacgcgctggtcgcgctgtgcgtttgcctcgccgatggaaccgtcgcggaccttttctgcaacagattttttcgcatcgttgattgcttttgcggcggcttctttaccaagcgccgtgatgtagcccgattcatcgctgatatccgtcacgttgacgttgatcagccgcaggccgatctttttcagttcggattccacgttgcgcgaaactgcttctaagaatttgtcgcggtcggtgttgatttcttcgatgtccatcgttgcgatgacgagacgcagttggccgaagatgatatcctttgcgagttcctgtatctcggacatctgcaaaccgagcaggcgttccgccgcattttgcatgatgccctgctccgtggagataccgaccgtaaagatggatggcacgtcgatacggatattctgacgcgaaagcgcgctctttaagtcaacctgtatggaaagcggcgttaagtcaagatattggtaggcctggattacgggccagatgaaggccgcgccgccgtggatgcacttggaggtgcggtttgttccgtcggtgttctggccgactttaccgtagatgaccatgatcttgtcggacgggcatttcttgtaccgcgtcaggaagatcagcaggcacataaataccagtatgacgattactacaataagaatcaaactttcaatactcattttcttttccccccggccggattttcccggccattatttccttttgacgacaagcgtatttccgcttgtaattcccgtaacgacgacctgtgcgcctgttgggatagcttccttctcatctgttaccgcctccatctccgtgagcgtaccctgcaccatgacggtaacctttccgacggagctgcgctgtgcgcggatagataggtaaacggtaccggattttcccagtgcattacggatgtccatactgccgtcggattgaaggcggagcatcgcgcgcatagcgaccgcgatcagcaccatagcgacaaacccaaagacaatagcaaggatcacgctggcaacgggcagcatatccgacttaagcatcagaaggccggaccacccaaataccgcgaagaacgcaaccaagccttgcagggtaaagagatgcagcccgctgccttcaaaatgtgtgggggtatcgccctgatgcataaaatcgcccggcggcgcgtccgcatctgtcgatatatcgatatccgttgcgccgtccgtcgtgatttcgccgatatgtacgtccgcatgcgccagcccgtcatgcattccgtccatgccatgaccggacgcatccatatcgccgggcgcgtccgtccctgcgtcagggccgtggcctgcgccaatgagcagcagaatcacttcaatcaccagcaaaacggtggaagcgatcccgaccacggcaaagatttgttcaaccaatgtcatggcttcccaccaagcaatcatatcaagttcctcctgtatcagatatcgagtgtgtttaactcaagtgcagcttctcctttgatctgcgcagaaatatgtgcgagaagcatgattttcaatacttttttcagctttggctgtaccgcttttcccacggaacgtttaataagtaccgaggtaatcatcgcatcaagctttgtggcagcccgaatcgtatccgtaggcacaagcgcaagcaaatctacgaagcaggtataaatcagggtaggcgcgccggagacagtggtcgcgacataatcggtcatccgcgtgatctggtcgatctggaaaatatcgttgagcatattgatgatcacaatccggcagaactggtcgcaattgtactttttaccgacaggcgggcttacaaatttacgtttgacccaattttgcactgtatgcgcggaaagcccggtaagctgcaaaacctgagaaagcaccaggccgttcgcggcgaacagcgaatgcaaaaactcctgcacatcattttccatattcatttcaaccgtggtacccggcaagtatccaatcataactgctgcagccttcccctgtttaaaaaacgaatcacatttaggtccgttcctttcttaccatcataacctgttactttggcctctttgtccttattatacaatatggtcatgtgactgtcaaataaaatcgtatgacttttaaaaatacataaatacataaccagtatatgggtgacgtcaggtttgcttaggggatttatattcatgcggttttggtcggatatgatcgtagctgtggctgatcatttcaaaaatcagaagttaagtccggcctgtttgcgcatctcctgcagcgtttcgtttactgcaatagaaagattttgcgcatatgcgtactcttcgtgtgtattttccggatcggtgatatagcgatggaaatccttcatttcgttgcccagcaaaacgggctttgcaatgtcgccgcagattttctcatgcgttccatcaggacgatggagcataatgcccgttaaatggtgaagcatatggatgctgagcgtgccgtggtcaccgataatctcggagccgcaatatccctgcccgattttggacgcggtcaggacgacctgcttgtcaggataaaaaaatgtactgctgaaatacccgtccacgccggagcggagaagatgggcattcgttttgatgcggtccggcctgccgaaaaagtcgagggcgggatagacacaataaacgcccaaatccatgatgcagcctgcagcaagcgcgggattgaaaatattgggaagctcccctttgcaataggcctcatatcgtgaggaaagctgtgaaaaatcaaaatgtacggtgtttacattgccgagatgggggaggatttgtttgaccgcaagtctttgcggctggtgcatcatcataatcgcttccaaaaatatcacgtttttttcgtgcgccaaattgatgagtgcacgcgcttcgccagggaggacggtaagcggtttttcgcatatcacgtgcttgccccgacttaaaagtaatttgcattgctcgtaatgcagaatattcggacttgcaacgtaaaccgcgtcaatatcgctttcagcaagtgcatccagatcgtcaaaggcctgctgtgcgccgtattgagcaccgaaatggcgggcgttttccatgttgcgggagtaaacgccggcaagttcaaagatgcccgcgttccgtgtgccttcgatcatttgctgcgtaattacagaggttcctatagttgcatatttcatgtgcatgctcctactgactttttaattttgatttcagtatatcatatttcagaagttcgtaaggaaatattaagaataatcctttgataaagcggaaaaaatgtggtataaataacatgtagcaagcgaaaggagttttcaatcgtgaattgtaaacattgtcatcaggattatgatgaaaatttaaatgcatgtccatattgcggagcgccgaaggagcagcccgcagaaggataccagccgccggtacagcaaccccaataccagcaggcaccgccgcaaagccagccacagcagccccagccccagccgggccagcagccgcctgttccgcccgtagcgccgccggtacaacagcaatatcagcaggcgccgccgcagcagcaataccagcagcagtatcagcagcagtatcagcagccccaatacgggcaagcgccgcagggacagccgcagcagtatgctcctgtaacggatgcgcaggcgaaagcgaagaacatggccacggcatctatgatatgcggaatacttggtttgattttatgctggacgccgtatgcgggactcgtgctcaatattctcggcattattttttatacgttgtataagaaaaacgaaccggccggccagaacggcatggcaacagcaggtcttgtatgcagtatcatcgggttgattgtatctattatctttacgatcctttggacaacattgtttgcggcaacgtccttctatgcgtccagtccttggctctggtattgataaaaattggattacgcagttgcatggcggctgcgtaattttttaaaacaggggaaagattatgatttgtaaaaaatgtgaacaaagttacagcgatgctttggcaacgtgcccatattgtggcgcgcccaaagagccggtagaagaaaatgcaaagcagcaggagccgcaggcgaatacgcagcaggcgtaccagcagcccgcagcgccgcagggccagccccaatatgggcaagcgcctccgcagggagagacacaatatcagcaggcgcagcagcagtatgggcagccccagtaccagcaacaaccccagtatactgcgcctccgcaggggagcatgcaggaaaacaagggaaaaggaacagcttcgatggtatgcggaatcctgggcctgatcttttgctgggtacccttcctcggactcattttgacaatcgttgcggtttcgctgtatgcctcgtccaggaaggacggcccaagcggcatggcgacggcaggccttgtatgcggtattatcggtatgatcgtagcgatcatcgtcacgattgtatcgatcgtggcattggcatttgtggggacgattggagccgccacgatgtcagtgataccttttatgtaaaaatattggaagttttaaatgtggaaagagcggaaaagggaacctttttcgctcttttttcgtcttaagcatgaaaacggaatcggaagacgggtgacatgttccggcattgtgaaaaaaatgtaaaattatttcacacaatgcgttgcaactatagtataataaagtattataggaaaaaacatggaggaaccttttatgagtgaaaagatatcacccgcggtcatccggcgtcttccgcgttattacaggtatctggaagaactcgaaggcaaagggattgataaaatttcttcgtcccagatgagcatagaaatgagccttaacgcatctcagatcaggcgtgacctgaattgctttggcggctttggacagcaaggatatgggtacagcgtgggcaagctgaaaaaagagattgcgcggattctaggccttgacaaacgctacaatgtcatcattgttggcgcagggcggatcgggcaggcgctccttgggtataagaattttatgctggaagggttcaatattgttgatatcttcgacaacgatccggcaaaagtgggcgcgtttatcgaggggcgtatggtgcaggatatcggcaaaatggaaggatatttaaaggataaggacattgatattgcgatcatttgtacgccgaaggaatatgcacagcagtcggcggacctgttggttagcttcggtattaaagctatctggaattttgcccccacggatgttgcggtaaggcgcggcgtagcagtggaaaacgtgcatctgtcagacagcttgtacgttctatcttataaattgaaagaaaatatttttgaatgagaaggatgatagcatatgaaatcatatgagctgcaaacttatcaaaaggaagtatttatagatatcacgcgcaatatccgagatgctgtggcaaggagtgggatcagcgaggggatcgcggtcgtccattgtccgcataccacggcgggtatcctgatcatggagaattccgatccgacggtgcgtgaagatgcgatcaaggcgttcaacaaaatgattccggaggaagaatttaagcatgataattttgttgcccatttcaaggcggcaatggcaggcaacagcgtgagccttcctattgaaaacgggaagctgaaactggggacatggcaggcaatttatttttgcgagtttgacggtccgcgtccgcgccgcaattattatgtgacgatcggaaagtgcgaataacttacaggttgtttacgttttcatcatattttaatatttacatggcctgtcagcgtatattattatagatatggaaacatacggcaactgtgggatatagggaaatcaatcataaagaggtaaggtaatgtctgaatttgaaaaagacaaaaatgaagagcataagtttggcgaaacagcccgtaaaataggggaaacacccacagaaggcgagccttcggcaaataagcccgccaatgaggatgtgacaccgcaaacgccgtcggggcagcaggaagaaacggaagcgcagcctttggaaggcgctccggcggatcgcgatgaaacgatggtttatgcgccaacaccggatacggaaaaggaagccgcgcaagaagcggcgcctgttttgggcgccgctgccgcaggggaagaaaaggtttcccagtccggcggaaggaataaattcggcggcgagtcccccaagaaaaaaggatggagtacgaaaaaaatagtagtcgcagcggtcattatcgtggcgatcgtagctgtcgggattacgggatacgcaatgctgggaaatagtaaggcgttatccggtgacaacctgcagcagattattgataacggaacgttttacgatggcgtcagcatggcgggggtagacctttccggaaagacgattgaggaagctaagcccgaggtgcagcaaaaggaagacgaatacttgtcaggacttacgcttgactactcggttgacggtgatacctatacgcttacaggagagcagcttggcgcaaaggtggatatcgacgcggcgcttaaaaaagcgatgctttatggccgagaggggacatttgcacagcgcagtgccgccattaaggaagcaaaggaaaaaggcgtagaaattgaaatgcctgtcacatacgacaaagcggtgatcctgacgtccctgcaggcgaacgatgaaaaaatcaatgttcccgcgcaggacgcgacggtcgaagtaataacgaccaaagacgaggatacgatgatgacaggttctacgatcactttaaaagaagaagtcgtaggcaaagaagtagatgacagcgcgcttgcagatacgatttttgcgcagcttgagcagaatgattttacacctgtatcggcagaaaccaaggtcacgcagcccaaattcacaaaggcggacctcgaggataaatacacattgctgggaacctacaaaacagattatgatagttcggcggagggccggagatataatatctggaaaatggcaagcgttataaacggcgtgaaaattgagccgggcgaaacttggtccatcaatgaagaagcgggcccgcgtacatacgcccttggctggaaggcagcaccgggaattgcagacgggaaataccaggatgaaccgggcggcggtatctgccaggtctcttctacactgtataacgcggtcctgcgcgcagaggtcgaaatcgtagaccgttcgcaccattcgtggccgctcaactatgtggatggcggcttggacgcgacgatctctacaggcgcgccggattttgtgatcaagaacaattacgatattccgatctatatcattgcgaactgcgatgggcagaacaggaacatagagatttcgatctacggaccgaagtttgaagacggactgacgcgcgatttcacatccaaagaggtgggcggcagtccggcaggcgaacagataatcgaggatcccacgcttccggcaggaacgcgtatcgtagagcgtagttcgcatccgcgcagagtgttcgacgtttacaagcattggtacgatgaaaacggcaaagaagtaaaggtcgaaaagtattccaccgagacataccaggcgtttaactcgatcgtacgcgtaggcacggccgcggcagaaacgcccgcgccggaaacgccggttaccccaacgccgaccccaacgccgaccccggatccgaccccaacgccgactccggatccaacaccggcgcccgatccggtaccggatccgactccggctgcgtaagtgtcgggcaaagcggcagctcttaaagttgatatgaaaccaggggcttgccgagaaaggcaggccctttttcttacggacagcgcatttatgaaaattttttaaatacaggggagatttgtttacaataccccctgggtacgttatatttatatagtatacttgtattttttagcatttttaggagaaagacactatgaaatattacagacctgtgcgcgggcacagagtggtgaataaaaaaaggattgcaatatttggcgtggcggtggccgtggcagttgttgcaatcattttttgtgtgtatatgttttcgcaggtcaaactgacgagtgaaaaagagcaggaactgtttactacaggtacgtttttagacggcgtatcggttggtgggatcgaccttggcggacttacgtttgcgcagggggaagagaaagtcaaggctgaagcagaccgcttggtaaacgagcacaaaatagaatataccgtacaggaaaccgcgtattcctataccttgccggacgcaggcgtatccatcgagtacgaacagccactgcgggaagcgatgctttatggccgtgaaggtacgcgctgggatttgcagtttaagcaagtggagccaaaggattggccgcttgaatataccttcgacgaaacaaagctggatgcgcttattgaaacggacagcgcgacatggggcgaagaggctgtcgatgcggcttatggcgtagaaaagacaaaaaatgaagacgatttgacaacaggcggaacgcttactgtccaggaagcgaaagacggctggaaggtcaatgtggaagagatcaaaaccacggcaaaaaaccaggtggaaaccaaggaatttacgccctttgcagcccagattgaagtagtcaaggcgcagggatcggataatcctaaggaaatggtcaagatgggaagctatactacaaaaatcgggtcgtcttcctcaaaaggccggaaattcaatatctggatgatcagtgacaaattgaacggcgcggtatttaagccgggggaagttttttcagtgaacgattatgttggcgaccgtacggaagaactcggctgggcgctcgcgccgggtatcgaaaacggtacctatacggatcaggcgggcggaggtatttgccaggtttcatccaccttctataatgcggcgctgtatgcggaaatggatattgtggcaagactccctcacacgattatggcgggctatgtcgagccgggcatggacgcgacgatctccaccggcggtcctgatttcaaggtaaagaacccttatgacgacgatatggtcatgattgttacctgcaatatcccggatatgaaagtcacggtcgatatttatggaacggtcgagcgggattattatctgaaattcgaaagcgaactgatcaataagcaggatgctccggcaatcaagtacaagacaaattctgcattgggcaaatatcaggtagaacgtacgaaggttggacagggcgaagagaagtatcaaatttgggggcagaaatataataaaaatacggatgaaaaaataggagataagtttgaagtgacaacgtcgacgtaccgcgggatcgcccctgaggtagaattggggagcggagtgccgatacccgcagagggaacgccgcttgaggatgttcaggcacaggcaaaagagttggagcaaaaagaagcggaagcgaataatccgcagccgtctgcaacgccggagccaactccgaccgtctcgcccgaaccaactccgaccccgccggcagagccgacggaagaagcggcataaaggcgatttaggaaggttgtatacttgacaaacgagggcggaaaccttaaaatattatactatagcgcatcaggtaaactgaaaaacaaatttggggaaaaacctcattcaacaaaaagattttcgggaggaaaataagcaatggcaaagggtaagtttgagagaaccaaaccgcatgtaaacatcggaac

SEQ ID NO: 11 - DNA, 95458 bp, Christensenella sp.
gttataaaacactcatatttcgttgaggaagcagatggtttgtgataggctgtagcagatatgataattttctgattaacgcaggcgaaaacagagtatgatacatacaggatacaattgcgttttaggataaaagaggcttaagaacgaaaggccggaaatggttgcggagaaaatggatgcaatggtggggaaacggaaaatttgggattttttgaagcgggaacatattattttcctgatcattgttttcctgttctattttttctggaatctttcgcagccgccgtttgctgcgccggatgaatccatgcgctaccagatacccaattttatcttccggaacggatatctgccgcatggcgcggaagaagcgatccgaaacccgacatggggtatatcttacgggtttgcgccatatttttctcaggtcataggcgcgggattcatgaaaatcgctgggatatttacaagcgatccttatacgcttttcatggcggcgcgccttgtcaatgtgatctttgccacgctcacggtatggatatgctttaaaattgctgcccgtttatttaagcaggaagcctacagatggctgtttgtggtattggttgcgttcctgccgcagttcgttttcctggggagctatatcaacaacgatatgatggcgattttttccacgtcgcttgtgatactcgcgtgggtatccggcttacaggaacgctggccgctgaagagttgtgtcatccttgggatcggtatgggactgtgcgcgctttcgtattacaacgcatacggctttctgcttttaagcgttattttgttttttgtatccaatctgctgatggataagcgccgctttcaggaaaaacagttccgcaaggaaatttatgtcgtggcaggcctgttcctcgcgatcgcagcctggtggtttatacgcaattacatcatctataatggggacgttcttgggtttgcaaccacagagcactaccaagagctatatgcggtggatgaactgaaaccttcactggtgaaaacggtcgagcggcaagggatttcgctggctggtatgctgcttcccatgggatggatgaagtttacctacctgagtatgataggctgtttcggatcgatggatatctggctgccgatatggatctatttcgtttatacagcgatttttgcgattgggtttgtaggctgtgtgatggcgtttgtccaatttatcaaaagaaaaaatacaacagagaaaaagaaaaagttgttatttggaatatgcatggggcttgcgatcgtcattccgatttttctgagcatgtactattcctataagagcgactaccagccacagggaagatatatcctttcctgcttgctgcccctgatgttttttataacgacggggatcaaaacaatactggataagctgtgcagaacccaaaaggccaaggcaataacggtccttgtgctcattgcggtgcttatagcaataacggtttattgctattttggagtgttcttaccagcttatcaataaaagaatgaggagaaacagatgatcagttttaatgtcccgccttacgcatccaagagtattgactatgtaaaaaaggctatcgataaccaccagatatgcggggacggggaatttacgcaaagatgcagtcaatggctgaagatgaattgtaaggtgccgaatgtatttttgaccacatcttgcacacacgcgctggagatggcagcaatgctttgcaacatccggccgggggacgaagtcatcatgccgtcttacacgtttgtttccaccgcgaacgcgtttgtgctgcgtggggcgaaaattgtatttgtggatattcgtccggatacgatgaacatcgatgagagtttggtcgaggacgcggtcacagaaaaaaccaaagtgatcgttcccgtgcattatgcgggcgtttcgtgcgaaatggatgaaatcaaccgaatcgcggagaaacatgggttatttgtggtggaagatgcggcgcaggcagtccttgcgtcttataaaggcaggatgctggggacgctgggggattttggctgtttcagttttcacgaaacaaaaaatttcagcatgggtgaaggcggggctttattgtttcgtgatcttgaatatgctgaacgtgcggagatcatacgggaaaaaggaaccaaccgcagcaagtttttcaggggccagactgacaaatatacttgggtggactgtgggtcttcatacctgcccagcgatatcaatgccgcctacctgctcgcacagctggagcaggccagggcaatactggatgacaggctggagagttggaaccaataccatataggatttggcaagttaagcgaggcaggtttcatagaacgtccggtcattccggagggctgtatgcataacgcgcatatgtactatatcaaggcgaaggaccttgaagaacgcaccgaactgatcgcgtttttacgcagtaaatatatcgagtcggttttccattatatccctttgcacagcgccccggcagggaagcagtttggccgtttccaaggggaggacaaatatacgaccaaggaaagcgagcggatattgaggctgccgctttattatgggatggacagcgacgatattcagtatgtcgtacgtaatgtatacgagttttattttcataaaggtgtcggaaaatgaaaagacttgcaattattggagcgggcgaatttcaaaatccgcttatcctgaaagcaaaagagatgggctacgaaacgcatgtgttcgcatggaaatgcggtgctccgggagaaaaagcggcagactttttttatccggtcagcatcgtggaaaaggtgcagatactcgaagtatgccgcgcgatgcagccggaagggattgtctctgtcgcatccgatctggcgatggtgacggtgaactatatcgccggagaacttgggcttgcttgcaacagtgaacaatgcacattgcgtacgaccaacaaattcgcaatgagggaagcgctaaaggcggcaggcgttcctacgccatgtttctgcctggcggatgcgcgccagaaaagactgtcaagcgatatgcgctatcctctgatcgttaaaccgacggaccgttccggaagcagggggattatgaaggtggagtcggaaacagcgctttctgacgctatcgatgcggcaacggcatattcgtttgaacaaaaggccattgtggaggagttcatggaaggcgaagagtatagctgtgaatgcatctcctgcggcggcaggcatacgctgctcgcgcttaccaaaaagtttacgacgggtgtgccgcattatattgaaacgggacatatcgagccggccggaatttcggaagaaaaaactgccgagatacaaagggcggtttttcatgcgctggatgcactggggatcgaggcaggcgcttcgcacacggaattcaagattaccccggagggcgaaatacggatcatagaaattggcgcgcgtatgggcggggattgcattggctcacatcttgtaccgctttcaactggctatgattttcttaagatggttatcgatgtcgcctgcggacgggaaccggatatcacaaaaatgcatgaagacagcgccgccgcgatacgttttgtattttctcaagaggatgttgacgtccttgggcaaatccggcgtattgcgcccggcatcattgcggaagaaagtccgatagaaaagataaatccggcaggcgttagggacagttctacacgggcagggtattatatcctgacgggtgaacgggaaaaaatatctgattttttgagcctctgaacagggatactatccgccttggcattttgatattttgtatttggcatttggcatgttataataaactatatatctgccggatggcaggcagatttttagcatagtaatattacgatcatttcataaattgattcgatttgaaataagggcggttatgcaggaaaaagaatggatactgcaagcacaaaaaggggatggagacgctttttgtgccttgatcggtaaatatgaaaataaaatatataacattgcatataaattcatgcagaatagctttgacgcgcaggatgctgcgcaggacgctattataaaaatgtacggaagtatccggaaattttcttttcagtctgccttttcaacatggatgtaccgcgtagtagccaatacctgccttgacgccttgcgcaggcgtaagccgtccgtgccgatggaggaatatactgacctagccgtgagccgcgagggaaaccccgatgagcaggctgaaaacagcgagcttggacggggcatccggatggcggtgcaggagttgagcgaaaaataccgtatggtgctggtcctgaaggacatggaaggcctgaaatacgaggaagtagcggaaatcctttctattacgcccggcacagttaaatcccgtttatttcgtgcacgggaaaagctccgtaaagtcctggaagaaaaacaaattgtataaatggaacataatatatcccgcgtgcgtctaacaagaaaagcactgcaggaggtattattatgaaaaaaggattgcttattactgccgcggttttatgcgtcggtatttttggcgttgtggggtgctcggcgcagtcgccccaggtgatcgaaaatggcgatatagaacaagcggcgtctgcgtccccctcggcggaaggaaaacaggaaagcaagagcacgcttacattaagcgcaacggaaacggtgaaggttgcgccggacgttgcatatatttctataggagtcaggacgacgggcagcaccgcggaagaggcacaacagaaaaacgctcaaattacaaatgatttcctgaaggcggtcgaagcgcaaggcgtttcccaagatgatatgcagacggcaagcatcaatatatatcaggattatgacgacgcaaaaaagacggtaatggaaaacacctataagattacagttaaagatgtgaatgccgtgggcgccgtgattgatgccgcaacgagcgccggcgcgaactatacctactcgttgacatttgatgtgcaggacagggatacggtctacatgcaggcgctatccaaagctatggagtcggtaggcacaaaagcaaaaacaatggcgatggcgggcggttatacgattgtgcgaccgctttcgattacagaatccggtgcggacaacggtgtgatgccatacagggaagcgggactatatagcgatacggcttcttccgcggacacaggtgcagcaacacaggttaccccgcaggagatcgaggtttcggctacggtatcagggtcttatctgatccaataaaagagcggccacggaaaattcgaaaaacaacttaaaagaagcaatatgcttctttttttatgcggaacggttgccgcgacgaacaaggaagtttataatgcatacgtatggaattttagcagatcagaggaaagtaatgtgaaaagcctgtttcaaatcggtattgttctggcagtatgtcttttaggcgaattgctgagtttggtcatccccctgccgatcccaaccagcgtattgagcatgatcctgctctttatcctgttattggcaaaaattatcaaaatacggcacattgaacagttcggagattttttactgaaaaatatggcgtttttctttatcccgtccggtgttgcagtgatgaaccagtttgagcttttaaaggataacctgattccgtttcttgcgatttgctgcatctctaccgtagtgacatttgtggtgacggcctataccgtaaaaggtgtaatggccttgcaaaaaaaagcaaagagggggacatatgatgaatgagtttttatcttcccctttctttggagtagtattatccgtagggatgtatgcgatcggcgtatggatcaacaaaaaaacaaaatccccgattgccaatccgcttatgatcgcgatcatcctggtcattgttgtgctggaggtattccatatcccgcttgacatgtacaacaaaggaggggattttatcggctttttcctcgtaccggcaacggcgtcgctggctcttgcgatctaccggcaattatggctcttaaagaaaaatttgttgcctgtgctgatcggctgtgcggcggggtcgctggcgtctatgggcagcgtatacggcctgtgccggctatttcatgttgaggagattatgacgtactcgctgcttcctaaatcggttacaacacctattgcgatggatctttcatcgcagcttggcggaatgccgtccattaccgtagctgctgtcgtggtaacagggattataggagcgatcgccgcgccgggcatgattaaactgttccgcgtcaaaaatccggtcgcatccggtgttgcgattgggacatgctcgcatgcgctgggtacgacaaaagctcttgagattggtgaagtggaaggcgcgatgagcggccttgccatcggcgtggcgggaatattgaccgtcatttttgccatggtgattggttgattggcaacgaattttcgaggataaaaaagcacataacaaagcgatctcatgatatgatagcgtagggataaacaaaaagacagacatgggtggaaaagtgttcagtttactgtcaaaatttattcgaaagatattcgatttcattgaaaacagcaggggattccgtgcgatcagaaaagggctcattacggcgatccctgttttgatgattggttccgtcgcgcttattttgctgagcatgcccgtggatgcctaccaaacctttctggattcctttggaaacggcgctctccgccagatattgacaattatccaggtcgcggcctttaattttatggctcctatcttcgtcattacgatcagttacagctatgctgaactttacagcaagcggatatcgatgcggatcggcgttccgctgatcgcattatgctgctttatgattatgtcgggaatggaatcggaagaattttctatcagcaattttggggtgaacggactctttatcgcaatcctgaccgcgattttttccagcatgcttttcgtcaagctttcttccctgaaaaagttggggctccaaatctatgcagatggcacggacaatgactttaacaccgcgttttcgctgatattgccgggggcaatcgtgctgcttgtattcgcggtgatccatttcatcacctcggatgtcttgggggtcaagaatttaccggatttgctggccgagattatgatcaatctgtttacaggtcttgggaaaggtatcctgacgggtgtcctgttcgtctttttcctgcagatattctggtttttcggcatccatggcggaaatgtaatggacaatgtatcccaacagtattttgcacagggaacgcagatcaatgcagcgaatattaccgcggggctcccgccaacggaaatcttaaataaaacattttttgatgtatttgtctttatggggggctgtgggacgatcctttgccttgtgatcgctatttttctgttttcaaaacggagaagtatgcgcgatattgcgaaaatggggatagcccctatccttttcaatgtgaacgaattcgtcatgtttgggttgccggtcgttttgaatccggtttttttgcttccctttgtggttacgccgatcatcataactgtgatctcttattttgcgacctacctggggcttgtcccgtatgcggtgcagacggtggaatggacgacacccgcatttttcagcggctatatagctacaggctcggcagcaggatgcatattacaggctgtgaacattgcagtcggtgtgcttatttaccgtccgtttattaagctttacgaaagaaaacaggtagataacctgaaaaaagagattgtaggacttacgaagattttaggcgaagcggaaacaaaaagccagccgcccaagctattggagcgggaggatcggtatggttccgtagcaaaaatgcttgtgatggatctgcggcacgcaatcaaaaagaaaaggttgaacttatattatcagccgcaggtgaaaaaaggcggacaatgctttggggcggaggcgctcctccggtgggagcatgaaatcggaggttttatcgctgcgccgcttattattcagcttgcgcgggaagcaggcttcttggcggaactggaagaatatatcctggagatgggctgtgccggactttccaagctgaatgccgaatttgatcctggttttagggtgtcgctgaatgttaccgccgatttcctcaaaacagcgggtttttttgagcgggtacaggaggttgtgcaaagaaacagggtaaatccacgtaatatctgtatcgaagttacggagcagaccgttttggaggatacgccggacatcaggcacaggctgatgcttttgaaggaggccggatgtttgctctcgatcgacgacttcggtatggggcacacatccctcatgtatttaaaaagcaaccagtttgggcaggtaaaactggatggggaactggtaaaggatacgatgcgcaacgagcgttcgtgcgatattatttcgtcgattatttatctgagtaaatccctgcatttttcggtacttgcggaatatgtggaaacaattgaacagctcgataaacttactgaactcggatgcgacgagttccagggatacctgttcagcaagcccctgccatatgatgaattcgtgaaaaaggttgtactatggcgggatcagggaggcagggtataatcttaggcattttgcgctttataaaaatatatggaaggcctgccggagagtgggctttttgtttgtaaaaagaatgaaacaaatgaggggtaaaccggtcctgtggtttgatttcaaaccacggacatggtaaaatggtgggacggcaaaaggtttggaaggaagaataaaacatggcggataaattgctggcgatcgatgggaacagcttggtgcatagggcgtattgggcgctgcccacaacaatggtggataaggagaagcggcataccaatgcggtatacggcttttttacgatgcttttcagaattgtggaagagtacgggcccacgcatatcgccgtcgcttttgatatgaaagaaaaaacgttccgtcatgatgtttttgcagaatataaagcaggcaggcgaaaaacgccgcaggagttaaacgagcaatttcctatgcttaaagatgcgcttaagatggtgggcgtgcagtatacggagcaggagagttttgaagcggacgatattttaggggcgctcacaaaggaagcggacgaacgcgggatggagtcttatatttttacaggcgaccgtgacgagttgcagctaatcagcgaccaggtgagcgtggtgcttaccaaaaaaggcgtgagtgaaacaaagttgatgacgcgcgaggcgctcaaggaagaaatgggcattgcaccggaacagatcacagacttgaaagggcttatgggcgatgcgtccgataatatcccgggcgttgcaggagtaggggaaaagaccgcgctcaagctgcttttggaatatggcacggtggaaaacctgtacgaccatatcgaggagctacccaaaaacaagctatatgaaaaattaaagaacggtaaggattccgcatttctttccaagcaattggcaacgattaagcgggatatgcccttaaaagcaaagctgcaggattttacatttgccggattcgacatggacggcttacgcgaaatgagcgaaaaatacagctttggatcatttttgaaacgcttttccatgcaggaagaaccaaagcgggaaattgtggcccaatctttggagctcaataaccttgcagtcttgaaggatgccgtagaggttgccttttatttaagaaacggcctgcattttgcggtggacggcgaaacggaatacctgattccgcaaaaggagacgctgcttgatgagggctatgatttatctgacattttaaagacggtatttcccctgctggaggataaaagcgtgattgcgcatgatatcaagggattggaacattttgcgggcaacggacgtcttacggatggaacgtattttgacacgatgctcgcggactgggtcttaagtccttcttattcaaaatatgatctggaaagcgtccttgaaaggaacgagcttccgttttgtgcggtgagtttgtttacgcttgcggaaaagcagaggaagctgctggaagaaaatgaactggataaggtctactatgatattgaactgccgcttttaaaagtcctttaccacatggaaaagaccggcgtacaggtatcggacgaagaactcaaaatcctcggggaaaagtacgatgcacaaatcgcggcactgacggagcgaatctatgaactggcgggcatggagtttaatatcagctccaccaagcaactggcagaggtactgtttgaaagactgggcctgcctgcgcaaaaaaagacaaaaacgggatattctacggatgtggaggtgctggaaaagctcgaaagcaagcatccgatcatctcatatatcatggaataccgtacgcttactaaattaaaaggaacgtatgtggacgggatcaggagcctcatacgggatggaatgatccatacgacgtttttgcagacggcgaccgctacgggaaggctttccagtgtggagccgaacctgcagaacatccccattaagtcggcgatggcaaacgatatccgcagggcgtttaccgcgccggatggttttacaatcgtttcggcggattattcgcagatcgagctgaggatattggcggatattgcagacgataggcacttgaaggatgcgtttttaaaaggacaggatatacacgcacggacggcggcggaagtgctggggaaaaatatcgaggatatcacgggacaggaacgcgcaagcgcgaaggcggtcaattttggtatcgtatatgggatcagcgattttggcctggcacgaaacctggggatcacacgcaaaaaggcggcggattatatcgcgcgttattttgaggaattccgtggggtgcgccaatatatggacgaaatcattgcaaaggcgcatgaggatggatttgtgcgtacgcttttcgggcgtatcaggtatattccggagcttgcgtccggcaattataacatacgctcctttggggagcgcgcggcgctcaatacacccatacagggaagcgcggcggatatcataaagattgcgatgaaccgtgtagacgcggcgcttaaggaagagaaatttgcgtctaaactcgttttgcaggtacatgatgaattgatcctttatgcaaagaatgaggaagcggacgcagtcacgaagctgctgcgcgattgcatggaaaatgcggtggagttgagcgtgccgcttgtcgtaaatgtggcaaagggaaaaacatgggcggaagcgaaataaaaaaacgtatcatcgggctgatgggaaacagcggctcgggaaaaagcacggtggcggcgaagctaagggagcttggggcgtatatcattgatgcggatcagatatcacgcgacttaagcgagccagggcaggacggatggcgcgccgtaaagcaggaatttggagaggcgtttttcaggaatgacggggcccttgaccggcataaactggggaaatacgtgtttgcccgtccggaggaattaaagcgtttaaatggtgtgctgcatccgcttgtgctgcaaaaggtggatgaaaaaatcaagttcacaccggctgggacgatcgtgatcgactgcgcgcttttggtggatgtgggactggatgaactcgcggacgaggtctggctggtgacggcgggacaggaaagcaagatagagcgcatcaagaacagggatggtattggaagcgagcatgcggaaaacaggctgagaagccagctttcggaaaaagaactggaacggcatgctgatgttgtgctcgaaaataaggggacgcttgacgagctgtacgagcgggtaaggaaacagtatgggcagggtaaatagaagcggaaagaagtcaggctccaaaaaggtcgtggtccttgtgatttgtatcatacttgccgtggcggtggtgctcggcgggctttatgtatttggcgatcttggatggcaaaaaaaatatcctctggaatatgaagacaccattgtgaaatatgcaaacgagtataacctcgatccctattttgtggcggcggtcatcaatacggaaagcgggtttgatgcggaggcgtcgtcaaaccgcggagcgatggggctgatgcaggtcatgcccgaaacaggagaatggattgcgggaaaactcggcatagacaatttttcgtccgatatgctgcttgaccccgaaaccaatatcaggatggggtgttggtatctcgatttcctgggcgaacgtttttcaggcgaagaagttattatggcggcctataacgcagggcatggaaaggtacagcaatggctcgaggatccgcaatattcatccgatggaaaaacgctggataatatccccttcgaagaaacggacaattatgtaaaaaaggtaacaaaagcatatgaggaatacaaaaaacattatgaattgggctaaaagactggcggcagcagggcttgctgcatttatgcttctattatgcgcctgtgcaaacctgaatgggaacgtaacagcgtctgcgagtacatcgccgagcgcatcggcctcagcggaggtgcagaaggagagcggcggagagctttttattgccatgccgcaggatatcgtggacctggatccgctggatgcaacggatgaagacctgatcaatttgcttagcttgatttatgatacgccggtccgccttggggcgggaagcgagccgcaggccggacttgcggaatcatgggaagtggatgaaacgggaacggtatatacgtttcattttcgccaaaacctgacgttttcggacggtacgccttttaatgtggatgacgtgatatatagtttacagcgcgtcttggctgcgggcggtaccgcggatccggctgcgccacagcctgaaggcagcgcagatccggaggggagcgcatcgccggaaagcagtagttctgctgtgccggaaagcagcgcaagcccaagtgcgacctcgagcgacggccaggtagaacttcctgaaagtaaccgttatacgcaatataacagcctggtcgcgaattatgagcggcttgacgattacacgcttaagctgacgatggcaaagccggggcgtgaagcgctttattttatgacgtttccggtagtgagtgcaacgttatttgaagcgagcgataccccgatagggacaggaccatataaagtggaggaatacgaagcagattccaagatgaccctcagcatcaacgaaggatggtgggatcaaaagccttatattgaaaaaatcgtggcgaacgcggtaagcgggtcggaccagaaaatcgaaaaggtggaatcgagcattcttgacttcatcacaacggatgtgctttacgcaggaaagtataagctggcgggcaagacacaggtcgttgattatatgaccaattattacgattgcatcgtacccaatttgggttctaatatactggaggacatcaatgtacggcaggcgatttcatatgcgatcgacaggcgggagatcatttctacggtattgctgaaccatgcggtaccggcaaacatgccgattgcaccggatttttatgcgtatgattccaaatataaacaggacgacgacctgaaaacggcgcgcgaatatttgcgggcggccggatataagacggatgaggatacggaagggaacacactggaacttacgctgatggtaccgtcagaccgtgacgcttcctatcgcacagaagcggcaaaagcgatcaaaaagcaactcaaagagattggcgtggaaattaccatcgaagagttgacgcctgaagagtttttaaataagctcaacgcaaaggattaccagcttgcatttgtgagctattatctggatgagaatccggatctgtcctttatgtttgacagcggcggctctggaaattatagcggcgtatccaaccaggaattgacggatgcgattgcggctgcaaacagcgcgtttaaagaagaagatatccagaaagcatacagtgaactgcaaaggatcttgatggagcgcgttccgcagatcggtctttattaccgcatgaattccatcatctgcgacgaggcggtcaatggcattacaggagcgcggcaaaatatggtttttggcagtatcaatcaatggttcatcgtccagaatgggtgatttttgcttgaaacaaagcagagttgtttatctatggttatcgtgcagaaaacaggcagaaaggaagttatatgggaaatcaggataacggaacgatgatgcagtatttcgaatggtatctcccgtccggaatactgtggaaccagttaacgacacaagcgccgcagcttaaggaggacggtattacagcagtatggctgccgcccgcctataagggaagcgcgggggaaaacgacgtcgggtatggcgtgtacgaccactacgatctgggggaattcgaccaaaagggatcggtggcgacaaaatatggtacaaaagaagaatatatcaatgcagtaaatgcgctgcatgaccaaggaatacaggtttatgcggatatcgtactcgatcatatgatgggtgcggacgagctcgagacggtcgtagcgcgtaaatacaatccggaaaacaggcaggagagcattggcggggaccgcgagatttctgcatggacaaaattcacttttccggcaagaggcggccggtattcggatttccagtggaattatacgcactttgggggcatagactgggatgaaaaggagaaggaaaaaggcgttttcaaattccacggcaagccatgggaagatgaagttgacgacgaaaaaggaaacttcgattacctgatgggtgcggatgtagacctcagtaacccggaggtggtggaagaattgaaaaaatgggggaactggtatctggaaacggttccggtaaacgggtttcgcatggatgcggttaagcacatgcgtttttctttttacagcgactggctggacaccttgcgccgtgaaaaaaacagggaattgttctcggttggtgaatattggaacggggacttaagcgcccttaaaaattatatcgacacgacggagggggcgatgtcgctttttgacgtaccgcttcattttcgtttctttgatgctgcgaatagcaatggaacatttgatatgaggacgatttttaatgatacgctgacccagaataatccgttaaaatccgttacctttgtggacaaccatgatacgcagccgggacaagcgcttgagtcgtggataccggagtggtttaaaccgattgcctatgcgctgatcctgcttcgggcggaaggatatccgtgtgttttttatggcgactattacggaatcgggcatgataatattgcgccgatgcgtgatatgctaaaaccgcttattgcagcgcggcggcagcacgcatacgggccgcagcacgattactttgacgctcccaatgtcataggctggacgcgggaaggcgatgaaatacatggtaattcaggtctggccgtattgctgacgaatggcaagggcggaacaaagcacatgtatgtaggcgagaaatttgcagggagccggttttatgactgtacgcaaaaccaccctgaggaaatcaccattggggaggacgggacagccgatttctttgtgaatgacggctctgtttccgtatgggtgaaagcggcggaagaaggctgattatacgcctgccgcctgattaagcgcgattacgtgctcatcgtcggaaagtgagaaaatatctgtttttccattgttgaaataaaggaacgtatggcccttcatgccggaattattgatatcatcaccacctgtcggcataccaaacaaggaagcggcataagtttgcgagccaaccgtgacgagtacgccacggtgctcccatgtggcgtcgccgccgaatgattggagatatgccgcataatcggcagaggtcttgggcaccacctgtgcgcagtttacgccgccgacacgctgcatggtatacgcaactccggtgttataatctgtgatcgcaatgtcgctgccgacgggaatcgtcgggtttaccgcatcccaggacccaagcgcgccgtgcgttttcacagtaccattaaaggcaggaccggcaacctttttgatccttgtgtttgccggcgctctttttgcagaatcggaaaacagcagttcgtaagtatccgaaccgatctgtccgtcaggagcgataccgttttgctgttggaaattttgcacggcagccacggtgagttcgctgaatttgcccgtgggacggtaattcaggtaacctaaatcacgcagccgctgctgcacgagcgcgacctggtcgccacggtcgttttgcgatatgacattatctgcggccgtgcccagcgcagggacaagcaaaaacacggcaagcaataaaatacaaataattcttctcataacgctcttattttaccgaaaaaaaataaaaattgcaaatcggttttcaaggcacgggctttcagatataataagactatgataaaaattaccgatatcaaagaatgtgcgcgcaataaaaacagggtgaacctgtatacggaggacggctttttaacggctgtataccttgatacagcgattgcctgccgcttgaaaaaaggagccgagctttccgaggatgattttaaggagatgaaacgggaagacggggacaaatatgcggcggggatcgctatggaattcctatcctataaaatgcgcacggaacgcgaaatacgcaataaattaaaaaccaaggaggtcgaaccggattccatcgaccgtgcggtggagcaattgaaggggtacggttatatcaacgatgaaaagtatgcccgcctttatgcgcaggaattgctgcagaaatttggggagcgcgtcgctgtcagcaagttgatcgaaaaagggatcgacagggaattggctaagcaagtgacagaggagcaggagcagccggaggacgtgcttgacggatttgtccggagattacgccataaataccgtgaagaggacccgaataagggcaaacaaaagatcatacgtgctttgatggccaagggttttgattatgaggagatcaagcatgcccttaacaaggagacggaagaatgagggaccagattgtaaaactactgcatgatgcgcaggattttatctccggtgaaggactgagcgaacaattgggcgtatcgcgcgcggcggtatggaaacacatcaaggagctgcgagagcagggagcggagatcgaggcgcacacaaggcgcggataccggctccttcgtttgcctgaccttttaaagccggaatatgtcgggctgtatgaaaaattgtcggggatacattatgtctggatgcaggagacagattctacaaacgaagaggccaaacgtgcggcaagggacggcgcaccggacaaaagcgtgtttatcgcggaacaccagacgcgcggcaaagggcggctggggcgagactgggattcacagcgcggcgtggcgattgagatgacggtgcttttgcgcccgcggtttacgcctgacaaggcgcctgcgattacctttgccgccgccttggggttgcttcatgccgtaaagcgggtatgcggcatccaggcgagcatcaaatggccgaacgacatcgtgtatgaaggaaaaaagctatgcggtattttgacggaaatgtcttcggatatggatcatgtggagtatattgtgtgcggaatggggctgaacgtcaatcaggaagggttttcggacgacgttaaggatcgggcggtgtcgcttcgcatgatcgcaggagagccgctctgcaggcaggaattgtgcgcggcgcttgtcaatgatgtttttatgtactgcgaacggtataccaaagaaggaatcgattgtatttttgacgaatattgcaataatagtgctataataggaaaagaaatacggattttgtgcggggacgaggaaatgacgggcgtttgtgaaggttttgcgaaagacggctcgatcattgtacggacgcagcaaggcttaaaggagttctgcgcaggagaagtatcgatacggggcacgggaagttatgcctaagcggcagggaaataatcccgggaccaaaatgagggaaaggcatcttatgtacagtggaagtataacggatgtgcaagggctgcttgtaggccatgcgcaggatacgataggaatgacgggagtcagcgtcgtcatcgcgcccaacggagcggtgtgcggcgtcgatgtgcgcggcagcgcgccgggcacgcgtgagacggatcttttagggcaggcaaaagcgatgcaaaaagtgcaggcggttttgctggccggcggtagcgcgtacggactggcggcggcagacggcgtgatgatctattgtgagcagcagaagatgggcgtgcatacggcggaggctgtggtgccgatcattccggcggcggtgatttacgaccttggatttggcaggagcgatatccggccgaacgcgggtatgggatatgcggcatgtatcaatgcagggaccaaagtaccgcagggaagcattggagcaggcatgggagcgacggtcggcaaagtactgggcatgccttatgcacagaagggcggcgtcgggacggcaagcatcattttaccaaagggcgtcgttgtaggcgcgcttgtttgcgtcaatgcgtttggggatgtcgtggaacatggagaggtgcttgcgggagcgcaccaaaacggtgcgcatatcggtacgtcgcagtatttgatggaacacgcggtggaccttggcaagatgatggggcagaatacgacgatcggcgcaattgcgaccaacgttgctcttacgaaggacgaagcgacaaagctggcgcaggtcgcgcatgacggacttgcaaaatccatcgacccgattcatacaatgctcgatggggatacgatgtttgcgctttcctacggcagtaggcagcttgatatcaacgcgctgattacagcggcggcggaagcgacgcggcgggcggtgattaacgccgtattagcgggaatgggcaaatgatcgcgggcatcggcattgacagcatagaaatcgccagggtcgaaaaagcgatggcgcgtgaggccttcctaaagcgcatattcacggaaaatgagcgggcatacctgaaagaaaagggcatggcggcgcaaagcgcggcagcaatgttttgcgccaaggaagcggtgctaaaagcggtaggccttgggatcacagacgtgccgctgaaagatatcgaagtgctgcacgaagaaagcggtgcgccctacctgaaactgcacggcaggcttggcaaggaaacaggcaaattttttttgagcattacgcatacaagggaatatgcaagcgcatttactgtatgggaaagagaggaataaaagcatgcatatcgcactaacccccgcgcagatgcgggcagtagacaaatacatgatcgaagagaagaaaataccgggcatactcctcatggagaacgcggcatacggtgtttttaacagtatacgcgaagagatagagccgtgctcggtccaggtattctgcggtacaggcaacaacgggggcgacgggctggccgtcgcacggattcttcttgcaaacggctatgacgtgcaggtcgtcatgatcggcgatccggatcatttaagcggcgatgcacagacaaactatgcatttttcaagacacaggatgagcagccgctatggctttcgagtgaagccgaactgagcggtctgccgcctgcggaagtatatgtggatgcgctatttggaacggggctttcacgttgcgtggaagggccatacgcgtcagcgatcagtcatatcaacgggcaggatgcgctggtggtcagcgtggatatcccctccggtatcaacgcgcagacaggcgcggttatgggaacggcggtgcgtgcggacattacggtgacgttccaatatccgaagatcgggcattttatgttcccgggcagggaatacgcaggagaattggtcatcgccaaaatcggcgtggacgacggatgcgacgtgccgttgcaggcaagcgtttgcgcttatgaaagcgacgacgaggatatgtgtcttgggcaaaggccgctcaatacgaataagggaagctacggacggttgcttttgatcgcaggaagccaggggatggccggagcggcagtgcttgcgtcgcgcgcagcatcgcgcagcggggcgggactcgttgtgacagcttcgacggagcctgtgataggggtattgcaaaataacgtgccggaggctgtctgccatacgttcccaggagggatcgacggcaggctgtccggacttgcggcggcggaaatcgatgagctgggacagggaaaatcggccatcgccatcggcccgggttttggacgcggcagcgcggaaacaggcgtggtggaagaagtcattttaaactatgatgtgacaaagatactcgatgcggatgctttgtatgcgcttcgtaacaatcttgatattttggaacagaagcggggggatatcattttaacgccgcatccgaaggaattttcgatgttgtgcgaggtgcccgttgatgagattttaaatgacccactcaaatatgcggtgaagttcgccacagagtacgatgtgatccttgtgctcaaaggatccgcaacggtcgttgcagatccgttcggcaatgcgtcgctggtttgcgccggaacgcccggtatggcaaaaggcggaagcggggacgtcctgacgggaatcatcgcaggatttgccgcacagggtaaggatgcatatgaagcagccctgatgggcgtatatgtcgcgggtatggcgggcgaatatgcgcaggcggcgaaaggggaatattccatgacgccgatggatgcggtaaaccatatcggcgccgtgatcgaagggatgctcgtggattatatcgaagcagatactgtgcaaaaaaaggcgtctaaggcgacggaatccttggaggaaccctctgacctattcatggaggaagagagcgcagagaaagaggaggcggaagatttatttacaggcgaaccccaaaatctcttcgaaggggaggaagagccggagcctgtgccgtcctttttgggaaagtatatggatgaaccgacggaagagcataagaaaatttccgcagagcgcgaaccgctcgtagaggaagaagaagcgttggagcaggaccgcagggagctgatagaagaagaggtcgctgaaacggaagaacgggaaacgaaagaggaagaaatggaagcgacccaggaaatgaaacgggagatattgcaggaattaagccgcaatggagattcctcacctacccgtcgtaaaattgggtaaggaatatcgtttagaggaggaaaaatatatggaggattttaagaaagtaaaaccggaagagtttgattatagtgcattccggatgataggcaaggactggatgctggtttccgcagagaaagatggaaaggttaataccatgactgcgtcatggggcggtatgggcgttatgtggggaaaaaacgtcgtgtttgtcgtcatccgtccgcagcgatatacaaaggaatttgtggattcggcgcagaggctttccctgtcgttcctgagcaatgattaccgcgataagctaaattaccttgggacggtatcgggccgcgatgaggataagattggcaaagcggggctgacggttatcaaagaagaaggaacgccgttttttgaagaagcaaacatagcgatcatcggcaggaaattatttgcgcagccgtatgatccctcctgttttatcgacgataccatcgacggacgctggtatccgcaaaaggattaccatacgctttatgtcgctgaagttgaagcgattttgcaaagagattgaaataaaaagccgggcaataagcccgactttttaatctttccatttccaccattgcagcttttccggatcgggattttccgtctcggcaaaataaacagccaatcggtaaacatatagctggcagcggtcgatgtgcgtattttgtaaaatgcaatcacgcgcgtatatttcttcgggattttcaccacacaaatcttccatgcaggtatatccaagatttagcaggtcttgcttcgttgcttttcccacacctggaatgacgagaaggtcggttttcttttccatacgctatctccttatgtgattaatcagctaaaaaacaggaatattcgggatggcgcgcgaaccatgattttgcataggcacaggtaggcgacgcctttttacctgactgctcaagctctgcaatcagggcgcacattaattggccgcctacgccttgtccacgcaaggagggatcgacaaatgtatgcaggatatttacaatcgaactgttgagatcaggaaattctacaaaagcaagaaccttgtgttctgcattttcaaaaaagatacggttggcttcatgcgtaaaggtcatggtccagtcctccggatttatattaccattacaataacacaaccggagtatcctaaacaagcagagaattacctgcttgtctgatcaatgctttcattccatgcaataacccgtccaatcacacgctgtgcacggttgttggagcactgttttgtggccccatcaccagtcgtgccgcagtaccacgttaccattttttgaagtccgctattgattgtttcctcagtcgtataaccgggtttattgcagacagggcaggtagtgccgccccaggaattaacaacgtctccggccgcatatgccggataaagggcggaggcaatctttggctgcgatgttccgcttttcggtgcaaagcatcctatcacaactatcagggctattaagctgcaaaaaagtatcgtgaatgtttttctcatgatatgctacttcctatatgtatcatactaattttttcacaaaagaatgtcaatgatgaaataatgcacatatgacaggatgtgtgcgcgggatattgtaatgtgcaagtacatgcagtatatccggcactatttctaagttgtacttttgatatttcttcaatcattaagcttaaattaacggttgacatttaaaaaaacaaacctatacaaagtaattaaataatgtctcggtaagtgaggctaccaaagggatatgggttgctgccgcaaagctgtggagacacagtgcgaaggtttgaacagtccaggtcgaaaataaggcttggaataatgcaacaacattgcccttaggagctaaagctcaaacgatggcgcatattcggtatgaagtcttttgcggtgtttgagcaaaggatttttttattgaaggggagtgagtgaatggactacgatggtagatgtaatgcaatgatggatatttttgagatatattctgttttactaggatatgtccgtgtctgcatgcttgcctgatgattcgtccgggaatcgttatatcgtgctgataaccatcgttgcgggaaaatcccgggaagcaaacgatggtttttatttgctttccactcagaggggaggtatcggttatggcgctttttgattttgtactgcgcagtctgctggcggtcgcgctgggatttgtgattggactggaacggcagcttacgggccatgtgcctggcatccgcatcaatgttctggtcagccttgggacaagcatgttcgtaatgttttcggctcttgtggatacgcccgatatgacaaggattgcagcgcagattgtaacaggcgttggatttctttgcagcggtatcatattcaaagaaggaggcaatgtccgcgggctcaatacggctgcgacgatctggtgtacggcagcgatcggcatgttgtgcagttccagtcacacgataatcgcagtatgtgcaacggcgttgttgatttgcgcaaacgtaggattccgtttcctgtctggacatatcagtccgtttaaacgttgcgacgagcaggaaacatactataaatttacattggtgtgcgaaggggcatgtgaattgaagacgcgatctctggtcatgaatattattaaaaatacacgctttacgttaatgaatcttgcgagtgcagatatgatcggcggtaaagtggaaatagaagctacgctttattatccgggcaaaagccaggaggcggatgtgtatgcggaaaaattaattggaagatgcagtgcctgttccggcataagcagagttggctgggaaaccgtataattccaatattgaaatatatattacattcaaagtgaggtgagaagaatggataccggaagtagaaatggcgaaaacccggacggaagaccccaaatgaacggaaggaacagatggttccggtttccgttctttgaaagatagtaaataagtacctttcgggttttggcttgcttcctaattgatcaggtaatatcttaaaggaggtatagaccaatggaaaaagtactaaatgcaaatcatatcagaaacaaaaaaacaaaaatccctgcggaactaatccggaaagaagaagtgaacgcaaggatgaaatacgccgcgtcagttggagaaagcgccttgctcaataaattgggaactacatctgacggaatcagtattgaactcgtatccaattcacgcgagcaatttggcgacaatacggtgcaacacggaaagaaagaatcacttgccagacgcttggcaaaggcatttttcaatccattcactttaatactgataggccttgcaatcgtttcgttttttatggatgtcatcatggcagaccctggggaagaagacccgatgaccgtgatcatcattgttattatggtgggtatttccggctctctccactttatccaggaaaccagaagtggaaacgcagccgagaacctattaaaaatgatccatttgtattgcttatcaatggcttcaccaaaggcaactggggcgaagcattgctttatgcgatttcgattgccgtaggcctgacgccggagatgcttcccatggtagtgacgacctgtcttgcaaaaggcgcagtggcgatgtcgaaagaaaaaaccattatcaagaatcttaacgccattcagaatcttggtgcacttgatattctttgcactgataaaacaggcacgctgacgcaggacaaggtcgttctggaatatcatttggatgttcacgggatggaagatatacgcgtgcttcgccacgccttcctgaacagttattttcagacagggctgaaaaacctgatggacaaggccattatccggtgcacaaaagaggctgcggaagctgacaaacagcttgacgccctgccgaccttctacacgaaggtcgatgagattccgtttgatttcgagcgccgccgtatgagcgttgttgtaaaggacatatatggaaaaacacagatgatcacgaaaggcgctgtggaagaaatgctttccatttgcagtcacgtggaatacgagggaagcgtgagtcctttgacgaaagaaatcaggaaatatattttaaaacaggtggacgccttgaacaatgacggaatgcgtgtcattgcagtggcgcaaaaaacgaatccttctccggtgggcgcattttcggtcgcggatgagggcgatatggttttgatcggttatctcgcatttctcgatccgcccaaggaatctactgcgaaagccctcaaagcgctcaaagagcatggggtggcggtgaaggttctgacaggcgataacgataaggtaacgcgctgtatctgcaagcaggtgggtatccatgctgatgaaatcctgctgggagaagagcttgacggcatgacggacgaacagttggcggataaggctcagcatgtcagcgtgtttgcgaagttgtcccccggccagaaatcacgtattatctccgccctgcgttctgcgggccattcggtcggctatatgggcgacggcattaacgatgcggctgctatgaaagcggcagacgccggaatctccgtagatacggcggtggacatcgccaaagaatccgcttcggtcgtattgttggaaaaagatttgatggtgctggaaaagggcatcgtggaggggcgaaaaacgtatgcaaatatgatcaaatatatcaaaatgacggcaagctctaactttggaaatatgttctcggttttgatcgcgagtgcattccttccgtttatccctatgatgtctatacaattgattttactgaatctgatctatgacttaagctgtaccgcaatcccgtgggataacgttgataaggattttctaaaaatcccgcgcaaatgggatgcgtcttctgttgggaagttcatgctatggatcgggccaacgagttcggtgttcgatatcaccacctatcttttgatgttcttcgtcatttgcccgatgatgtgcggcggcctttcattcagccagatcacggatcctgcaacacaggtgcttttcgtctcgattttccaggcgggatggtttgtcgaatccatgtggagccagacgcttgtaatccacatgatccgcacacccaaaatcccgttcgtccagagccgtgcttcggcatccttgacgctattgacttttgcaggcattgtggcgctgaccatcatcccgttcacttcattcgggcacacgatagggttgtcggcattgccgccggtgtattttgcgtggctcggcctgacgatcgcatgttatatggtattggcgacagtagcgaaaaaactctttgtaaggaaatatggtgaattattgtaacgcagccagcggaaaaaacagggcggttctgatctagtgggaaagtccgttgaaaattttaggaagttacctaaaaagtgatggagaagagcggtgtttctaccgctcttcttatttaaaaatttgctagatttcgtattgcatcctactgaaatatgctgcgaattttattgctaaaagcataaaacttgagcgataaagaagattgataaatttcgctgtataaaagaaaaaaccgctgttaagcggttttttagatggtgcggttgacgggacttgaacccgtacgtcatggacacacgcccctcaaacgtgcctgtctgccgattccagcacaaccgcataaatatcaaataaataatgaatcagcaagaaatattatagtataccttaaaagctaagtcaagcattccaaaagaaaaagagcggtatttttataccactctttgatatattattttttcttgtgacgcgccatgcgggagcctactttaggcatgctcggatcgcgcggcggctccatttttgaaggttcagtaggggaagaagcacggtttagatattgttcagagatttccgatgcttcggaaacatccgcagtgctctttttgtaccctttcggctgctgcgtatagcggctgacatctgaaagatcttcgctctttggctgttgtgtgtaacggctgatgtccgaaatatcataaccgcccggcttttggggatcggaacccgaggactgataaccttcgggctgctgcgtatagcggctgacatccgaaaggtcataaccgcttggctgctgggtataacggctgatgtccgcttgataccggtcgttgaattcttccatactgtttttgggcatttcgggtgaggacggatcagaagacggcccgacatgatcttcagggagaggcggtttaccaccatcaccattctgttttctccgtttgcggctctttaaaagaagaataacaatgattacaaccgctatgatcacagcgccgccgatcacataaaatacaaagttcggatcgttgtaatatgcattttgtatagtattgccaaggtcggtaaaaaaaccgccaactccggcaacgggagtagaagtaggctgcactgtaggctccggagagggcgcaacggatacagttggaaccgcgctcggcgagggggatgcaaccaccgtgccggccgtactgaatgtaagggaattcaatgtgttgagcgcctgattgagatagatatcggcactgtcgttcttatacatgatcgtaatacaaaagttggtattgttttgcgcgaccatatatattttggacgtgtaaccgttattttccgcgagccgtccggtaaacacaatagcagttttcccatttaaatcctcgaccgtatatgggtcaaagacataatctgcgccaaattcagcctgcttttgctgaacaagatactgtatttgctcgctgtctaacatagaaaagtccgtaacattaagaatactaaggctatccgtgggtgcagccgatacggaagaatcgcttgttgcgcccggagtcggcgttgcggcactgatggaaagagggatctcagtaatatccaaagagtaggagagagaattatcggcagcatatgaagtgatcatgagggctaggttttcgttctggttttgtatggacgcaagaagttcatccgacatattggtgctgccgggcgtataataataaacgccggtatcggccggtatctccatgctgaaatcccctgcgggatcgctatagggaagcgcaaacgcgcaaaccggaaccataagcatcatgataagcgccataaaaacgacaaatttcttcaaaacagtgcctcctgtttgcataatttccaaaagaatctgatacctattatagtataatcaacacctgttttcaattgctcacaggttttttctgctgcgtttttcgtattgcaaaaacctgttgtcgaaatctttggtctgggagacaatcacgcctgaaaggacgagcaggcaaatcaagttggggatcgccataaggccgttcgcggtatcggaaaaatcccatacaaccttgagcgtcgtgaccgcgccaataaaaacgacagccgcgaaaacaatgcggtagatatattttgccttcatggaagggatgaggaattccaaacttttctcgccataataactccagccgaggatagtggaaaaagcaaaaaggatgagtccgatcgtgatgacccagcttcccacaggccccatgacgctgtcaaaggcaagaatcgtcaatgatgcgcccgtgagcagttcgccgctttcggcaagcgtcccaagaacgccggacgacgcaatggcgaggcccgttaaggtacaaacgatgatggtatcgaaaaaagtccccgtcatattgatataaccctgacggcacggatggtcagtcttggctgccgccgccgcgatgggcgcgctgcccaggcccgcttcatttgaaaatacgccgcgcgcaacgccaaagcgcagggcggtggcaaaggtaaagcctgccacgccgccgaggatggagcggggcgcgaacgcgctttgcatgatctgtgaaaaaccggcggggacgttttcaatattcgaaataataatgatcaggcatccgactgcgtaaaaaacagccataacggggacgatcttggaagaaacgttgcctatggatttgataccgcccaaaagcacgataccgaccaaaacggcgatcacgatgcctgtgatccatgtgggcacggaaaatgtattggagacggcttcggcaatggaattgatctgtgtcaggttgccgatgccgaaggaagcgacgaccgcgaacacagcaaacgcaacggacaggagggtgcccagccattttattttgaagccatttttgatggagaacataggaccgccggacatttcgcccttggcgtttttttcacggtaatagacagccaagacagattcgccgtatttggtggcaaggccgaacacggcggatacccacatccagaaaagcgcgcccgggccgcccagggtcatcgctgtggcaacgcctacgatgtttcctgtgccgatcgttgcggcaagcgcggtcatcagggactggaaaggcgagatatcgccgctatcggaattatctgttttgctgatgctgtgtttggaaaacacctgccggagcgcatagcccaaattccgcagggggcggaaccgcaagcgtatcatcaggaaaacaccggtgcccactaaaagtatgagcatgacaggcccccaaacaaaatcattgatatttcccagaatttcagaaaacgtcataaaaactccccacatgtgatttttttgacctaaatatggattcattctacaacataaggcttttttctgtcaattttaccaccttgacaggaatcaggcgatgcggtatgataaattcaaagtgaatgaagtcttcggggcagggtgagaatccctaccggcagtacagcctgcgaactcctgttatcaggagccgatgcggtggaattccgcagccgacagttatagtctggatgagagaagaagaatattgtgatcaatatgatttccggggatgcttgcattcgcggaaattttttattggagggtttctgtatggaaacattggcaaaaaggaacaaggtgacaaaaacccagtacatttccagagtcgcgattcttgcggcgatcgcatttgtgctcatgtatgtggaactgccgctcccgatcattccgccgtggctgaagctggatttttctgaaataccggtgctgcttggtgcgtttgcgctggggcctgtggccggtattatcatccagggtatcaaatgcctgctatttttgttgatacgcggcagcatgtcgggcggcgtgggggaactcgcgaatttcctgatcggcgtagcgttcgtcgtggtcgccgccattatttacaagaaaaaacataccttcaaatttgcgatcatcggtacggtcatcggcattgtggcggcgacggtcgtggcggggatactgaattattatgttttgattcccttttacgcaaatacagggctcatgccgatggacgcgatcatcgcggcgtgcaaggcgatcaatccggcggcagattcgctgcttgggtatgtcctcatctttgcaatgcccttgacagccgtaaagctagcgatcgacgctgtggtcgttttccttctatacaaaaaattggcgcgctttttgcataattagcgtttggcatggtgcagggaaagtaatgcatccctacaaggatgcttgacatatcattattttaaaagtgaatgaagtcttcggggcggggtgaaaatccctaccggcagtacagcctgcgaactcctgctatcaggagccgatgcggtgggattccgcagccgacagttatagtctggatgagagaagaaaagtattgtgatcaatatgatttccggggatgcttgcattcacggaaattttttattggaggtacttattcatgaaaacactggaaaaccaaaacaaacccaaactcacaacacggaacataacgtcgatcgccgtcatggcggcgctttcgatcgttcttgtatatctggtgcgcatcccaatgttcctgccgttcctggaatatgatccggcagatataccgatttttattacggcctttgcctttggcccgggtatcggatttatgcttaccgtgatcgtatctgttttgcaggggttaacggtgagcgcgtcctcgggcatcatagggattgtgatgcatattctggcaaccggctcgtttgtgctgatagccggaaatatctacaaacgaaacaaaacgaggaaaaacgctgttgcggcactgatcgcgggagtgggggtctggacagcaatgatggtcctttggaatatcattataacgccgcttttcatgggcgttccacgtgagcaggtattgacgctcatcgttccggcaatcctgccctttaacctgatcaaggcggggatcaacgcaaccgtgacattcgcgctctataagtcggtgggcaaactgttccgtatacccgaggctcctgcagtcaggaaaaagcactgtgcaaatgaggaataactgttttggcacaaagaaaacgttgcgcttcttgcataatcagcatttttactatatgatataaagagtatttttgatatgtaatataaggatagaaatgcgctcatgcaggagttctttagcgatagcgaacaaagtacaaaagattttgcaaaaaagctggcttcccgtttggtaaaaggcagctttcttgccgtttatggagatttgggcgcgggaaaaacagcctttgtaaaggggctggccgaaggccttgccgtccgtgagccggtcgtgagcccgacgtttaccatcctgcgcgcatacgagagcggaagtatgccactgtaccactttgacgtgtaccgtattgcggacgaggacgagctttttgagatcggattcgacgaatatgcgtcgggagacggcgtatgcgtatgcgagtgggcggacctcataccggacgccctgccgcaggagcggctcgatatcaggctggaacgcctaagcgaggataagcgcaggatcacggtcgaagaggtggcgttatgaacatacttggcatggataccacaggcacgacgcttagcgttgccgttagcgaggatgaaagattgctttcggaaatttatatcgatgcaggaaaaaaacattcccagacactgatggtcgccgtggatgacgccctgcgggtggcgggaaaggatgtttcagatatcgacgtctttggggtatgcgtagggccggggtcttttacggggatccgtatcggcgtggcggcgtgtgcggcgatggcgcatgcggtaaagaaacctgttgcggcgatcagtacgcttgatgcgttgatggaaaacgcacgcggggacgaaccggtcgtgtgcgccgttatggatgcgcgcagggaagaggtttacacggccgcaaaacgcgaaggcaaatatatcgtcgaagaatgtgccgtgccgttaaaaacgttggttacagaactattgccgcaggaacggatcgtgtttgcgggagacgcggcgctgagatttgaggataaaatacgggacttaaatcccctgagcagctttttgccgccgcagttcattatgcagcgcgcttcctccgtatgcgcgctggcctatggaaaagcgaaggacggcgcattggtgcaatatgacgaagtaatgccgcattacctgcgggatagtcaggcggaaagattgaggaaagaaaacattggcaaatagcgatattgcaatacgccgcgcggagattggggatctggaacagatccattattgcgaaaatacgagttttgagcttccgtggtcgtatgcgatgctgtatgacgacattatagaaaatgagaataccgtatacctggtcgtggagtatgaagaccggatcatcggttatggcgggatgtggatcatctttgacgaggcgcacatcacgaatgtatgtatattgccggaatatcatcacaggggatacgcatatgcgttgatgaaagcgttgatcagcacggcaaaggagcacggtgcggacgcaatgtcgcttgaagtacgcgtatcgaacaaagcggcacttaagctttataaaaaatgtggatttagcattcacggtatccgcaagcgttattattccaacaacggtgaggatgcatatgtgatgtggacggaacgcggcccggggctggaggggctttgagatgttttcagaattagacggtcttaaaatccattatgaaatcgagggagtggggaaagatatcctgcttttgcacggttggggcgcgcagatcgagagttttgcaccggtgatcaatgccctgaaagcgcgcaggcgcgtgatcgcgttggattttccgggattcgggcagagcgacgttccagcgaaggatatgaccgtttacgattatgcggaactgaccgcaaaatggatgcgcgaaacggggcttggaaaaacggatatcatctgccattcgttcggcgggcgtgtaacgatgctgattgcggccaaatatccggagctcgtcggcaagatcgcctttgtggacgctgcgggcgtaaaacccaaacgcggcgcaaaatattacgcaaaggtgtatacgtataaattgtgtaaaaagatcgcagggaagcagggcatgaaaaaagccgctatgtttttcggcgtggatgtggataaacgagtcaaaaatgcggggagcgacgactataaaaacctgccggactgcatgaaaaagacgtttgtcaatgtggtcaacgaagacctcacgccatatttaaaggatatcaaatcgccgtcgcttttgatctatggcgaaaacgatacggatacgccgctttatatggcgaagatcatggaaaaggaaatcgccgatgcggggctggtcgtgctgaaaaatgcgggacatttttcatatctggatcagttcggacaatttatggcggtcatcaacagcttttttaaagaataaacggggtaggataaatggatgcagtatatatgacctgggtaatgatttcgacatacgtcgtatttggctcgattattgcgggcgcggtgctctctatgatcgcgcagttgcgttacatccatgtaatgcagctcgaaagttaccagaacgaaggattttcgcactggctgaaagcaaaccgcaagaaagtattgctgcttccgttgatcgcgggctggagcgcgctcgtaggatattatttctggtcgctccttgctacggcggggcaggcgaatatcggctttttcgttgcgttcctcgcctgctacggcgttgccgttttcctgacgatactgcatattttacaggcaagacaaaaggaagcgaaaaaaccgcttgtgtttacggcaagggtgaagcggctgatcgtatgtgagatcattttatacgtcgctttttattgcttgatcgtatttgtaccatatgttaatttcttcctgccgcctttcgggtaccttatattcatgatactggtaccgttcatgacgccgcttgccaataagatcatgacgcccatcgaaaacagcgtaaaaaagaagtttttgaatgaggcgaaacgtaaaatcgaggcgcgcggagacctcgtgaaaataggcattacgggaagctacggcaaaacgagcgtcaaattcattctgggaacgattttaaaacagaaatataatacgcttgtgccgccgcagagttataatacgccgatgggcctcacgcgcgtgatccgcgagcagatgacggacgacaatgaagtgttcatcgcggaaatgggcgcgcgccacgttggggacatcgcggaactggttgaccttgtacatccgcagatggggatgttgacgtccatcgggccgcagcatcttgagactttccacagcattgagaatatcgcaaaaacgaaatacgagctcatcgcggggctccccagggatacgggcgtagcgtttttcaacggcgataatgagatatgccgtgcgctttatgaaaatacggagatccataagaagattttgtatgcgatggattatgatgggaaagcggacgtacgcgcaaaggacatcacgtttgccgcgcagggcagtacgtttacagtggagacgccgcagggcgagtttgcctgcacgacgaagcttttgggcagacataacatccttaatatttgtgggtgtatcgcaatcgcgctggagcttggattgagcgtggaagaaatacagcagggcgttctggacgcgccgagcgtagagcacaggctgcagatcgtgcctaccaataacggtattaccgtgatcgacgacgctttcaattccaatccggcaggaacgcgcgcggcgctcgaagtgcttaaatgctttgaggggcagcgattcatcgtaacgccgggcatggtggaactgggggaacgcgaggcgcaggagaattatgagtttggcgaagcgatggcgtccgtagtcacatatgcgtttttgatcggcccaaagcatacgcatccgatctatgaagggcttgtgcgcagcgggtttccgaaggataatatttatgtggcgaaaacgctcagcgaagcgacgagcgttatggggcacctgacgaagcagggcgacgtgattttgtttgaaaatgacttgcccgaccattataatgaatagggagcgtcgcaaggtgaatttgtccaaaggacaaggagagcgcgccctggggtgtccgaacctgtagttcggctaacgacgccccggcaagacatggcaggcacggtagctatatgaagtataaaatttactgagaggtaatcaatatatgaaaaaaaacatggcggtgtttttcggaggcagaagcgtcgagcatgacgtttccatcatcaccggaaaccagatcatcgaaaatgcagacaaggaaaaatacgatgtgttccccgtgtatattgcgcgggacggacaatggttttgcggcgatccgctgcgtgatacgcagtattttggggagttcgatccgaatgataaaaagctgacaaaagtatatttggaaccgcacccgacaaaggaactgaagtatgcggcgaagttcggcacaaaggtatatgcgcagatcgacgtagcgatgctggcgatgcacgggatgcacggcgaggacggcacgctgcaggggctcatggagcttgcggatattccgtattccagcgcgggcgtaacgggaagcgccacaggtatggacaagatcgtcatgaagtgcgcgtttaaaggcgcgggacttccggtcctgccggccgtccattttgagcgcagcgcatttaaaaacgacagacaggccgtgatcaaaaagacggaagaggagatcggctatccggtttttgtaaagcctgcgaacctcggttcttccatcggtatttccaaggcaaccaatgcgcaggaactcgaaaatgcgtttgaggtagcattttcttacgacaggcgcgtccttgcggaacatgcggtggaaaacctggtggagatcaacagcgcggtgcttgggtacggcggggatgttacagtgagtcttttagagcagccgatctcgtggcagggatttttgaacttcgaagaaaagtacctgcgcagcgagggcgcttccaagggcatgaagtcgctggcgcgccagattcccgcgcccattgaaaaagggcagacggacaagatcgtcgaaatgtcgaaggaagtattttcaacgcttgatttgaagggcgtcgtgcgcatcgattatatcattgataaggattcgaacgaaatttatgtgaatgaagtcaatacgatcccggggtcgcttgcatattacctgtacgagccgatggggatcccttttaggcagctcatcgacgaatgcgtaaaatgcgcggaagcgcagatgcgcgataagcacgataacagctatgcgttcgattccaatattttggataaaatgaagcgcggcggtatcaaaggaatcaagaaataactgccatggcggttttaaggatggacacgcagacaggaggaaaaagcgatgcagaaaattaaaatgaccgtgcctctcgtagagatggacggcgatgaaatgacgagaatcatttgggacatgatcaaaaaggacctgcttaccccatatatcgacctgaaaacggagtattacgatcttgggcttccctatagggatgagacaggagaccaggtaacgtatgatgcggcaaatgcgatcaagaaatacggcgtgggggtgaagtgtgcgacgatcacgcccaacgcgcaacgagtagaagaatacaagctgaaagaaatgtataagagccctaacggtacgatccgtgcgatccttgacgggacggtgttccgcgcacccatcgtcgtggacggcatttccccttctgtcaagacgtggaaaaaacctattaccattgcgcgtcacgcatatggcgacgtttaccgcaacacggaataccgcgtacctgcgaatacgaaatttgaaatggtatttgagacaggcggcaaagaaacgcggctgcctgtgtttgagtatgagggcggcggcgttgcacagggaatgtacaatacggacaaatccatcagcagctttgcgcgcagttgctttaactatgcgatcgatacaaagcaggatctctggtttgcgacgaaggacacgatctctaaaatatacgaccatacgttcaaggatattttccaggaaatttacgacggcgaatataaagagaaattcgaaaagctggggatcgagtatttttatacgctgatcgacgatgcggtggcacgtgtgatccgttcggaaggaggatacatctgggcatgcaagaattatgacggcgatgtgatgagcgacatggtggcaacggcattcggcagtcttgcgatgatgacgtctgtgctggtatcgccggacgggaattatgaatatgaagcggcgcacggaacggtaacgcgccattattataagcatcttgacggggaagaaacgtccacgaattctatggcgacgatctttgcgtggtcgggcgctcttaaaaaacgcggcgagctggacggcaatcaggaactggaatcctttggcgacgcgcttgagcgggcgtctatccgtacgatcgaggaaggcgtcatgacaaaggatttagcgcttttgtgggagaagcaggaaaaaaccgtcgtcaatacggaaggcttcatcaaagaagtggcgaagagactggataaggagttgaggggataatatgaaactgtatgaacaatggcagcagcttgcgcagatggcgcagacgccgcagcagcaacaggcattctgggacgattattttgcggtggaaacgcaagtatatcaaaaaattttggcagataccggtactgtttatgagggaacgctcaaagaggtcgcagataagtttgatatggatccggtcgtgttctgcggttttatggacgggatcaataccagcctgaaaaaggaaatagacgttgaaaaattggaggaagattcccgcgtcaaactggatattgattttgagaaacttttttacaacatgaatgatgcgaaagcaaaatggttatatacgttgcaggaatgggacggcgtgctttcgcaggagaaacgcgacgacatcacgcgggagtggcgcaaggcgggacaggcaaagagcgaaaagaccgtgggcaggaacgatccgtgcccgtgcggaagcggtaaaaagtataaaaagtgctgcgggaaataacagcgcgggggcttctcttttttaatgcctaaggagatgaacaaagtgaagtatttcaaagttccaaacacgaatcttgaagtatccaatgtcgtcatggggtgcatgcacctaacggagcttagcaagacggacgcacgcaaactcattgaaacggcgctcggccaggggatcaatttttttgaccatgccgatatgtatgacggcggcgcatgcgaaacgatgttttcggatgcgatcgaaatgaatgatgataagcgcgaacagatgatcatccagagcaaatgcggcattgtgaaatgcgagggagactgggtatattacgatttttcgaggaagcatattttagaggccgtcaagggcagcctcaaacgcttgaaaacagactatctggacgttttgctgctgcacaggccggatgcgctcatgcagccggacgagattgcggaggcgttcgattacttgcattccaaagggatggtgcgctatttcggtgtttccaatcagaacccgatgcagatgcaactgatccggagatcggtaaagcaaaaacttgtatttaaccagctccagttgagccttgcgcatacgccgatgatcgacgcgggtatgtccgtcaatatgaaacttgaccagagcacggacagggatggaaacatcctcgagtattgcagactgaacgatgtgacggtgcaggcgtggtcgccgttccagaaaggcttttttgaagggccgtttttgggggatatggaaaactatgcggagctaaatcgcgtggtggatcgcttggctaaaaagtacggcgtgcccgatacggcgatcgccgtggcgtggatcacgtgccatccggccaatatgcaggtgatcaccggaacgacaaaacccgcacgattaagcgactgctgtaaaggatcgcaggtcccgctaacaaaacgggaatggtacgagctttataaggcggcggggaacatgattccataagaagaaatagaaggactctgcgtatgtgcgcggagagatatcatatggtacgaatgtttgaaacggcatcgcgggaaaccgctgtgccgtttcttcgtttggtaagcatcagcgcatgctttcgggtttgcgtcttgtttttttacgtatgtcaagtaagcggccgtatgtaaagtttatgaaaaaacctatacttttagcagggataactatataataatagtaagcaatcaagcgatggagaatggcctatgaaaaggggaagcggggttctattacatatcacatccttaccgtctccgtatgggatcggcacgcttggaaaagcggcgtacgactttgtggacgccctttgtgaggcaaaacagtcgtactggcagatgctgccaacgccgcctaccggttatgcggacagcccataccaggggcttagcgcgtttgccaataatccctattttatcgatcttgatttattgatggaagagggtcttctcaaaagggaggacgttgcgccgcttgtgacggaggagcagggggcagcccttttcaaaaaccaacttacctataaagatgatatcctgaaaaaagcctaccgcaacggatacgaaaaatataaagacgagtttacgggttataaatatgagaatgcaagctggttgtttgattattctctctttgccgtattccgaaagcagtttggttctaagggctattttgactgggatgaacgcgcaagttaccgcgaccaggccactgtcatgaagctggcgcaggaacacgaagaagagattgaatccgtaaggtttgcgcagtttttatttgaaaagcaatggcatgctttaaaaaaatatgcgaacgggaaggggatcagcctgatcggcgatataccaatctatgtttcgccggattcggcggagacatgggcgcatccggagttgtttatgccggatgacatggtggccggtacgccgcccgactgtttcaacaagcgagggcagttttgggaaaatccactttatgactgggagtatatgaaagaacacggctttgcatggtgggtcgagcgcgtgaaaaggtgttttgcgttttttgatattatccgcatcgatcattttcgcggttttgagtcgttttatgcgatcccgaaggataaaaagcccaaagacgggcattggatgaaagggccggggcacgatttgtttgcagcgatcaaacgcgaaataccctgtccggcgatcattgcggaagatctgggacatattacgcaggaagtacgtgactttttggggcaatgcgggttcccgggcaataaggtgcttcagtttgcctttgatacacaggataatgaatatctgccgcataattatccgcatcattgcgtggtatacacggggacgcacgacaatgatacgacaaaaggatggttttcccatctggatgaacaaagtaaggcgaggttgtttgcctatcttgggcacgaatgcagcaaaagtgaggcggcggaagagctcatgcgtcttgcgatgatgagcgttgccgatatctgcatcataccgatgcaggatgttttgaaccttggaacgtccgcgcgtatgaattatccggggcgcgcgctcgggtattggaaatggcgcatgaagcaggaggcgttcacggcggagcggatcgagtggctgcgcacgataacagaaatttatgggagaacggggtgttgacatgaagaagatactgacagccgggcttgccgcgctggtgctcgtgcttgcgttgcagggcgcgtgctttgccgcggaggcgccaaatgatgcgaaggctccgctggtcgaagccgcggaggaactgctccagaagatcgaaacgggggatgtcggcgccgtcagggcattgttcacggacgaagcggcggaactggtcacggatgaggtcgtacagcagttgaacgaatatttcaacgggcaggtcgaaagcgcggaagtaacagacatttccatcgacacgaccaattctgccgatacgggcacgcagatcatcaagcggagcgcaaccatcaaggtcgttacagatgcggacgaatatatcgtagcgatccagcaggaacaaaaaaatggcggcgcgtggaagaccgggacgttcaatattgtaagcgctgccgattatgcggcggcaacggcggtcgatgaagcgcggacggctgtgccgcagggcattatgatcgccgtgaccatcgcgttttatgcggtgatcgcatgggcggtcgtctggtgcatccgtgcaaagatcaagctgaaatggctgtggatcatcgttatcgccctgctgacgatcgcagtgacggtttcagggaacgggacgaatgtaaacacgaacgtgcagttcggcgtgtatatcgcaacgttctcgaacgcgatctatttgatgaacggcgcataccagctgcgtgtggtgtttccggtcggggcgatcctgtttttggccctgaaaaagatgctcgaaaaaaattacgcaaaggcgcagcagcgccagttaggcgagatgcgcgccgcggcgcaggccatggaggccccggacgacggggcgggtacggagccgcagaaggaagaagatcgatccgaaggattgaaataaaattgaagtatggaggaacaaaaaatgaaaatagattttaataacatgctggcgaagaatgtgggcaaacacgggcttacggatgagcatattgcaaaaatgagcgggaaaatccagatggtacaccgcaacatgaatgagaaaaaggcttcgatggcatggcgggcgctgccgtataaccaaaaagagatcgcagaggatatgaaagcggaagcaaaacgtatcaacgcggattttgacaactttgtcgttctggggatcggcggcagcgcgcttggctccaaagcattgtttacgggtaccaagcatttgaagtacaatgagatcccgcgcgagaagcgcggcggcgcaaggttttatgtagtggacaatgtagatccggacggtatcaatgccttgcttgatgtgatcgacattaaaaagacgtgtttccatgtcatcacgaaaagcgggaatacggtagagacgatgtcccagtttatgatcgtgctcgcaaagctgaaagaagagcttggcgaaggctttaaggataatatcgtgatcaccacggacaaggaaaacgggatcatgaaaaagatagcggaccaatatgggtttaagacgtataccgtaccggacggcgtgggcggacgtttttccgtgttgtgtccggtcggccttttgtccgcagccgtgctgaatatcgacatcgacgcgctgctcggcggcgcagcggcgatggatcaggcatgtaccaaagaaaacgtgtgggaaaatccggcgtatatgtatgcgctgctgtattgcgcggcgatggaaaacggcgtgaatatttccgtgatgatgccatatgcggacgggttgctcaacatggcggaatggtatgcgcagctttgggcggaatctttgggtaagcattatggcaatgacggcaaagaagtctatacggggcaaacgcctgtgcgggcgctgggcgttacggaccagcattcgcaggtacagctttatacggaaggaccgtttgataagataatcgcttttgtggatgtggaggatttcaatacgcagcttacgatccccactgcgccgatcgacgtgatggacgctgcatatttgcagggacagacggttaataagctgatcgcatccgagatgcgcgcgacacagtatgccgttacgaaatcaggaaagatgaatatgcgtatcacgctttccaagctggacgcatggaatatcggggcgatgttcttcctgctggaaatggctacggcagcggcgggagagttccttgaaatcaacgcatttgaccagccgggcgtagaggaaggcaaaatcgcgacctttgccctgatgggacgcgaaggatacgagaaaaaggcggaggagttgaatcaggcttcaagcagggacgaccagtttatctataacgtgtaagaacgttatgcttttaagaccgcagccgtgatgtggtgtttgcttccgatgcctttgcaagcgtagcgcgcaggctcggaaggcaaatagccatctaaagtttgcggcatgggagcacagtggcgcgtggcaacgagaacgggaaggtggatatatgcacaaggcatgggaaaaatatttgccggaacatgaaatatatttgtttaataccggcgaagcgcaaagagcatatgatttttttggatgccattacatagaagcgctgaagatgcaccgcttttgcgtatgggcgccgaatgcacgggctttgagcgtggtcggggattttaacgagtgggatatcgaagcaacgccgatggagctttataaaaacggcgtatgggtagcttttgttcccggacttaaggatggcgagaattacaagtatgcggtttttggctacgacggcagccgtgtgctcaaaggcgacccgttcgcattccattgtgaggtgcggccgcaaactgcgtctaaggtatgggatatcggcgggtacgaatggcacgattcccagtacatgcgcaaacgtgtcaaaaaaaatcctttacatgacgcggtctcgatttatgagcttcatcttggttcatggcgtaccaaagagggataccgttttccgagttttcgtgaaacagcggatgagttggcggattatgtatccgacatgggctatacgcatgtggaaatcatgccggtagcggaatatccgtatgacggttcgtggggctaccagatcacagcgttttatgcggttacttcacgctatggaacgccgcaggatttcatgtattttgtggataaactgcacgcgcgcggtatcggcgtgatcatggactgggtaccggggcactttcccaaggacgaacatggcctggcgaagttcgacgggacgcacctgtatgaacatgagaacattttgcagcgcgagcatccgcagtggggaacgctgatcttcaattatggcaggctggaggtcgtcagcttccttgtctccaatgcgatgtttttcatggataaatatcatatcgacggactgcgcgtggatgcggtcacatccatgctgtatttgaattatgcgcgcgacggctattttgtaccaaatgaggaaggcggcaatatagatttgcatgcggtcgcgttcctaaagaaggtcaacagtgtcgtgctgaccaattatgcgggcgcaatgaccatagcggaagaaagcacggcgtacccgatgatcaccaggccgccctacgacggcgggctgggctttacatttaaatggaatatggggtttatgcacgatacgcttgcatatatggaaatggatcattatttccggcagttcgaacacagtaaaatgagtttttctatgtattacgcattcacggaaaattatatcctcgcttattcgcatgatgaagtcgtgcacggaaaaaagtccatgatcgataaaatgttcggcgattactggcagaagtttgccgcgctcaggacgctttatgcgtttatgtttgcgcacccgggcaagaagctgatgtttatgggggacgaatttgcgcagttcatcgagtgggattataagaagcagcttgattggttcctgctggattacgattcccatgcgggcatgcagcaatatgtgaaaaagctgaatagcatctacaagaagaaaaacgctctttatgagatcgacgatagctgggacggcttcacatggctcaatgtggacgataatgaaaaaagcgtctatgcctttatgcgtaacgcgggtgataaacatatcgtgtgcattgcaaactttacgcctgtcgtgcgtgaagattactgggtcgcgctgccgcaatgcggagaacttaagctgttacttaatagcgacgataagatatacggcgggagcggcgttacgggcattaaaaaatgcgccgcgcagaaaaaagggatgaacggttttgaatatagtgcggtcgtgacggcgccgccgcttggcgcgctctattacgaatttactgcaaatgaaggggaaaaggggatgacgcgacatgattaaaaagaaaaaagtagttgcaatgcttctggccggaggccagggcagccggctgggggtacttacaaagcacagggccaagccagcggtaacatatgggggaaaataccgcatcatcgactttccgctctcgaattgtatacattcaggtatcgatacggtaggcgtactgacacagtacgaaccccttgaattaaacgcatacattggtacgggcgcatcgtgggatcttgacagtatgacgggcggcgcgttcgtcctgccgccgtacgtaaaaggggaacgcggcgaatggtattccggtacggcgaacgcgatctaccagaatatctactttatagaacgttatgatccggattatatcgtcgtgctctcgggcgaccacatctataagatggactacagccagatgatcaccttccatgaggaaaacggcgcggacgctacgatcgcggtcatcgaggtacccattgaggaagcctcgcggtttgggatcatgaacacggacgaagacctgcggattctggaattcgaggaaaaaccaagaaagccgaagagcaacatggcctccatgggcgtttatgtatttagctggaaaaaggtgaaggattaccttgtggcggactccaaggatgaaaaatcctccaacgactttgggaaaaacatcattcccaagatgcttcatgcgggcgagaagctgtacgcctatccctttaagggatactggaaggacgtggggacgatcacctccctctgggaagcgaacatggagctgctgcacgataatccggagcttgacctctacgacgatccgtggcgtattttttcacgcaatccaaataagccgccgcattttgtggacaagggggctaagatcaaaaacagcctgatttccgaaggctgctatatctacggcacggtggaaaacagtatcttgtcggctggcgttaccattgaaaaaggcgcggtcgtaagagacagcatcatcatgcaggatactgtggtcggcgagaaaagcaaggtcatcatgagcatcgtggatgaagaagtgaaaattgagcgctgtgcatgcgttggcggcggaggagacattgccgtgatcggtacgaaagcggtgatccgcgcgggcgctgcggtagaggcaggggagagcgtgcccgccaagcgtgttataaaaaatactacaggaggtgacgcggaatgttaagggatacatttggcctcatatatgcgggggaacaaaatatcaatctgcgcgagctcgtatacctgcgcacggtcggcgcgcttccggtaggaggccggtaccgcgcgatcgattttatattatccaatatggtaaactcgggtatccgtaacgtaggcgtgatcgcccagcgcagttaccattcactgatggatcatttgggaagtggcaaagaatgggatctttcccgcaaaaacgacgggttgtttatcctgccgccgttttccagcgcggaaaatatgggctcttaccgtgggattgtggatgcgatcaagggcgtgatgagttatatctcacgttccaagcagcagtactgcgtgttctccggttcgtttacgatttataatatggcgtttgacgatatggtgcgctaccatctggatacgggcgcggatattacgatgctgtataatgaagaggattcggaagacttcaaaggagagcggtataacgacgtgcggctgcacttaagcgacgaggggcggcttatagaccttgagatcaatgcggcgctcagcgattccaaaaaggttgggatggatacgtacgtgatccgcaaggacctgctggaatatctggtggaggactgcatgtcgcgcgggaaatacaattttgtaagcgacctgttgatgaacaatttgaaccgtatcaagatcatgggttataaacacaacggatatgtgggaaggctgcattccgtcgcttcgtattataagctgaatatggactttctggataccgacgtccaaaaggatcttttttacggcgacaaccagatatacacgaagatcaaggacgaggtgcctgcgaaatatgccaagacctccaatgtaaaaaattctttggttgccaacggctgtattatcgagggcgaagtggaaaacagcgtcctgttccgcggggtatacgtcggaaagggaacaaagatcaaaaacagtatcgtcatgcagaacagtgagatatacaataattcggaccttgaatatgtcatactggataaatccgttaacatccgccaggggcggcgcttgatcggtgacgaggtgtttccggtcatcatacggaaaggggcgatcgtgtgagcagaccaaaagtactgatcgtaggggcggaggcgacgccgtttgcaaaaacggggggactggctgacgtgatcggcgcattgccgcgcgctcttgtgggtcaggatgtggaagtacgggtggttctgcccaaacatggtatcatcaagcaaaattatggggatgaactgaaggtcatcgcggcgatgaacatccgcatgggctggcgcagcctgtacatgggggtcgaaacgcttcagagggatggcatcacctattatttcatcgacaatgaatactattttggcgattgtatttacaagggcggccaggccgaggccgagcagtatgcttatttttgccgagcggtcttagaagcgctcccatatctcgattttatgccggatgtgatccattgcaatgactggcatacggcaatgatcccgtttttgttaaagacgcagtaccaggatacgccgcagggcaaggcgaaaagcatactgacgatccacaacctgcagtatcaggggcagatatcttttgacttggcgcgagatatattgcaggtagatgataaatattttacatcggaatacctggaagcatacggcagtgccaacatgatgaaagcggggcttttgtttgcggataaaattacgacggtcagcccaacctatgcgcgggaaatacttgacccgtactatggccgcggtatggaaggcatcttaggtattcgcaaggatgacctggtaggtatattgaacggtattgataccagggaatttgacccggaacatgacccgtatatcgaaacgaaatattccaaggatgatatgacggggaaatatgaggacaggaacgcgctgctcagcgagcttgacgtccacgtgggacctgggacgccagtgatcggcatggtgacgcggcttacggaacagaagggactggatcttgtccgcgcggtgctcgaggagatattgttcgaaaacgtggcgtttgtccttttggggagcggcgatacgcaatatgaaaattattttaaatatattgcgggacgctaccctgataaaacggcgatttgccttggctacagcgactcgcttgcacacaggatttatgcgggaagcgactttttactgatgccgtctatgtttgaaccgtgcggtatttcgcagatgatagcacagcgctatgggacgctgcccatcgtgcgcgagacaggcggtcttgtggatacagtacagccttacaatatttattcgcaggagggcaatggattttcattttccaattataatgcacacgatatgctgaatgtaatcagatttgcgcttactgttcatgaagataagcctgcgcttgcgaaattgataaaatccgctatggaagtggacaatagtttttcaaaatccgcaggggaatatgctcagttatacaggagccttttataacggacatggagggatacggtcacttgatggaagataagaaagaagcgatccagcagattgccgaagagatcgacgaacaggatacggggatcacggaggaaacgatagacgagtcaagtcacgtggacgattatacggtgccgcaggcagagggttcggcgccggaagaagagccggaggaggaacaggacgtttttgcggtgctggatatcaatctgccgaagccggaaaaggagcaggaggaaatcctgtgcagtgagtttgaacgctatgatacgaaagacgaataacgcatttttgccgccttaccatagggcggcaaatctttgtgggaaggctggagggctgtatgagacgtgaattatcaaaagcggatatcaaagaagaaatactgggaaaattgaaacggcattttggtaaaacgctggaggaagcgaccaaggatcagatctataaatcctgcgcgctttcgatacgggacagtatcgtggagcaatggacggatgcgaacaagcagatgctgaaccaggggctgaagcggctgtattatttatccgccgaatttctgatgggccgcgcgcttgtcaataatatggtaaatctgcaccttctgaaggaatatagtgacgtgctgtgtgaaatggggcttagcctcgacgagatcgaggagcaggaacgcgatgcggggcttggaaacggtggtctcgggcggcttgcggcctgttttctggattcgctttccacgctcgacctgcctgtgacagggtgcagtatccgttatgaatacggcttgtttaaacagcgtattttagacggcgaacaggtggaggtggacgacaactggctggaagcaggcaacgtttgggaaattccgcgtccggaagagcaggtggaggtccgttttggcggagaaatcgaggaaatatggacggacggcgggctaaagatacattacaaaaacagctacagcgtgctggcgatcccctacgattatccggtgatcggttacatgagtaagatgccggcaacgctccggctgtggagcgcaaaagcaaaaacaggtctcgatatgcaatatttcaaccgcggggattacgcgcaggctatgcaggagcgcgaacttgcggaagtgatatccaaagtattgtatccggaggataaccacgagcagggacggcagctccggctaaagcagttttatttctttacgtcggcgacaatgcagcatatggtgcacaaacataagcagaattacggcgacctgcacactctgcccaattatttcacggtacagatcaacgatacgcacccgaccctggcgattccggaactcatgcgcatcctgatggatgaggaaggcatgggatgggacgaagcgatggacatcgtttcgcgcatattcaattatacgaaccatacggtcctagtggaagggatggaatgctggaacgaggagctgtttaaaacgctgctgccgcgtatttaccagatcatacagatattgaacgagaagttctgcgaccatctttggcaggtataccctgggcaatgggacaagatcagcagtatggcgattattgcgtataacgagatacgcatggcaaacctgtgcatcgctgtgtgcagcaaagtgaacggggtttccgtattgcacggcgagatactcaaaacgcgcacgttccgtgatttttatacggtgtttccggataagttcctcgggatcacgaacggcgttacgcaccgcagatggcttgcaaaggccaaccagccgttgacggagctgatcgccgaccatatcggcgacggcttcttaaaggattaccgcgaaatggaccgcatagaggacctgacgcgcgatccgaagttcctggatgactttatgtatgtcaaaaagcaaaataaggagcggcttacggcatatctcaaaaagacacagcgtattgagatcgatccaaacacgctgttcgacgtacacgcaaagcggctgcacgaatacaaacgacagcttctgaaggcgttgcatattctgcatctttaccacctgaaaaaaacaaacccacaggtgaatatcgagccggcgacgtttctgtttgcggcaaaggcgtcgcccggatatgcgcgggcgaaaaatattatacgcctgattctcgcggtggcgaagctggtgaacaacgatccggacacgagggatgtcctgcgcgtggccttcatcgaaaactacagtgtttccggagcggaggtactcattcctgcggcggacctgagcgaacagatttcgacggcaggatttgaggcgtcgggcacgggcaatatgaaatttatgatgaacggcgcggtcacgatcggtacgatggacggcgcgaatgtggagatcgccgacgcggtagggatagacaatatctttatctttggcgcgacggaaaaggatatcgccaagatggaacggtatgggacgtataaaccgggcgaatactacgaacaaaatacagacctgcgctatgcgctcaacgccatgatagacggaacgctgctcgtagcgagcgacaggcagttttcagacctttaccattcgctcttgtttggcgatgtggacagggcggaccggtattatttgctttatgattttgaaccgtatgtgcaggcgtatgaaaacatgatatccgtctaccgctcgaaggatgagtggaaaaaaatggctgccatgaatacggcgaaatccggccgtttttcgtcagaccggacgatccgtgaatacaatgataaaatttggcacctgaaagaaatgtgatatggcaaatatagatttttcaaagcaaatgatacacgattcagcgcagggaaagttcaggagtcctttgggcgccgtggcgtgcaatactgcggtgaggctcaggatcgccctcaaggacgtctatttgcaggcggtttatctggttgttgcaaatgggcaggatacgcagacgatcgaaatgcacgagcaggatggcatgtggactgtcgattatacggtacctgaccacccgggggcgctctggtattggttttgcgtgaagctcagcgacggcgcgaagatttattatggcgcgcgcacaggacaaacgtgtggagtgggcatggcgtattgggacgagccgccggcctaccagcttacggtgcacgatgcgtcgtttacgacaccgcactggctcaaatgcgccaatatgtaccagatatttccggaccgttttaaaaaacgggacgacgggacgtttgaacgtggtatttctttccacagggataagggcagggacgtatatgtgcatgaaagctgggacgagccgcctgtatatgaggctttgcccggaaaagactattaccagccgtgcgactattatggcggaaaccttggcgggatcatcgatgcgctcgattatctgcgcgacatgggtattacagcgctgtacttaaacccgatcgtggaggctgcttccaaccaccgttataacacgggggattataagaatactgatccgatcctggggacgaacgggcaatttgaggaattggcagaggcggcgcggcagcgcgggatacggctgatccttgacggcgtgttttcgcatacgggcgacgacagcgtatatttcaacaaatatgggcggtacgattcgctgggggcataccaaagccgggaatcgccttattacaattggtaccagtttgaggaatatccggatcgatataaaagctggtgggggtttacgacccttccggaagtcagggaaacacaggaagactgggtaaacgatgtgatcgaaggcgaaggcagcgtaatggatacatggcttgcgcgcggcgcatccggttaccggctggatgtggctgacgaactgccggatgaaacgatcgaacgtatgcgtacggaaatcaagcacatctcgcaggacaacgcgctcatcggcgaagtgtgggaagacgcgaccaccaagcaaagttatggcactgcgcgtacctatgcccttgggcgcgggctggacagtgtgatgaattatccgcttaccaatgcggtcacaaattttttactcggacgcctgaacgcacaggatttcaagcagtttttagtgggacagcatgaaaattacccaaaggaaatgtattacgcgctgatgaacctgctgtcgagccatgacgtcgcgcgcatccgcactgtgcttggtacgaggatcgatccgcacgccctaacgcgcgaacagcaggcacattttatagtgagcgggcaacaggacgagacaggggcaagattgcagaagctggctgcggcgatccagttttcactgccgggcagcccgtgtatttattatggggatgagatgggtttaaatggcttgttagacccatttaatagggggacatttcaagataaggacaaggagatgcaggcatactataagcagctctcgaacctgcgtcaaaagacggatgcgctgaaaacagggcattgcgttttttacaggcagggggaggatgtgattgggattctgcggttttgcatggatggaaaagacgcgttcgctaatgttgcgcaggacgggatgtatttaacacttgtaaatcgatgcgggcagccaaggtcggtcgcgatcgatttatttgcgcaggagcaattgatggatacgtccatgcaggaaatcttcagggaactggaatttacaagcctttcatgtgccttgagcggggaagaatatgaaataaatgcggggatgataggtcttaggcttgcaccgcagagtgtaaaaattttggagattaactggatatgaaatacaaaacggtactatttgattttgacggaacgctggtggattccagcaaggggattttgcacagcgcgcggctgacgcttaccgatatgggctttcctatgccggggccggaaatgttgaaaaagtttatcgggccgcccttgaagctttcctttgtgaacgcatgcgggatggacgacgagacggcggcgcaggccgtgcatatctaccgcgaaaaatatgcggaatatgggatgtttgaagtagatatctatccgggcatacgggagttgctgaaaaaactgaatgaggcagggatattgtgcggcgttgcgtcggtaaagcgggaacaggttgtcagggaaactctgacgcatatcggccttgcaaacgaatttgcagcgatctgcggcgcgtccggcgatatcaacatcacaacaaaggcgcacattattgatgaagcggccatgcgggcggcttcccgcaaaaaagactgcttgatggtcggagacagcgattacgacgcgattggcgcaagagatgcggaaatggacttctgcgctgtgctgtgggggtttggttttgaaacgatacaggatgtagcaagttttcagtgccgttatgttgctgaaactgtggaatcccttgaaaaatttcttttgaaataacagtaagaaacctaagatgtctattgtgcaacatagcgcgcgcgtcatgcagcttgcctaaaatgcattgacgcgcgtttttcatttccattatactgaaaacagattcgaatcagggcgtacgggagagggagagccgatgaaagtaatcttggatatcgatccaaaatatagacaggatgaaattatcattcgatgtgcagaaatgaatgacgagcttttgaagatcgtatcgctcgcaaacagtgtgcaaaagaaagtgatcggcagtatcgaccaccagacatttgttttggaaccaggcgaggtatattactttgaaagtgtggatgataaggtattcatttataccaaagataaagtattcgactgcgcactacggctttatgaaattgaagagcgttttagaaacaccagttttttgcgcgccaacaaatctacgatcataaatttggcaaaggtgagagtgctcaatccgattctaaatgggaaaatcgaagtggagctcgaaaatagcgagaagcaaatcatttcaaggcaatatgcgccggcgctcaaagaaaagctgggacttgggagatgagtattatggaaaataaagggatcaaaaaaaatttgtatttattttttactgtgttttgtattgcattcctgattgcactttttatctcgacgtgtatcgccatgatactgggcgccgatgcgttgccgcttggggaactgcgtaatgatttgattttgggtctgttcattgggctggtacaaatgatctggatcggttcggataagggcaacaagacatacctgatacgtacggctgtccacttcgtcatattgctcacaggctgcactctgcttatgatttggttcggatggctgccgcctggccagtggatcgcaacttactatgtgagttttatcataacgtatattatcatctgggttgtatttttccgcattaataaaaagaaatggcaggctatgaataaaaagctggacgaatataaaaaggcgaataaggaataaggggtgaaaacacttggccgtggattttctgtacttatgaagaaaccaaaggagtttcgttttccagccgctttaatatcttcatttcgcggctgacgagcaggacggcgacaagggcggccatgccgtcggcaacaggtcccgcatacatgacgccgtcgatcccaagcagagcgggcaggattagaatcaaaggcagcagaaagatgatctgccgcgtcagggaaagccaaataccgcgtgttgccttgccgatcgaggagaagaagttcgcagagactggctgcaacccatttaagaaggtaagcagcaggaaaatacggaaacaccgctcggcaaaatggaagtattcttcactgcccgaaccgaatatgccaatgatttcccgtgggaacagttggaatgccagaaacgcgatgacagaaataatcgtggcgacaataatcgctttccaataagtctcgcggacgcggccataattctgggcgccgtaattgaaactggaaataggctgcagaccctgtgcaatgccaataataatagacatatagatcatattgaccttcatgatgatgccgacgaccgcaagggggatttcgcttccgtacacggatagcgccccataataagtgaggacattgttcaagacaatttgaacgaccatcatggcgagctggttaaagcaagcggcggcgccaagacccatgattgtgcgggtatgctttgcgcgtacgcgcaggatagacttatccagtttgacggtgcggaaccggaagatcaaataatatacggccaaagcagcggaagcgatctggccgagaattgtcgcgagcgctgcgcccgccatgcccatattgaatccaaaaataaaaaggggatcaaggatcgtattgatgaccgcgcccgtgaggacacaggccatggaaaatttgggactcccgtctgcgcggatcaggttactcgcgcctgtcgcaaagatcaggaaaggaaagccgaacgacgtgattcccgtatagacgacggaatgctccagtacatccggcgtagcaccaaaggctaccatcataggctccaaaaacatgcgcacgacaagcattaagacgacgccgcagataataagcatcaggatcgcattgcctgcataggaggctgcctgcttttcgcgttttgcacccatggacagattaaagttggccgcgccgccgataccgaacaacagggcgatcgccgtgcagattgttgtcaaaggaaaagcgacgttggtcgcagcgtttccaagcataccaacgctttggccgataaaaatttggtcgataatattgtataatgcgctgacgagcatggcgatgatgctcgggaccgcgaatttaacgagcaacttactgattttttctgtccccaggggattttttattgtttgctccatatatgttaatgctccttatttgctacacaggcgttgtcggtcatttggtcgagcccaaggcgtaatgtggtaagcgccgtagtatcaaaaccaccggccaatattgtatccagattcttgaatgtttcgataagcgcaggaataaggtcttctccccgctctgtaaggtgcaggcaaaaggaacgcatgtcctcgggatcgcgctgccgccgtacaaatccattgtcctccagcttttttaggacccgtgtcacgacagcttcgtcaatggtcaggtggcgcgccagctgcctttggttgatgcccgggtactttgaaatattgataaggaaagcatggtccgaataagtaagcccatagggctgcatctgacgattgatatatttttgtatctgcctgtataagatagaaatttgctttccgattttttctacctgctggttgcgcatcaatacctccaaaaaatcgcttgacatatcaagtaataagataaataaaaacgcttggtttgtcaagcgtctttacgattgcaattcgtctattcctgaagccactggggaaggggcgtcccagcccttatatatgcgcgccgaaagagctcggtctggctgtcgatacgcgccttcataggctcgggcggtaatttctcataaacgcccttgccaacctggtggcgggcttttacagtatcgtttaattgtagttccataaggtttgtaatctcggctttgagaacaggatcattcacaggggcggccacttctacgcggcgctccgtattgcgcgacataaaatcggcagaagagatataaattttacggcggtccggcgtgccgaacatgtagatgcgcgaatgctcaagaaagcgtcccacgatgctaataacttctatattgcgggtcgggccggttttttccacattgagacagcaaatcccgcggatcagcatttgaacctttacgccggcatccgaagccttgatcaatttgcggatgatatcgaggtcgttaagtgaattcagcttgaaaataagctgcgcgggcgcgccggattttgcaagcgcggtctcgcggtcgatggcccgcataactgcgggctttagcgtaagcggggagaccataagcaggtcggaattttcaaccaggcttcccatacataggtttttgaacacatcctgcgcatttagcgcaatattctcgtcggccgtaaaaagggaaagatcggtatatagcctggcggtggattcattataatttcctgtgccgacctgcgttataaaactcagtccttttttatccttgcgcgtgatcagcagcagctttgaatgtaccttataattttcgatgccataaattacagaagcgccggcatcctgtaaaagctttgaccagtcgatattgttctcctcgtcaaaccgcgcacgaagttccacaactgcgatgacttctttgccgttctcggcggcgcggatgagcgcgtcgatcaccttggaattgcgggccacacggtatagcgtgattttgatggaaatcaccttggggtcgtttgccgcttcttccagaaggcggacaaacggccgcatatcctgataaggataggaaagaagcacatcctttttcctgatctgggcaatcaatggctgtgcaagatcaagctgtggggagggctgcggcgtgagagtatgataaaaaagaggagcaaatttcggatcagtaagctgatcccttaaatccgatacaaaggacaggatcgtaggcatctcgttgaaaaagacctcatcgtttgttagcttcaaatgcttcataagcagtttggtaatttcatcgctctggttgcgcgaaatatcaaggcgtacagcttccagttttttgcgctttttcacgatgatttccataatatcgcgataagacatgtcataatcaaaaaaagcttcatccgcgtcgatatcggcattgcgcgtaatcgaaaaaatacttttagcgagaactttgtgcttgggaaatatcttggatgcaaaataaaaaatcagatcctcgatcaaggtaaatttcacatatttactgggcatcaaaagcaaacgctcaaaatagccgctcgcgggtatgatgccaagctgcgttccttccttggatttaagcaggacggcgatatgcaccgtgttgttcataagaaaagggaacggatgatgcttatcgatgatatgcggtgataataagggcagtacgttccgatgaaaataacgctcaaggaaacgttcttcatatttggtcaggtgttttccggtcttataaaagattccgtagttttcaagctccgcgaggatttctatcagcgcgcggttttttcgcggggtcaaacggcggatttctttgtggatactgcgcagctgctcgcccgtcgtcattccggacatctcgtcgatggaatcttttttgagcagtaagcggtcgtgcaggctgcctacacgtaccatcaaaaactccgcaagattgctatggtagatggagatgaaattcaagcgctcaaacaggggatttgttttatcctctgcctcttccagcacgcgttcgttgaatttcagccagcttaaatcacgatttatcaggtgtttatacttattctcccccatactggcccctcggattgtttgtcatattattattataaacgaaatcgtacataaaaacagtggaaaacaaaaattttacaaagcgcgaagcattcattttaggccgcttttatgctacaatatactggcgaataaatttttgaatgaaacggaagaaaatatggatttttttacaaacattacatcactgcagatttttgcactggccttgctggccataggcgcagtgattacctttaccgctaagcatattgcgaaacacttttcgtatgagcacgcggacatggtatggaaatttatcgggctgggatgcgcgatcgccggattcctgcttgttttcatctaatcatttttggaggaaagacgatgacaaaagaactgagcacaacgtacgacccaaagcaaacagaagcaaagttatacgaacggtggatggaaaagggatacttccatgcggtggttgatccggataaaaagccgtttacgattgtgatcccgccgccgaacattacgggccagcttcatatgggtcatgcgcttgacaatatgctgcaggatgcgattatccgcaccaagcggatgcaaggatattccgcgttgtggatgccgggaacggatcatgcgagtattgccacggaagtaaaaatcgtggatgcgctccgcgaggaggggatctcaaaagaggatctcgggcgcgagggctttcttgctcgcgcgtgggaatggaaagcaaaatacggcggacgtatcgtggagcaattaaaaaagctgggttcgtcgctggactgggagcgcgaacgctttacgatggacgaaggatgcaacaaagccgtgcgcgcggtctttgtgcggctttatgaaaaaggccttatctaccaaggcagccggatcatcaactggtgtccggattgcatgaccgcgctttccgacgcggaggtggagtatgaggagcaggcctcgcacctttggtatatgcgttaccgcgcacaggacggcggggaaggaatcgtggtcgcgacgacgcgtccggagaccatgctgggggatacggcggtagcggtgaatccggcagacgaacggtataaacacctgattggcaagaatgtgattttgccgctcctggataagccgatccctgtggtggcggatgaatatgttgatatggaattcggcacgggcgcagtcaagatcacgccggcgcatgatccgaacgattacgaggtaggcgtgcggcacgatctgccaattgtacgtgtcatgaacgacgacggaagcatggcggaaaatgcaggcaaatatgcgggccttgacagaaacgaagcgcgtaaacagatcgtctccgaccttgaaacgatcggcgcaatggtcaagatcgaagattatacgcataacgtgggacattgctaccgctgtcatacggtgatcgagccgatcatctcgaagcaatggtttgtgaagatgaaagggttggcagagcctgcgatcaaggcagtagaggaagggcgcatcaagtttgtgccggagcgtttttccaaaatatatttcaactggctttataacattcgcgactggtgcatttcgcggcagctttggtgggggcacaggatacccgcctatacgtgccaaacatgcggcaaactgattgttgctattgatgcgccggagacttgcccggattgcggaggtacggaatttgtgcaggaagaagacgttctggatacatggttttcgtcagggctgtggcctttttcaacgctggggtggccggagcagacagacgagctcaaatatttttatccgacggatgtgctggtaacaggctacgatatcatctttttctgggtagcgcgcatgatcatgttcgggctggagattatgggggatatcccgttttctacggttgatatccacggcattgtgcgcgacagtgaaggccgcaagatgtcgaaatccttaaacaatgggatcgatcctttggaagtaatcgataaatacggcgcggatgcgttgcgtttttcgcttgccatgggcgtgagcccggggaacgatatgcgcttttactgggaaaaggtagaagcggcgcgtaactttgcgaataagatatggaacgcgtcccgctttgtcatgatgaatatcaaaggcgaggtagggccggtagacgaagggaagctggatattgcggaccagtggatcataggaaagctgaacgatgcaatcagggaatgcacggacaatatggagaaatacgatctcgggcttgcagcgcagaagatatatgattttgcatggagcgaattttgcgactggtatattgaaatggcaaaaccgcgcctttacggcgaggacgaggaggtcaaggcatcgacgaccagcgtgctcgtatatgtgttgaaaaacaccttgaagctgctacacccgttcatgcctttcataacggaagagatttatacgaacctgccggaaacagacgaaacgatcatgctgagcgcatggcccgcggtcgaatttgaaagcggaagcgcgcaggctgagaggatgaacggcgtgatggatatgattcgttccatccgcaatgtgcgtgcggaaatgaatgtgccgccgagcgtgaaggtgaagctgacgatattgacgaaacatggagaggatatcaaggcgtgcaaagaatacctgaaaaagctggcgtacgcaagcgatgtagaggttgtggaggatcaatcgcagattccggtgaacagcgtatctgccgtatgtacggtaggcgaggcgtttatgccgcttgcggagttgatcgatatcgaaaaagaaatacagcgacttacgaaggaagcggagaaaaatgacggcgaaataaagcgtgcggaaggaaagcttgcaaacaaaggatttacggataaagcgcccgcgcatgttgtggaagaggaacgcgcgaagctcggtacttaccttgaaatgcgtgaaaagctgaaagaaaggattacattcctcagggacatgaaataaatggagtatgtgcatctcgcgggaaccaatgcaaagggttccacggcgcagtatattgccggaatattgtcgcaaagccatatatgcggcctgttcacgtctccgcatatcatctcagcgtgtgaacggatgaatatcaacggggaaaatatttcagggcaggaatatgaagaatacatggaaaaagcaaggcgggaagaacattcccaccttttttccgtttggacgagcgcggcgcttatgtggtttgcggacaaacacgcggagtatgcggtgatcgagacaggactgggcggacgcctcgatcctacgaacatcgtaccgtcaagaatgcaggtcataacccccatcagctatgaccatatggcgctgctgggaaacacgctgactgaaatcgcgcgggaaaaatgcgggatcataaagcaggattccattgtcatctcccatccgcaggagaaagaagcgatgcgtgtgatcgaaagcacatgccgcttaaaaaacgcgaaactaatcgtgctcgacgaacatctgatccacgttcatcaaagcggcgtaacggggcaaagctttgatttcacttacaaagggaacagataccgtgacctgtatattcatgcggcgtcgccgatgcaggtggaaaacgcgtgcgtagcgttgatggctgcggcagaactgaagataacggaagaggatatcagggaaggactcgggcaaacgaagatcgcggcgcgtgtgcaggtgtgcggggatatcgtgatcgacggggcgcataatcccgccgcattaaaagaactcaagcgggcactctctaagtatttcaagggaaaaaatataacggcgctcatcgcggtgatgcgggataaggatatccttaagatcaccaatgaaatagccggatttgcaaaccaggtggtatgcacctgtgcggatagaaaaaggggacttacatccagggaactggcagaatattttccgtgcgcaacggcccatgaaaatccgcagagcgcctttttagaagcggaggatattgccaaacaaaaaagaggcatactcgtggtatgcggctctttttaccttgcttcctatatacttgctatgttaggcgagacgcgtgatgacgtccttatataaagggatcgcattgctgcgccagttgcctgtcatgcgctgcgcttcttccttggaatagacgatgcagcttagttcaaatatggtgcggtcgtcctccaatacttttaaaatcacgcgatattcaccgtcggaaagcttgatatattctcccacaagctgggattccattttgagttccgtagcatgttcctgcaaataactgtcgatacggtcgcgaaaagaccggcgcaaatcggactttaagatggtaagcatttgcgaacccttttccgtgatgccataaagcacgttttgcggcgtagtcttcgaatagatatgcccgctttccgtaagttcaaacatacattctttcagatcaaaataactcatgaaggaaagctcgctcaaaatacgcacgatttgcaattcagaaagcgcgatatcactattttgcaaaagatataacaacagcagcttattattggctaatgtttgttttggctttatttgcatgattccacctcaattctattatagcatatgcataaaagtttctaaagaaagtattgtcttttttaaggaaatcagtataatagtaagagttcggagttatatataacaatggaatacgggaatgtgggactatagctcagatggttagagtacctcgttgacatcgagggggtcactggttcgagtccagctagtcccaccaacaaaaatgcctgaagatcttgggcatttttttatttttctgtaaaatcaactttgcggatacacaaagaatgtaacaaattaatttgctggggcaggcaacaggcattgacaagcaagcgattattttatacaattcataatatattttcgtgttcattcgtaaatatacaattcagttggtataaaattcatatttttcagtttcaaaacctaacatatcgtttggtcgtcttctgttgacttgctttcactatgtttctaggttgtgttgtgccgcttttgaaaggatattcgtatgtctatttcgaggtttaagccacttattattgctattatcgtaatggttttttgtattatattcgtttcgatgtccatgtttccgaaagaaacgtttccgcaggaaaaaacaatcagcattggattgatcgagacagactctgaagatagctggagggttgcaatgatggagcagatacagcaatcagccaatgcggccgatatcaatattatgacgattgagacggataggacgcaatccgcacaaatcaatgcgattcgctcatttatcgtatacggggtcgatgcgattgttttttctccggtcatgaacaacggttgggattatgtgctgcaggaggcagcggatgcggggatacctattatcacggtcaatgaaatggtcaatacggaagtcgaaggtaagatggcgtgcgtcacctatgattacaagagtatcgggaaggctgtgacggatgcattgctggaaaggtcgcaggaaaacggtatcgatacatcagaattgaagattctggaattaaaaggcgcgatcggttcgacggtatcggaaaatatttcggaaggcgttcgttcggcattggaaaacagcgacggatataagattaattacagtgcaaatgcagactatatgagatcccgcgcaaaagaaatggtgaatgggttccttaggaacgaatatgaaatggacgttattattacgcataatgacggtatggcactgggcgtgatcgatgcgctggagaaaaacgggcttaggcctggagttgacgtgcaaatcgttacgtttggcggcggcagcgatgcacaggaaatgtttgatcaagggaaaatatcttatttggtcaaatgtgatttaaacggccttggccaaaagattgtagagcttgcaatgaaacttaaaaatgacgagaaaatctcagatgtgacctatttgaacagctatctgatgccggacgaggcaagatcatgaatgggaagaaagcaagtatcagcagatatctgaaaacatcctatatgctgattatcatcatgatggcagtcccgacgattgtgctcagcgtatttataccggtgatgaatcagcggtatagtgatatgatcggctatgtgagacaggccagtgaagtaattgaggttacggacaggcaattggaaaaggaaatttgggatattgtcgccggtaaaaaggatttccaggatggcaggcaatatgaactgatcgacagcgcgcaggatgttttagaacaattgaaaggaaatatacgtaacgataaccaacggtacatcgtgggggcgacggagatgctggacagtatccgctcatactgtgacgaattgggggtgcaaatccgcaagaacgtggccgtttccagtaacgaacagttgttgcgtgaaattcgcagggtttcttcgtcgctcaaggatgtgatgatagaatatatctatgcagaaatcgacgaaatatccgtgatcaatgctaatatcctgcggatcacaacgcttaacattttattgacaggagttctgatgggcctcgttatttattttgccacacgttgttaccaaagtgcacgggattccatccaaaaaccgatcgcacggctggaaaaaatgtcggttcgtttggcagaaggggaactgtcggcgcggtcgccggcatcggaactggaagaactggatgtattgacaaaaagcctcaattctatggcgtataaactggaagaactgatcgacagccgcgtgcaggaccagaaaactttgcgtaaggcagaactgcggactttgcaggaacagatcacgccgcattttatttacaataccttggacaccatcgtttggatggcgcaaaagaaaaagacggaggacgtgattggaattaccatggcattgacgaaatttttgcgtatttcgctgagcaagggaaatgactggattacggtagaacaggaaatagggcatgtggaaagctatctgaaaatccagcaatttcgttaccgcggcaaaatccaatatgtgatcgatatcgatccgcagctttatgaatacaggatattgaagctgctcttgcagccgttggtggaaaatgcattatatcacggcgtaaaacaaaaacgcggcgcgggaaaaatcatggtcatggggataaggaacgacgatggaacaatgacattttcagtgagggacaacggaattggtatgacgcaggaacggtttgaaaaagtccttacatccatgaaaaatgatgtaggactgcgggacagcacctatgggctatataacgtgaataaaaggatttcactctactatgaaaatgaggggctttgcattgaaagccaatataatgtgggaaccacggttcgatttacgataccgtataaggagatgtgaaaatgtaccatgtatttattgccgatgatgaagatacgatccgcgaagggatccgcgaaatgctggaaagcgaagacgaaacgtattccgtgtgcggggaagcggctgacggcgaattggctctgcccatgatccaggaaatgaagccggatattttaattacggatatctgtatgccctttatagatgggttaaagctggcttcgatcttaaagaaaacaatgccatggatgcacatactgattttaagcggatataacgaattcagctatgcgcagaaagcgattgagatcggggtggacagttacgtattgaaaccggttttggctgaagaactgaaggaaaacctgtctaagatcataacgcgtattgaagcggaacgcaaagaaatattggataaactttcacgtcgcaagcgggagaaaaaaaaccgcagcactataatagatttcttttttaacgaattggtgaacggaacgatccactgttctgaaatataccgcagggcggaagaattgggaatcgatatcgttgcacaggattacgtattgtgttatattgccgtggatcaaaaaagggatatggagaaattatggacgttttttgcgggactgattgaagacagggaggatgtttatggtttcagatatgctgatacatatgtgttgcttgttaagggcgcctccgaagaaaagacgatggaaagcgcatgcgaagcagtccagatactcaagcacgagacgcagaggattttggagatagaactttctgtggatattggcgctgctgtggaacgcatcagcgatgtggcagagtcatttcaaaaaatcagaacagcgcgcaacggtgcggaggacgatcctgaaaaccatctgatccgtatccttgctaaagaagagaataccgtcattccgatcgatgcttcagatccggctacattggcagagaggctgcgccatgcggagatcgaagacgttgacaaactggtggaggaccagtttattgttaccaaacaggaggaaaaggcaagtgttttgtatcgttattacctgtttgttgaccttatcgtgactgctgtccgcctgctaaaggaaatgggtgcggacgaggggagcatgaatttgcaggataaaatgaacaatgcgcagttgtttgaatacgcagtgtcttatgaaaagacgtgtgaatatgcacgcggttttctcaaagatgtcattcgctatcgtgagaagcagcaacaaattccttatagcgaagaaatcaaaattgcaaggcaatatatcaaggagcatttttcagacgaaggattgtcgctgcatacggttgccagggaggttggatttagtcccaatcatttcagtacagttttttcccagcagatgggggttaccttcatagagtacctgatccgatatagggtagaaaagagcaagcaattgcttgccaatactaatatgaacctgaatgatatcacgtttcaaatcggttacagcgaaccgcattatttcagttatgtattcaaaaaatatacggggatggcgcccggcgcgtaccggaaggcatgcaggaagcaggataatgaggatggtaattcccggaaatgaaaaggatgtgcgaaactttatgttatgttccgataaaaaaacatactctccgtagtcatgccatacgaaaagatacaaaatattatgataagatactggctatgtgttttacagtcaagaaatttataatgaggttactcggatgagtaatctttttaatttaagggggaacgacatgaaaaaaggtaaattgttggcattggttttggcggcgctcatggtattcgggctcgctgcttgcagcacagatacgggaacggcaagccagagcgcgcctgctgaggaaagtgcatcggcagctgcgagcgaaagcgcgccggagcaaagcgcgtcggcggcaaccgaaggggaatccgcagaggctgtgggcgaagatatggtagacacccaggcattcaaaaaagacggcccatatactattggattctctgatatccaggtagtcaacacgtggcgtgcgcaaatgcataacgaactggaagccgcggcagaagaacatggcgtgacattatatacaacagatgctggtggagacacatccaaacaggtttcggatattcaggacctgattgcaagagggattgacgcattgctcgtagcgccgggctccacgacggcaaccaatgcggtgacgcggcaggcgatccagcaggggatcccggtattcatgatcaatgcggaagtggatgatcccgatgcctatacgggctatgtaggatccaacaacgtagattttggttacatcactgcaaagtggctgctgaacgaaattggcggagagggaaatatcatcgtgctgaacggcatcgccggaaactcgaccagtacattgcgcgaggaaggattgaagaaggcgctggaagaattaccggacggcggagagaatgtcaatatccttgcaacatactatgcggactgggcgtatgacaagggaaaacagagtgcagagcaggctcttgcagcatatccggacatcgatgcggtatggtcgcagggcggcgcaatgtcgcagggcgtaatcgaagcgttccaggctgcgggccgtgacctggtgcccatcacaggcgaagataacaacggttacctgaaaatgtggaatgaactcctgcctaccggctttacaagcattgctaccagcgatcccacgtgggaaagcgtggtagctctggagacggcgctggacgcattagcgggaacgcccgtccttaaggacaattatattgcagtaccggtcattacgaacgacaacctcgcggaatatgtgaagccggaatactccgacgcttactggtgcagttctaaactgtccaaagaaaaggcagatgaactttatctggaaaaataaaaataccaactgaaaaatactgatcagcataccaactgatatagcccttgaaaggagtaactgagatcaattagttactcctttcaaaaaggaggaattttcttggaaaaagttgttttggaaacaaaaaacatctgcaaatccttttatgagaacagagttctggaaaacgtaaacttttcctgtattgcaggagagatacatacgctggtcggagagaacggtgcgggaaaatccacgcttatgaaaatcatatccggcgtgcacaagcaaacatcaggcgaattttacatcaatggggaaaagagggagtttgataatacgctgcaggcgcaggaagccggcgtgagtatcatccaccaggagtttaaccttgtgccatatctcacggtttatgaaaatatgttcctcggaaggctgctgacccaaaagaacggattgacggacgttgcggcgatgcggaaacggacaaaagaacttgcagaaaaaatggaagtggaacttaaccctgatacccgcgtgaaggatctcacagtcgcccagcagcagatgctggaaatcatgaaggcgatcaacctggaaacccagatcatcattatggacgaaccgaccgcagcgctcaccttagtcgaagtcgaagcactattcaggatgacgcgcaaactcaaggcggaagggaaaaccattatttatatttcgcacaggctcaacgaagtattcgagatttccgaccgcgtgaccgttttgaaggatggcgcaacgatggggacaacccgcgtggaggataccaccaaggaggacgttgtcaacatgatggtgggccgccagatggggaacatctttcccgaacgcgacagcgcaacctttacgcagcctgtactggaagtggagcaattgcagctcaaggaaaaacaggaagggtttaccttctcgctgaaggaaggcgaaatccttggaatcacaggtctggaaggacaaggacaaagagaactcgtccggtcgttgtttggcttgcatcgcgcggtaagcgggacgatcaaaatcgatggacaaacagcaaagatcaattctacaaaaacagccatgaaacaagggatttcatttttgacagacgaccgtaagatcgaggggctttgtttggatcttcctatttacagcaatatctcgctgccgatcattaaaaaattgaaacgcagggggatgatcttcagcgcctatgaacaggcggaaacgcagcaatatatggaaagcatcaacatcaaggcgacatcttccggccagacagtcaaaacgctttccggcgggaaccagcaaaaggtcctgctcgcaaaatgcctcgcggacaaaccgaggatattgatcgtacatgaaccgacaaggggcatcgacgtagccgccaaagtcgagatttataaactgctgaggaagctgtccagggaagaaaaaatatcgatcctgatggtatccagtgatctgatggaggtcatcaacgtcagcgaccgtatccttgtcgtttacgacggccgtatcaatggggaaatagacggcagggaagcgacggaagaaggcattatgcggatcgcgaccaacatacaagaggggtaacggacgtgaatataaagcaatttgtaaaaaagaacgatgaagtactcattgtgtatgtgatcctggcagtcgttctggtgattggaggatttgcatctgaccgttttttcaatcccggaaatatcggcaatgtcatcgagcaggcgactgcacttgggattgtggcgataggccagatgatggtgatcctactcggggggatagacctctccgcaggcgcggtggtcagcgtaaccacaacgatcctgtcgtatgaactgatcgcatcgccatatggactgttcgtcaacattatcattgcgctggcggtgggggctgcggttggcctattcaacggcgtaggcgtagcaaaactcaaaataccgccgtttatcatgacgctggcaaccatgtgtatcgtcaatggggttgcgctcaaaatcaggccgatccccggcggctccgttccctacgaatttatggatcttttgaacgggcgatttggtgtgatcacgcatgccgtgattttatgggtggcgatcgccgtgatctttgcactggtattaaagaggacgcgctttgggcgtgcagtctatgcagtgggcggaaatccgaatacagcggcgctttcaggcatatcggtacgcaaaaccacaattagctgccacatcctgtgcagcatgctggctgcggtgggcggcgtatatctgacctcgagagtggggacaggagatgcgacccttggaagcatgtatgctatggatgccattaccgtgtgcgttcttggcggtatcagcttgttcggcggcagggggaatatcgtgggcctgtttgcggcgacctttatcttatgcctgctcagtaacatcctgaatatggcgggagtttcctcgtattaccagtatgtatttaagggactcattatgctggttacggtcatgattttctcgcttaaagacctgaaaggcaaggaagtgggggaaatggcatgaacgtaaaaagcgaaacggttttacaaaaacaaaagacaaaaaaaaggctgtttaaggatatccccatcatcctatgggggcttatcgggctgatcgttatcctgggattcgtttccccgaactctgtattgcccgcgcatttattggattttacgcggcaagcggcgccgctcatcatcgccggtatcggacaaacgatcgtattattgatcggaggactggatctctccgttggagcggtcatgatcctgatcgacgtaatggcggcacaattgatgcaaaatgatccggataagatcggccctgccgtgatggcatgcgtcggcgtaggcctgctgatcgggcttgcaaacgggattatgtgcgcaaaactcaggatgccgtcctttatcgtaacgctgggtatgagcattcttttacagggcattatgctcatttactgccaaggggcgccgggcggttcaatcccgaatgaattccgtgcgctgggcgttggatttgtaggaccgcttcccatggcattgtttgtgtgggtgatcgttgcggcggttgtgatcatcgtgctgaaattgtttccggttgggagatatattatagcgacaggcgtgaacgaacgcgctgtataccaggcgggcatcaatcctgtcagtataaaattgctttgttatatgatttgtgggctgctgtcagctcttgcagggctgcagattgcagcatatatcggaacgggagtactggagctgggcgtagattaccagatgcagtccatcgcagtcgcgttgctcgggggggcggccttcagcggcggaaaaggaagtattccggggacgatattggcaggactattcattgttgtcatgctgagcctgattgcagccctcaatatgagtgcgggagaccagagcatcgtgcagggggtcattattctcgcagcccttctcatcaacggattgaaaaaggattaatggcgaaaggaaggaaaagacatgaaagcactggtgaaatacaagaaaggcatggacggggcagaactgcgcgagattgaaaaaccatcggcgcgggcgggcgaattgctggtgaaaatccatgcgggcggcatctgcggaacagatatacacatcttaaatgatgaatatgaggcaaattaccctgtggtaatgggtcacgaatacagcggcacagtggcggaagtaggaaaaaatgtggaaggcttccaggtgggggaccgtatcatatcgatgacggcggccgtaacatgcggacaatgtgattattgtcggcaggggcttttgatgctgtgccctcggcgcaaatcgatcgggtcgggcgttgacggcgcatttacagaatatatgcgtatccctgcaaatctggcattccatattccggataacgtttcgatggatatcgcggcgctttccgaaccgcttgcatgcgttgtacgcggcgtagtggagatggcgaacatcaaagcgggcgactgcgtgtatgtatccggcccgggggcgatcggccagcttgccgcgcaggttgcacgggtaagcggcgcacatgtaacggtgggcggtacagaccaggatacagagcggcttaaaatggcaaaggaactgggggcggacgaaaccgtaaacgtgatgcgggaggatattgcgaagcgcgcgatgaaaataacgggcggacgcggttttgacgtggcgtttgaatgtgcgggcgcggctccttctgcacagacgtgcctggaagtactcaaaaaaacgggacaatacggacaagtaggcctgtatgggaaaaaagtgccctttgaccacgacatggcattgaaaaaagaaattcatattgtgaacagctatgcttcggaacgcagttcgtgggaaatcgcactgaggctgctgcaacaaggcggcttgcatctggaaaaactgatcagcgataagatccctttaacgcggtggcaggaagcgtttgatatggttcagcgcaaagaaggctttaaggtattcctgacaatgaatggggaataaggagataagatgatgaatacaaaagaaatgaaaatttttgcaaagcagatacagatggagacggtcaaaacgatcggggatcttggcgtcggtcatattgggggagcgctttccgtcgcgcatgtcctagcagttttatacggaaaacaaatgaagcatgatcccaaaaatccaaagtgggaagaacgcgactggctggtggtatccaaaggacatgcagggcctgcggtatactctgcattggcgctgcggggctttatggatatggaacagttaaaaacgcttaacaggccggggacaaagctgcccagccattgcgacatgaacctgacgacgggaatagatatgacgacgggatcgctggggcagggcgcttccacggcggcgggcgtagcgctttccttccggatggatgcaaaggacaactatacttacctcgtcttgggcgacggtgaaatcaatgaggggcaggtatgggaaatggcgctttttgccgcgcaccgtaaactggaccacttgattgcttttatagactataacaaattgcagcttgacgggccgactgaggaaatttgcgcgctgggcgatgttacagagaaatttgaagcattcggatggttcgtgcaggatgtcgacggtcatgacgtggaagcgatcgacaaggcgatcgacattgccaaacagcgtcagggaaagccaaatatgatcgtgctcaatacagtaaaaggcaacggttggagtgcaatcgcaggcaaagcgtccagtcacaatatgccgatatccgaagaacaaatgaacgaagcgctttcacagatgcaggcagaaatggatgaaatacagggggaacagtaagatgaatgtcatgatcagagaagaatttgtacccgaaaaacaggaaatgaggcaagcatatggtgaaacgatgatatcgcttgcaaaggaaaacaggaacatcatcgcattggatgcggacctgatgggcgcaatgggaatgaaaccgttccagaacgaatttccagagcagacaatcgattgcggtatccaggaagcgaatatggtaggcgtggcggcaggcctttcggcacgcggcaagattccgtttgcccatacgttcgcaccgtttttgacacgcagggcgtgtgaccagatttttatgtccgcggattatgcgcgcctcaacgtaaaacttgtgggttcggaccccggcgtgacggctgcgctcaacggcgggacgcatatgccgtttgaagatatggggatcatgcggctgatgccgactgtaacggttattgagcctacggatacggtgatgctgaaaaacctgatccctaaaattgccaacacatacggcgtttattatatgcgcctcgtacgaaaaaatgtaatgggtatcttctgcgaaggcagcgatttcgagatcgggaagtccgctatgttacgcgatggcagggacgcaacgatcattgcgagcggcttttgcgtgacacaagcgctgcaagcggccgcggcactggaaaaattggggatatccgtgcgcgtagtcaatatgttcacgtggaagccgatcgatgaagaagcgatcgtcagggctgcgaacgaaacgggcgctatcgtcacggcggaaaaccataatgtgatcaacgggctgggcagcgcagtttcggacgtagtggtaaaaaatagccttgtaccgatggaaatggtcggcgtgcaggattcattcggtgaagtaggaccgcttgaatacctttcggagcattttggcttgacagaaaaatacattgtggaagcagtcaaaaaggcgtgcgcaagaaaataacaggaaagtgagagcaagcatatgaacggactcaggataaaggttttatatctgggacgatgtgaacacgggaagtttgagcttgtcaaaacagataacgatgcggaacagatcgtatcgccgcgtatggcggtattgatcgaccaccctgcgctcggctatctattatatgatacaggggatgcagacgattggcgggaggtatatccgcaatctctccggcagaggtatccgttaaaggaacatatcctgctggaagaaaaacttggacagtgcggcgtatcgcttggggatatcgaccagattatcctttcacacctgcattttgaccatgccggcgggcttaaaaagtttattggaaaaaaagcggcaaaagacgtaatcgtttcggaagaagaagcgaaaacggtattcttccagactgtggccgacccgtcaaaattaggaccggcacatattccatcgttattctctaacctggacggcgtgacctaccggacggttacgggtatctcggagctcgccccgggaatcacgctgttcgtacagcattgccatacgccgggggtgatcggcatgatactgcgccttgaggacggcacgccgatggtcttttgctgcgataccgtttatacaaaagaggcttatgaaaaagagctgccgcccggcgggtccatcaataaaacggacgatgaattttaccgacagcttgccgtgctcaaaaagttgcagcaggatacgggagcatatatggtgtttggccatgattttgaccagacgaagcagcttgaaacactgggttggatcacaagcggaaaacaactaccgatatgaggtgaaaaagatgaaaaaggcagttttgacggattggggaaaattggaagtattggatgaggaacttccggaaattggggaagaggaagccttgatcaaattaatatatgcaggaatatgcggtacggacgtgcatatttacctgcataaccataaaagcgcaacgatcccgcgcgtgcttggacacgaatattgcggcgtgattgaaaaaatcaattcgaagcgctttccggaccttaaggtgggggactatgtcacgtcgcatccgctcaacaactgtggacgctgcgtgtcctgcctgaccggaaacgaaaacgtgtgcgaatccttggagatctacggcatccacgcggatggatgctttgcggaatacttcaaagttccggtacagaaaatcataaaaatcgacacgaaagtaaagccggagatcgccgcgatggtcgagcccctcgccgtagcggtccatgacgtgcgtttgagcggcctgaagcgcggcgataacgcttttgttatcagcgcaggacctatcggactgctgattggtatcgtagccaaattatgtggggcagacaaagtgatattgagcgagatgaacgaataccggatcaagctggccaaggaattcgggtttacggtcatgaatccaacggaagaaggatttgaacaaaaattgaaggaagcctccggaggccatggatttgacgtcgtattcgaggcatccggaagcaaagcgggcgcagagctgatgaccaaagtcgcagcgcagcgcggtatgatcgttgtggtaggcgtacccaaggatccgtatccggtggatacaggcgcgtttttggcgcaggagctgcggatgacgggcgtacggatccatccgcagtatgattttgacagggcagtggaaatcgtcaacaggggaacgatcaatgacaagctggaaaagatggtaacgcatattttcgatttgcaggacattggagaagcgatccgcttcagtattgaggaccaggcacatttcaaggtattgctaaaaccgtaagaataagatccgcagtcacaaggagaagacagtatgaggaaaaaaatcggcgtgctgaccagcggtggagacacccctgcaatgaatgcggcgatcaaggccgttgtgatggcggcggatgcgcatggcatgtccgttatggggattgaaaaaggctatgcgggcttgatcgaaggaagggccatccgtttaaaaccggaggacatagacggaatcgaaggattggggggaacgatcctcaagacggcgcgctgcgtggaattcaagacagccgaagggcaaagccgtgcgcttaagacgctgcgggcctttgggatcacgggactggcggtgatcggcggcgacgggagctttgcgggggcgcaggcgctcacgaacttaggcgttccggcagtcgggattcctggtacgatagacaatgaccttgcctataccgattacacgatcggttttgatacggcggtgaattgtgtcgtggatgaaatgtctaaaataagagacacgatgctgtcgcatgaacgcgtcggcgtaatcgaagtcatgggaaataagtgtggggatattgcgctttttgccggaattgcagggggcgcagaacacatcatcattccggaatatggatcatgtatggaagaaatcctcgaaaaagtgacgagggaccggatacggggaaagatgacgagcattattctggtggcggagggcgcgggcaaaggcgccgatattgcccgttacctgtttgcccggggcgggatcgatgcaaaagcaatcgtactgggatatatccagaggggcggcgcacccagcatgcgcgaccgcctgctggcgacgaggctgggcgtacatgcttcggagctgctgttttgcggaataggcggcagggtaaccggagtacgcagcgacaggatcatcgatgaagatatccatgacgcattgcgaaaagaaaaaatattccgatcggaattgatgcaggagtttatgatcctatcaggcaacaagaggacaattggggactaaaaatgaaaagcgtattcgatcaaacgagaataaaagggatgagcctgaaaaacaggtttatccgttcctccacatggctgcgcagggcatgcagcgacggacacatcaataaagaactactgcaggcctatgaagaacttgcgcagggaggagtggggctgattttgaccggatacgcctttgtttcggaagaagaacagccgaatccaaggatgttgggagcgtatgacgatagtttttcagaaggatttgaaaagctggcggagaccgcacaccgctatggaagcgcgattgcactgcagattgcctacggcggctcacaatgtacgcatccggacgcgaaaaaaatggatattctgggggcttcggcagtttataacgcatatacggatgtcacgccaagggaagcgacgcatgaggatatcaggaggttggttaaagccttcgggcaggcggcaaagcgtgcgcaaaaggcgggaatggacggcgtacagattcatgcggcgcacggttatctgttaagccaatggctcacgccatatttcaacagaaggacggatgagtatggcggcagtatccataaccgtgcaaagatcatctatgaggtttatgaggaaatacgaatgcttgtaggaagcgattttccggtgatgatcaaaatgaattgcagcgatcttgttctgggaagcaggtacctgaccttggaagaatccataaaagtattcagcaggctcgacagaatgggtatggacctgatcgaagtcagcggcggaaatacttcactgatcggttcttttgaccaatctgcacgcaaagcaatatttgaaagggaggaacagtcatatttccggcgggaggcagaggagatcgcctcgcgcatgaaacatgccaaggttgcgctggtaggcggaaacagggaaccggaactgatgacagaactattgcagggaacggaaatagaatatttttcactgtcacggccgtttatgtgcgaaccggatctggtgaacaggtggaaagagaatccggaatatgcaatgagatgcagggcgtgtaataagtgctgggggaaggaacggaacgaatgtatcctaagccggcggtaattggagaaacgaaaggaagaatgagtggcaaagatatatgtgttgggcgcatgccgtacagccataggcagccttggcggttcgctgaaagatgtcagcgcggtaaaactgggcgcagcagtgctgcgtgaaacggtgatccgttcaaaggcaaacgcggcggaaatcggtcaggtgattttgggaaacgtcttgcaggcggggcagggacaaaatcctgcgcggcaggcggcggtacttgcggatatcccaatcagtatacctgctgttacgatcaataaagtatgcggatcgggtctttatgccgtcaacctcgccgcagcattgattgcttcgggacaggagcaatgcgttcttgtcggaggaatggagagcatgtcttgcgcaccgcatacgctgcaaatgcgctgggggcagaaaatggggaatgcagtgcttaaagattccatgatacaggaaggcttgtgggatgttttcaatgattaccatatggggatcaccgcagaaaacgttgcgaagcaatacgggattacgcgcgccgaacaggatgatttttcctggaaatcccagcagaaggccttatctgcaataaagaacggacgttttaacgaggagatcgttccgctcgctgtcccgcagcgcaaaggggaccccgtttgctttgacagggatgagcatccacggcccgatacttcgatggagacgcttgggaaactgcgtccggcttttcaaaaggaaggaacggtcacggcgggaaatgcgtcgggtatcaatgacggcgcggccgcaatgatggttgtatcagagcggttgatcaggaaaaggggactagtcccccaggcacgttggatttgcggagcgtcttgcggcgtggatccatccgttatggggataggtcctgtcagtacggtgaaaaaagcattacaaattgcggatatgcgaatcgaggatatcggcctgatagaagcgaatgaagcgtttgcagcccaggcggttgcggtaatgcgtgaaattggcgctgatgaagaaaaagtcaatgtcaatggcggggcgattgcccttggacacccgattggcgcttccggcgcgcgtatcgccgtgacgcttttgcatgaaatgcagaagcgggatgaaaaatatggactttcgaccctgtgcattggcgggggtatgggagaggcggcgatttttgagcgggatgaattatgtagatgaggacaggcgatgaatacggtacggttagaaaaacatgaggaggcgctctggatatatctttcgcgtccagcgcagctcaacgcgctgaatgaggacatgatttttgatttagaggatgctttggatattgctgagcaagacgaaacgctgcgctgcatcctgttaaccggcgaaggagataaagcatttgcagcaggcgcagacatcaaggcaatggaacagatgtcgtatgaagatgcaaaattattttcgaaaaacggcaggaagttgatggacaggatcgcaaattttgccgtgccgacaattgccgccatcaatggatttgcctttggcggaggtctggagctggcgttggcttgtgattttcgctttgcaaaagaaggatcggtacttggcttgcctgaagtgacattggggatcatgccgggctgggacggcagtaaaagacttgcccaaacagcaggttatgggcgggcttgtgaaatgatatttacagggaaaaccgttcctgccgaaatggcaaaggaatatagaatcgtaaacgaggtttttccaaaggaagcctttttggagaaaataaacgcaaccgttcaggcgatttgcaggagtgcgccaatcggtatccgttacgcaaaatgctgcatgcgcgaaaaagaaagcgtgagtgaagaattatttgcaaaattgtttttgacgcaagaccagaaaacgggaatgagaaactttaaccaaaaatgtaagacaaaacacttcgaaggaaaataggggagaaatgacatgaaaaaggctggagtaatcggatcgggcacgatgggtgcgtcgattgcgcaggtatttgcgacggcggggtatgaaacggttttagtggatatttctgtcgaactggcacaaaacggaaaggcaaagattcgtaaaaccctcgataggatggtacagaaggaaaaaataacggcgtatgaagcaaatgtcattgcggataaagtaacaccgacaggttcattggactcatgcgccggatgcagcgtcgtggtagaggcagtagcagagaaaatggatattaagcaggaaattttccggacactcgaagaagttgtggacgaagatgttatcctggtgacgaatacatccagtttgtctattacggaaatcggaagtgggctgagaaaaaaagaaagattcatggggatgcattttttcaatccggcgaccgtaatgaagctggtagaggtgatcagtggagaaaatactgatccgaagtatgccaagcgggcgaccgcaatcattgaagaaatcgaaaaaacaccgataaaggtcatggagagcgcaggttttgttgtgaaccgcatactgattccaatgattatcgaagggatcgcagtgtacgcagaaggcgtagcgagcgctgaggatatcgatacggcgatgaaactgggggcgaaccaccccatggggccgcttgccctgggagatttgattgggctggatattgtactggatattatggaagtcctgcaacgcgaaacgggcgatgataaatacaggccgcatccactgcttaggaaaatggtgcgcgccggaaaactgggcaagaaaacaggaattggattttatacttatcaggaagggaagggaacaagatgaaaggtttggaatttacgatttttcgttatggctatatttataatgatttggggtggaatgtggcattgcctgaccctgtctctaaatcatgcagggaaaaaatgcccgtatatggcaaattcccatgctcaatggtattgatcaaacatccgcaaatcggatatatcctctacgatgtaggcgaatatcctgcggatcggccggaagacaccaagcgtccggaattttgggatgaatattttacccttgaagcgaaaagggaggactatattgacgaacaactcaaacgggcgggcctgacacctgacgacatttccgtaattattatttcgcatatgcactgtgatcacgcgaacggattgaaatttttttccggcacgaaggcgggcagaaatgtttacgtctcgaaacccgattttcagcaggggtgcatgcttacttttgcagagccggatgaatctaagacgagtttggcatattggaaaagtatttatacgcagccggatattacatatcattttattgaagaagatacggagcttttcccggggatcaagctgtttttgctgggaggacatacgccgggcgtattgggaatgctgctggaactggaaggcgggaattacttgtttccaaacgatgcatgcggctctaagctgaattatggaccaccggcaaaatcacctggaatcatttatgactccttgggattcgagaagtgtgtgaaaaagctgcgcaccctggaaaaggaatacgatgcaaagattattttctcccatgacttaaaggaagacgaaggttatctgcattttccggaatggtaccggtgagagggcgggagtaccaaaagtgaaactggccacattgccatggcgtaaattgtcggcgaagctcaagccaacgatgatcgcctgaaaaaaatgcctaaaatattaggcatttttatttgcgtttttccataataaaaattcgagtaaaatatggcgggaatttgtgcaaagtccgtgtgaaaatataaacgatgcttcataaatatccaacaaataagtgcaactgaatttcaaaaagtgaatatttatccgatgattggtgggatatcgtgaatatttgtctgatttcatcttctatatttcacatttcttttgacacaattttgcgatgacatctacaaatcagaaaattataatgaacccaacaacaaagaattcctttagttctatcaataaaaacacttaaagattatagttcaaaacaaaacgaaaactcaataaacccagaggtaatgaaattttgcgaggcatattagtatactttttcagcaccggaatcaaaacgaacagcaattttgcggtgatcactgcaaaaataataatggaggaaagaagaagatgatgaaaagatcaaaaagtgtaggaagtattttgattgtggtctgcatgcttatggcgcttatgctcacagcatgtacacaatcggaaacgcccgctcagtcagcgccggaacaacctgcggcaacgcaatccgaagctgcacagtcaaaagaaccggaagaatccaaagctgcagaacctgcgggcggggacactgtggtggcagatcttgtagcggaagcatcaacgcttcaggatatggaggcattcaagttttttgaatcattggcggataaaggccttagcggggcacagatcatccagttctttatcgatctgccgctctcagacgcaaaccaacagatccatgatatgtatttagaagaagggtttgacgcttatgcagaagcatatcctgcgggcgagttctatgatggatttgaatggacgcccggcatgggaacggaaatcaccggtggatttacaggaaacagcttaaaactgcccttctcggacgaatacgtaccgatggacgaaggcccgatcggcgacgcaaataagacgtacaagatcggcgttgtgtcgtccggtctgaacaatgcatggatcggaaacttccaggatagtatcgattatgaagcggcacggcacgaaaatatcgagttgctctatatggattacaattttgacatgaacgcattttccacgcaatttgatacctgcattgctcagggcgtagatattattatcacatggccacaggtagaagcatcttccggcccggcagcgcaaagggcagtggaagcggggattccggtcgtatcggcagacagaataacctcttgtccggacgtaacggcaagagtcgcgggcaacttcccggcaaacggtgcgcagtgcggcatgtatatggtatggaagctggcgcaggatgctaacaatgaagccgtaggcggaaatatcgttatgctgcgcaagccggcaggcagcacggccgacacgatccgttccggctatttcctcaaggtattgagctatttccctgatatcaatatcctccagtcctatcatgatccggacaaccgtgaggaagcctatgtaaacgcacagaacgcattccaggcatatgacaacatcgacggtattttctgcggcgactataacaagggtgcagtcgcatatcaggcggcaacggaagcggaccgccttacgagcagggaaggaggcaagcagatcattatcgtgacctgtgacgactccaaggaactttaccagttgatgcaaaaagaaaacggcatccagatgaacgcgccttatacacccttgatcggcgatatcgcgacgcgcgtagcaatcaagatcttagagggcgaagatatcgcgcaggatatcgcaacaccgaatattccgatgacgacaaccgagggaggcgttgttttcggattacagacccaaacacctacggaatggtacgaatacaccttcggacctgcatatgaaggatagcactactacccatgacaaagtactgagcctttctcctcccccgcataggggggaggagggcagaaggctgatccaatctgtccaaacaatttaacaatcgatgaaataaataaataaggaaacgatgctgccctaagtccttttggggcggttaaagatattacggggtgaagaaatgataaaaaaaagcaggagcttttcacagcttttatccagcggaaacggaatcgccgtatcggtcattattttatgcgtattcctgctgattgctgcaatcggtgtgccaaatgtttttcagtcggcaaaccttgctaatgtattcagggtaaattcaccgtcagggattatggcggtcggtattgcgttggtattgttactcggggagattgacatttcagttggcgcgatcatggcgctgagcgtaatgatcggagcacaggtcattgactatagcgagcctgcggcgttggcggtcatcattggcatcggcgctgcatgcggtttcctgaacggatgggtggttgcgaaaatgagggtgccgtcgctgatggtgactatcggaacgatgtccatttatacagggctcgccttcataatctctaattcacaggcgaaatttattacgcctacgcattccctgtttgggacaatggcgaaaggggatttaggcggtatccccaacacattcatcttatttctagtggttacgatcgtactttgggttatcgcttcaaaaacgagttttgggaaatccatctattatacaggcgcaaacaagcgcgcagcctggatgagcggtatcaggatcgaccatgtgaaaattattgtattcgtcatctgcggtatcacggcggcgcttgcggggccgcttctgacgacgcagatcggaaatgcgacaccggaagcgggacatgggcaggaaatcacggcaatctccgtagcagtacttggtggaatttctttagacggcgggcgcggctctgtcatctgcgtattgttcggcatgattacaatggggatcctgatgaacatgctggcgcttacgggaatgggaacctatgtggaaatggcggtgaagggactactgatcattgcagtcgtattcatatatgggttggtcaacagaaaaacaggcgcgctcaaagaagcgtaatagcaaggcggtataatcatggagaatgtgatgaaaaaaagtttaaaagacaagggttttatgacgaagtacatgttgttattcgtactgattatcgaaattgtgatcggatatatcattaacccaaatctgctgagcctcatgaacatacaggtaattttgttcgcctgtacgttaaacggaatcatctcaatgggacagtcgctggtgctgctggcgaaagaaatcgatttgagcgtgggttccaatatggtatttgcgcccatactggcggtgacgacggcagacgcactttataaggctacgaccggaacggggatccttctgggcaaaaccggtacgatgacgggcggctgggaactggtagtgattctgacgttgggatttgcaatcgcggtggggatcggcaatgggctgatcgttacgaagtgtaagattccggcgtttatcgcgacgatcgggatgcagttttttctgcttggcattgcctacgtggtttccaacggtattccgatttttttccaaaacctggaagagtccagattcattggaaacgcgagtattgcgaatgtagttccgttcagtgtaatcctgttcctgatcattggccttgtgattctgctgttatgcagtcgaacgacctttggtatgaggctgtattccacgggcggcggtttgaaggcggcaaaactgaccggcatcaataccgacaaatggaagattattgcgtttgtagtatgcggtctgctggtaggtatcgcggcggtcatctcgatgtcccgcatgcaggggatcgaaatcatgcaggcgagtaaaggcaactatgagatgaacagtatcgcgatcgctattatcggcgggattgcgctgtccggcggcaaaggcagcattgcgggtaccatgcaggcaacggtcattattgcaatattactcaatatcctgaatatgcagggtcttatggcatattatcagcaatttattacaggctgcatcattgtcgtgatcgccattattcaccagagaaacgaaagcaagcggctcaagtcattgaaaattatcgaaatataagggtggatactatgaacagtaaattattggaaatgaaacaaattgaaaaaaggttctggggtgtccctgtgctgaaaaaagtggattttgaaatggataaaggacaagttgtatccattatcggcatgaacggcgcgggcaaatccaccctgtcgaatatcattgcgggaatctatgaaagggatggcggagaggtattcgttgagggagcaccggttgattttcataatccaaaagatgcggaaaaatgcgggataggcatggtacaccaggagccgaccctctgtgaaaatatgaaggtgtacgaaaatattttcctgaacagagaactgaaaaagggcggacttttggaccgcgccaaaatgaaggaagaaagcatcaaagtccttaaaaggctgggattcgaaattgatgtggaagaagtggtgcaaaacctttcactggttgcaaagggcgtcgtatcgatcgccaaagcactattgatgaatcccaaaatattgatactggacgaggtaaccgccccgctcagccaaaaagaagtggagcatcttttcgacgtagtacgcagtcttagaaaagacgggctaggaatcatttacatcagtcacaaaatcaaggaaatcgtaacgatttccgatgaagtggccgtactcaaggacggggaaaaggtcggtgtgttccgtgcgtcggaagaaccgttgagcgaaaagaagattattcacttgatgcttggtgaaacggagggctggcacggggaatacagcgaaaaggatctgctcatggatcagggcgaagctgttttggagcttatgaacctatgcaagcaggatctgtacgaagatgtatcgctgacgctgcataagggtgagattatcggccttgcaggccttaagggatcgggaatcacggaattgatgttttctgtgtttggcgtattaaacagcgatggcgggaagatcgtcaaggaaggcaaggaaatcaggccgacaacgccaaaagaagcgatcacacaagggatcggcatgatcacgaacgaccggcaaagggaaggactggccattatgctgccgatagaagataacattacggtagcctcccttgataaagtcaagacaaacaagctgtttacgtcttcccagaaaattacgggctatgcaaatgaatacattgagaagctcagcattaagacgacagggccgaaacaggcggtacaatttttgtctggcgggaaccagcaaaaggtggtcgttgcaaaatggctgctgcgggatgcgcaggtcatcttgatcgacgaaccgacaaggggcgtagacgtaaaggccaagaatgaaatttatgatttgctgatcgaagaaaaaacgcagggcaaagggattcttattttttcgccggaggtgcgcgagctgttgaatatctgtgaccggattatggttttgactgcgggaaagatcacggcagagatacgacgcgacgaagataattttaccgaacaaggtattttggaagcgatgcattcgtattgaaaacgcgatgcatgaaaaggaggattcattatggaagcggaaaaaagcacggtagagcagctaaaaaatccgaaaaacctttcgccgaggatcaaatggttacgggattactattataaaggaagggagcgcaaatggaataatgaatacatggcgttttctaccggagagccgtgggattattgctatgattttatcaaccgtggcattgtttacgaagaagtaagggggtaccggatcacggaaggttccgctacccaaagcggattatcgcatatcatcaaggtgccggaaggcttttacaaacagagccttgccgaacgtaaggcatggttcacgaaggaagttatggtacaccatgtaccgatcgagatactgccgggcgatttgctggcagggggacgcttcaacctgcgcttatcccactgcctgagcgaagaagaggccgaggaacggcaggaacaggcgggagaattttatgaaaggagcgtggaattcaacaaccgtggatttggtaatttagggcctatccctggacatatcattccggggcaccagaagatcgtcgattttggattccgcagcgaatacgagtattacgaaaaactattggcggaattgccgccggaaaagcgggaaggaaagcacggcggacaattacgcgccatgatgacggcctgcacaatggctaaggagctggctgagaaatattcggagcgttgcggtcagttggcacaaaaggccaataccgagcaacgcaggcaggagctcatggaaatgagcaaaatgctcaagcgcgttccatgggaaggcgcgaccaacttctgggaagcgatgctcagcctgtggctgcagcatatgctgatcttatcggatgaaaattacccggggcccggaacgtcgtttgggtgcatcgaccgttatttgtatccctactggcaaagatcgcttgaccaagggatggacagggaattcggcaaggaaattctgaaatgcttctttgtgcattgtaatacggcatacgatgcagggatacaaacaggcacaaatcaggggatcagcgcaggatatggacaattattcagcttttcaggagttggaaaaggcggcgcggatgtttcaaacgacctgacaatggcattatttgaggttatcgaagatatgacccccatgctggaacctaaaccgaatgtacgcctgcacaggaatacgccggacgaggttttggataaggtagtggatcttgtgagcgaaagccagggcgcgcctttcctgatcaatttcgacgaacgttccatggcggggctgctgcgggaagcgaagcaggcgcatgtggaggacctcatcaatgaaaataatgtctttgactatgcctccgtaggttgcatggaaaatacgatggtggggaacgaccgctctgagacggtaaattgtaatgtgcttttgatcaaggcaatggagcttgccttgggaaacggcaaggatattatagaacattacgattttgcgggggaagcgtacccgattttgcaggatgggccgcagacgggcaagccaagggagtttggtacctttgaagaattttatcgtgcgtttgaagcgcaaataaaatatgtcatcaaaaaaagtgtggatctttataatcttggagacgtgatgcgtgcaagctacggtccgacaccttatttatccgtactggtcaaggggtgtgcggagcgcggcaaagatgttacggcaggcggtgcgcagcttcggttttgtaccatagaggccgttgcgtttgctacaacggtggattcgctgctcgcagtgaagtatctggtatatgatgaaaaaatttgcacgatggatgaactgattgaggctttgaaagcaaattggaaaggctatgaagtgctgcaggcgatcgccaagaataaagcgccgaaatatggcagggacgatgacagcgcagacgaaatggctgctcgggtcatggagctgtggtcttccgagtgctggaaataccgcacggaggggagcgatgaacagtttaggccgggcatgcttagctggaactattgggtaacgtatgcgggcaggacttttgctacgccggacggaagggaatgcggtcagtttatgtcgaatgcgatctgtccttccaacggcgccgatatcaacgggccgacggcaaataccaattccgtcggaaaagcgctgggcggtaaggatgcgataaacggcgattttgaggaatacaggaattgcctgccgaacggctcaagccatacgatcacctttaacccgtcgatcgtcagggatccggaacataaacagaagttcaagtcgtttttgaaaggatatatcgaaaacggtgggacggccctacagatcaatgtccttgatgtggatatgctgaaggatgcgcagaagaatccagaggattacagcacgctattggtccgtgtgacgggatacaatgcgtatttcacgtcgatcggaaaggaactgcaggacgagatcatcgcccgggaaagtcatcagaaattttaggagacggcattgatgaaacggcataaagatgcacagactgcattggtattggatatccaaaggttatcgacagaggatggcccaggacttaggacaacggtgtttttaaaggggtgcaacctgcgctgtgtctggtgccataatccggagagtatttccggaaagcaagaggtggaatggttccatgcaagatgtatgggctgtgggcaatgcgtgcacgtatgccctcagcatgcggtaaaggcagacggacagggaattactatcgaccggaaaaaatgcaaggcatgcggtgtgtgcgtacaaaggtgcccgacgcttgcgatggagatgaaaggcagggcgtgggatgcggaaagcctagcggccgaggtgctcaaggaccgaaattatttcgggacagacggcggagtgaccgcatccggcggggaatgcctgttgcatggggaatttgtaacggaatttttccggatcctgaaagaagaaaatatccataccgctctggatacagcagggatgacagaccagagcacactggaagcggttcttaagtatacggatctggttttgttggaccttaaagtattcgaacgggatatgcaccagaagtatacaggcgtggacaatgccaaaatattccagaacgcatcgtttattgccgaatattgcagcaggcatccgcagaaaaagttatgggtaaggacaccggttattccgggatacactgatacggataataatattcatttcataggcaagtatatcgcggagtatatgcagccatatgtgcagcgttgggaacttctggcattcaacaatttgtgcaaggataaatacgataggctggacaaaaaatgggagctggaaaaacaggcgctgcttcgtaaagggcgcatggaacggcttatgcgcgttgcgctggaaagcggcgtggatgaaaaaatcgtccggtggtcgggcgcaacaaaggaggaaagttaatgagatcggtagaacagatacgggcatcgtatggacaaaaagaaaagcaaattgacttttatgcgacaattaatgaggatgaaacgccgcatatcacgatgatcaactcgttgtaccaatacgatgaaggaagattggtttggggggaatcgtcagggggactgtctaaaaaaaatcagcgcgagcggcatgagatcggttttctttcgttggtggacggttcgagaatcatatgggggaaaggcaattggctggacggaaaaacaagcggcagggaggtcgatatactcaatgagatccccgagcttaaatatgacgtagcaaaccgttatacgcccgttcatatcatcgaaaagaggtccatgaatgaaggtgtgctttcaaaagaacaggtgatgcatgcaaaagaagcaacggccgccgtcatcaaacaagcaggcagaggcgacgacccgaaagcggttagccacctgactaagcggtatctgacaatagataatggattcaaagtattggctttcctcgatgaagacggatatccgcaggtcttgccggtgccgcaggcgacagtggcaaacgcgaaccgcattgtatttgcgatggaagagttcgtttctgaaataaacaaactgcatgacggcatggaagtcgctatattggcagtggaaatacctgcgatgtgctccgtattattgcacggggttttgcacgtaagaaatattgacgacatcgcctgcgggctagtggacgtacggcgcatatacaaccctatgatgccggtcccaggatatatttatcctccggtaccttatgaggcggtcgtcgaatttgaagatgtgctttacgaatataacgtataaaaacaaagtaaaaaggagagacaagaaatggcaaggacgtatatatccccatcaaaattt

SEQ ID NO: 12 - DNA, 90495 bp, Christensenella sp.
aaattttgatggggatatatacgtccttgccatttcttgtctctcctttttacttattttgttcgtgatttttctatcgcgatttttttatataaaaatcctgatattacataacgaatgaaatagaagatgtcctttgttgcttatgttatttttattatctgtaaatattttgaggattcctgaatggccggctttgcgaaattgtaaatacggcatccagattttcttttgttggtgtaaggccattataacctttaaaattttaaataacattatacgcacatgacctcattttgtaattattgatcgtaaaattttgtccttcgtatatgccatggtatttttttgaccgtacaaattgtcatttcatgtactttctgaacatcgccggcgtaacgccttcatgtttcttgaattgtttgataaaatatcccgaatcgctgaacccaaggtcgtttgagatatctgtcactgacagatttgtcgtttccagcatttccttggcaagcgtgattttgaaatcggtaacataatccgagaaattttttcccatttcctttttaaacaacctgcttagataactgggactcgtatgcgagagctttgccatctgtgacaacatgatattctcatgtttattattgtagatatattcaatgaccggttttaaaatcggatgcttggacgcgctgatatccttcggttccgttgatttgatctgtttgctcatgatcgcctttaagacctggtccttgatattgatcattgcgtccagcgacgtatcggtaaagtctgtttccacatgggtactttcagctacgtttccgagtatcttcccataggtttcattcatggcgtttttactgactgcctcgcctacaatataattacataaatgaaagagaagatccgtcaccgctacaatgcgctgcattgaaaaacatgggattttttcgaacttgctgcgcagcgaatcgctttcatctataaaactgttttcatacgaagacatcagaattttttccagatggtcttcgacttgtgcatattctgccatcacctgtcccgccatgacggcgccgatatatttctcatctattacaataggaatcgccacatctacgatattacagtggcataaatacataaatggtttgttcagcctcgccgcctcgatcccgcccctggaatcacatttctggcaatacttagcagtttccggatttcttcttaccgttgcacagaattccctgcaaccgctatgttttgtgaccggaacgcccttataatcaacaatcaggatcgccatacccgtgacttccgcgagttcatcctggatcctttgccattgctccaaatcaagaatactgcgaatattcaataaattactgttcaattgtcctacctccaaacgttttgtacaacaaaacaaactgtgatgtgcagtttgtttccacccagaaagaacgaattcgtatgaaagccaaatattgttttgaaatctagtggaattgttgaaggggatcggttcttataaagattaaacttttgtatcctttttccattataaaccaactgttttttaatgtattcgtatacaaatgacaaaaaaaagtagtttcgaatcgtatttttatgcttttttcgaaaatgacagtaatatttttaccatcttttgtacagaaatgccacaacaaaagccaaaatcaatatatgccagctaaaagcggcattttctctcacagagcatcatggaattttcttttggaaatatgtataaaataattttatcgcttattttgcgaatgcataagaacattataccgtttttcttatcttatccaataacagaaatagtaaaaattcgttattttttgtgttaaaaacagcatttttgcttgtatatctgtataggagcgataatcatatatatcgatttgcattgaagcggcaggccatataccagaaaaagaggaacaattattaccactttaagtaataataatccattgttttgccccaaagattattctatagttttagataagttttacagcattttcattatatatttcaagcatgatcgttaaaagtacactttttcgttcgtatgattttcaacatttttacgcctattcaaggcgttttttttgccgttttctgtgaactgtaaattgtaatttaaaatttgtcccaccggacaaaataaatatgaggaggctttatcatgaaaaaaatgaaatccggagctctctgtatcatgctgtctttactgtttttaaccttatgtattgccggttgctctactgcatcgcctaacggcgaagcttcatcaggtacggaaaatgctgtaaaggcggtcaacaatgatgacggcacaaatgctgaaagcgccggagaatccgtttcaagcggcgaagagacagtctataaaatcggttgttccgattccatgaccggcacgggcgcgccatatgggctgcctggtacaaaggctgtagaactcgcagtcgaacaaatcaacaatgacggcggatttcaggttggagacaaaaccgtcaagctggaagtcgtgacatccgacaataaatcagatgccggagaggcggtttcgaccgtacaaaagctgaccgatatcgaccaggtacagtttattgtcggatggagcaactcgacctcgaccaatgctgctgtgcagacaatccggaataagcccgttacactgattgtaggaaatgcacgttcccccgaagtattactgtatgcaacaggaaatgtattccgtcctgcaactgtcaattgctacgatccgattgcggattgtaaatatatcaaagaaaatttaggcgtcgaaaaaatagctatgttctgtaacttcaatgacagttccatcaatattcatgccaacaatgttatggacgcttttgaatctatcggtgtggagatcgttgcaaaggaaacgctgaaccacggcgatacggattttctgagtccaatgaccgtcatagcatattcggatgccgacgccctgtatatggcgggcaatatcgaagaatcttcccttgctcttcgccaattgcgggaactgggatctgatatcccgttgatcacgttttcctcgggtaccggcccccaatggctggaagtttgtacgaacgaacaaatggctaatagttattctatccggcccgccgttgccgacgtcggcgcaaacaatacgctttacaatgacgaggcgcaggccttcatcgatgcctatgaagcaaaattcggcgaacatcccagccaggctgcaacgaatacatacgacagcgtgtgggtgctgaaagcagccatgcagcacgcaggttccttagagtatgaggatatcaatgtcgcgctgtgggagttaacgccggaggaactggattccagaacgatcctgccctatgaagcggtagatggcaagctcttcgattcgatcggccagggctatcacccttatgcggtgctcaaatggaattcggattatgtgaacggcccgggagaacccacgggaaactgggattttgaaacgctgattggtatgaacctgggaccggatttttaccatgcgtatatgctggagctcgcgaagaccaatgatgtaaaggattttaatatcaacggctacggtaaataattgtcaggtcgcgagggcaggcaaaaaagcgcataggatatacacgatatacgctttactgcctgcccacctgctgcctgtaacctgaaaaacgaaggagtgactgaaatatggctaaagaacttaccaaagaagaatggaccgacatatatgcccgcttacaaaaggttctgaaatttaaaattgcgcccatcggtataaagtggctggaagacgaaagcggactgaatcattacagccggctgaaacgagcgaacggcaagcatttacagggatgccagtttatggggcaggccgccaggcaggggcaaacagtcggcttcacggtagacgaccttgtccaatatggactgcaatgccattgtatcctggggctggcagagccggacaaggcattttatgaagccgacgaatttgtgggcgtatggtttgagaataaggcagcggccatgagcaggcaaaaacacctcaatctcctgcccaatcgatacaaggccgtggcggccgcgcctatcgaacgcggcaagatcccagatcctgatgtggtggtactttacctgaatcccgcccagacgatctattttgtgaacggctatcagtggaaaaaatatgaacggatcgcgattgatatcgtaggcgagtctacctgctgtgattcctggacgaaagcgatgcttacgaaaaagctgagcatctccattccctgtttcgcggagcgccggttcggcggcgttgctgatgacgagatgattgtcgccgctcccatcgaggatatcctgcgcgcactggacggtatggaaggactgtccgggacagccggactgcgttatcccatcccgccgtacagtgtgatgagcgacccttcggacggactgaaagggaattacgaaaaaccaaaagcaaaataaagccggacggccttcccgcccgctgtcaaatgttcaaagtataaaggagaaaagcatgagcaatattgcattggatggcgtgattgtaatcgatttaacgaggtttgccgccggcccctacgcaaccatgatgcttgccgatatgggtgcgcgggtgatccgtgtagaaacgcgtcacaatacagacggcgcacggatgtacggcccgttgcgcggcggcgaaagcggctattatttgacgctcaaccggaacaaggaaagcatcacactggatatcaaaacggaaaagggaaaggagatattgtggaaactcatcaagaaggcggatatcttcgtggaaaatttccgtccgggcatcgcgcaaaaactggggttcggttacgaagatgttcatcaggtgaagccctccgttgtttatgcgtctatctccggctttggacaaaacggcccatacagcaaattacccggatatgatatcgttgtgcaggcaatgggtggcctgatggactccatcggcgatcctaacggtcctcccctgcgcgtcggcacttcaatcggcgatctcgtagccggcatgagcgccgatatcggtatcctcgcggcctatgcgaaatctttgcaaaccggtatggggcagtatatagatattgcattagcggatacggtcatctcctgtatgtgcacatggaaccatatttacctgatgtccgggaaaaacgccctgcgttcagggaatggtgatccgatgaccgccgtgtacgggggctttcggtgcagcaacggatatatcacgatcggctgcgccatgcattccttttttgagaaagtggcggtcgtaatcgaaaaaccggaacttctcgatgacccccgtttttcctcctaccgggcggcgtcagaaaaccgggatgccctcaacaaaatcgttgaaggctggaccagcaggcatacggtacaagaggcggtccgtttgcttcgtgcagcggacgtcccctgcgggcccgtcaataatgcggagcaagttgtaaatgacccgcaattcagagatgtacgggagatgtttcccgaaatcgaccatccgactgcgggaaaggtacgcattacgggtagccatatcaaaatgtcggatacgcctaccggtgtccgatcccttccccccgcgcacgggcagcatacggataccgtacttaaagaattgctgggattcgatgacatccaactgcagactttgcgggacgaaaaaatcatctgaaatgaattcatgaaatcctttcaaaaagttgatataataaaaggaaagaaaaatttaccgaaaggagaatagatcatgcataaaacaataaaaattgaaggaatgtcctgcgagcattgttcgtcgcggattgaaatgctgctcaaccgaatagacggcataacggcccaggttgacttagcatcgaaaacggctgacgtcgatatcgcaggcgatatcagcgacgaagtcctgcgtgaaacggtggaaaatgcaggttatcaagtggtatccattgactaataaaggcgtatgggaactttggaatacttaaacattccaaagatgatgtatgcgcatgccgttcctaagagcgcaccgaatagtacgtctgatgggaaatgtacaaacaggtatacccttgaaaaagcaatcagaagcgcgtagactgtagccaagctgcgcgctttttgttttgtcaggaaaaacatggtaagtgctgcaaaggctgaggatgtatggccggaaggaaaggaataatcgtccggcggggaaaccaaaagctgctgtgttacgccaaactgtgtaaaggggcgcggacgcatcaccaattcttttaaaatcagattacccaggatataggtgagggcaattgcaagcagtagaagccagcctgccctgcgtgtttttttatccagcaaaaaaagaaggcaggtaagcagccatataaatccgctgtctccaatggcagaaaaagcaggcataatggtattgagcagtctacaggaaaaagcggccgatgtgaaaaacaacattatattatcaatattttgcagcatagcgactcctttataaacctgttgcaattatagcgtatttgcattctaaaaacagtaaacattttctaaagaaattcttaattgaaaagccgatcaggatattgacggaattttcgttacggtcattgactttttgggcgttctattatacaataataaagctttaaattttaaggtgtgtgccagtagctcagctggatagagtgtttgactacgaatcaaaaggtcgggggttcgaatcccttctggcacaccactgataaaaccgcttgtataaaggaatatgggcggttttttgtttgtaaaacaatcgaacaaaacggagtcaaaaagaacatttacgactaaaaagtgtcgtaaatttgtcgtaattatatcataaaaatgtagatacttgaatgacatctgcccgacaaataacggcaacaaaaaagcggggacttgcgccgcccttctccatcactttttaggtagcttcctaaagtctttacgcactttgttactgtgccgttgcctctgcaagggtaataaaaaggacggggtaccgtccttgaagattttatatttacgatttttttgcaactgttgatattccttttaggattgcattttttatcaaataattatcatgtgtgcggatagctatccgtttattaaactcttcttctaaatgctcaaacaatccaccaaataggtccctagcaaatcctgtcgaaatatatggtacattttcaaaatcaaatataatcctggtgtcttgcgatttatccagaagttgcaatgcatctttttttattttgatgcccgtaactcttgcgcgaagcccaaattcatcataatcaattactttgataattctatcagtcatcgaaaacacctcctaaactaatttccatataatcttccgcttgatcgcatcctatcatttgcttaaacggaatatctataggacatacccaggacatttgcggacatcgccgcataaccaaaaagagcgcaagcctaagcccacgcccttctccattatcctaataatcgtgcgatcagaaatgatacaatccctacaatcgccgtaggtacaacagccttccatatttcaaaggtcttttgtttttcgcctttttcaatggtgtccagccgttcatccacattcatcactttatcggccagtttttcaaccgatatggcaagcgagtttgtcgctttggtcaagtcctttatttctttctgttgctcaaatagtgtcctgatctgttcggtgtgtccgcttactgttctgtcgattcgcgctacctcggttgtcaactgccttgtgtccatgtcttactccttcggtttctcgtactccatcgcctgctcgctgtctgatacgcccttcgtcgtcgggtcgctaagtaccccaataaacgacaataccgccatgcccaccgtgccgatcaaaaacggattggtgaaaaactgctgcaacacgtttccaatactttcccacgtcgtcaggtctgcataatcaagcccgtaatatgccagtacaggcgatgcaaccacgccaagaatcccgatccaaaactgcgggctttttactcttaccttccaattaatcttcatctttttcctcccttcatccctgccataaaatagcccatgtcttaggtcctaccacaccgtcagcccccgtgctccctaagtcatagccttccgcgatacgcgctttctggaacgcgatcacgcccgctttggtgcgcttaccgtaaatcccatcgatgccgcctacatccacaaggtgatgatcaagccgcttctgtacctcccgcacatcatccccgcgcatcatgggagatttcaacttcaaattgcgtgtcagttcgggaacttcaatctccggctgctcgattacaggcggtaccgttgcggactgtccaagcgcatattccttgatctcctgcaacggatataatttaccagggcaatccgtgtatcctggccccgccgcctcatcgtgtccaacaatctggctcgcctgtgtaaatccgtaatgctgcacaaggtcttttactaccctgaacaacgcgtctttctgcacctgcggcatgacgttatgttcaatatcaccctggactgctactgcaatagacgtatcgttgtagcccttcgttttggcgttggaattgttgacgctgccgccgcagtaatcaagaccccttccccatacgacatcaccgtttgcaagcactacgatattataatctatccccgcgtggcccctgccgatatgatagttgtgtaccgactgaaccgatccattgctgccaaaatggtgcagcagtatccgcagcgtttgtttgcgtgttgcatatgctcgatctggtacaagccctaaatccttgatgtagccaaaatcactcatttccttttcctcctataatctcttgtttttctttttccccgatccaccctttgtcgactgccctttgaaggccatcgtcattgatacgtccatcgtcatacagccgctgtagcgtctcaaacattcccttcacccccaagcattgaaatcaccagcatgtcaagcgtttcctgtatgacctcaatctgtgttttttcgcgtggctgcgctgcctgttctgccaaaagccgcgcattatactcttccatttgccgtatcgattcatccattgattttccctcctttattttggataggtgatatatgtacttaccctgtgaactgctcccatcggtgaatatacgcatatttcaccgtttgccttaacccatgcccagccaggcgctaccgtaccgtttgccttttggcagatacacgggaagttaagcgttgccgcaggacctgcaaagcctgtaccgtttaaattgcctattgccccgttctgcgggatcaagtctgtcgtgccctctttaccggcacacgttacaatgatattgatactgaaaccatcgtcccacgaccaccccgcgtcatatgcaaggctggataacatcgtaatgactttgaacgtttttggcgcgctgacgcttccttgccaaacttgcagggcttgcatatccgattgttttgcataatgcgccggaagttgtccccccagcttcgatgcatccacgccgcttcctgttgccacgagcgcatcgattaaatcattgaatctcccgagcgcaaccatatttttcccgatattgtcaaacttcgcttttagaaaatccgcctgccctactacttggtttggcaaagatgagatatccttgtttacaaactcggattccgtaaattttaaatcagttatcgccatattgttttcctccgtacaaaaaagacaccctttcggatgtcttaaattactgtttacttttgatttccccgtggtataataaaagcagggatatgaccgcaaagcggttggcccaagagataagattaaataatcgctacctttgggcgggggcgattatttttttgcttctgaaagtatcttgtaaaccacaatcaaaatgactgtaagtatcaccaaatattccattggcaccaccactttctagcccaagtatgggtaaagtggccaaccgcccgcaacgtatccctgctacgttattatatcatgctcatgctgccctttcaatcacaggaagcacgccgttttctttgagcagttcatacaagaacaaccgccctttttgcgtccattttgtttccatcacaatatccggcctgccgtcgcttctgacaatatctatcgtctcgctgtgcgtgtagcctttattatggtatttacggtatagcaaccattgcccgctttgtttatactgtactcccaaatctgcaagcgtccggttcattgctctgccgctcatgccgtaatctttggcaatctgcgtgatggttacaagccctttattctgtaagattttgtctgtatagtcagcgcgcggctttagttctccgattaattgattttttcgttcgatttcagccgccagaagcccgtttttagcccgttcttcctttaatgcagtaaacgccttaattgcgagatcgggattgctcaaaagctcgtctacggcgtatacgccgtgtttgcggattgcaggaagtacttcatcgaatacccaccgttcgaaccgttccgcagagggtaatttactgtgtgtgataaggcggtataggtcgccctcggtaatgaatgtcatttcctgtataccgccgtttgtaagggcgtcgcgtttcacgactcccttgcaatgtctactgagtgcatctcttacatttctgtatttaagcattttagccgcatcatttccacaaaacaaaatcttcccgttttcttccagtgtgcggatttccccgaactgcttatttttaaatatttgtaattcgttcatgctaccatcctccctatatgatgtaataatccatctgcaaatcgtttcaccgatgcttcttcttcctgtctcacatgtttttccgcttgcaaaaggtcaatatgggtaagaaaagcgtgccctatttcatgcgcaagtacatgttccatatcttctgcgtctgggttcaaactaattacggcgcacctcatactgttttcatcatcatataacccattaaatatctttttcagtttttcattctcaatgtattcgatttcaattcccattagcttgcataaggcaaacattctttccattttactcataaaaaaactcctttctgattgcccgaaagaagcttgtatggtataatatttacaagcaatcttcgggttgtggtgtgaaacagtccagtttactttagcgggtagcgggctgtttcttcatttttttaattcttcgtcgattttttcttcaacccatgccgttttagtttttccttgtttacgtaatctgttctcgatggcttctactttttcctttggcaaaagcacgctaaaaccctttctttctttacggcgctctttgaagtaatcggctctgcttttatttgcgattttcttcacctccatttctgtatcgcaatacaaatatatcatgtatcgcgatacaagtcaagaggtttttttcaaaataaaaccgcccattactgatacttctcctgttccatcctgcgcgcatttgtcctctgctccgccgtcagcagccacggcataacggcttcttcctgtttttccttctgctgtttcgtaattgcgttgtggatatccaccatcgcctgtacggggtccgcgctgccgcctgttttgggagccgcgccctccgtacccctgtttttagtaagcatgctccagtcaagtttcggaagcgtttgacccggcgcgcccaaagcttcttccatcgcaagccgcgcagctttcttcgctgccgtcttagagccgcccgacgatctcctgccgcctctgccgcccgatgaactgtccagtttcagcgatgcaagcaggctttcttttatctcgtccgaagccgaaagcccgcctatatactcccgtactgcttgcgcctcgctgccgttaagcgtgtattcgcgcgcaaggaaataaagctgctgctgctcgctcattcctgtcgatgcaaggaaatctatgtatttcttctttttgcttccggaaatcgtctttccgttttcgtcataatccgcacgcaaaggcgcaaaatatgcgtacgcctgcaagtaatcgtcaacaggcaaccctcccgccgcgtaatatgagaatttgtcgtcagccggcatctctctctggtaaaaatacaccttttcttcgggcgtgtaatcgccgtttagtatgtttgtgagcgatacggattttttggtgccggactgcgtcgtgcctttctcgtcgacgacgatctgcccgtccatataaaacgcgtcgtcctttgtattgccgggcgttccttcctcgtctgccttctgtatctcgcgctgcaaaaacgccctcggccgtactccctgcgtttgtgcaaacgcgatcgtgtcgcgttcgtttgtgtccttgccctcaaatatagccgcatatatcggtgcaatatcttcgtcccctgcattctcaaacaaccatttttccgcctctagtttttgattcacatcgtttttttcaaggtattccttgttgaaaaaaggttgcgatttaagctctatgaatttcttcacgtcgccgccgctatcatatatctttcgtatactgttctcatatgccgtcctactgtccgttcccaatttctcaaactgcttttcgtatgctgtcacgagcgcctcgccctcaaaccccgtattcagcaacgccgcacgtttatctgtatcattgtcggttccagaaattcctgccttgtaggcgtacatctcgcccacattatcactcatcgccgttcccacggataaatctgcctgatcgtagctgattcccctgtttttgagcatctcctgctttgcaatcttgttagcgtcctcgctcaaagaggcgagcgcctttgctttctgcccgtccgaaagcgccgcgtatgccttacttgtaatcatcgcgtcgccgttcgtcttgatgaatttcccatatgtctttttgtattgcgtgaactcgtccggagtcatggaataattcgtatcgccataacgaaacgagctttgcggcgcgtgaggcagagcggatgtttctccaacagcatcgtatacccgaagggcctcgtttgccaatgggtcgtccttgatcccgctgcggtaccacggtgcaatgccgttctccaaataccgcgtaagtacgtttccgccgtttacctgttcccgtccgaatatatcgacatacggctcgttcaagtaggaaagcccaggaattttgttagccatgcgcctaaaaaacgattccaattcttttggtaacggcccgttctttcccgcgtacgtcgtgcgccgcgtcgggtctgctgaccgcgcaatctgcccaaacagcgtagggatatactgacccgcatagctttccgccgctttttctgccatgctgccaagcgcggccatgcccccatcgtttctgtacgcgctcatgaagtcgtcaacgctctgtaatatcgacatgtccatcacgggatttgcgctgttcataatcgccgtaaaaaaccgagagacggggtctccttcatcatcattttccatgttcgccatctccacgcccatgaaaagcggaatactcaccggagcaagccagtcaagcgaatacgtattgtcgccgattttaatgctatatccctgataaccctgatcgttctctaaccttccctcgcgatcatctccgctacccgcgaggataatgccggaagcaccaagaagatacccaatcgccataatgcccgtacccgtaaggccagacgatacgccctccacaaattcagatgcgctgatgtttccgtttgcaagctgctttacgccgcgcgtcaggcgttctacaagtcctgccggagaatacctaagcccttgtttcaagatgttgatcggtgttttacggaagggcagcaccgcgtccattaacgccgccgcgcctttgtggttgcgcgccaaattgttaagcgccgccgccgttttggaatactcgcggaacgtcatttccagcgcttgccgcgtcgcgtactgctgtacctgctgcaaggccgtgtttcccgccttcgtgccgctttcaaggaatccttgcgtatatccccgcgctttcatcatttgcgcaaacgcgtttgcatacgcccccttcataaagaacgcgtccgcaccttccagtcctttgttattcaacgtgcgcagaaactcaagccatcttgtgttgaatatcttacggttctggtcgataacgtcgtccatgccgtatttaccgtcgctgagcatggcgcgttttgactgctcaaactgcgcctttgcaaactgcacgttctgcctgtcttttggggtaagcaccgcttttgtacgctctccttccggaacgaacgcgtgctcaagccctgttgcaatcaggtctctgccgttcgtcacaagccgcataaacgcattacctacgatgttgcgcgcgtgcgtccttaagttgccaagcatggaaaggtaacgccacgcccgcagcttatcccccatcgatgatggaagtttctgcgcgatctccaccgccgccatttcttcggcagcgttaagctccgaaacgttctttgcgttcatgatcgcatccgccgtttcctgcgaaagttctatatctttccatgccttatcagggttcttcagcgcctttttctcgaatttctgcgcatattcgcggttgatattcgcaagctgcctttgcacgtacaccatgcgtccctgcggcgtaagcttgtcgatcatggaaaacgcctgcgtcatctgccctgcacgcgtgccttctgccgccaattccgcagccagcttcataaaaccttccgtatcgcccatgtccgaaagctcggctaaaagttgctcgccctgcgcgatctgtgttttgttgccgatcctcccttcttccgccagagtaagccagcttgaaagcgcatcccctacgccgccttttttggcgatccactcgctcgcggcttcaatcgctctcctgttcgatacaggtacgtattggaactcaccgcgctcaatcgcttctgaaagcgccttgcccgccccctcgctcagattcgggctttcaagcatgctttttgccgcctgccgcgtacgtgtattttctccttcaaagctgtattgcctgttgccattgccgtccttcttgtttataatattattagaaggagttgattgcgtgggaagatcggcgtttgtgctcgcctgtggcgaccgcatatttgatcttaaattttccccaccccgtgaatttaaagacggggcttgggtcgatgcggtcccgttttccgaggaagaacgcggcaaagccgtgaagctgtcctcttgggaagttgccgtgctcatatctctccaaaaatccaaggaggtatcttgaatgaagctttcaccgtatgtattgacagaatccggtcggctggtcgatgaatccagagctcccgtcaaagaattttttgatggtgcttggcgtaaagcgcgatctccgctatttggcgaagatgtgctcaacggtcgtacactctcgccagaagaagtagatgagcttataaagtccggcaaattcaactgagcccacatttcatttgagcgctgtatatctgcgtctttttggtctaattcagtttgccccaattctgcatcatcagagttcctccatttttcataaatcttgtcgctttccaatttcgctttccatgcctccggcgtagtaagctgcaattctgcggaaagtccgtccgcgttgcggaatgtaatatgataccctgtgtatccataccgtgtcggccccacgatctcgctttcaaacgggatacctctttcgccaagcatacgctccacttctgaaatctgcgaaaaatctttcatcatgatcttgtttctcgcgtggtctttcatatccagcacagaataatcttgtcctgcagcttgctttcggttcgttttgtttttcatgctttcaatggacttttgcgtcgcgggttcatacttcgttcccagctccgatgatatttccgccgttaattcatttatttctccctgcaatcccgttgcacgctcataaacggcttcataatccgtgctgccatcctgccttaaataccaattgttttccccatccgccgccttgcgtgtctcatggcgcggctgtacgtaattcggaacggcgttgtttacaatagcgtcggcctgcgtctccgcctgctccgtaagcgcacggtttttggaaagctcgcctaaatcttgccctgttacgctcgaaacgatactgtccgcttccgccgctatcgggttattcagcgcgtccatcgtgcccatattcacataaaggtcatcggtcaactgttgctgcgctttattctgcgctctgctctgtgttgtatccgcgatatattccggcgcattcatcgttcccgataaaattgcgcccatcaaggccgcttccagtttgtcctgcgaaaacggatcgatcacgttgtcctcccccagcgcaagattacgcaggatcggatcgatgttcgcctgcaaatattcctccaacgcttcgccgcccatgtttcccaaagacatcatcactttttgtacggcagggtccttcgataccttttgcgctgcgttcgatacgattttacccagttcgctgcttgccccgaatgccttcacgccattcagcgcgtattgcgttaatccttccgccactgccgaaggtaccgcgtacgccactgcctccgaagggtcgtatccttgcgctatcgcccccgaatacgcatcggagtaagacgtcgccatgatcattgctgttcctgctgcctgccctacgccgggtatcatatttgcggcaaacgtcggccccatctgaacgccggaataaagaacgtcgttcacaaacgcttccggtccctcaagtctgcttctcatcttttgctgcgtttgctgtatcacgcccggcaagatcacgtcgtcgctgcccgtaaaagcggcggacatattcataaatgcacgttgcgtgtttttgtttgcgccgccgaccgtcaaggaccctctcgccgtcttcttaagaaattcattatcaatgctttctattttctcatcaagcatagacgctgtccgttcctgcagatcgggcatcagggaatctagatatttattggcgactgtttcgtcgccgttattttttgtcaaatagtaggtgtacgtcttcacctcatcaggcgtaagcatattgtatgccactgtattgtcatcaagataaccggcattccatctttcaaagtcgctacctttaaaatagtttgccagcttgcttttatattcgctgccccgtctggaaatctcgtcaaaagcaggatcggcctttgcatgcgcctcgtaggtttgccggtctatcgcctgctccgttctttttttatcagttttaagtccggcaacttgcgctttgttgttttttacatcagtaagggcagcgcgcgcctcttgcgtacccgtgcgatcctgcagttcggcaattttcttttccttttcttcatctgaaagccatttgctggttcttaccgcattgattgcctgtgcattaacagattctgcgctgcccccagtgtatttggctgcattggccttaataaaagcatccgtatcatatactttccgttccgacgtttcctgctgaatcttcgccccggatatcgcatcatcataaggttttaggatatcatccttgtgctttttcacctccgcgtttgctgccggatcatacagagtatttttagttgcgctgtcctcccagcgttttttcgtttcctcgctgcgcttcgcgatggcctgcgacgtttccgcaagcgaactttggtgcagcgttctctgtgaggtttccgcctgcttaggcgcaataggcgcaaaaatattcttgtagtcctgctccgcctgtcctaaattgggcgttttcgtctttaccgaatatttgtttccgtataccgcatcggcgtacgactgcttttttgacggaatggcgcgcacgctctttgcgtactggtccgatgtatataccttgccgccaggcgcagtgcgcgtgtttttggactggaagctcgcctgctgccttgtcctgcccgcgtcctcgcccgtaccaacgtaaatttttctttttttgtcccatttccagcccatatcaaaagctcccgtttcctattatctccacttgtttccgtataccgaatcagcatacgatttatcatatttcgaagtcggtttgtatgggctagtatacccgccatatccttttgtgcccgcttttgtggcattcgaatttgtatatgtacttccgccgccggacgatccacccccagaagaaccgcccgaggaacttcccctaagctgctgtctctgtaattccatttccgcttcccagcgtcgcttttcttcctcttgtttttctttttctacctgcgcgttgtatgcaaattccgcctgcgccaacgcatcgtccctccgctttcgctgaagctccgccaataaattggcgtatttactgcccagtgtagacgtattcgtgtcatagttcgtgcgcaactccctttcgccggacgcatacgaattgtttgccgcgttcctggaattctggtaattccgcagaaggcttgccacggacgtttcgttcgcgccgcccgtcattccgtttgccgccaaaagagaaggcatcgttttctcgttttgccgtttgctgatatatgcctgcctaagcgcttcgtcccgcgtttgcgcgattttgtccgtgctcgctttcagttgcgcgtcgatcgccgcctgttctttggcctgcgcgtcttcatatgcctttttttgctcctcgtagccgttctgcccttccgcccatttctgattaaaaatatcttcccaattaaccgccatattgtccccctatctcttgataaatccgcccaactcgtaattgacgcggatttcataaagcccaaacgcgctgtttatttccgcgttctttacgatcatctgccacatttttgccttgcgcttcttctttctggcaggtacgaacaacggattaggaagcatgccgaaattgaaattgtcaaagtccacgttgtcgaaatcaaagatcgtagtcatcgcgtattcttttacttcctgctcgtcgtccgtcatataacagatcgttccatccgtcttcgcaaatggtttgaccacaactcccgttccggttttggtgatctttttgtaaaccgcgctgtctgaaagccggtccattttggtcgcccacgcagcggcaattgcacgcccattatcggaatacgcgtccattccgtccgtaagctccgtcttgaaggcgcatacccgcccgtcttttgcgccgaaccagatgcgcccgtcgatcaccgctactacgcgcgcgggaatatccgtccagtaataccattcgtacccgaatgattttgaagggttgatgttcttttgccgcgaatccgcgacatatacatgcccgtttacgaataaataaaagtagccgtcgttcacacaacataccgcctcgtcaagccccgcttcttttgtcagggaagcgttaacataataactcctgatctgcgtggttttctgttgggtgacggacgaggtgtccataccgtaaataccgtcttttgaaagaaaaatgttatcgtctacaagggtatgaaacccgtacatagaacatgcgcctacgccggctaatccctgcttggtgataaaagccgcttcgtttttatcattgagcgtcgcgctgcgtaaaaatacacttgcatcctgtccgttcggttcctttacaacaacaaggtcgtcatattgttttaaataccccatgatcgcgcccgcttcgctgcccacgatgttgtaattaacgtcaggaaaataatctgcccgcagcgcaccgcaccaccagtcataattacggtaattcgggttgccggacacaaacacacgcgtgtcgtttccaattccatacatggcggcgatcctgcactttttgattctgtccgcatagcccgttatctctttttgaaacgtgatcctgacattatcctctccggtaacggggggcgtccccggcgctgtcgcaaacgtaacgatccctttttgcagatcagccgtatacgctgtagtctctacaaataagccggaagcgttcatcacttccactttagctaccgcgtttatcccttctgcgtcaagccggtattgcgtcgcgtccgccttccccaaaaaactgttgatacgcttgctttgcagcaggtttaccggttcgtaatccgtgcccccgccctccggcggcatggaaatcgcggtcgtcggaatatatgcattgtccataacatccgcaacgctcgccccgtcccataccacatagtttttaccatccagaatatacagcttgccggaatatataaagctccagcttcgcgcatcattaagccctgtcctgatgctcgccgcctctgcggaggtaaagtcgtacaataccgtacctgcgtgcagcgcaatcttcttcgtaccgtcagccatgatgtaccggtgtatcccgttgatccgtccctccagcgttgccagaacagtatatcccgtgcgcttttgcggaaatccggccatgtcggcgatcatatttggcgcatacgggctgcgcgcgtcgtctacctccgtcactgcggatgtcaggtcgacacctttaaaatcacggtatgattttttatatacgtccgccgcctccggcgctttttcctgatacatttacccttcctcttccgcaatggaatttacataatccgcttgcaaaatccggctgcgttcgttttcatatttgttcttgtacgccgtcgcaatgcccggcgaatcctctgtaaaaatatatccggcgcatcccatcggcaaaatctgccgtgtaaattcccattcatagtcaaccaaatctgccattccggttaaaagcggcggggattccagcttttctttcccacggcgctctcgtaatgcattgtttgtcctgaaattttccgccagcatataattcagcgtatccagccaaaacggttggtaatccggcctgtcggtttgttccccgaacataaatgttaccgccgtgttaaaaatctcctgtgccgtcatcctttatcgcctcgccctgtttttcgcgccgtttgcttgcttcgcgcgctgcggtattgccaaagcttttctttcccgctcaacgtccgccacgctcaagcatgcctttgtcgcctcaaattcttccttgctgatctctctgttcccgcgaatatacttttccatactagtctcctaaaaataacagagggagaagcgatctccctctgtccagctcttaagttacgcgtccgtggccgtagatacgccggacgggaatttcccgctcgcttcgccaaacgctttaaacaccgtccccgcggtcgtcgtaaccgcatcggagtatgtttgcgccgttttggaatacctcggatcactgccgtccaccgtgtacttgaacgttacgccggataccgccgtgatcgtcgcgctgtggcttgcgatcgagatcaccggcgctgccaccacatacgcggaatccgccgccagataaacgccgcccgcctttgcggaaaggacaaacgcgtcgtaatagttgcgtccctcgagcaaatctccgtcaattccaggcggatcagacgtaagcttcgccttcttgatcttgttcggcatcagtacagaccctttgtatgtgatcaggaagtatgcgtttgccggaatatacgaatcgggtatcttgatgaccttcatgtctgctaccataccgacgtatcctttggagagcgctttttccgcgagattatccaccgccaaaaactgctttgacagcctcagtaaattgtaatacgtggtcggcaggtacaggatgcggttatcatccggcaccaacaggttatctaaatctttcgcgccgtcgaaaatcttctcgacaatcgtatccgccgttggcgccgcgctcagccctgcaattgtgcccgcaaggtacgaccatctgctaagcgcgtatttatccatcgtaggcacgacctgttccttgatctgcatcttaagcatttttgcgccgccctttgtgttcatctggtctaagttattccccctgtcgatggtcagcgaaaatcccttatcttgcgaaagctcaagctcctggatggagtcccccatctcgaccggcgttccgtaacggttctgcccgcttcgcacgtagtcgtttaatccgactgtctgcggcgtgtaaatcgtgatcgactttacgccagaaaattcatagtctgtagacgcgttccccgccacaaaagagttctttgtaaatttttcagcgatcttgccgctatatttacttgctaaattaatatctgccattttctttcccctctcaatccttcataaattccaaaaggaacggatcggtcacaacatcagcctgtccgttcacattcccgggagttgtttccctgttcttcttttcctgccggagcatcttaagctccgtttcctgctttcgtatcaaataccgttgatatgcggccacgggcgtcgctcccgttttcgtaatatcgtccattacttcgggcggcagttctttcacatctggatatagccggtcaaattcctctatgtgtttctggaattccacgcgcgacttctcgcgctcgctgcctgcctgctgctcagcgcgcagccgttcgttctgccgctcgacgtccgccacatactgcgcaaggctttcttccatgccctgctctaaaagctgcgatatgcgcgcgtccattttttgcttttcagaagcgtcctctacagcctgcaggtactcctgcacgctcatgcccgctctgtgcgccaacgccttgagcgtgtccgggaattccggttgcctttcaagcaacgcttttacatcttcgctcgtgtacttcctgccgtctacatccagcgccgggctgtccgcatcttccttttcttctgcttgcgtttcctccgccagcttttcctcgggtgtgtcgatcgtttcctcggcgcccgtttcctcttcgtccgcaaaccccgcttcaaaatccgcttcggcgatcgcgtccattgccgccgtttcctccggctgcatcatgttttcttccatcgtttacgtttcctccgtaaaattttttatttatgcaaaggtttccctttttgcctaagtacccaactttacatcctgcgcgatttcaatcgtttttcctttttcggggcagctttggttcacgcactccagcgtcattatatacgcgacctttgtctgcgtctgtgcggattggtctccgctcacttcatagcgtcccccgcgtaccttcatatcatttccgcatttactgcaaagcatctccgcttcccccgttctttaattcctcatacgctaatacgacgcgttccttgtccgtatccgcgatttgcatcgcctcgacaattcgcatcgcttcgccgtcgtctttttccataagctgaactgcaatgtctgcgatctggccgtctgtaagcccgtcctgcgttttttgctcctgcaagggcggttgttcctgcattaatccggcatcctgcgccgccgtttcctgcatcgtttgtatttgcattgcctgcttgattttttcgataatgtctttcttgttttttacgtatccatccggcaggctttcaaggtatgtgactgcgtccggcaatatgttcctgtccatcaggttgtccagcgtctgtacctgtgtaagctcagaccagtacgccgcctgtccgatatcgattttcagacgcagtgcgtagtcgtttagggcagaatagtcaaatatcacggtctgcgcgccttcttcgcccgtaagcgtaatattcctaaggccgtagtttacccgcatcatatcgatgaaaatacgaatcacgctctctacaaaattataaaaatccattcgctgcaaatcgagcggcattccagccgccttctgtaccgcgacgattgccgacgtgttatccggctttacatttcccagcgccgcgtcggacgcgcccatcaggtccttgctgtacctgatcgtggaatcaatcatctgtgacacatacccgctcatgtcaggaggtcgccatgcgttaaaaatcgcgtcagtcacgctgccttccacgggaatatcacgtcccgctctcccgtcccacttcgtaattttcgaactgtcgtaaatgactttcggaaaggctccgttttgcatctgaatcatcgccattgcatataacttgttgacaaatatctggttcggaatcgctgcggtaatgggcgatactccgtgataagaatttttcacgccctcccagttcataaaccccacaggatatagcttatatcccgtgtctgtgcgctttacaagctctacgctctccgtggatttcatcatccataccgtgccctcttccttccaaagcttaagcagcacggttgtatactcgttttcattgtccctgtcagaattcatatactgcgattcgttatccgcaacaatcgactgcggatcaacgccgtatttttttgcctcctcgcgcacctgcgatgtcagccgcctgtatgcaaggatgatgtacggctgctcctgcggctcgctgtttgacggatcgccaaaatatatatttgtattgtcgatcaagtctaccttgatctcgcccttgtattcaaagcccgtttccgcgtccggatcaaaccagatataaaaacacccgtcgccgtccaccgcgcagttgcggatcatcttgcggtttttgaaacggacgtttgcccgttccatgatgttgtcgatctccgtcgatataattttcggaatatcaggttgcatatccacgctgctgcccgcgctgtccataatctctatattcgcggcgatatcgtccgaaatcagcatagcgttatagtaatttacaacaggttttaaaaaattaaagacgggctttggcaattcgggagcctttacgccctcccattgcttgccgttgaaaaaattctcgttgcgtttgaccgtatcgtatagaccaatccccgtcttgtattcaattccgcgctggtattcgccccatacctcgcccgccgtttgtttaatcctcatcatcgttcaactctttctgccgatagtcaggcatcccataccctaaaagattttgcatttgaatattcatcctgtccggctgcaattgcgcggcgcgcgcagcctccttcttttcttctttttttctcagcacaaacggtttgcgtatccatgctcccagcacaaacgccgcaaacaacgctattaaatgcagtatgtccatcgtcactctccatattccaaaaagtcgtccacgtctctttcgtagcgcgcgatctccgccggcggttccttctccatatgcctgcgctgctgtcccctgatctcgcttgcaatcatatcggaaaacaaaagatcgtcgtgttttccactgatcgcgtccggtctcccattttcgtcgtaaacaaatgtgatacattcgcgtagcatagcggcgtcgttaaacagttctatatggttgtttaagcagtcaatctccctgtcgatgataaggggccgcgtgttgccgtcagttttccatccgtattttttttgttctttcttatccctgctgtcatacgtcctgcgcatatactggcgcgggtatttcaggcgctgcaattcctctatcggtcccgtgttgaaattcatctccacgccgattaaggcgtcgttgtaatactttcccaaacaatacaattgatgcgtatacggcttagagtggtccgcctgcatatgcagcgtggcgacccttttgcctgtgatgttatcgatcaccgttgccgcgtagtagtccctgccttcgcctttggtgtctccgccgatcacgtacggaacgcccgttttcgggctctcatagatacgaatatcttttccgttgcccggcgcgtaactctcgatataatcttcgctgtccgcgtcatgccacgtatagcaaaagctgatctcctttggcctggtaagctccgacaaacgccgcatgatcttttcgttgtcaaaaacaggacgcccgctcatcaaaaacgcttcctcagggcatgctggatactcctgagcgaaaaggtctttgtttccgccgcaattgttcttgatgcaccaccgccgccatgcaagctgaccatccgtcaggcggtacgcgtcttttaaacgccgttcttcttcggtaaggacaacccccgcagctggaagcgtatactccccatgttcccaccacgcgcagaaaaccggtacaaaatcactctcgccagctaccgccctatcccataaatctttaaagtcgtcgtacccgtttgccgtggattcgatgatcaccattgtgttcctctcatgcggtaccgcctgcaaaagtcctgtgagcgtttcttccttgtttcccttccagtaagcatattcggaaatgtgcaggttttgaaatgtatcagaccgtccaatgctgtcgtttcccgccgtcatacacttgatagagctcacgccgtccgcatggtcaaatattagttcccgggcattgcttgccttaagcgacggccttaaatcctcgtctaaagtatcgtggtacctctttgacatcgcgaaaaggttcgtggtggcgacagattcatgcgccacgataccgctcgccacgttaggatgcgtaacgcagtctttgtatatcatggcttccgccagcgtagaaaaccccatctgccgcgcctttaagatgattgcgcgcacaggttttccttccgtatattgccttgctatcgcgtcgtacagcttgcactgcgcgggattcagcttaaagtctatgatgttggcctttttatccttgatctttaaaaatttttcgataaaagcctttgtgttgatcgccatgtttgttaaaacttatcccccatcacttcccgtagctttccctctaaagacattttccccgatacgttaatgctttgttcgatcttgtctttccagccgaattgtttcaatgcaaagacatccccgccattgcctcggcctatcagccttttttcgtaggcgttctcaatcttcaactttgccatttttaccgtgttggaatattcgtcttttccttgataatccataagtacatcccgcgtcgtactcaaggcgagcgcaagccccgttacggtaagcggctctcccgtttcctcgcaatccgcaaagtatttatctatcgcaccctgcaacgcctttacagtcttaaattttaatggtctgccccgtttattatccgacatatctccaacgctccatttctccattcaaaccgataaatatcccctatccgatagcttccgccgcgcacaataaacgcaactgtctttctccggtccgccctgctgaccgctatagctgccgtttcatcccagtagtgttctgcattgtatttgtccattccctcacccaactgtttccattttggaaataatcactttaaaccaaaaagacccccgtaggagtctttaagggctgcgcgcctcgcaagcattcacagcgcgatcactttatatgttgcggctataccgctttgtttcaagtccgctatttatatgtcgctgcgggcaagcggcaattatttaatcctattccgctctaaaacctgcgcttatctgtgcaggaaacctacggcttggttttttcgggtatcagccagcttgggcgcttaactattcccgttggcactcgacggcttcccaaatgccgcctgattatagcggtatgcgcctacccgctttcacgtgactttttttataattatctcatggtaccatcatactgctaaaaaacgcagatttccgcagttaaaccgcagttatttttaaaagtgccgacttttttatttcccgtagatacccatcgcagtaatccatttctatcgaaatctttttgggctgcatcccttcaaaataccgcagttgcacatattttcgctctgtttctgttagccccgcatcctttaccatcttctcaatctcgccaatgtggtaaaatatatccgtgatctcattcctgattacatccaatcttgtcccgtatgcatcaattattttttgtactgccgaaaacacaggatcagaagtaaatccaccttgtactcgtacatcctccatgctgggacgtttcagcagtccatccaaaagagtattatgttgccacaggatttcatctgcctgctcttgcagttcttttaatcgtcttttgagccttgcgtaatcatacagtctcttttcaacatcttgtgttccttgcattatatactctcctgttgtatactatatttagaataatccagaacacagaaagcgccgcatccccatcccccacttttaacgcggcctgtgctttttgtttttaaccaaatccgccccgtctcctttttaacaaatcgttcaccatttcttttcaagcggttcatattccccgtttaatgtatatgtaacgcttcggcgattatatagatgaggcttggaggtacaagccaatggatactttttagcaatccctgatacttcggtgtcggggatttttgctttcccccgcgcttatgcgctatattgcgtacgcttcgtttttttcttgcggtctattttcttctgctctctttcatcttcccgtctcgtaagctccccacgcagacgggcaatctcgtctttaacccattcctttgtttgctcatccatcttgtacgctttcaaaagctgttccagtcttgtaatttccgtattgatctcgcaatcagtcggttccctgtattttctcatggtcctttctcctttaccctattacctcaaccgcgatcctcctgctgccccactcattgccgcaggtacacacgtcgcgatcccctaaatacacatctaccttgccgttgtccctcatacgatcctctaccacgcattcaccgtagcagtcgatgtaaagccttgtgcctatcgggtaatcattacttgccaccctgccccatgcaagaggctttccgcttgccgtaatgcctgtggagtcacatgcggagcagtacgccgtaaccgttttgacgtcgccgccggcggaatcggatgtacttgccgccgtctgataccctgtaaacccgccccacagccaccgcaagccattatccgtgttgcacaagacgtactccgtcagtcctgcgtgtccttcgtattctgtcgtgctgatgacgtataccgtatcgccctctttgacttcctcggctacgtctcccatcggctgcatagagtacgcgcagtctgttgtagcaatccgcagctccgttacttctcccgtgtccaatgattcagcgtgggcgattgcgtttaccgtcatgatcaacataaataccagaacgcataatatgatgatcagtatcgtttgctttgttttgttagtcatctattctccccccccgctcctgcgctttccgtttttttgttcgtctgtattgacttatccaaaatctaatgggatttcgcggctttatcccaagccatccgcagccccaaagatactttttatatttaatacgtctatgcttacttccggtaatcattgtttttcctgctcccgcgcttcccgcccctcaagctcacaggccgcttcttcaagcagcccccttacctggcagcccgcactgcatctatcgcagttttcagcccaccacctaaggcgttctgatatgctcatatctgggtaatctttactcatgctctccctccattgccgccagtgctgcctcggctgcttcgcgggtgagaaatacggttttgccgaagtacggaatcatttcatatttaaaccttgtgcttataatcccaccttttccgtctgctcctatatagttatttgtgcagataaaatcatcgcctatttcttccccatattcacaatccgtatcttcaatatttttacagcaacatattccacagcctttattttctgtatacttatcgaatacttcatatactcgtgaacccaccttgcatggcagcaccacaagccgcccatcgctccccgcctggacaagcgccgcaagcttctcccgcagggcggcgttttcggcttcaagacgcttgatctctctgtccgcatcctgcatgaatcccaaaacatcgtaataatcatcaccacgtaatacaggatcgcttttatgccatacttcaaacgcttctgtgtaggtttctttactcattctccctcgcctccgtccatctctccccacatactgtcaacaaactcataatctccgtgttcacctgttccttctccattttgaagattatggtaactcactactccattcctcacgtcaaggctgtcatggcggtcatcgcccacacggtgaatgcttccgtctgatttatcccgcacgtaaatgtccgtaagtgctccatgtatcactggcggttctaccgtgggtgcatgctgtaccgccgttaatgcaatggcggcatcgtacgacctatcatcttctccgtattgttttatgagcatctttttcagcgcgctcctgctgatcgtgtcacctttcatcatttgttctcctttcccccgccaaatagtcgcaccatctcagaaacgccctcaaaagcggattcacatttccctgatccgcccatcccgcaaaccctataaagccatcccggttaaagctgattgcttcgcggcgcgtgaagtagtgcgaattcatgtaaaggtagcacgccgtgacactcccatttgatctatgctttatgtctattttttcactcaaccgcattgtgcatgaggttttttctgctttatttgacttcttgatttcctgattgagcatcatcgtcagagttaaaatatctccatcggttatgtccgcataggtcaaacctttgtctttaaaatattgccttgcttcatcgttcgtgcaaactgcattatcacatctactcattgttcgctcccttccggttttgtccgataggctagccatgttttgccgttatattctttcagcagataaaaattcccgtttgccaacgtgattaccggttctttttcagaatagttcccttcaaggctaacgactccgcattccgtctccccgttctcttcaatccacaccggctccccgttcatttctcgcagttcgtcaatcgtcagtggctgcgggttcccccgctcagctttctcgcgtagggccctctccgccaaatgcgcatattttattatcttttcacacagcattgtcagtgcagcgtcttttccttttctttgttccgttttaaacgctaaatccataaaatagttgattgcttctcttaattcgttcatctccgcgctccttcctaagcctaaaatctatatttgtctatccgatgtctatctcaatttccgtcctcggattgccttcgtcatagtcgcccctaagccgtaactctatgttcccaaagctgtcgtccttgatgacccctgcccttacaaggccgtctaatatcatcttgccgttgtaattatctggatcgcggcggattttgtccgggaagaagtatgtcagggttacgattgctttcgtcaacacttcgcttggtatcggcctacagcagcacactaccaaatcagaccattcctgttttaggcgtcggtactcccagtggttttgccgtcccgcaaacttgttaaggctgggcggaatgtctggtatcacgtatttcatttgccgtacatcctttccagttccgcgaagctgtcagccttgcgcttttctaagtcctgcggcgtgtattcccgttgctcgaagtcttttttgtttgcaagaggttttgatcttcgtcgtttaaattcaatacgcgccgccttcgcctgctccactgtaaaaatcttcttttcgagccatgaatttagcacagcctttgcatatttccacggattgtccgttccgatagcttctttcaacgccatcactataacctcgtcgcaaaaaccgtctgaaatatagctttccgcttcgtccacaatgaacggggtgataattccaaagttgtcagagtaaaattttacatacgcgcgcgcacgcgcggcttcttctgcttctatatcacattcactatcactaccactatcggctttttgaaaacccactgggttttctgggttttcggttttcccattcggttttttaggtctgccgcccttacttccgttcgccttattacgatccacagccttttggtaattctcgtatgccttgtcgagatcgtccttgataaagtaaaatgcgtcctctatcgattcgtccaactctggaatgatccgcgtctgctcgtattcaaaaattgccatgagcagcatatacccgcgcttttctccgaggcggcgaaagtgtttctcatatttagtttgcataataaagctgtccttcatggtgtacctttcttaaaatccgcgccctgcctatctgttcaggaggtcaaagcagggcgcggtattggcggggcttaaattattttgtactctcgtcctaatatatctgtaatttttcttccttttttcagcgccaaactcatgtatccatgattgtgccctaaaaattcggatgcttgcgatagagaacgaaaaattaaaactactccattgtgttcaagagatatgcttttttgcgctgtatttagccccatatcaaaagcgtgctgtatattttctttccgtgtgacccattccaagttatctatcctgttatttaatctgttcccgtctttgtgatttacagtcatatccgtatcaagcagattttcataaaatgtagcacatacaagccgcgcaacaagataatcatgtggctttttatccttccacagagttaccctatatccaatcaatgattggtcggcgcacccttttggttttaatatcctgcttttccatttgcgcacaccatgccttacagaatgggtgacctttccgtccttactcctaatacgccccaagctgcttgcctgatatatgttttcgtagccgggtatatctttccacatctcgcccatacatatcactcctaaaaaggaagattcggcatctccgcatcgtccaacggctggaagtccgctaaatcttcagcaaacgtatcgcctgcattctgtgcttcctgttgccgctctccattgctgtcccccaggggatcttctctgcctgcggcattcaccttattcaaaaactccacctcatccgcaacgatttccgtgacatatcgcctcacgccgttcgcgtcctcataatttcttgtctggatcgcccccacaacgccgacccttgatcccttagagcagtactttgcaacgttttcagccagtccgcgccagcaaaccacgggaataaagtctgcctgttgttgtccgtcctgtttgaatcgcctttgtaccgctaccgtaaaactcgtaacggttatcccgcccgatgttgtccgctgttcaggatcgcgcgtgagattccctaccaaaaccaccttattcatattgcccctacctttctcaaaaacttcctgcgcggtgacaatgccactaatcgcgataccgccctgcgccgctctctcatataatcccgtttcaaaatgtctatatcatcgcttaaataccatccttgcccgtcctggtcgttgcatattggatagcccgccttccgcaatcttgcaatgctcttcctgatgaacctttcgtcaagtcctgtcagacgctccaatgcttcatacgaggccgcgttgtgtttcccataaccgagcatgtcaagtatcgtcttatccacacttgcaagcaccacggttttgcttttgccgccctcgtcgtatattttgtctatcgtggcatcgcacagccttaaaaccgtcttaaacagcttaggcggatacggcacgatccccgcctctattttggaaaacaaaggcgcatccatccgtttatccccgtaggcttccagcacttcttttaccttaacgccgctgtccatgcgcagcttcttcaaatcgttcatatccgcatctcctttgggtacttgtggtatatcctgtcctcgtccgaaaagtcagggtaaaggctgtcaaggtattccctgaacctcgccccgatctctccgcgcttgctgtcctgatcgcaatcgctttcattgtcgtacatggcatggatgtctttgttcatcagagcgagattctctacgatcccaagtccgccttgtgactttggtatgaagtgcgccacctgcagatcataattaaggccgcttataacgcagcacggttgcccatctacgctgtctctcttcaccactgccgccctcactgccggtgatatatccgtcgcctttgtcattgcgcgtttcatgctccacacctctcgcacatagaagctatatcctccggcgtacgtgtttcgatttcaagctgttgcgcttcatgtacgatcccgtcaataaatacgctcatttcctttgtgtcatattcgcttgatccttttatgacccgaaagtggtttgccagtttaccgttcacctcactttggcccataaaagccgtatggatatataagtattcatcgcttttcatcgtcacatcgacgaccgccggaactgacacggtatagagttccccgtttaccattttgtttgttccgtagctcacaagcatttgatggtatacttcgtttgtatcaatgccaacagcttttgcgatctgccccatgagttcccacgcataattgtttgcccttatagagcgccgtttccgatgctgctttatttcgatgtcgtaacgctttcctttgtcaagccatgctgttacgccacctaaccatcggagcgcactgtctaagttctttccatcaaacgtacgcttcataccgcattcgccctcgtattaatccatttcagcgcttcgtctgccgccttagctttaacatcttcccatttatccgcattgcacattttaagcattttggcttcctcgagacccgtggcaaagcaggcttcccgtagtttctttatctgttcgtccgttgcgggcttaaccttgtcaagatcaaagttatcgttgatcgtgtccgctttttctgcatcttcctgctgctgtgcttttgtaggcgaagggcgtgtatttttcatatcctccggtatttctgcctcaggtaaatcttctccggcgtaaatatacagcccaagtccgtggcgggcgcaagctttcgtaagcgacctttgtattgccctgtttacgtctgtactggtcacagcatccactgaaatagacttattcttataatccatcacgggaagatattcaatatgttcaaggtcattgatggtaacgcccgtcttgacccaacacgttttaccgtctgtgtggtaaaaacatccgttttccgcttcataaatcgtgtatgttgcctccggataggctttcttgatttccgcccaagcccatgcccatgaaagatacgtaagattgttctttttctccgtatgctcatttacattgatattattcagcgtttcaaatatactgctcatcctcgtcctcctcttcccaatatgggtcgtcctctatcgtcagtgttccccacatcgtattgtttcccgcacccatcgcctccctaatatacggcgcgtccggtatgtcatacatcgtattcacccgcctgatcttttcggctgtcatatatgccgtattttttcactatcttgtctatgcgcttgcaagggtctgtttttgttccgtcaaagcatgaaacacacccatagtcaccgcacagatcggattccaataatcccgtttgcccacatctcatacacgtcattgacttttcctccgtcttaatccgctacggcttcgtaacagcaattatttttttcactatttctctcacctgttcacgttttgcgctcggtatcgccgccgtagatttaactctgaatcttgcttttaataggctcgatattgccgatttcactttatgacgctccgtgtgcgaataatcttgtgcaatcggttctccgcgatagttcttgcttctccaatgttctgtccagtcatattctttaagatcttcctcaaattcatttaaaacttcttttaccatgcatgtgtttttgcgcctttcttcaaggcgttggtctatcagcgcgtttagctcctgttccgtaattgtgattgttttcatttatcccgcctcctgtttagtattttttatttatttatttgtactatatagacactatatagcaacttgtatctaatgtcaatacatattagtatctaattagtacatatttaggaggctattatgaacactcgttccaccacacaattacgctttgacgaaactcttcacgctaaggctaaaattatcgccgacagagagattagaacccttaacgcccagcttgaatattttataaaaaccggaattgaacgttacgaagcggagcatggggaaatcattctttcagaaaatgattaacggacacaggggcttcccttatctttttcccttcccacataagcattatcattacggcattctgcgggattcccatttcagccgacgttttttgaatgtattcatgcaacccgtttgggattcgtatttgcgtgcttacaatttctctatcgctcattgacttttcctttcgtttgcctcataattaaggcgaagataatctcttggttattttcttaggtcacggctccacccgtggcctttttctttctctcatatgaggtagattacacatgggattgctatgattagaccttccatcatgccgtctcctttggctcaaatttattgcaagccttcgtgcttttccgtaccagcttgtgcgtcgagcaatgcccgcttccggcttcaatgtatggcgcaatgctgccccttttttattcctcgatttccccacactcgtatacgcggtgaaattcgtttgcttttttgacgatagattttaatttgcacaattttttcatttctgccgatgtgtttttgctataattcacattcctcacgagatgataaagtaattgtaccgcctgtttatcgtctatattgacatccagaccgccgcaccataacgggaagcaagaaaaatcaaggtcggcaccgcgcaggttggcaccgcgcaggtcggcaccgtgcaggttggcaccgcgcaggtcggcatcgtacaggtcggcaccgcgcaggttggcaccgcgcaggtcagcatcgtgcaggctggcatcgcgcaggtcggcatcgtacaggtcggcaccgcgcaggtcagcatcgtgcaggctggcatcgcacaggttggcacgttctccctctttcccattagtgcgcagccattctttatgattgtctaaaatcttatctagctctttatggttcatttttagctctccttattctcatttccatccgataccgccgcgctttgctcctgcggatcgcccagtgtattgacatcctgttttcccataaggtcagcaacgccgcgcctatgggtaggaatagcaggaaaccttgtataaatgcactcatgatagctcccttgcaagcgttgctttactgatatatcgatccttaaacggaaacctcactgctgcgtatttcgtacatataccgcaaaacgcagcaacatctttaatcctcaaaagttccttgtttggaaatgcttcgttgagacgctctaagttgtctctgtatgcttctttttctctcggcatgatctttctcctttcttacgtaatttacttcccattctcccaatccttgatgatcttatccgtctccttaagcactgcttccatttgcgcgccctttcgttttccgttgatatagtcgttaagaagcgcataaaccagattcggaaatcctctcctgtgaagctcgtgcagcaaatctgtctgtgcctttccaagcttcagcagccttatctttaaatcggttcccattttatcgtccccctattgcttttatgcctttgttatgctattctttggttatgaggttgagtaggttcaaccttttgttatctttattataattcctcaaatgaggaaagtcaatatattatttcatcttttgaggaattattttcggaggaggtaattttctggtagatattgggacgattataaatatcgctttgataggagtcacgatttcctctgttatattagccatcagaacaacggcggtccaaagcgctttagagcacaagaaaaaggcatatcacgatatgcttacactgatggaaaaatacaaatacgcatttatgtctggtaatataacggaagaattgctaattgaaagagacgctacgatagattgtctttatatcgcaacgggctctgacgaattgacaaagcgcataagcgcctggatagattccatagataggaaggatagcaagcaaacccaatcgcaaaaaatgaatgatgtaatttcatttatgagaagcgatttgaggtttcgtctttttcgctctgttgggtagtatggcgccctgcttccagcctgtcaaacgcatctttgagtccttgtattttcttccactcgtctggatcttttttatccaatggaagcagtaggccgatagtaagaaattcatacgcaagggctaatatgagcaccaaaattaatataagttcagtcatgttgtttctccttctgatcgtttccttgcggacgcttgctccattcttcaagctgataagtatattataattcctcatttgaggaatatcaatagaaaggtttcaaaatgatttttatagaaagattagaagaattgttaaaagaaaaaggtgttactacaaataaaatgtgcatcgacctaaagatcggtaaaaactcaatggtcaattggcgtgaacgtgggaatcttccaaatagcgaaaccctcgccgcgttgtccgactacttcaacgtgtccaccgactacctcttaggccgcaccgacaatccgtcccccatcggcgaggttgcggctgcgcattttaaagacgatcaggacttctccgatctgcccgaagaagatcaggaggccgtgcggggcgttatcgctgcacttagggccaagcataaaaagtaggttctgagacctgcgctttttctataaaaatttatgaatcgatggaaagtccatgctaaattatataattggcaaaacaatttgcctacctataaataggtcatccgcgaagcgaggtgtgggttatgaaaggatataaaagcgtctttgtttggattgcatttgcattcggtatattgagcctttttttattgataggcgatatacactttgagattgcagaatacggatttaccgtgtccgatctgctttttaccttgcgagggtttgccgtcgctctatatatcatagcctccttggtggggctggctaactatagtattgcaccatgtatcatatatacagggggctttattattgcggcaattgcaggcggaattttttctgatatgttcggacttgttggtatgattatactgtggtgtggatttccgtctgcgcttcgtctgtctcgccaaaataggcctcaatttcaatctctatcagataaagcgattgataatattgcacatgctcttttagcgctgcccgaaaaaaaagcaaatattcagatttcaaatatgccagtatccgaacgcgaccgctataaagtgcttataaggtatcgcgaacttgcagactagtcttgcataccacgccggattgccctaccctgtcgcgatcttccaatattttagcggtacaatcgaggacagcggcaaagacagggtttgtaagaaatgcgtataatataaggggttggtaaaatgatgaaaatttgtagttttgcggatgtatttcttttcatatgatcccgccgttatacttgggttaatcagtattccttttgctatttatctattcacatcagaacgttcccacacagtattttggtttaattgaaaataaatccgtaactcatgacaaattttaacgtttttgtacctaaaatagcatgatcaagtagtaatatggtgcttaggaggtaaggaaatgtatccgcttagtcttgaggatattctggatcaacagatttttgatgaaggaatttttctggaagagcatgtagaaatgcctgacatacaggacggcatgtattatcggtctaacgatctaccctatccgattatagctataaactccaatgtaagcggtacatttcgtcgtaactatgtaaaggctcacgaacttgggcatcaccataactgcgttcggaacctatttgcggctcctgagtggatacagcgcaaatatgaaatgcttgcagatcgggattggatcgataacattatgtccattgacgacctgattattgcctatgagaaaggcaataatactcccatgtcgctggcggactacctcgaaataccaattgaagcgcttatgaaaggtattgcgatttgctgccaacagtacggtcctgtttcgtacaaagggcagtattgtatctattggaacccgtttaatataaaaacagacttaaagacgtaaaaaataaaaggatagaatttattatgaaaaagagattgataaatataaaataccaaacggaaaccagaaaggtatacaatgaaaacacgcaaagacggtctcgtcgaggtaaaagaaacaattttattgcctaacggtaaaaaaacaagaaaatcattctatggcgccaacgaaaaagaagctcgaaaaaaagcatatgcctatcagagcgaaactacaaaagggcgctcgtttaaggttgttgctgaagaatggaaagaacggcattttgaaacgcttgagaatggcacaaaaggctgttataatcccgcattgaagcgtgcaattgaatctatgggcagcgagaacatcaaggatatcgtgccggccgatatagagcgcgaaattttaaaactaaaggatcaaggcttctcagctcagacggtcagagtgcagcgcatcgtctacaaccttatttttagccatgccgtaataaaaggcgatatcaagatcaatcctgcacgcgaagtgaaagtaccgcgcggacttccaaaaacaacgcgggagctgccgagcgacagcgacattgagatcattaaaaagtcttataaaaactcatttgggctgtttgcctactttctcatctatacgggactgcgtcgggaagaagcccttcctttggagtggtcggatatagattttgacaatggcatcatacatgttacaaaaaagcttcaattcattaataacaagccggttgttacgcaaaaaacaaaaacagaaaaatccaaaagagatgtacttcttttggatgctttaaagcgcgttttaaaaccaaaaaagcacggatatatattctttaaggaattgcctacagaaacagcatataacctgatgtggcgtaaatactgcgttgaaagcaacttgatgaaagaaaatccaaacaggcgtataataaataaaaaaaagggcgcgctttcgcctgtatatatcccaagaataaccccgcatcaattgcggcactgttatgccacgttcttattcgaagccgagattgacgaaaaggacgcgcaaggtttattggggcatgcagacatacaaacaactagaaatatttacacgcacattagaaatacacgcaaggaaatcaccgcgaagaagctcaacgaatatctcaagtaaatttgtatataaattatatgagtatatagaaaaaaattgtgtgaaaacataaaaacagtgatttattacacgaaagcccatatcttgaaacgtttctgtttgaaaatcgctgtttttttacaggaagatggattttcagtttgaaagcacgaaaagtcaaattgaggaaacgattgagccgttctgaaaaaatagggcgaattttgtcgtaaaaatgtcgtaaaaacattataaatagctacaatataatgtttttaagtgactacgaatcaaaaggtcgggggttcgaatcccttctggcacaccaaataccgttttatatgcggagcatatggaacggtatttttgttgtattgaaaaggactcgcccgccggggttcatgcaagcacgcgcttaagcgaagtgcgcgctatcttttccacaccaaaattcattttatacgcgcagcgtacagaatggcttttggtgtgcaatcgttccattgaaaatgcagtaaaggattatatactttttatttattaaaaaagcattgacatttttataatcgtgtttataataataattgagaatagttattattcttaaaaaggtgtgatacatggtttattcaaagcaacgggaattgattttgaaaacagtgcttgaaaacaggattcatccaacggctgatacagtgttttccctcttaaagccggatcatcccggtctctcccttgcgacggtttacagaaacctgaagcaattggccaggcagggattgttactgaaaatacctgtaccgaacggtgcggatcattttgacgggacattgcgtccgcattaccacatgatatgtgaagaatgcggtcagatggtagatataccacctgaatatgtacctgaatttgacgccgcagttgctgaaaagacggggctttctatacactctcacaccattgtgttttatgggttgtgtccgcagtgcaaccacgcatcgcaggcttcctcctaaaagccgcgagtcacaaagttttatttcttcactttgagaaagaacgtttccgcattgattgggggtcggaaacgttcttttttatgtgtttagcggcaatgaaaattgatgcgtacaacacgcgctcatcagctcgcggtcatgcgtaatcaccaaaatcgttttcccatcctgcgccgcctcccgcagagcctctgaaatgatcatcatattcccgccgtccagtccgctggtcggctcgtcgaaaattaggatatcacgcccgctgagcaggccgcacgcaagagacagccgctgcttttgtcctcccgaaagggtcgccggatggcgagtgcggtattcatatagtccaagccttttcaatatcctccttgcccgttccaggttctcttcccgccgtggcaacaaaagaacgacctcttcttccacactgggcgtaaaaaactgggtgttggtatcgttggagctgtaccagacctttttcgatcgtttatgcgcaggggcagcctgccctttcagcagcactgttccttcgctttcccgccgcaaaccgcaaagtattttcgccagcgtcgtttttccggcgccgttttttccggtgaccgcaacgacgttgcctgcagccgcctgaaaatcgacatcttttatgatcgtcttctttccgaccgtgtatccgccccgtttcaatatgaccgatatgttccgtgagcaaggcggttccggaagccttgggcattcctcgttttgcggacggcgaagccccatacgcgccaggtcggcatccgccagagcagcaaggcttttgggggagaattcctccacgagccttccgttctccaaatacacaaaccggtccgcgatccccatgagccaagacaaacggtgctccgcaacaacaagggtatgtccatcccgtttcagtatcgccaaggtttcagagaggcctgccgcgccttcctcgtcaagatttgcggtgggctcgtcaaatgtgaatacccgcggacccgcggatcttgccgaagcgatcgcagccttttgcttttcgccgctggaaagcgtatcgagcggggttcccctgaatctatccaaatccatagtacgaataaccccgtctgtgcgcgcacgaatctcctttacggaaaatccgagattctcacaggagaaagctacttcgcctgccagttcaccggaaaaaaactgggattttgggtcctggaacacacatccgatcgtttttgcgcgttcccattgccgcatttcttcaaggtctgttccgtccaagtagattttgccgcgtaaaatcccctcgtaataatatggcgcaaggccgtttatcaggcgtgtaagagtcgtctttccgttgcccgacttgcccatcagtacgatacattcgccctcccgtattttcaggtttacttcatggatgcagtcttcttccccgttatatgcaaatgaaacgttttcaagctcaatcattcatttcatccctccaacagccagaaaaatgacgattcctgcagcatatgccgctgccgcaaaaatgtcacgtaaccgaatctctttctcgtaataactgtgccgccgtcccggcgtatcgatcccccgcgccgctgcggatacggcaagctggtcggaaatctgcaggcagcggagcagcatgggcaccagcatatattcaaaggtatcgcccggatggcgtgccacatgggcaaagccggttaatccgcgattatgcatggattcccgcaatccccgaagctccgcccgcatagtcgggaaaaaacggaaaatcaccagcatccccaaaatcattcctgtcggcgcatggacttttgacccaaaggcactcagagtgcccggcggcgtcgcgatcaggttccacgccgccagaaagaccggcgtcatccaccagaacagaaatacgtggaattctgaaaatacaaccattcgaaggtgatgcacacggatgaaatacaaaagcagggtgaggatagtataaaaaaccgcgaatcccgccatctgcttccactccttttgtactgccagaaaaacgaacagcgccgctgtgatcatccatgtgcggttcgtatcccctgtcaggaatacgcccagcatagtagctatcagcacacatagcttggtagcaacggcaaaaccaccgtttcggtatttcatttacaggactcccgccttcccgaaatgctttttcatcatgcggctgccgatcaggcttccgacaaaaccgcaaatcaccgtaaatgccaggatgaaggccaaccagcccggctgggtgtaataatccaaataggaatcgatgtactcctgcgtcatccccgacgcaagcgcattggatgtaaagctttcccaaaacaccaggatcggcagcaggttcacgccttggtaaagcccgctgtagactgtccatgctgcggtgatcctccaggggttatcgtagcttccctctttccagagaatccattcgcagataagccccaccagaataaaatagggcagcaggaaccagtcccccatgattaggaacacaacgccaagcagcgtcatatagagcagcgaaacaaaccgcttatgcacgcggcgcaccatcaaaaaatagatcggagcgcacacaaggcatgtgatacctacagacagtaccatgctgacaaaatgattggccatacagatcatattgatcgccagttggattacaataagcagaacgctcagcaataccgtagtgataacatcccttgcagaccatttcccgtttgttttcatatcgaatcattcctccttgttttgtatctttcctgtccgcaggggcggacaatatatcgcaccagtagttagcaatagctaactactggctgaaaaaaagcctaaagaaaacgcatcaggctgtcccagccggcattaaaaaatttcgagatctgaccgacgtaagcgagcgctttttccttcggcatattatgtgcaacaacttcaaagaccgccgtaaaatatgcgctggtgagcatatggtgcacctccggatcaatctctccctccagctttcccaattttttcaattcctcataataccagccgctccgttccacctcaagctgcaccaactcatgtaggaagtcctgatatttcgttccgtccgaacagcagatgagcaacctgaacgcctcaaaattttgataaatgtagtccaggaaacggtacaggtaatcaacggaaagttcctggctcgacactgttttttcttccggtatcaaatcaaaatattgatcctgcgccacgcggaactgcgctttcaggccttcggccacaggcgctaccagcgcgtcgaacagggcatttttatctggataacgaatataaatggccccagtgctagtccccgccttttctgcaatctcgcgcagggacgcttcctggaagcctttttccagaaattctttttttgcatataaaagaaggctttccgtgattcccgcttccctttttgccatttattactctcccttttagatatcaaaaacatcgttatcaataacaccgttatcaatttaacattctttcttacgtttgtcaaccatcctttgcaagacatatgcgcaaataaaaagcttccgccactgataacggaagctttcttttattttaatgttatttttgcaggactgcctgcacaacgtaacggttttcatcctgataacgtacgcatgtggaaagcgtaatgatttgatcttctgcatttagctctgcatccgtcttataagacgagcgatcctgcattttctttagatactcttcataagcctcgccggtggaaaatcccatcgtataggtttcgtcgaccgcatttacaatataggctgaaaagaccttatattcgttcacgctgccatccggcagataaaggtaaaccgtatcgtttgatctgaaaaaatcttccttctcatattcgtgcagcccggcaaacatagacccgtcgttcatgcggtgtccgtaaatgatcgtattctgatccgaaaaatccggcttgttctggtaatccagaaagattgcgcccgccttgttttctgatttatccgcgttatgggaaatataataatcattgtcctggccgattacaaccggataatcaatttctgtatccggaatatagatccagccgataatatccccgtttacctcttttaaagcgtcaaaatcgatcttcctatccatcgggttttccactgactgtacgtcgccctgcgcggacggctgtgccaccgctttcaagtcgtcataagcatgctctgccgcccagtcctcactttttatgccgaaaatctgcaccaaggcaaatataatcacgacaattgccgcagcaattacgatccatgagatcactttgccgcgtttcttgcgcgccgattggacttgttgtatttcattcccttcagttgtgctattatttccccgaggctcctcaccgattttttttgccataaaactccttgttttttaatcgcttttctatatattatatataccccgaaaagtcctgccttaaaagcgtcaggcatcgaagctgtaatatgccccgttagacttggtattatcgtaaataaaatccactgaataatttccctgtccgtctaaaaacaacgttacatatgccagattgtcgccgatccttcgccacgtatactggaaacctgcgtatgtattccgcataatcgcatcgctcacttcttcatctgaaaattcgcctaccagcgccatatccgactcgaaacccgttggactcatcgcccataaatgcaggttggccttcccatacttctgctccacagcgccggcaagcatattcagttccttaacgattttttccgttgcaatatttccggtttcaccactgtagaaataatcgatgtagttattttttccgtcctggtcaaatcccaggatgataccgccgctttttcccatgaacggcgtttctttcagataggttccgtcctcctgctgcaaatacaaggcgtcccctgcaatttcatcgagcgtcaatgcgttcctgcccgaaagcagactttccgtgtccaccagcgtatcaaaagctgtggtatcctttccttgtgaaggtatggaagaagcacgcggtgcactctcctcttctttttgcggttcgggcatcgccgacggcgttggcaacaccggcagttcgcgctcatgcggcgcatacgtcgcagatgcgctttccttctgtcccatcaatacattcaagtcgcggatgatgctgcaggagcaacacaaagccagcacggcagccgccatgctgaaaaccattacccgcttcagccacttacccattttttccgccctaccctacttatcgaacaagtgcataaaatcaaatgtcgcaaaataatcctccggcgtttcgccgcggcggatcagttgcgtcgttccatcctctttgaacagcacttccgcgctccggagcttaccgttataattatatcccatcgaaaacccatgcgcgcccgtatcatggattaccagcaaatcgccgatatcaatttggggcagcatacggtccactgcaaatttatcattattctcacacaacccgcctgtgatatcatacttatggtcatgcggggtattttcttttcccatcaccgtgatatggtggtatgcgccatacatcgccggccgcatgaggttcaccgcgcaagcatctacgccgatataatccttatacgtgtgcttctcgtgcagcgcttttgtcaccaggcaaccgtatggtccgagcataaaacgcccaagctctgtaaagattgcgacatcgcccatccctgcgggcacgagcacctcgcggaacgcatttttaacgccctcgcccaccttgaggatatccaccggctttccttccggcttatacgggatacctaccccgccggaaaggttgataaaccggatatccgcgcctgtatcgcttttcagtttgaccgcaagctcgaacagaatatgtgcaagtttgggataataatcctccgtctgcgtgttgctggccagaaacgcatggattccaaaatgcttcgcgcccagcttcatcagcttccggtacgcctgtttcatctgctcatacgtcatcccatatttcgcatccccggggttgtccatgatgccgttggctgtcgtgaacgtaccgcccgggttgtacctgcagcaaatcgtttccggaatccccgcgaccttttccagaaaatccacatgcgtgaggtcgtccaaattgatgatcgcgcccagtttctttgccaagacgaaatcctccgccggcgtatcgtttgaggaaaacatgatctccgatcccttaaagccgcatgcatcggcaagcatcagctccgtataagaagaacaatccacaccgcagccttcttctttcagaattttcatgattacaggattgggcgtcgctttcactgcaaaatattcctgaaagcccgggttccacgaaaatgcctgattcatacggcgtgcgttttccctgatgcccttttcgtcgtaaaggtgaaagggcgtgggatacttggctgtgatctcctctagttgctccttcgttacaaacggtctcttgtccatcttgtgctcctctaacatatcaaaaatttttatgccaaatccttgggatccggttcgatatataccgcaaccagctccggcggattattgattctgattttgggatacccgctcgctcccagaccccgactgatgatcatcgtcgttgcgccgtccgtaaactcgccctccacatatttgggcataaacccctgcccgctcatagcaaacgtgccgattttgggaaaacggatctgccctgcatgcgtatgtccggaaagtacgaggtcgatattcttatgcagatagagcggataatattccggcctgtgcgcaagaaatacgttaaaccccgccgcattgccaaatacgttcacggaatcgagcacattcacatcatcgaacgaaatgtcgtccatccccgcaaggttcaattcgttgccatggacgcataccttttgcaggtccccgcttcgaagcacgctgacgccatactccgccataatatcctcgatttgcccttcaaagttacgctcgtggttgcccgttacaaagtaggcgggtgcgatcttcgacaattcgcgcgcaaactgcctggtgtaacgcgcgtctatcgccttctgtttttcgtgtgcgaccatgtctcctgtgacggcgatcacgtccggcatcagcttctccaccttgcgaaacagttgaccgttgtggatcccaaattccttctcatgcaggtctgaaagatgcgcgatgaccacgccgctttttactttatcgctcaaaatcccgtaggatgtaatttgtaccgtattgttattaaacattccttttccttatctgtttataagcccctgaccgatcccacgcacattgcacaagcgcacatgatccttgattttattatagtataaaaaaggttctgattcaatcgggcagggcacagtggacatgaatattttgtaaaatatggaatgctaccacatgaatgtcgatccgctaaaccaaagatacaacaaaaaaaattccagcaaaaagccaagaaccgccacgaaaaccgtaagccattttttgttccatgccatgaggatatccgtaaacgccagcataaatacagcattccctatcaaataccgcgggatcgactgcaagcgcacagagatgggaaccagcaggagcgcaaacgccattcctgcctccgcatacctttttttcagcagcaagtagatgcacagccccagtcctgccagcgaacaaacggcaaagaagacttgccttttgacgccggacgcaaagccgcttacgatcgcggtcaaagggtttccgccgccgctcagatcccacgcggcctgcgcatgcacaaaggcgagcggatcccccgttttgattcccagaaagaccataaaggagatcagaccgagcaaggtcaggatcgctcccgccatcagcttccggttcgtcaggcacaccttgaaaaagtcccgcacgcttttcatttttcgcccgcttgcgcaataatccgaaacaacttgtaccagcagaccgatcaataatataacgcccatgttccttgtaagcgtcaggaaaaaaccaaacagccccatccaaagatactgctttttgtataggaaatacattgcgcccacgaacagcatcatataaagcgattcagtatagtagctggcaaaataaaggctatagcaccccagcgacaaaagcaggcaggcgaggattgcctgtcccaggctattgtttcgcgtttccagtatatatttgaacagaaagacgagcgctgccatctggaacaggatgttcagaataaagccaaggagattgacatcaacgccggtaagcgcgtaaaggccgcgcacggtcatactcagcaaagggaaaaacgcccagtttaccagtcctccgctgtaagccgcaccatccgtatacccgttaagcgtaatgtcctggtaccactgcgcatcccaaacgttgaacgcgccaaaaaagctgcgcgtatcacctgtcgcttcggcgtatcccataaaaaacagaccgattacaattctggaaacgagcaccagcaccagcgcgaaaaagcagatattccaattggaatatctgctttccaaaaataaccgtttcgttttcgcggtcaatcccttttcctgcatgccgaaactccgttactcttccatttcacggaaggccgtcaggtaattcatgcagtattcgtcctgtccaagcagcatctccgccgctttcaagtgcatcttcatcgcgtgattcgtaatgtccatgatgggcgcgtccatgccggccgtcatggcgcacgcaaggaacgcctggttgatgatcccgcgcttcggaaggccgaacgaaatatttgaaagccccgcgagcaggtggacgtcaggatattcttcatgcagcctgcgcgccgcgagcaacgcttctttcggcgcgtcccagcctgtcgccgccgcttctaccacgatatccacatagatatcctggtccttcgcgccctcgtcccttaaaataccgatgagtttccccgcattttgaaccctgcggtccgccgttttgggaatcccgtccccgtcaagcggcatggcgacgatccccgtatcgtagtttttgagcaagggaagcacgcctttcagcctgtcctcttccagcgtcacggaattgatgatgacctttttcatctccaccgtttcaaaaaggcgcttgagcgccgccggattggtggaatccgccatgatcccgcagtccggcgccgcttccatcgcaagctgtgccgtccatacgagcatctcttcttcattgtcgcacatacctgtgttgatatccagatagtccgcccccgcgcgcgcctgccgcgccgcgagttcttttacggccccttcgtccttcgcgctcaggatctcgagcgtggaagggatcgagctgttgagtttttctccaataataatcatgcctttaactcctttataatctcgcaaacgatatccgcgcgtttgagcggcgtaataatataataaccgtccgcgatttcttttaccatctgcgccgcatccatcgccgtttccaccgcaatacgcgccgcttcctctttgcccgcgtctttgaaccgctcgcagatctcctccggaatctcgatccccgcaagctcgttattgataaaacaggcgttcttatagctgaccacaggcatgatccccgcccatatttccgcttgcagcgcctgttttgcgcgtgcgatattgtctgcggcacgtctgtcatacaccggctgcgtcaacaagcaccgcattccggcagcctctttcttcttcgctttttcaagctccgcatcgaaattctgggcgtttacattgagcgcgccgcaaatccaaaacggtttttccgcaaaaacggtacggttcagatcctgtataaactccgtatataaaatagaattgaactggaacacgcttttgatctcccccctgcggttgtttggaatcgggtctcccgtcaccaccagcacattatgtatcccctgcatgtaaagccccagcaaaagcgccttggaggcgttgaggttcctgtccctgcatgtcagatgcggcagcgcttgtatcccgtattgcgttttcagcatggcggcgagcatactgctgtccgcccgcgcacggccgatcgggcaatccgcgatcgtgatataatccgcgcccgcatccgccaggctttttgccgccttggtaaaaaatgcgctgtccgcatccagaggggaatccagttccactgcaatgggctttttcgtatatacctttttctccgcctgcacatcgatacgccgcgtgcgcggatgctcctgtctgacctcgcccatatcctcaagcgcaagacgcgccgcgcggatatgctcaggcgtcgtaccgcaacagccgcccaggatcttcacgccgaagcgcgcaattttcaaaagctgttctgcaaaataatccggcgtgcttttgaataccgtcctgccgccgatcactgtgggatatccggcattcggcataatgcatacgggtttttcataaaactccgtactttccaccacatgcaccatatgcagggggccgcaggtgcagttaaacccatacgcgtcgatttcgtctgcttcatgcagggcgttaataatgctttgcgcggaaaccccgctttgcgtatacatatccggtgcaaccgagcattcggttatcacgaatgcagagggcgcaacgcttttgacatagcgcgccgcatgcaagagcggcggcgcttcgccaaacgtctcaaaaagaaaattggtaataccatttttaagaaagcggtcgatgagcatataccgctcttcatcacatttttcctgattttcgtgcaggatcggccccatgctcgcaaaaacgagcgttttttctcccgccgcttcctgcgcgcatttgcaccctgcgtcgatcacgtcaaacacatcttctatgcctgttcccatggaaaacgtattcgcggcaaacgtattggttttgatcgcgtccgcgcccgcttcgatgtattccctatgtgcctgcgtaacccgctccggatgctgtatattcgataattcgcaccgcgccacgctgtcttcgtatttagccgcgaggtatgtccccatcgcgccgtcaaacagcaggatacggtcctttcctatttccttcatgttttctccgatatgatttttttccattataccataaagagtttctttttttgtaaaaataagttaaactattcttggctaaacaacttaactttttgaagtccgtcaaatgccatcgatctattgttttgcaggaaaggtgaaaaaatgacgagaacagatatgaaatatttggaacttctttcggaacaatatccaacgatccagtccgcctgtacggaaatcatcaatttgcaggctattcttaacctgcccaagggaaccgagcattttgtgagcgatatacacggcgaagccgaggcgttcacgcatatcctgaacaacgcttcgggtgttatccgcgaaaaggtggatatcctctttgaaaaaagcttgtcatccgccgtgcgcaccgagctttgcacgctcatctattatcctgagcgcaagctggaggaaatcaagcaaaaggaagatgacatgtatgaatggtaccgcatcacgctgtaccggctgatcgacgtatgccgtctgtgcgcttccaagtatacccgttccaaggtcagaaaagcatgcccgccggatttttcgtatatcatagacgagcttttgcacacggacagcgcggacaaaaacaagcaaaattattatgaaaatatcattaaaaccattctcgatatcgatcgcgcggacgctttcatcatcgcgcttacgggagtgatcaagcgccttgtcgtagaccgcctgcacgttgtgggcgacgtctttgaccgcgggccgcacgctgatgtgatactcgataagctgatgaaccaccatgcagtggacatccagtggggcaaccatgatatcctttggatgggcgcggctgccggaagcgcggcatgcatcgcgtgcgtcctcaatatcagcaccaaatattccaacatcgattttgtggaaaacgcatacggcatcaaccttcgtcccctcgccttgtttgcgcagcagacctatacggacgacaccgatatcttagaccatatgcacaaggcgattgccgtgattcagtttaagctggaagggcaggtcatactgcgccatccggaatttcacatggaagaccgccttcttctcgataaaatcgacttcgacgatatgacagtgctcgtggacggcaaacgctacgcgctcaacgaccacgatttcccgaccatcgacccgcagcgcccatacgagctaacgagcgaggaagcggacgttgtcacacagcttatttcgtcgtttacacaaagtgaaaaactgcagcgccacgtaaagttcttatattcccaaggcagcctttactatgtttgcaatgggaatctgctctttcacggctgtatccccatgaccgacgacggagagttttatgagctttgctttggcaagaccaagcgtaaaggcaaagaattgatggattatgcggattcgctcgcgcggcagggctattatgcccaggaaggctctgctatccgcaagtacggacaggatttcttatggtacttgtggtgcggcaggcgctccccgctcttcggccggagcaagatcgcaaccttcgaacgcatgtttatcgacgacaaagaagcatggaaagaagacaaagatccttattacaaacatgtggaaagccaggagatgtgcgaaaaaatacttgcggagtttggccttgaagaccagtattcgcatatcgtgaacgggcatgtgcctgtacgctttaaggacggtgagttccccgtacgcggcggcggcaaaatgatcgtcatcgacggcggtttctgccgtgcttaccagacgcagacgggcattgccggatatacgatgttttacagctcgtatggcatacgccttgtttcccacgagcctttctccggccttgcagacgccatccaatacaacaaggatattttgtccacctacgtggttttcgatacggcgcaaacgcgcatctccgttggcgaaacggacgtgggccgcgagctgcaggcggatatcgacgacctgtccatgcttttgaacgcttaccgcaacggtacgatcaaggaaaaacacttatagacagaagtaaaaaagccgtatccttttcggatgcggcttttttctgtttttattgtatgtccagcggaaccttatgcttcggcgcaggaaatgcgcggtcgatctgctcccattccgcatcgctcaaaacaagctccgcggcctgtgcattttcgcgcgtatgagcgctctgcgccgccttggggatcgcaataacctgtttttggtgcaacacaaatgcgagcatgacctggaacacggaaaccccatgcgcccgcgcgattgcgttcagcgtctcgtccgtcagaagctgcctgcgcagcgagcctgcctgcgcgaccggacaataagccatgacaggtacgccgcgctctgatagccacggcatcagatcgtactcaataccgcgcgaccccagatggtaaagcacctggttgaccgcgcatttgtcgccgcccggcaccttccacagcttttccatatccgccgtatcaaaattggaaacgccccatctgcggatcttccccatttgctttaattcttccatacacgcgaccgtttccgccaggggaacgctgcccggccaatgcaaaagatacaggtcgagggtatccgtccccatacgttcaagactgttttcacagctatcaaaaatatttttcctgcccgcgttccaagggtataccttggaaaccagaaacagcttacctaagctcctgcccgcgatcgcttttccgaccatgcgctccgccgcgccgtcgccgtacatttcagccgtatcgatcagcgtcatgcccaggctgatcccctctcgtatactctccacttccgtctccagcctgtccgcgtcctcacccatataccacgttccttgcccaaggctgggaacctcctgcccatccggcaggatcaccatatgcttacccatgaaaagcccctcctttttatttatcttaccataaatcccgcagcttgaaacgcgcattttccagtttgacaaacgatgcccctcacggtatcatacgtggtatgaagaagtcgcttaaaattctacgtatcgtgctgctggtccttgggatccttctcgtttcttattccggattcctgctgatccaaaataattttaatcttggaaacgtattgcccgcccttttgggcattcccctgcttctttacggtatttttgcccccgcactgaaccggtggttttcaaaaggtatcggccaagtggtcaaatggatttttattatcggctacgctttcttgatcgtggtattcacggttttcggcatcatgatgacgcaggcggcgaatactgtcccccctccggatgcggatgcggtcatggttttgggtgcggcgctcaagggaaaagaaccttcggatacgctggcgcgtcggctggatacggcgatggaatatgcgcaggaaaatcctggcgcgttgatcctcgtctccggcggacagggcgcacaggaagaaataccggaatcgcatgctatgcgcgaatacctcataaaccacggcatcgacaaaagccgtatcctgatcgaggacaaatcgaccagcacgcgtgaaaatttcgcaaattccaagaagatcctcgacgaacggtttggcaaaggaaattacactaccgtttttgtgacgaacgattaccatatcctgcgtgcgggaatcaccgcgcgggccgcagggatgagcgacgtgcacggcatggcataccattcgcttatttatactgcgccgccatcgtatatgcgcgagtcactcgcgcttcttgcgacgtatgtatttggcgttgtattcgactaaacaaaggatgaatattcatcctttgttgttgctttctttgtaagctgtagaattgacaaatcggggtccatacattaccataagtactataattgggttttatagaaaatggggtagtaggcttatgttttgtaagcatgcgtcctaaggcgcatgtatggaaggactgagtaaagcagcatgcagacattggatcagttaaatcccggggaatccggcattattcaggcagtaggcgggcagggggcgttaaggagaaggctccttgaaatgggccttacgcccggcacgcgcgttatggtacaaaagatggcgccatccggcgatccgatcgaaatacatatccgcggataccagcttaccctaagaaaagaagacgctgcacaaatccagctcgattcgctgcacaagcgtccccgccacatagtaacccgcagattcggaggccgcgcatgagtatactggtcgccctcgcaggaaatcagaattgcggcaaaacaactctttttaaccagcttacaggttcaaaccagcacgtcggcaattttcccggcgtgaccgtagaacacaaggaaggaaagatcaagggcgaaagggacatgtccgtcgtggaccttcccgggatctattcgctttccccttatacccccgaagaaatcgtttcgcgggattttattatacggcaaaatccggatgcgatcctaaatatcgtggatgcaacaaacctacagcgcaatttgtatttgacgctgcagcttttggaactccataaaccgatggtcatcgcgctcaatatgatggacgaggtgcgcgcgaacgacatcacgatcgatatcgaaaaactcagcgcagagatcggcgtgcccgtcgtccccatttccgcttccaaaaaccaaggcacagaagagctggtggaagaactgcgccgcgtgatcaaaaacaaggaactgcctgcgcgtaccgacttttgcgaaggcgaagtacacaaggcgttgcacgcagccaagcatttgatcgaggaccatgcggcagcggccggatatcccgcgcgttttgccgcgtccaagctgatagagggcgacgaaccgctggaacgtgcattggagcttgacgagtcggataaggacattttgcagcatattatcgaccagatggaggaaggcacggggacggatcgcgaagccgcgctcgccgatatgcgctacatgtttatcgagaagctctttgacgagaccgtttccaaaaagagttcgacgcgagagatgcagcgttccgtaaaaatcgataaggtgcttacgcataagatttgggctatcccaattttcatcgggatcatggcgttcattttttatctgactttcggcccgctgggcagctttttatccggcgcgcttgaggatggtatcgcctacgtgacagacgtcacaaatttcgcgctcacatccgcaagcgtatccgaatggatgcgttccttcatcattgacggcgcgttcacgggcgtagggaccgtgctttccttcctgcccatcatcctgatcctgttcttcttcctgtccatcctcgaggattccggatacatggcgcgcgttgctttcgttatggacagttctctgcgcaaaatcggcctttccggacgttcctttgttcctatgctgatcggctttggctgcagcgttccggcgatcatgtcggcgcgcaccctggcaagtgaacgcgaccgcaaactgaccatactgatcacgcctttcatgtcgtgcggggcaaaggtgcctatttacgcattgtttaccgccgcatttttcacgcaataccaggggcttgtcatgacgtccctttatgtccttggcatcctggtagccattctgaccggactgattttcaaaaagatattatttcgcgggaatccggttcctttcgtccttgagcttcccgcctaccgcctgccctcgatcaaaaatgtgctgatgcacatgtgggataaagcaaaggatttcttggtacgcgcttttacgatcatcttccttgcgagtatcgtcatctggttcttacagtcgtttgatctccagttcaatttcgtaacggacaattccaccagtatcttagcgggcatcggcagggcagtcgcgcccatattcgcgccgctcggatttggaagctggcaggcgtccaccgcgctcattaccggtttaaccgccaaagaaacggttataagtactttgtcagtgcttaccggaggcgagcaaatgctgacgtcgctttttacgccgcttacggcttattctttcctggcgtttgtactgctctacatgccgtgtatcgcggcggtagcgacaacaaagcgcgaactcggaaccaaaaatgcggtccttacaatcatctaccagacactggcagcatgggtggtcgcattcctgattttccagatcggttcgctgttgctataagctaaggagagggtattcgtggcggaaatcatcattggcgttattatcgcagtagctgtggctgctgccatcgtatatatcgtaaaaaagcgaaaaaaaggggaatgtatcggttgcagcgagtgtaaccggagcaggaattgtgaaaattgtcccctgggttccccgacggggaaaaagggaaaccgcccataggcgcgtctttgcataacagtgtgaagcaggccgcacagcgcgtttcgacgggcctccgaaatgattattgatttctaggaggcttttattatgacaccggttttaacttacgacaaatggactgatactgcttatacccttcacatgatcgcgcagatgatgggcaaggtaaagctcgttcgtatgcccgcccagcccgaatgggggcatatcgtgctgcattttacgccgcaaggccttacaacagggctgatccccaatggcgaacgcagtttcgcgatcaatttgaacctcgatacatccacggtttttacacagaccatctcgggcgatacgtccggcttttccctcaggaacaacacgtccgtcagcgaatattacaacgattttaaaaagatgctttctgccctcgtatgcgataccgtgatcaacgagaccccacaggaaatggggacaaagatccccttttatgatgatacgcccaagcatgactacgatagctgcgctgctaaagaatttatgcagatgtacgtatatgcacgtaacgcgctgcttacgtttgcttctccgttccgcggcaaaaaaatacttccctctttcttctggggaacgtttgacgtatccgccgttctcttctccggcaagcccagtccatttccgggcagcggcgtgatcgaggtgaacggttttgacgaacagtttatggaagttggcttctggaccggcgatgaaaacattcctgatccgtccttcttcatcatgccgtatccatttatcaaggatgaccttgcagcttatcctgtaaaaccagataagaccgtatggagcaccgtcaagatggaatatttcctgtctttaaaggacgtactttcctatcccgacccgcaggcggcattgcaggagttctttgaaaacgctttttccgtggtgacaaagcacgaagattgggaatgcatagactggttcacacagccccttacgattccggcgtgggattgaggcttttttattccagcccgtggaaatccagtattttgaagctgtttttccagtaatccaatatctcttcgcctttcatgcgcgaaagttccctggacatcgcgctgcggtccacgctcaaataatccgcgagctcgttcctgttgaggtcaatcaggaacgggttcgttttcttttggctgtattcgctgagcaggtaagcgctcagcttttcacgtgtcgtgcgcctgcttaaaaaatccatcttccggttgagcagcaaattttttcgtgccagcatacgcacaagacgccgtataagctcactatggaacatgcaggaattgccgcacgtcgtcaggattttatcaatttgcaaaaacagaatcttgctgtcttctcctgcgcttaccgcaagcgggctttgtttcagccccgcgcacgcaaacgcttcaccgaatacgccgcccggataaatggacgcgatgatactgcgcttgccaaaataatcttcgcggattacttgcacatgccctgaaaggacgatcccaaacccattgatatctgcacctgcgttccataccatatcatttctcggatattcacgcacagcatatcctaaacacgaaagcatcgcctctatatccgcagatcccatcccttcaaatagttcgtttttcccaagcaccgtataatcaattttcattctgttttcctttcgttgcaaatgcaacatcacttttgagtatattgtactacccttgtgattacaaagtaaatatgcgtttatcaattgtctaaattaagggaggaagtattcaatggaaatgttttgctttcagtgtgaacagaccgctaagggcacaggatgcacaatgagcggcgtatgcggcaagaaggcggagactgcgaacctgcaggactcgctgacggacaaactcgtggagcttgcgtgtgcggcgcagggaaagctccatgacgcaaagacggatgcggctattatggacggcctttttacaacggtcacaaacgtcagtttcgacgacgaggcaatcaaagaacagatccgcactcttagtcggcttatcatgcaatatggaggagactgtaattttgacgctaaccgtatctggcataacgatgaggatatgcgcagtctacaggccctattgttatttggtatgcgcggcatggcggcttatgcgcaccatgcgcgtatcctcggaaagacggatgcggaggtcaatgcatttttctatcgcggacttgcttcgctcgcccaggaccttaccatagacgaacgccttgcccttgtcatggaatgcgggcaggtgaacctgaaatgtatggagcttttaaacgacgcgaacgtcggggcatacggcaagccgcagcctacgcaggtcaccactgatatcgaggcaggcccgttcatcatcgtgaccggacacgatctgcatgatttaaaactactgctcgaacaaacagagggcaagggaatcaatatttacacgcacggtgaaatgctgccggcgcacgcatatcccgaactcaaaaagcacagccacttaaagggcaactttggaacggcatggcagaaccagaaaaaagaatttgataacgtccccgctcctatcctgtttacgacaaattgtctgatgccgccgcaaccttcctattccgatcgcgtgtttacaacatctgtggtcggatatccgggaatgcggcacatcgacgaaaaaaaagattttggaccggtgatcgaaaaagcgcttgcgcttggcgggtatcctgagaaaaaagaaatgagcgggatcaacggcggacacgttttaagcgtcggctttggcgtggacactgtgcttggcgtcgccgatcaggtcattgatgcggtaaaaggcgggaagatcagccgcttcttccttgtcggcggatgcgacggcgccaagcccgggcgcaactattatacggactttgtcaggcaaacaccggatgattccgtgatcctgacccttgcgtgcggaaaattccgtttcaacgatttagacctgggtactgtcgcgggcctgccacggttgatggatatgggccagtgcaacgatgcatattccgcgatccaagtggccctggcgctcgccaaggcctttgactacagtgtgaacgacctgccgttgtcccttgtcctttcctggtatgagcagaaggccgtatgtatcctgctcacccttctcgcgctggggatcaggaacatctacttgggacccactcttcccgcctttgtttcccctaacgtcctgaatatcttagtggagaagtttggtatccgcccaatctccacaccagaagcagacctgaaaaaaatactcggctaagcatataaaaaggcgcttttgtgtaaagcgcctttttatttaaccaccaataaaattcaattaacgtgccattcggtaaatagcagccatatcattttgatgaaggacttttgccgagccttggcttccgcctgttgctttcgcacacgattccgccatttcaaggatttcctcatccgtgggctcaatgccaagctccttcatatttgtcggcatcccaatgcggcggtaaaattcttccatagcggaaattccttttaacgccgtctcttcatcatccttgcccggcgcaacctgcataacgttcaaagcatattttacaaagcggcctaagcaatccttgtaaacgtatcttgcccaactgctccagattgccgcaagtcctgcgccatgtgttacgtcaaactttccgcccatttcgtgctccaacatatgcgtggcgaaatctccgccatcgttgccgcaccccgtgaggccattatgcgcaaggctccctgcccacatgatttctgccctggcgtcatagttttcaggatccgtatgaaggagctccgcgtttttcatcacggtccttaacagcccctctgcaatgacgtccgtgatttccatgtttccgccgtttgtaaaataacgttccatcgtgtgcatcatgatatccgcacaccccgactccgtctggtaatcgggaagcgtcatggtaagctccggattcatgaccgcgaacttcgggcgggacaggtcgtcgtcatacgcccttttttcatccgtttcttcattcgtgataacgcagctattgctcatttcactgcctgccgcagcgatcgtcaaaacagatgcgagcggaagacaggcgctcgcttcccgcgtatgttcgaacagatcccacacgtcgtgctttaaatccgccaatccgtaagcgatggccttggccgaatcaatgacgctgccgccgccgaccgccaggacaaagtcgatgttcgcctgcttgcccagctcgatgccttcccttaccttggatagatgcggatttggaacgacacctcccagttccacatgtgcaacggcgcttgcatcaagcgaccccttgacacggtccattaggcccgagcgtaccgcgctttgtccgccaaaatggatcagtacttttgtgccgcccgcatttttcacaagctcccctacctcattttcgctgccctttccaaaaactactttcgtcggtgtataatattcgaaattaaacataataaaccttatcctttcttttccatagtaacagcttattcctgtttttctttttgattacattgattctacccatagtatagcacaaatcgccggacgaatctttatacagaaaaaatatgactttgcagcatttggatggtatgataatgatatccttataattcgaaaaagaaaggctggaaagaaacatgatgcatgaaatgagacggaaagagcgcgcactcgcaagagaggacgcgcttgcactgctgaaggactgtgaatatgccgtcctttccatgaccgatcatgacggaaacccgcatgccgtgcccgtatctcccgcagtcgagggcaacacggtatatatccactgcgcgcccgagggctataaactcgactgtattgcccacaatatgcaggtatgccttgtatgtgccgatcacatcacgcgtatgccggagcggttttcaaccgcctaccaaagcacggttgcttatgggatggcgcgtgttttagaagacagggacgagaagatccatgccttataccttatttctaaaaaatatgcgctccccaacataggcaattttgatgatgtgatcaaaaaatccctgtcccgtaccgcagtgatccgcatcgatattgaggagatcagcgggaagcaaagaaaattaccgaaagataaataattgagacaaaaaatgggtatctatatcctgaaagtgaggatgatcgtatgacggcccggatttcttccaaatccgtaagaagatatattttggatgggttgctgttcttactgggcagcctgatttatgctgcggcaatcaacatctttaccgcgcccaacaacattgcccccggcggccttacgggtatcgcgactatgttgaatttcttattcggcttgcccatcggtaccatgatccttttgatgaacgtcccgctttttattctcgggtttatttatttcggctggaaattcatcatcaaaacgatcattgccaccgcgctttcttcggcgataatcgacgctacctccggcatcttcccgcaataccatggcgaacctctcattactgtcgtattcggcgggcttctttcaggcgtcgggcttgccctgatcctgatgcgcggaggaacgtccggcggtacggaactggcagcaaacctcgtggcgcttaagtttccccatatttccatcggcaagctcatcctggttttggacgtcatcgtcgtcttgttttccgcatgggtataccaggatttcgaaagcccgctttatgcgatgatcgttattttcatcacctcgtggattatagacgccatcctttatggaacgagtatcggcacaggaaagatgatgtttatcgtttcccccaagaataaagagatcgccacagaaatcatctcaaaaatggcgcgcggcgtaaccgctcttaaatcgcgcggcggatacagcgacaaggaaggcgaagtgcttttgtgcgcagtacgacggcaggaagtttatcgtatttatcacctgatccatgagatcgacccgggcgctttcatcatcgtaggcgatgccggagagatcagcggcgaaggtttccgcaatattgcggccagtgagatggcaaggaaaaggcgtgaaaagaaaaaaggaatttagatatgaaaaagagcgctcctgcaagaagcgctcttttatttttcttaatacctgttgtttccgttccctgaattataaccttctttttcccatatccggaaccactcatgaagccttgccaaaaattcctcgttggtctgcgtacgtacgagcatgccgataagctgttccgttacctccgtcgtattgcctgaggaaagggctttcctgagcgcccaagttccttccaactccttctgtgacaagagcaggtcttcacgccgcgtacctgatttcgcaaggtccaccgccgggaagatacgtttttccgagagcttgcggtcaaggtggatttccatattgcccgtacccttgaattcctcataaatgatttcatccatgcgcgatccagtatccacaagcgccgtagcgatgatcgtaagcgatccgccgccctcaatgtttctcgccgcgccgaaaaaccgtttcggcttataaagcgaagccggatcaagtccgccggaaagcgttctgccggaaggcggcacgacaaggttgtgcgcgcgtccaagacgtgttaagctgtcgagcaggatcactacgtcgcggccgtgttccaccagccttttcgcccgttcaatgaccatatcggcaacgcgcgcgtggttttccggccgttcgtcaaaggtcgaataaacgacttcgcccgcgatagagcgctgcatatccgtaacttcctccggacgttcgtcgatcagcagcacgagcatttccacttccggataatttgttgtaatgctgtttgcgatcttctttaagaggatcgttttaccggcctttggcggtgcgacgatcagcccgcgctgccctttgccgatgggcgaaatgaggtcgatcatgcggatggcaaggtcgcgcgacgcacggacattttccagtgtgaagcgttcttccgggtaaatgggcgttaacgtttcaaacgcaggacggctgatacatttttcgaccggttccccgttgaccgtttcgatatacaaaagcgccaacaaccgttcgccgtcctttgacggacgtgttttcccgcataccttgtctcctgttttcaggttaaacttacgaatttgcgcctgcgatacataaacgtcttttgttccgggcaggtaattttcgctcctgaggaagccatagccttctgagtgtacctctaagatgccgtttgcatccttacattcccctgtattcaggatttcgttgaccgcatcgttgtttggtacatactcgatgatgcgccggcgtccggaatctgcctgttcttcttcctcttccgcatctcccagatcatcaagctttatttcctgctgggattccagactctctgcttccggtattgtatctgcagaagagtctttttctgccgcttttttgcgaggcctgcccgcacgctttggcttttggggtgcagcttcccccttgggctcttcagccttgggcacctcactctttggttcctgaacctgtggttttggtatgggcatgctcgccatgccaaaaatatccacagcttcgtcctcggcctgtttttcctcgcctttttgttccaactccaaaagcatggataaaagttctgccttcttatatttcgtaggcgactttactccagctaattttgcgatctctctgagatcagccagactcttgtcttcaagtaaactagtactcacgtaaatacgctcctttgtatcataaaaaatttcaaattttttgaatacgaattaaaaatataaaatatatcatttcaatttggtaagaaatggcttacagccctataagttttcacttctgtcattcttattatgcgcaaaaatcgcgccattgtcaatctgttttccatagatttatatacataatatcctgttttttacaattctaaaccaaaatttcattaaaaatttacatttattctttttttatgcttacttttcccaaatattgtatattttctcctgcattatatttgattgtatttgtttcaggccaaaacaacggccgcttcccaaaattgtaatcaattccatagtttgaaataaaaaacggctgggaagccgttttttatttcctatacataataaagatctttcgacggatacatcggttcgcaggtcaaattgatattcagcttcttaagcaccgattcgtccgcctgcgtcagcatacatgtcgaatgcacctcgcagcccgcaagcagtttcaatttggtcattccaacttctgccgttgggttcatcgcagcactgatggaaagcgccgccagtacgtcctctatattaaggatcggatcgatttctttcagtatcgagcttttgagcttcaaaatcggttccaacgcaatgggcgatatcagcctgatctcatccgaaatatttcccaggtgcttgatcgcgttgagtatcatgctggaaacgttgttcatgagctccgtcgtttttcccgtaatgatcgtaccgtcgggaagctcaagcgctgccgacggtacgcctgttttctgttcttttgcaattgccggctcgacgaccttgcggtcattgggctctaattcaagctgcttcatgagcatcaaatttttctgcagggcctccgccgtcgtgtttccctttttgtaatcgcactgcgcattgtaataccggcggatcacctcctggcatgccgcctgcttgcatgcttcgtcgtctataatcgcgtatcccgccatattgacgcccatgtcggtcggggactggtagcattccttgctccccgtaattttcgccaggatcgtttttacgatcgggaacgcgtcgatatccctgttgtaattgactgcggttttgccgtacgcttccaaatggaacgggtcgatcatattgacgtcgttcaggtctgaggtcgccgcttcatatgccatattgacaggatgctttaagggcaggttccagatgggaaacgtctcaaattttgcatatcccgccttgcttccgcggcggtattcatgataaagctgtgaaagacaggttgcgagctttccgctgcccgggcctggtgcagtcacaacgaccagcggacgctgtgtctcaatatatggattcataccgtaaccttcgtcgctcacgatgagttcgatttccgaaggatatcccttcgtatgcctgtggatgtacgtcttgatcccgcggcgctccaatctctggcgaaaaatatctgccgcatattgctccgtgtactgcgtgatcacgacgctgccaacgtaaagtcccatgccgcgcaggctgtcgatcagccgcaatacatcgaggtcgtaggtgatcccaaggtcagcgcgcactttgtttttttcgatatcgcccgcattgatacagaaaacgatttcagactggtccttgaggctttgtaatagttttgcctttccattgacatcaaaccccggcagtacgcgggacgcatggtaatcgtcaaacagcttgccgccaaattccagatagagtttccctttgaactggtcgatcctttccagaattttctccgtttgttttttgatgtacaattcattgtcaaaaccgattttcattataagcctccatacttatcgcccaaaacacttcccacacaaaaaataccccgggcacgcccgcagtatttttttaacaatatcccttacccaaacgtcatttcgtccggcgccccgcattgtgctcacggacaatgcgtacattccattaccacgatcctgttgcgtttctttaaattatccgaagtgatatcaaagagtccgccgccgatgcgcgaaacatcgtattccctgcttgccgcgcgcgcgaggaaatcatgcgaacttgcaatatccagcttaagccccggcgttaagtaatgcatgggaatcgtgatgttcggatgaatcctgtccatgatattgagcgcgcccttcgcgtccaccgtatatgtccctccgaccggaatcatcaaaagatcgatcttgccgaccgcttcaaaaaagctgtccggcggcatcgccccaacgtcgcccatatgcaaaagccgcattccgtccgcttcgatgaggtaagcgacagtcttgccgcgcagcgcgccgctttcttcgtcgtgggaaagctcgatccctttgattttgatgccgcacgcttcatactcgccggccttggtgatcagcgtatggtcgtgctttaagccatccacatactcatgattatagtgatcaaaatggtcatgcgtaatcaaaaggatatccgaaattttctccggaaccttaagcccaatcgtattatcgtacgggtcggtcatgatcgttttaccgtccttcgttgtgatgtaaaaacaagaatgcccaatccattcaatcaacataacgttatcctcctcaaaatacaaaactttttaaaaagcatatgtctatgcttttggtatcgatttataattgatattcagcttattgacagcctgctgatcccccacgcggatcacgtattcaagatcgatatttcccttgtcgcaggaaagctcgcttaaaacctgtgtgggcagcacggacatttccatcataccaaagggcgtctcgtaggccgccgcaaacacacggctttttaaaaacacgaactccgtctccacaagtccggtacgcttaagctgtacgcggtctccatcgatcgtcagactggtttttgtgttttccatgccagaaagctcgctctcgtcgtattctatgatatatttcccgtcgtcacacgtcagcatgccttcggtaaaaagctccatctcatggttatcgttttcatcggcctgatatccacggacattcaaaagaatgttactttgaatcattatcaaagcctcctcctgacatacctacgggtatgtccgtttcttgttgagaaaatattctccgcattatattgtacttaataaattattataccacagaatcaccccatacaaaaagattttgcataaaaaaaacacaaaaaatgttgtatgggaccatttgttatgttaaaatacaagcagaaaaagacccgccaattaaaacttgccttcgaaaattatttgggggaattttttaacaaggtctatttttccaaaaaattttcaggaggatgccaaaacatgccagacaaaacattgatctgcaaggattgcggagcggaattcttattcacagaaggtgaacaggactttttcaaggaaaagggattcgacaacgagccggttcgctgcccggcttgcaggaaggcaagaaaacagcaaaggaacaatttcagaagagattacgaagactaagcaaacgataaaaagccgcctttaggcggcttttttattgtctgaaatatggtggcacgctcaacagtccgcgagcgcatttttgtttgcgcgcgtcacgttgttaagccatttgccgcttttaagccgccacaggcatatgaacactttgaccacctcatcgaatcgcagaaaaagaaatacgacggggatggaaaggtgccaggcaaagccgccgagcgcgccgagcggaagggcgatcgcccacatggtaatgatatcgaggatcatgcagaacatggtatcgccgccgcccctgaacactccgacgacgcacgacaggccgatggcctgcatgataacgatgaacgccgctacgtacatcgttgcgtcaagcgcggcgaacgtttcgggcgttaatgtgtaaaagcccataaagacattctttaacaaaagcagtgcccctgccgaaattccggcgatcagtatatttgcccatacgagcgtattcgccgattttcgggcggtatcatattgttgctccccgatatattttccgataatgaccagcgtcgcggaggcggaaccatacacaaagatcgtcatgatgcgcatcaccgttgagatgatgcctaccgtcgttacggctgtaacgcccatgtgtcccaaaacggacgtctgcaccgacataccgatagaccatgtcatttcattgacgaaaacaggcagggcataacgcaggtaatccttccacaacgccttatcgttttgcaccaaacaacgcagcgaaagtttcacgcgcggctctttttttgcgtagaccagcacgatcacaagttcgctcaggcgcgcgagcactgttcccatcgctgcgcctgcaacccccatcgcgggggcaccgaattttccgaaaataaatacataattgaaaaacacattgaccacaaaggaaatactgtaagtaataactgcaattttgacgcgttccacgctgcgcacgcacgtcagataagtattcgtgaacgcatacggcaaataggaaagcccaacgagcggcaaatactgcgcgccgtactcgatgacctgctgttcattcgtatacagctccatcacctggtacggggcagccattacgcatattgtcgccaccacgcccgcgatcagcgaaaggcgcagcacgatgccgaatacttttgcgatggtatttgtgtccttttccccccagtattgggatatcagcacgctggcccccgtcgcaagtccgtaaatacagatcatcagcaggaaaaacgtttggttggcgatcgtaacggcggaaagctgcacctcacccagcgacccaaccatgatggaatccatcagcgcgaccgaataggtaagaagattttgcagccctacagggattgcaagcgataaaaaccacctgagcaaatgtctatttgatttcagcttgattctttccatcaaaaaattcccccaccgtcaatcaaaaattgctgccaaggtccctgcccttgcagcaattagtatcatagcatattttctttttcccaaaaagggatttaccgcaaatggttaaaatcgtccggtaaaccggtcaaaaaaatccatctcaatccatgcggtagcgcgatttaaacaatttcagccctgcccgcgccaccggatttttcgccatgctccacagcatttttttcttctccccctccgcgcaaacagcctcataaaacgtatcggcatatgccggatcttcaaggatcacacgatttttgatattgcctttttgtacctcacggtaaaattccagccataccacacggttttcgcgcacgccctcttcatgcagggacaaaaaagaatttttgccgtgcaggcggtagaggtatgccgtttccgctgtataagcaggttcgtcataaaggcacgcccgcaggaaaaaatcgtaatcgtgcacatatttataatttttgaatccgccgaccgcttcatacaggctgcgcgcaaaaagcagatttccggtagatatactgacgttttccgctaccgcgctaagcgcgataaagcgtttcccttctattttgtcctgtatcttctcaaacgagcatgcctgcccgcttgcaagcggctctccttccgcgccgatgcaacggaccttcgagaagctccacagactgtccttcttttgcatcgcgtccatcatgaccataaagcggtttgcttcatagaggtcgtccgcattgagtatcgcgatataatcaccggacgacgctgcaatgccggcgttgatcgtggcatgcgcgcccatattttgttcgttctgcgagacgataatacggccggaaaaacgtttctgcagcgtttccgtctgtgtaactgcaaggatttcctgccagcttttatcctgtgagcagtcgtcgatcacgacaagctcgatgcttgcataactctgcgccgcaacgcaatcgatcgccgcacggatatacttttcataatgataggatgggataacgactgaaatcaaaggttccatatcacagctcttttaaataacgcgcgatcgcgtccttataatccggcaaaagttcaaaccccgcatcgatcagcgcccgtttggacatccgcgaatttttggggcgcggagcggccgtgggaaccatctgccggtattcctccgttgttacgggaaccgctttggtatttgcgcccgcttgcctgaaaatttccgccgcaaactcgcaccatgtgatatccccttcgttcgacgcctggtatacgccgaatttatgcgaagcaatgatatcgcatatgagccttgccacgtcgtatgtataggtaggcgaaccgtgctggtctgcaacgacggtgacctcgtccctcgtttgcgcgaggcgcagcatggttttgataaagttattgccgtttttgccaaacacccagcagattcgtacaatataatattcatccagtaccttctgaacttccagctcgccctcatatttggttttgccgtatacgctctgcggattcttgggatcattcgcttcccacggcgtatccttggaaaaaccgtcgaacacgtaatccgtactgatatacatcatttccgctccgaccgtttttgcagcctgtgcaatattctttgtgcccgtcacgttgacggcatagcatttttcctgctccgcttcagctttatccaccgccgtatatgcggcgcaatgcacgatgcacgtaggcgcgtattctttgatataagaaagcacggcggcttcatccgtcaaatcaaaatcctggatgtctactccctggttctcgataccgcgcatgtcaaggtgccgtaccacgtcatagccaagctgtccgttcactcctgttacaagtactttcatggcatgctcctatctgtccgcgtacatattctggtagtaattccggtactcgccgttgatgatattcttccaccagtcctcgttgtcaagataccactccaccgtctgggcgatcccctggtcgaatgttgtcgtgggctcccagccaagttcatccatcatctttgtcggatcgatcgcatagcgcaaatcatgtcccgcgcgatccttcacataagtaatcaggctttccggtttgtcaagctgtttcaagatcgtctttacgacctgcaaattcgtgcgttcgttgtgcccgccgatattatatacctcgcccacacgcccgtcatggatgatcctgtcgatcgccgcacagtggtcgcgcacataaagccagtcgcgcacattttcgcccgtaccgtaaaccggcaggctttcgtcagccagcgcgcgggaaatgatgagcgggatcagtttttccggaaaatggtacggcccgtaattgttcgagcaccgcgagatcgttatgggcaaaccgaacgtcctgtgatatgcctgcaccagcaagtccgcgctggccttggatgccgaatacggcgaagacgtatggatcggcgtttcttccgtaaagaacaaatcaggacggtcgagcggcaaatcaccgtatacttcgtctgtggagacctgatggtaacgcgtaactccatatttgcgggaagcatccatgagtacctgcgttccgaggatattggtgcgcaggaaaatgccgggatcttcaatcgagcggtccacatgcgattccgccgcaaaatttacgacgatatccggatgctcctcttcaaacagcgcaaacaccgcgtccctgtccgcgatatccgctttgacaaacttcacgtttggccggtcaagcacatccttcaacgtttccaggttgcccgcgtaagtcagcaaatccagtatcacgatttcataattcgggtgactgtccagcatatgaaatacaaagttactgccgataaaacctgctccgcctgttactaatatcttcatcttatccttcattctccttctgtccgccagtttttgcacacgtcgatccattctattgcctgcgcataccgcataagttcatcgcatgtaagctcgatcgcactgtttgcgctcccgcatgccggaaataccgtttcaaaccgctttagggaatcgtccagatatacccgtacctctttgggtattgcgaacgggcataccccgcctaccggatgtccgactttttccagcacttcttccggcgaaagcattttcgcttttgtcccaaaatacgccttataccgtgcgttatcgatcttagcgtcgcccgccgttacaatcaggatacacgcatcgccaacccgaaaggacaatgtttttgcgatacgcgcgccttctacacccaatgagagtgccgcaagctctaccgtcgcgctggacgtttccagttcacgcaccttgtgctccatgcccagctttgcaaaatatcgttttacttcttctatcggcatacgttaaaaatccacatcgctgtcacgtaaaagcggcgcctgtaaatccttttgcgaaaggaccggattttgaatgccccagtcaacgccgatttccggatcgtcaaaacggatggaccggtcgcactcgggcgaataaaccgcatctaccttgtactgcacttccacgtcgtcgctcagcgtcaaaaagccatgccccatgccctttggcataaagaactgccgtttattctccgatgaaagttccacagcgtaccactttttataggtcggagaacctttgcgcaaatcaaccgctacatccagaatttttccggccgtacagcgcagcagctttgactgcgccatcggatttttctggaaatgcaggccgcgaagcgtccctttctgtgcggaaaacgactggttatcctgcacaaattcacatgtgattcccaattcttcaaactttggtttactgtatgtctccatgaaccatccgcgatggtccccgtgcacatccggctcgatgaccaccaagccttcgatccctgtttctattcgtttcataggtcaagcacccttccttccgcaaccgcattaagatgctgcccatatggcgattttccatattttgccgcactgctgcgcagcatatcgcaatcgatccaccccttgcggaacgcgatttcctccggcgcggacatcacgatcccttgccgtttttgcagcatgcgtacaaattccgccgcttcgatcagggaatcaaacgttcccgtatccagccacgcgtagccgcgccccatcagcttaacgtcaaggtctccttcttttaaatatacggcgttaagatccgttacctcaagctcgccgcgcgcgcttggctccagcgcttttgcgtagctcgccacgcggttatcatagaaataaagccctgtgatcgcataattggattttgggttttgcggcttttcctctaccgaaagagccttaccattttcgtcaaaatcgacgatgccgaaccgctccggatcttccacataatagccaaaaaccgtggccctgccgctatctgcattggttacagcctccgccataagctgcgacagcccgttgccataaaagatgttgtcgcctaagatcatcgcgcatgtatcgtccccgatgaattcctcgccgatgatgaacgcctgtgcaaggccgtccggcgacggctgctccttgtaagaaagcgaaatcccgaactgcgatccgtctcccaaaaggctttcgaaccgcggcagatcgacaggcgtcgaaatgatcaggatatccttgatccccgccagcatgagcgtggaaagcggatagtagatcattggtttatcatataccggcaaaagctgtttgctggtcatgatcgtaagcggataaaggcgcgttccgctgcctcccgcaagtataattcccttcataacatcccccttttagtggatattttaccgcattatcatagctgtttttaaccgtgtatgtcaagcggctgcgctttgccgcgccatttccagaaatacttgaacatggaaccaatatggatcagcaaataacgcaggctgtgcgcgctgctgcgcgcatagtcgtgcacaacataatcaaacggataaaagacgacgcgcgcagtttcccttacgctgcgcgataggtccgcatcctcaaaatacataaaataccgttcgtcaaatccaccgagctgtttcagcagatcagtacggataaacaagaaacatccgctggcaaactcgacgtccgtgacccctgagagatcctcgtccaacattttataatgtttacgcaagctttcccattttttcccgggcgtccgattggcgatcaggtatttaagtttcggattgcgttttggaaggtgctgtggatccccattggtataacggatcgcgggcgtacacatcccaatatccggatttttgcgcataaacgttgtaagttctgcgagaatgtcgctttgcaatacgatatccggattgacaaaagcatggaaatccgaatcgatgatatcaagaacaaggttgtgtcccgcgccaaatccaaggttccggtccgaaaacacaacgctcaaagccgaaaattcatccgccagacgttctgcgctgccatccttggaagcattatcaattaaataaatttttgcgcggatgccgtgcgtatactcaagcagcgtccgaatcgcctgacgggctttttcataattattataatttacgatgctgacagtcacgtcatatttcaaatgctgtatcctccgtccggctttcacaagctctgtattattatatcagcaaattagcgcgttttccatccgtattttatacttacatattaattgcgtattttctcttcaaagtgtataatacaggtataatccaaaaaagggtggatttcttatggcaaatgaaccgttacatacatctcccggggaagccgagcggaaaaagcaaaaaaagatacgcggtaacgtcatcacggtcgtcgttgtgaccgcgcttattgtgttttttgtgctcagtatggtacagatgttcaatacaagggttgcgcaatataagctgtcgcccgagtatcaggcgttccaggagcgttgggcggaacagcatgatcctgcggagcctaccggcttgtttgactgaagctgtttttcgaaaacaaaagacccgcttctaaagcgggtctttttatatcgtatactcaaagtccttctttccaatacctcttatacagatggcgcatatggtttttcattttttgagtagcaagttttttgtctttggcgctgatcgcctctgcgatttctttgtgctcttcaaaattgacttccctgtattccggaatcgtgatcgtgcggtcacggatcaacgtccacatttgtaaatccatcgctttggtcaggtcgcccatgatcatcttatagacctcgttgtgtgatgcatcggcaatcagctcatggaaccgtttatccgtcgttggggaataaaatccatcttttgtttcctgttccattgtcctgatgatgtcgtcaagctctgccaaatcctcttttgtcgcgtttgcagccgcaaggcctgcgagctgcggttcgataaacgtacggacttcgatgatatcgtgcggcggaatctgtatttgttcctggctatcgtttttcaagtcaaggctggcaacataaacgccgccgccgcggatcgaatcgactacgccgtttaattccaacgcgcacaaagcctccctgaccggcgccctgcttacgttaaactgtttgcacaattccttttcactgggcagcttatcgcctacttcgaatgccccgcccttgatcttatccagaatctgcgtgtatatctgtatatataacttttgattattgaccggatcgaaatcgatacccatgcttccacctttcagaaacttgtctgcttctctattaatcttagtatatgttcatattaatatagaacaagatttttggcaagcatttcattccgctatcgcaaccgcccttacgggagcgccgctgcagcctttgagcttcaggggaaaggaatacatcgtccatttttcatactcgagcagttcttgcgggagacggtattcttcaccgatccatattccttttccaagcagcatttcgtgttgatagagcgcctcgcccgctcgcggaccaccgatactcatgacgtcgatcacgatcccctttacgcccttttccgccagccagtctgcgccttcattggaaagatatggccaattgtcgcaataatctttgttccagccgcgtttttcgccgaatcccgtacacagcatcacgatatctccctgtgttattttttgactgtatttttccagatgttcttccgtaatctgggcgtggggcttgattccaaataggtcaatgggtaccgccggaccgcagaacaccgacaaatccatttcatctatgcatgccccgtccggcatatggtggtacggcgcgtcgatatgcgtagcggtgtgggtattaaacgccacccgctccgaagtgtatccgtcccgcggtttgattttttccaatgtaaatgccgtcagttcgtacgggaaatagcctggattattatggtatatttcaaaggataaatctactattttctttgcattcattatattcgtcccctttgcctcagcctttggcctttttcttctcgctcatcattccaatgagcaccgcgataacaagtacgatgcccgtgatcgtcccattccaaaacgaattgatgcccatcaggttgatgccgttgcggatcgcaacgatgataagcgcgccgatcgccgcgccgaccggcgtcccgagccctcccgacaggctcgcccctccgataactgtcgccgcgatcaccgacatttccatactgacgcccgccgtacattctacagtcatcaggtatgacgcgttgagcattgccgcaaggccgcaaaacacaccacaaagcgcgtaggtcagaaacttaacaatcgctgtcggtactccgaccaggtgcgcggcagattcattgctgccagtcgcatagacccatctgccaaacagcgttttgcgcataacaaactgcataatgattacgataatcaccatatagaaaatatagttgggaacgccgaagaaaaagtttcctttgtcaaattccccaaacgccgccaggctctccccgccgatcgtctgtgaatttcctcccgcaatgataaacgtaagactggccgccgcactgtacattgccagcgtcgcgataaagggcgcgactttgagttttgcaaccaatataccattgcatgcgccgcacgcaaagcctacgagcaatgccacgataatgccgggggcaatgccgaaatggagcatcgcgagcgtccccgccatgccggacagggagaataccgatcctaccgagaggtcgatacctgccgcaacgacgatcatcagttcccccatcgccatgatcaggtacggcgcccccgcctggaacacgttcagcagattattccctgtaagcgcccgtccggtgataatctgcataacgacaaatatcccgaccagtacaaagaacataaaaaattcacttttatatgttttgaacaatccggaaaatccgcccttccccttgatttcaagctgacgcgaatttgtttccatttcaattttcctccttaacctgcgtatccgccattgtgatacacgccataatatagtcctcgttgatatcgtctcctgtaaggattctctccagatgtccgtcgcgtacgatcatgatcttatggcacagttccaccagttccgatatttcagaggaaacgaccaacgacgccgaaccctgctcggagagctgcctgatcagcttataaatatcctgtttggtatggatatctacaccccttgtcggttcatccagcaaaaacagctttggtgtgttgatgaaccatttgccaaacagaagtttctgttggttaccgcccgaaagagcacgcggcgcgctttccacagcggggattttgactttgagcatatggataacgtcttctactttttttgcttcccctttgcggaccaatttctgtccgtcataaatccggttgggcatcatgaccgtttcagtgatcggcaaatcaagaaacaatcctgatattgccctatcctccccgatatatgcgatatcccttctcaaggaatctttaggtgatttcggcgtatatttttcacctaaataggcaagttccatatcctttctatcattgaccccccagatcgtccggagcaatgcgctgcgccctgaacccgcaaggcctgccacaccgacgatttcaccctttttaagcgtgcaggacgtattgtttttttgataggtgactttcaggatattctctttattctcgaatcgatccttgtggactttttccacacttcccgtggaaactgctgtgccgatcatatcccttatcagttctgaatcgcttttatccccgatcattaccccatccacaaccgtcttaccgtctttgaatatggtcacgcggtcacatatctgccgtatttcgttcatcctgtgggatacgaatataatgccgattccctgcttgcacagcccttggattacttcgaagagtttatttgtttcatcaaagttaagggacgaggtcggttcgtccaataatatgatatcggccccgtaactgatcgcacgtgcaatctcaatcatttgctgctggtctgcgcggagcgcagagaccggcacgtccagttcgatctcgtccgcggtggtccccagcttgcccaacgcatcccgtgagatttcacgagacttattccagtcgaaaaaaccgtttttgatggtcgccggattattcatcgtaaggttctcggccactgtaaggtgcggcagtagcgataattcctgatatacgcacgcaatcccattttttctggaatctatggtgtttttaaatttgacttctttcccccgtagcgtgatactgccgctgttcattgtattggcgccgctgatgatgctgatgatcgtggattttcccgctccgtttgcacccatcagcgcgtgtacctccccgggataaatacgcagcgacgcatgatccagcgcatgtgtcgcgccatacgtcttgacaatgtccttcagtaccataataggggcattcgcctggctcattcttgcgccctccattcaagtgtgttttaccggcacgcagcttttggccgcatgccggtattgttgtgaacatccaaacccaaaataatttttatgccgctatggtcaatatgctcccgcagatgcagggtatacgagcttcaggatatcctggatctccggatcatccacgttctccgtcgtaacgagcggctccggcagcggaatatctttttgctcgatctcctcgcctttgattgccttgatcagttcctgtgtcgcaaccaagccctgtcctaccgcttcctgtacgacgatgcccgcgatttttcccgaacgtacgtccgcaatggactccgggcttccgtcggaagatacaatcgtatatttatcctgtgcacctgccgtttccactgcggcaaccgcgccgatgcctgcctgttcgtacataccgtaaattcctttcatatccgggttagccgtcatcaggtcgttagcctgctgcgtcgcaacgttgaccgtcagatcctgtgtttgcaaaacctgacaaatctcgatccctttttccttgcatgccttttcaagacccgccattttctgttgcgcattggagcgatcgagcggtaaagacaatacgccgattgtaccgccgccggctgcgatcactttatcgcaaagaaaaataccgttttcgtatcctgaagtgtagtcgtccgccgttactaggcatgcataattttctacgccttcatccgggccgatcgctgcaatcgtaatcgggatgcctgctgcttccgcagcatccaggaccggcgtgcaactcggtgaacttaccggtgaaagaacgattccatccacttcctgtgtgattgcggtattacagttgttctgctggctggaagccgagttttgcgcatcgtatgtgaccaaatttgcgccggcttcttcacaggcctgcttcacaccggcttccacccactgccaatactggatatctttagatggcgccagataaacaatattgagtccttccccgaaagtctttgccccctcgtcttctgaagctgcggcagaaacgggcatatccgaagcttcagaagcctgcgacgtgctttcgcttgcctgcgcgccgttattgcccgagtctgcgcagcccgcgaagagggcaagtgccataactaccactaccacgattgaaactaattttttcattttttcctccatagatattttttattttgcgcataccgcgctggaaactatatgaaaaatttattgttttgttattatgcccatgcgcgaccggtataaaatcgcattgcaatactttatgagaaaacttattgaattatttcttgattataatccgcaacttttgtcgacttgttgatttgtatgacaagtatacttcctaattttcaggttgtcaacatattttaaaaagttatttatttcacaatacatagcccccaaaaaggccctaataaacggtaacagaaaaaaagctttgtttccaaatctcagaaaaacaaaacatttgatatcttaatctgcaaaactgatatgggtaaaccggcttcggactctattctacataatcataaaaatatccgtagtcaacaatctcttctatattgctttcatcctggttgatgatcgcatcatatattttcttatgagcaagcaacagcgttttcgctttgccgcttttaatcatgttcattacagtcgtatagcggatatcataggtaagcgtacgcacaagggaattgatcctgtctatgagagggttgccaccaacagttgacagcacacggtgaaattcgttatccgcctcaaaaacctcctcgaccacaggtgatttttgttctgccacccgtttaaaagcattgtatttttccaaaagcgccttcttatcttcagccgtgcacttatgcatagccaacttgattacgccaacttccatcatttggcgcaactccttaatgctcccgtaagaatcgtcttcatgcagaatgattccatacagcatcgggtcaatcatgctatcggaaaaacctttgcgtacaaaggtcccctccggccggcggatctcaagcaccccataatagaccaataccttgatcgcctcgcggatggacaaacggccgacccctaaggattccgataattccagctccgtgggtattttatcccccggcctgagttccttatcaatcatcgcctgcgtcagcgcatcgatcacctgctgtacgactgaagaactgtttatttttttactctggaaataatcggattttttttccatatacttacctctttgttcaatatgataaccatcatacatcatacatcataataacatagaatccttttttttgaaagcaagcattttttcaaaacttgcattttcctgttgacagcccaaaaaacgagtgctatacttaagccatcatttaacatcatacgttagacataagctgttagacaagtttattatatgatagcaacgcagcgttttcaagttttctttttcaatatttttgaccgctatcgcaggccaaaagcaataactcatacgatgaagggagagtaaaatacgatatgaagaacacaagcatacctaaactccgggaaatcgcgaccgatctcaggaaaaaggttgtgaccatgatctacaaagcacagtccggccatcccggcggttccctttccgcagcggattttgtaaccgctttatattttcgggagatgaacatcgatccggaaaatccacgctatgaagaccgcgaccgttttgtgctctcaaaaggacatgtctgtcctatccagtacgcggcccttgctacgctcggttatttcgacctggaggtcctcagcaccctgcgcaaggaaggctctatcctgcaggggcatcccgatatgaaaaaatgccctgggatcgatatctccaccggttccctaggacaaggcttcgcctgcggagtcggcatggcgctggcaggcaggaacgacaagaaaaactaccgcgtatttgtcgtattgggcgacggtgaatgccaggaaggagaaatctgggaggccgcgcaggtagcgaataaataccggcttgataatgtgattgtttttgtagataacaacaacctgcaaatcgacgggacatgcgacgaagtcatgcccaacatcgacctcggcaaaaaattcgaagcatttggttttgaaaaatacgaaatcgacggaaacgatatgcagcagatcgtcgagaccctcgacaagatccgctccgctaaaaatggaaaaccgaaatgcatttttgcgcacacgataaaaggcaaaggcgtttccttcatggaaaattcctgcgcatggcatggcatcgctcccaacgatgaagaatacaaacaggctatggacgatttgaacggagggtttgcatcatgagtatagatttgaagttgatccccacgcggaatgctttcggggaagaaatattggcgctcggccagaagaatccggatatttatgttgtagacgcggatatcggcaaatcctgcaaaacggcggattttgcaaaggtattgcccgcccagcacttcaacgtcggcattgccgagcaaagtgccgcgggcgtagctgccggaatggcaacatgcggaaaaatcccctttgtcgttacatatgccgtcttcgcttccctgcggatgtgcgaaatgatccgccaggaaatctgttatcccaatttaaatgtcaaaattgcctgttcgcacggcggactgacccctgcaaacgatggggcttcccaccaatgtattgaggatatgggcgtattgcgtacgcttccgaatatgacgatcgttatgcccgcagattattattcggcaaaaaagctggttgccgacgcagccgcactgcacggacctgtatatctccgtttcacgcgggacgcaatccctgttatttacgacgaaaacacgccctttgtgatcggtcgtgcgcataaaatctgcgaaggcaaggatgtcgccatcatcgccaacggagataccgtgtcgatcgctgtgcaggccgccgagcaactaaacgagcagggaatcagcgtccgcctgctcgatatgcatacggtcaagccccttgacgtcgccgcagtaaaggcatgcgtcgaagagatcggctcaatcgtcaccgtggaagaccataatattataaacggtctgggcagcgctgtttgtgaagttgctgccggaatgggcaaaggaatcgtaaagcgtatcggcgtgcaggaccagtttggccaatccgcaccatacgagagcctgcttgccatgaacgggatcacaaccaaggaaattgtaaaggctgcggcggcgctcgtttcgcaagcaaaataacatcatacgtatgctattattgatacattgaaggagtatattatgtttgaattcaaagaccaggtagttatcgtaacgggcagcggttcgcccaaagggatcggccggacgatcgcgctttcctttgctaaacaaggtgcgaagcttgtgattgccgatatcaacgaggcaggtattcaggatacggtggatgccgtaaaaaaggaaggagccgaggctattggcctcgtcctcaatgtgaccgataagacttccgtggacgatatggtaaaatccgtattggaccgttggggaaaaatcgacgtgcttataaacaatgcggggatttcccaaaaggtaacggtcgaagatatgacgcttgaggatatgcgccgtatttttgaagtcaatatgtttggattatttctgtgtacgcaggcttgcatgaagccgatgcgaaaagcaggctatgggcgcatcgtcaatttatcctccgtttccggcaagagaggcggcggtgtgtttgggggtgcgcattactctgcttccaaagcagcagtactggccttttccaaaaacttgtcccgtgaaatttccatggacggcgtcaccataaacagcgtgtgtccgggcctcatcaatacggaaatctggaaatctcttcctgagtccgacgcccggaaaatcatcgacgggataccgatgggacgcccgggcgatacggaagaagttgccgctgctattttattccttgcgtccagggaagccagctatatcaccggagaagaaatcgatatcaacggcggctcacacatggactaaccaaagccaaccaacagtaagccaatagaaattctaaaccaaaagggccggaatatattttataccgacccttttggtttttttaatttacatggacttcatgtatacgtcaatgatatcctgacgcgccatagctacgggcgtcgcttcgatcgcgccgcgcatggcaaacagcgcatcgtctgcaagggctggaatcgattcttctgttacgcccaatgaggaaatcgtgatatcgcgtccaaaacccacaaggaaccggcgcaactgctccgcacactggcgcgcaagctcctcctctccctggtcagaatttgcgcctaaaagcagggctacttttgcaaatttaggaatattacctttgtacgaatactccgtcaatgccggtccgagcgcacacagcgtttcgccatgaaccgcattgaagtgcccactgatgctgtgtcccatgccgtggattgcaaaggttccgccgagcgaaattgccgtccccgccagcatatttgcaagggacattgcactgcgcgcttccaaatcctgcgggttatccacacactttttcaaattcgccactacaagttcaatcgcgcgtttggcaaacatatcggaatattcattttcctccttcgaaacatatgcctcaaacgcatggaagaatacgtccaagccggtattgatggttaccttttccggcaaagagagcgttaattccggatcgacgatcgatatcgtcggataccaaaaatcgtgtcccgtgcctggtttgtttccattatccggatttgtcactacggcgaacggcgttgcttcactgcccgtaccagaggtcgttgtaatagctatgataggcaggcatttgagatccttgtcatctgtatccgcaaatttgccccccggtatatagtcggctgcacttccgcccgaagcggcaagcaaggcgataaatttggaagcgtccattgggcttccgccccctacgcctacgaccacatcacaaccattttcctttgccaaacgcgcgcccctgtcacatgtagccgtcgttgggttttgctccacttctgcaaaaacgaccgtttccattcccgcttttttaagctgccccttaaccgtttccaaaagagcggtcttttccggacgtacactctgccccgccacgatcaaagcgcgttttcccagccccttggcatatttgccaagctcgtggagcactcctgcgccgaatacaatcttttcaggtacctctgctacaaaatttttcatttttatattcactccttcatttatttgtttagtaaatcacataatttttttattaaacaattgcattctcgttcactaaatgttatattatatat

SEQ ID NO: 13 - DNA, 86849 bp, Christensenella sp.
gtgggttcgattcccatcacccgctccatacagggttgcggtcgcttcgctcccttcgcaaaagaagcctggcttctctcgcgggctctcttggttcaaagttgttttccatcgcgttcccgcttggaaaaccgattgatttctgacgaacatagtcagcaagagaaaatatgcacccttagctcagttggctagagcacctgactcttaatcagggtgtccagggttcgaatccctgagggtgtaccacaaaagtaaaaaagaccgcctgatcggcggtctttttgttttgacattaatttcttgtcttccagcatcatatctttccctcctcttttaaagcgtcggcttctgtgtggctcttattttcctcttccattgttccaccttgccggatgctttactgccgtttcatgcggttgagcccctccaccatccccgtgatcgtgccgttgccgcccagactgtggtatacctcgtacatatcgtttacattttcgaggttgtaaatatgcacatatccgcgttctgtgcatttatcgcattcctggataatgtgtgtccgcagcaaggcgacgaggcccgccttgatggcggtatcctcgtcctttgcttttttggcgcgctttaaaaatataccgcacaaaaaaccaagcaggcccataccggacgcaaacagcgcgcctaccgcctgctctgtgatgagttcccctacgatgtccatgccctcactccttcggcttttcgtactccatcgcctgctcgctgtccgaaacgcccttcgtcgtcgggtctgtaagcacgccgacaaacgacagcgccgccatcaccgccgtgccgatcaaaaacgggttggtgaaaaattgctgaagtacgctgccgatgctttcccacgtcgtcatgtccgcatacgaaagcccgtaatacgccagcaccggcgacgcgaccacgcccaacagcccgatccagaactgcgggctttttatccttaccttccagttgattttcatgattgttcctcttttcgttcattaaattgcttaactttcttttactttcctgccttgtttgcgccattgtgccgctacatcaggatttctggtcgttgccgtttccccgtacattcctgtactatatactgtgtttttttgtcctcttttcccacgccgcgatgaacttccggaggccgccgcccgtgacgcagcttccgcccgcgcccgttcttcctcctgccgtttgcgctcctcttcctccgctttcatccggtacgcccattgcgcttttgtccacgcattgtcccgttgcttttcgcgcgcttcgccaagcatctgcgcataccttgtggccatgtttgcattattggttgtataattgccctgcaagtcgctgtttgcctttgaataagtgttttccgcagccgttttggctttcaggtaattgttaaaaacatgggccgcggttgtttccgacatgccgccggccgttccctgcgccataagcattttcggtatgttgttttccgccatgcgccttgatgtatctgcattttgccacgcctgccgccgctccgcctgcagcttcgcatcctgctgttttacctcattgccgagcgcggcctgttccgctacctgcgcggcttcatatcccttgatctgttcgtcatccctgccgctgctttttgcaaatgcatcatcgaacatttgttgtaaatcgattgccatgtcgcgataccctcctttctcttacatttccggctactgccacaagattccccatgtcttttgtccgaccacgccgtccgcgcccgcgctcccaagatcgtatccttccgcgatacgcgctttttgaaacctgatcacagcctccctggtcttttcgccatagataccgtcctccttgcccgcctgcgccttgtggagattcagccgcacctgcgccgcctgcacatccccgccgcgcagcatgggcgaagccagcttcaggttgcgtgtcagctcggggagctttccgccgccctgttgccctgatgcttcatcctccttaacagccgcgtattcccgcgcctcgtcaagcgggaaatacctgccggggcagtccgtgtaaccacgtcccgcgacctcgttatgccctttgatctccgtgatcccataatactgcgccacatctcgcgtcacgcgcatgagcgcctctttttgcagtttcggcatgtggttatgctcgaaatcccccagcgccacgatcgccaccgaatcgtcgttcatccccttcgtccccgccgcagagttgttgaccgatccgccgcaatacgcaagaccgcgcccccagcttaccgtaccgtcgcgttccacgcagatattgtagtcgatccccttgtgcccctttgacaggtggtatgcgtggatgccctgtaccgtttccgcgtcgccgcccgacgtatggtgcagcagtatccgccttgtcgctttgcggggcgtaagcgtcccatcaaacacgagcccatactctttcacatattcaaacattatatctcctcccccgcctatccattcagcgaagcccatgtcttgctgcccacgatcccgtctgcaacaaggccgttttgcatttggtatgcgcgtacggcgctcgcggtcttcggaccccatttgccatctacagcaagggaaaatcctgcgttattcaaaatcctctggatatccgcaaccctatgtccgcccgcactgcccgagctgcccccttttgaggcctgcgccaataatttttcctgttcctgcttcttacgttcgtcctccgctactttcgcctgatacgcccactgcattttttcccacgagtctgcctgctgcttttggcgcaattcattaagtaattgtgtatactttgattttagttctgtgctattcttcatgtaattgccctctaagtcgctgtttgccttagaataggtgctgtttgcagccgttttggctttcaaataatcgttgaaaacattggatgcggacgtttccgccatacctccggtgatcccctgcgccgcaagcatctgcggcatattcttttctgccatgcgttttgatacatatgcgttctgctgggattgcaggcggtccgcctgcaactgctggtttcgcctgttccgctggtcttccagcgcggcctgttccgccacctgcgcttcctcgtatcctttgatctgttcgtcgtacccgccgctgcttttcgcaaattcttcattgaacattttttccagatctaaatccattttaaatacctcctttatgcgtatgctgcgggaagcgtcacatcaaacatcatgcctgtcatactcgatccgcttgagttttccactgtcattgatcctccgtctgataccgagcacagcgcaagcgcgatactgccattcgcaagaacacatattcccgtgaactttgtttctcccaccagccccgcgcctacgatctggaaccatgcgccgctatttgttacacttgccgccgtacaatacattgacagccgtacccagccgttccgtttctgccatttgccataatatacattcccgcttacagccgtgatatttccactcgccgcttcgtttaattttgccaatggtattttatcgtttacttccgccttcgtcgcataatgctccggcatctgcccgccaagcttctgtgcgtcctccaccggttttgtcgttttgatactcatattgttccatccttaattaaaaaattctatattgagatagttgagtgggaactccgtgttatccataagcacaagatcactccccgcgctttgataaacggacatccataattccgtaacatccggcgccatttcccgatcaaatagataactgatctcaccagattgtgatccgcctgtcgttggtgaaaacccatgcgtcgttaaaatcgtagggtttgttccgcttccactatgattacagttcaggtaaatcgcccttataccgtttgtattctgtgcaatacggctatggcctgtaatccgcgcataacggtatccattcggtacagtgatccgtcctgtcgccgtatcatatgccaggttgtccttgttgcttataatcctcgaaaatataacaggggtaatagttccgtttacaatagtctgcgtggatattcctaccataatcacgctaccacgtttaattcgcacatccccctccatatccggcccttgcccgttgacggataggacgcgtcccgcaggaaccatatataccctgtcaatgtacgcctttcccgggaacgccgtatcagaatagatcgtgatatcgcccgcctcgttcttttccatttcaaacaagacagccttgagcttgccggtttcacttgtgtcgtaaagcgcggtcaatacgcattgcgcgcccctgcggtgctcgctctccggtataaaaagcgcatatccgccgccgctccgctcctcccagtccgcagccgttatgtcccatatgacgggcggcgcggtcacgccgatctgctcgtagctgcggtcgaacttgatgatgtagttgcataccaatacgggatgtacgttgttgtgggcgctcacggcattctgcgcagccgaattttttgtgtttccccatgcctgcaccaaatatcccttgtcacttccggtcgcgccatcggcggctacagataaggtcggggtactattcggatgaaaatgcgcgggcaatccgctttctgccgcctttagcgtatgcgtcttgttcccatacgtctttcccaatgtgttaaaatccgtatcgtccgcatccaagccaatgggactgcgcccgcgcatatccggcacgcggaaggtgtccgccgcatctcccgcctgattgtaggccgtcccgatgatgccgaacaacttcgtatacgcgccgtttgtcgggtaactctgcccatcgcaccacaaatacccgtccggcagcgtctcgccggcgaaaaatttcatgcacccgaccggttcgaactccccgccgccgccaccgccgccaccggcgtcgatcgcgtccgtgacagccttctggctcatgacctgcgattgcgagcgtccgcgcatctgcacaatatccgccttggggatacgctgttcgatacactcaagcagctccgccttattcgtgtcgtccagcgctttcaggctttccaataccgtctgcacgtccccgccctctatgtccgtaattgccgccgcgccgatatttttcgccccactgtccgtagacgtcgcccccagcgcgtcgatcaggtcgttgtattttcccagcgcaaccatcatcttagcgacgctgtcaaaccgcgcttttaagtccgacgcggaaacgccctccgcggaaggattatccggcaggctcgtaacgtccttgcccgcaaactccgcttcgctaaatttcaaattttctatactcatatataatgtgcctcactttactttcgttttcagatcgtaatagactgccgcgccgtatagcccaaacgcttcgcccactacgtcgttttcaaacttgagctgcgtcgtcacgatctttttagccttgatcttggtgtggatcacgttcacgtccgtgttggtgttgaacgtaaacctgtcaaaatccaaatcctcaaagctcatgatgtccgccgccttatcatcgatcagagaccacgccccatcctctttcaggtatatcttcacgctcgaacgcgcatatgggttaagctttgtgtaaatgtggcgcagcgtcttgtacttggaatacgtatcgaacgcaagctccggcgtcgcccaccgcgcgcagatcggctgtccgtcgtcactgtatgaagtcgaccgtttgacgttataaaaccgcatgatctttccgtctgccgtgccgaaatacagcctgccgtccgcctcgaaccagcacctcacaggcacattttcccagtaataccattcgtattggtactgctccgcgctcttgccgatatacgacctctgcgaggcgtccgccacatagacatgcccgtttaccgcaatgtagagatatccgtcgtgctcggtcgctaccgcttccttcaaattcggctcgcgtatcagttttttgttgatcagttcgcttcttgcctgcgcataccgctcggatgtgatcgcgttcgtcgtgatagcaaatacgccttgtttggataaaaacatgtggtcgtcgcgcaggtctttcatgcagtactgcgataccgcccccacgcccgcgatccctgttttcaccggaaacaatacgtccgcgttctcattcatcgacgcagagcgcaggaacaccgtcgcgtcctgttcgttttcctcttttaagaccgccaacgtgtctccgttgcgcagatatccaaccacccgcgtgttgtcctgccccatgagcgcatagcccgtatccggaaaataggtcggcgcgttgcgcgtttccgtcgtgatatccgacataaaatccatgttggggtaattcggatttcctgtgataaacagcctgttgaatccgcccagcccccatgtgatccccgtcgtgcatttgttgatcttatccgcgtttcccgttacgttttttgtgaacgtaatgcgtacgttatcgtcgccgctcgcgtcatatggcggcgcgcttgcaagcgtcacctttcccgtacttgcatcaacagccgcaacactggtcgctacccagcccccgttcgagtccaaaaattccgctttcgatacggcgatccccccaaacgtatcaagctggtagattttatcgcctgcctgcgttggcgtctgcaccttcccgttgaactcgttgatccgtgtattggaaagcagattgaccgcttcgtaattttccccgccgccgctgggcggacatttgatgcgcgtcgtcggcgtgtatgccatgctctgcgccgtctttacggtcgtgccgtcgtagcataaaagcgctttgccgtcgagtatccatagcttactgttcatctggtaagcattggaacgcacatcgttcatccccgtgtaaagctcctgcgcgttaccgtcgtccttccacaggtaaagtttcgtcccgcagtggacgatctttttcacgacctccttttgcaccaggcggaatatcccgttgatcctgccgtcaagctgcaaaagtttttcgtacccaaaccgctttaccggccggccgctctgctcggagatcatgttgacacaatccggcgaacgtgacggctccaccgcgcccagctccgaattgaagtctacgcccttgaaattcgccagctcaaattttctcgtcgacgaattgccctgtaatactgttcttcccatcgcgtcacctctctgacccctttttaatacatgctctcaacgtccgcatacgccgccttcgcaaaccttaccttattttgctcgtacatcatgttgcacacgttcgccttgtcgctctcgtcgtcctggaacaaaagccagtatgccagcccgtaaaccatgacgttcacgagcgtctcatattcgtacggcaatacgtccgttgttttcgttactgttggaatggacgtcagcggctgtttccccgcgctctcgcgcaccgtattgttcacactgaaacaatccgcaagcagcccgtttaccaagtccgtcacaaaaggcgcgtacccgttttcgtacttgctttcctcgcccatcagcgacatcgcctttttcagcagttcccccaccgtcatcgtttgctgtgttgtcgccatctcgtttcctccctttcgcgtcactccgcgccctattagcccgcctccgccttaaggcggaggcgaaccttttgggcggtcgttccttttccccacgaaactcattccgctttgctcattcgagtttcgcggggaccccttttttcgtttctcgcttacttatgcgttctttgcttctgcaagcgcgcttctgtagctgcccgccttttcagcgaacgccttgatcacctgaccggattccaacgccaccgccgcagaatacagttttgcggatttggagtagcgcggatcgctgccgtccaccgtgtatttgaacgtcacgccggataccgccgtgatcgccgcattgttcgatgtgatcgtgatcaccggcgcagccaataccttcgaagacgcaaccgccgcataaacgccgcctgattttgcgtccaatacgaaagcgtcgaagtagttgcggccctcgagcacattgccgtctatgcccgctacttcgctcaaaacgcgcattgtcttgatcttgttcgggcttaaaaccgaacccttgaacgtgatcaggaaatatgcgccgtccggaaaatatacgtccggaaccttgatcgccttcatatccgcgatcatgccgacatagcctttcgtaagagccttttccgcgaggctgtccaccgccaggaactccgaggacaagcgcagcatgttgtaatatgtcgtcgggatataaaggatcctgtcctgatcgggcaccagcgcgttatccagcgcctttgcgccgtcaaaaatcttttcgacgatcgtcgccttggtgggcgccgcgctcaagccctcgatcgtgcccgcaagctctgtccagcgtttcaaagtgtatttgtccatatacgggacgacctgctctttgatctgcgcattgagcatcttcgccgcgtttttggccttcatctgatcctcgttgttgccacggtcgatcgtgatggaaaagcccttgtcctgcgaaagctcgacttcctgtaccgtatcctgcaactcgcccggcgtaccgaaacggtgttcgccctcgcgcttgtagtcgcttaagtcaacggtctgcggcgtgtagatggaaaccgattttacgcccgcgaaatcataatccgtggacgcgtttcccgccacatagctttcctttgtgaatttttcagccatcctgtcgctgtatttgtgtgctaaatttactgccattactaatttgctcctttcagtcgcttgttcataatgatgttctgttttccctgcgggaaaaagaaccgctggactatctcaatttttctttcgcctttggctctgcaaaattggatattccatgcgtcctcttttatttcatcaattctactaagaacgggtcctccacttctacgccgcgtcctttgacgctgcccggcgtgctttccctgttccgttgttcctgtttgaggcgcgcaagctccctgccttgctccgcgatcaaatacctctggtacgcgaccacgggcgttgcccctgtcgttgcgacttcctcatatacttccggcggtatttcgtatacatccggatacgtggcgttgaactcctgcacgtttttgcgtatctgttcgtctatttgcttttgccgcgtcctgtccatttcttccggcgtatttttataccgcgcgttttcgacctcaagctgcgcgatgtgccgcgccatgcccgggtcaaaatcctgcgcaagcaactgctgcatgcgtgtcccgatcctgctttcgctgaaaatatcgtccgcttttgaaacgaactcgtccacctgcataccgcattgttccgcgagccgctttacgatcccgcgttcgggcgaggactgcaccgtatcgagtatctgctcgacctcccccgcagtcatctgcatatcgccgatcgttattttcggttcttcgcctgcgctgtccgccgtttcctgcagttctttgtccgcttccgcctgtccatccgtttcttccggctgttcgtccgcttcctcaaaggactccatgaaatccgcgcattcttcttccgacatcccttccggcgtttcttccgccatcagcatctcttcttccattgtttacgatttcctttcgcaatgtttttttatgatcaagcgtcgccgcccgattcctgctttttgtcgctctccacttcctgccggatcggtatatccaccggctttccatgggagacgcacctcgggttttcgcacatcagcgtcagcacggcgtaaagctccgttttacgctcgggcgtatcgtcgaacttcaccacgttcctgctccccgttacgtgcagggcgcacccgcaatccttacaaatatcgtcgttcatcctttttccctccttgttttttacgtataaaaaagaagcgcatccctgcgcttcccttattcatatttttttacaatatcatcataccacatccgagccggacaatgcctgacgcggaacggacatttgcggacacggggcgagtggtaaaaaaattgttccgcaagcctttctgcgtctttgttagcgtcgcatactccttagccaagtgtctcaaaccccttggcaaacccgtcgtccatcccgctgatcgtatcgtacttgaactgcgccgccttgctgttcagctccggctcgatcaggtaataatacttaagcgccgcgttcctatggaacgcgctgcattaaaaaaggaagcacgcgaggtgcttcctttttgctaatataatcttttgttacttactttcacccatactgcacatacacatttaacttattggcctgtgcctctctcacaaatgcgactaagtcatttcttaaaagatccatttcagacaacatatttttcgattctgtttctgccctattcgattggaatgactccaattctttttgaactgttgtgagatttattattttccatggctgctcatcataaaatccatcgcgggtaacataactataaagtaatccatcacgctgtaaatttactatatcacaaccagataacagggtttcaaaatacccttcccatattttaaatcctttatctaaatcgtcgtatattgtaacttcaacttctccctcaaatccttcataatatttttcgtctatcatactttactccttccaatgccctttatctaataattctagttgctctgttgtagctactccagcttttcttgcacttattgcatcataccacttaaacgctggcatccacttatttccaaccaaaaattctgtttttggctttactcctccatgccctgcttgcgttcttgtaacaacccaagtatttccttgatcctccggcgcatcagaagttcttgtatgccatctggattcgtatttgtatgctccgtctttccatttatatgagatttgctcatatccattttttgactgcgctctatatacggcattatcaggtatttcgatgggcgatctttgcttaaattcttccgcaatttgtgaaatagtcccatcagacatttcagaaaacttaagatttccttcttccattataccattcccattaccactgtcaaacccgcttcccatgccgctttcccccgtctcatcaaacgccatccccgcgccgttgcccaactccgtcggcatgttgataccctccggcgtgacaagctccggctgcgccaactgcccgatccccgacttcgccttcagcaccgctagctgcgctttttgcacgatcgggttttgtgacagcgaaaatgtcttgcgcagcgcctccggcaccttgcccgtcgtaaaagccgctaccagcctgttgcgcagtcccttctgtcccttgctcagccccgcgtaatccgcgtttaacagccccgcgatcccttccggcaaggcaagcgtcctccccgctcccttcgccgtggttcccgccgccgtctcgttcggcatgaatcccgacgcgcgaaggatattctcccccgccgtcttttggctgatcatccctttcgtctgcccgaccgcgttcggtgcgttcgtcacccctgacatgatcgccccaagcatccccgcgtatagctggtcttttgtaaacagcttgatctcgttcttctcgtcaaacgcgatgttgcgcagaacaggtaccatgaattgctgtatcatccccaccgtcgcctgtcccgtgctcgccgccatctgccgcgctaccgtgttcaggaggagccgccctttcgcgctccctgtgaattgccgcaccacgtcgtccgcctgcgacaacgccttgtccatcaccttcgtcgccccgcccagcttcccaagcccgcccaataccgcttgcgtcgccccgctgaccgctcccgtcatcacgccgtacgccaccgcctcattgactttctttccttcccgcaatgcttggttgatcgctccgccgccactgtccgctcccatcacgaccgcccccagcgcagggcttacaaggcttgtaaggatcgccggagccgcttctgtcaatcctgccaccacgtcgtatgccgtcctcatcccgccgtccagatcctcgtacagcttcgcgcctgcctgcgtactcaatcccgcctgccgtccccgcgtatccccgcgcacaaggtcgccgatttgtccgatgttattgacgaacttctcaaatccctcgccgcccgcgtttccaagcgtctcaaaccccttggcaaacccgtcgtccattccgctgatcgtatcgtacttgaactgcgccgccttgctgttcagctccggctcgatcaggtaataatacttaagcgccgcgttccatcccttggtatcgccgccgttttcgtagtatagctggaaccacctgtcgcggtctgcctgcgtcgcctgccccgccgccgtcatgtccacgcccgttatgacgtccgtgccgccctcaaacggattataaagccccatattattgacgcggtcccgctcaaacatttccttgcccgcttctaccttcgcccggtcgatgggcgcggccgtcaggtcagccagcttcgccgcgtcagcgtcgtttaactgctggttatttgcgacctgccacttcacgtccgccgcgtcagcttgtttgctcagcgcctcgatttgtttatcgattttcgcgccttccgcaaacgtggcgctccatttgtcccttttcaattccgctatctgcgcttcgtacccctctttttccgctttgtattcgtctgctgtttttggagcatacccaatactgcttatcagtgtctccttgttttcgcccagcgtatccctgatctcttcgatttccgccaatgtatcgttggcctccgtcaggtagccttcgtatttgatcctgtcttgccgtatgctttcgatatcttccgcgaagtccggatcatcgccgtactcctcgatcaagccgtcgatcatgctgatgttttcttccgcagcccttttttgctctgcccatccgctttcgatctgcgtaagttcctcgaaaccctgatcgatctcttctatacccgcctgtatatcctgtttggtattcgagttcgcaagtgcggcctcgcgctccgcctgaaggatcgactcctcgttttcgttatagttcgtaaatactgcccttgcatgcttgtaccccgtttcatccccgctccctaccaggtaattcaggtacgtttgctgatccgtcgaaaaatcattgcggtcgctcatatagcttttgtagcttccctgctgtaccgtgttccaaaatgcttcgtcctgcgcaattcccgcgtaatccgccatcagcttgtcagtattttctttcgtaaacttgtcgcgcgtctttttcatcgcttcttccgacatcgttggatcgttccatttgttcccgtacaccgattccgcatagttcgggtcgacctccggcgtcactttcaccgtctggtttatctggttcacgggtggttgcgttttgggctgtaccggttccggcgacaccgtcccgcccgtctgctttgcgggcggcgcgcttttgggcggcgtatcgtttttctttccgtccatggcttttccggccgcattgaccatgcccatgatcgtctttgccggattggacaagaagttccacgcgagcgcgcctccgtcattctgtttatcctttggttcctcctgctctgctttcggcggcgcactcggcggagcggtaatcgccgccgccggttccagttttatgccggtcgttccgaggtgggaaatcggcgcaagcatgtccaggatgttcttttcctcgaccggcttcggcgtttgctccgccgtattgttgctgttccctttattgccgttaccgcctttattcccgccgccgtttttattaccgttgccgctcttgttgctgctccccgacgagctcgtgttggcaggcgcgggcgtgctgctgacgggcagcatcatatagtaattgttctttccctttttcttgtctgatccattgtttttggccatcctgtgccgccccctttactgcgcgccgcccgccgcctgttcataggccagcaggatcctctccttatcctcgtccggtatgtccatcgcctcgatcacgtcgtagacctcctcgttgccgatacccatagaaagaagctccccaacgattccctgtatctcttcgtcggtcagggttccgtccgccatcgcctcgtcaagcatctccggcggcatatccatttcctgcatgtccgcgcccattgccgcagaaccgatttctccgcccatatccggcataagcgcccctgtatccgttcccgccatatcgggcattccgctgtccatcatagccgccatatcgggcgtaccgcctgccggagcctgcgcgccctgtatcaggccttgctgctccttgatcttttcaacgatcttgttcttgttcttgacgtacccctccggcatcgcttcaagatatgtcagcgcgtctgggatgatcttgttctgcatcatgctgtccagcgtctgtatctgcatcagttccgaccagtacgcgcccgcgccgatgtcgatcttaaggttcaacgaataacggcccagcagcgaaaaatcaaactcgccaacgacccgttccccgtttgcatcgtccaccgcgacctgccgcacgccgtagttgacgcgcatgatctcaatgaagatgcgcacgcattcttccacgaagttgtaaaaatccttcttctggatatcgagcggcattcccgacgctttttgcagcgcgatgatcgcggacgtgttatccggcttgacgttcccaagcgccgcatccgacccgcccatcaattccttcgtctgcttgatggtcaggtttgccatgttcatcacgtcgtcgctcatgtcggccgcgcggaaattcgcaaagatcgcgtcgttcgggtttccggcgacagccaccgccgcgccgaccttgttgttccacgcgggtatcttcgtgcggtcgtacatcaccttcggaaacgcgttattgagaacattctgcatcgccatcgcgtagatcttgttgacgaatatctggttttgtatcttgcccgtgacaggcgatacgccgtgatagcagtttttcacgctttcccagttcatccacgcaagcgggtacagcttatatcccgtgtccgcctcgcgcttcacgagggcgttgcgcgcgctcttgatgatgtgcactttgcccttttccttccacattttgagcacgaccgtcgtgtaatcgttgtcgtggtctttatcgctgttcatgtagtggctttcgttgtccggcgtgatctcgtcagggttcagcccgttttgccgcgcttcgtccttcacttcctctgtcaggcggcggtaagcgatcatgatatacggctgctcctgcacctgctcgtccgacgggttgccaaacaatacgttggtgttgtccacaaggtcgatcttgatctctcccttatagtcaaagcccgtttccgcgtcaggatcgaaccagatataaaaacagccgtcgccgtccacggcgcagttcttgatcatcttacggtttttgaatttcatgttcgtgcgctcgatgacgttgtcgatctcctgcgcgaggatcttgggcatcatctcgtttaggctcatttcctgcgtttccgctgccggctccgcgccgcccggcagtccgggcaataccggcgttgctgcgacaggcgcgccctgctcttcacccatcgcgtcctgctttgtcatcttgatcgtcgttttgccgcgcccgtatttttcgagcgcgtcggtgccgcctgcaagctcgatgttcgccgcgatatcgtcgctgatcatcatcgcgatataataagaaacaacaggctttaaaaagttaaataccggcttatcgaggtcgggcgcgtttacgccttcccactgcttgtcgttgtaaaaattattgttgcgctccacgttttcgtaaagcccgatccctgttttataggaaataccgcgctggtactccgaccatatctcgtttgccttctttttgatcttcatagtttccatatccccctgtgcttagttttcaaattcttcttccgtctgcgccctgcccgtataactcaaaaggttattgagctgcgcgaccttgtcccgcctgcggttttcctgttcctcctcccgcggcattgcctgtgccgtctgcgctttgcgccatgtaaacggcttcctcacatacgcgcccaaaaggaacgccagcgccatccctgcgatcactcccaaaatttccattttccttctcctttttacgcataaaaaaagaagcgcgtgcgtgcgcttcccctgcatatatttttacgttatcatcataccacgcttcatcctgacatggcaggacgcccacctgacaagagcggacatggcccctaccgcccgaatcgggcgaacgcttctatttgcctgtcccaatccttcccgtgctttttgtcttttcgttcgggcacggcggcgatcggccgtccggcgataaaatagcggatcgcgtccggcgcatgcgtcaattcgtgcggctgcgtcgcgcaatcgttcgggttcttctcgtcatattgcagcgcgggcagcgtgcggatcaggttacggcaattgtcaaaaattttcaggtgcgccgtctgcctgccctgctcgtccccgtatggccgcagccattcatgcaggttataccatccctgcaccctgtcattacttgatttcacaagattgatcccgcattccgcaaatatctccgccgtgctcttgcccgtgtcgctatgcctgttccataggtcgggcggcgcataataggcgtaaacatcctcgcccgtcatttccgcgatccgcttcgccgcctccgtcaccacaagcccgctttcataaagctcgcggtatacgaaggcgttttcggcttcatcgaccgcgatccagtagcacgcgagcatgtcgaggccgtagtccatgctcacataccgccgccaatgtttcgggatcacaaacggtcgtgtgacgtgcacatcccgcttgaactccgcaaaatattgtccgtcgaacacgtcccaatcgccataaagcatcgccttcctgcgttcctccggcaggttttccagcgtgcgcacatattccggcgaatgctccatcaggaatttgttttcgtacacaagcgactggataaacgtataatcctccggccgctcgctcccctggtacagcctgtcgataaacagccgcttcacccacgtgtgccccacgccgcccgggttgcatgtaaaatacatgcgcggcttaaaaggcgttttgcacatccccgacgcgcggctcgattctgttaaggtctggaactggaactccgtgaactgcgtcgcctcttccataaagatcacgtcgtacgcctgcccctggtattgcagcacgtcgcgctcgttatcacaatatccaagtttcaagcggctgccgtttgggaacaaaaactccttggtcgtctccttatactgcgccacgtcctttagctgcttttgcaggaaattcacatggttttcccgcagctccggcagcgtccggcgcaagagcaatatttgtatccccgcataattcaatgcaagcaatattgcctttgtgcgcgccgcccagcttttcccgccgccgcgcgccccgccgtacgcaatgtagcgcgtctgcgcctcaaaaaattgtacctgcttgggatacggctgttctatcttcagaatcacttactccactcccttatttcgccgtccagttccacgcggatcgttgcgtcgcccgacaaatcgaccttgtccgtcaaaatcttgtggtgcttggcgaggtgctccgccgccttcgtgcggtcagaaaccctcactggctggcgcagcacgatctcttcgcccgtatcctcgtcgagcacgattttttcctcatagatctccccgcgcatcagctttgtcaggtattcgagcacatcctccgcctgcgcgatgttctttttgttcaccgcgtcgagcgcatgctgtatttcggcgcgtacttcctcgtttttcatggtattggatgcgctcctgtccgcatatttgggcgcgtatcccgcgcggatcgccgcctgcgtcgcgtttaggtcctttaaatactcgctgcaaaacctcttttgcctgtccgtcatattttttcctcctccgtttttttgcaaacaaaaggccgcccgttcgggcggcctatcattggttatgtattacttatttttcgctgtcctcttcgggatcgtcgaaacggtcaaacgataccgacaccccgttatcgaggaattctttttcatcatccgggtccgtaagcaccactgcttcttcgtctgcgaattcgcccggttctgttttatctgccattttgaaacgcctccttatttgctttgcttatactctcaatttaaaccctgccgcgccgtttcaaacggagttttactgcttctcactcatttcgcatgcggtatattatcttgtactatactttttgtagtatacttattccggataagcgagcaaataccatccctcttctatctcttctacaatattgtcatatccccgcaattccaattccctcttgcttgcctccgtatacattaaatctttcggcagatagaaaaacgacgaatgcagcacaggactcaaccctaaatcaaccgtcaaaaagccctcttcaatcgtaactcctgttatgccatatgtccgataaagtcgttccagctccggtaaaagtttttctgcatatacgctcctgtcttttgcactgtcccagaaaaagacataccactttccatgataacttatctccaatggctcaaacatgtagtcggtcttatgatcgttgacgctataattgcccaaaccactttcgcataactgacctgcgagattaaataaggtatccttttctttctcgactatcgtatgcgcccttgccaactcttgttcaggttgtgtcctcgcgcacgcaaacatacccacaaaaataagcacgatcacaataaggatgatgtaaaaaattttcatatccaaactaactgtccacttattttcattttccgaagtatttttcataatagtcgactccccttcggatcacatcctgattcttctgttcattcctctcctgttctttcaaacgttccaaatattcatctttcggcgtaaccttgatcgctagtatttcatgcctccaccatgctcaataacgtccaaataattcccaaaatcaggcaaatgatcataaatatcttttttctgccttgtttcctacttttcgtaagataataaatactgaggaccactacgatcgcccccatcatgacttctacaacgtacatccatgttctgtccaacagggatgaagacgaaaagaatctgcctacgcacatatgaaacagcggtgaaaaaacaagcagggccacacatacgggcttcaaaaattccatcctgtcctgtttgaaaaacttgctgcacaagcccacccacacgattgtcatgatgaccgcaatgatctctgcagaaaaactcatcactgttgccggataccatttgatgttaccgtaatcaaacacgtcaaaataattccagtccatgagcacccaaatagccacgattattgcatagatgatcgtccagatgaccatacactcttttgagatgtccctgcatcgttttttcatcttcgttctccattctgccgtttcgatttttcactgccatctcttgacatcgttcatccccatcgtctggtaatatttgtcgtaaagttcaccataatcgtctccacccattttcaatcgatccacatttgccgcgccatatccatcttttcgcgcgtgcccatgccctgtcgcaattacgcccaaagaataatttcccaattcttcggggctcaataccttatctcctacgcggaaatacccatatccttgctgcatcaaataattgacaccatttgcaccgccaactttcaatgcctcattcatgatctcttgtggaatttggtctccgcataaatcctggatggctttcgggttatcttttaggtaatatatccctttgtttccggccaatcccaacatctccgtctgccagaatgggttgtccaaactctccgcgaccatctgcccatatttgtccgtcacatcgataatttttgccggatcggcattttgtttaccaaattctgcttttagcagtagcaaagttccctcaagtaacaactcttgcttatcttgataactctctgggcattgttcttcgatcctttgccggagcgcatcccgatagtccccaatcacatttccctcattatccatttcaaagtgcatatcttttccaaaggatttttcgagattgtcaaatgagattcctgtccctgtatctccgatccccaaaatgttatacatctgttttagttccgtcggtgcttctgcaaaaccctgttttgcagctgtttccacatccgccatattcactgcatctttttcttcttgtttttgatgctctttatacgcttctattaagttaaggttgttcgttccggcggttcccgtatccatcacccccagttcttgtgccctcacctcgtccgctttctcctgtgtgatcggccccattcccaaatcaagggtactgctgcccgtatccccagcatggggctcttgtgtcctttgcaacggtaccgtaaccgatatctggtttgcctccggctggggctcacttccgctcatcgtcgccgacaacggctgcatgatatttcctaccgcctgcgggtcaattttcagcgtccccgctatcatgccgtccttcgcgaccttcggattgtccttacccatagtatacaccatattcatactgtttgcggtatctttatcactatcctcgccgctgctttcagccgcatttacctgtcccctcaattccgctacccgcgcttccaaaagcggcttgagtttttccgtctgctgccgcataaagtcatccttcaattccttttcaccttgtgcgcgagtaccctgtccatcagcgtttgcacgttcgtttggggtgtctgctgggccgccttcggccgtacctgatgtggacgcgtagtgacaggcattgtgttgccagacgtatgcgagtttacatcgcgcagcgaggttgggtgtttgagcaagtaggatggcaacatatgcctgtcacggccttcttcctgcaccaagccgtcgttgcgctgcttccattgcggcgcgggttgccgcattttcgtcatgaaattccccagcaccgatgcaggattcgccacgtcctttttcggcattggctcccgccacttgttgccgtacaccgcctgagcataggtctgcgcttcctcctgccttttgcgctcctgctcctgctgtcgtttcctctccgcttgcctctgcatgttactgtaaagatcgttgttccaattcgtccccattttccttttctccctttccggtcattgatttgtagtctgccgtcgtgccctccggcgtatgcgttgcctcgctcccgccttgctcattacgttgcccgggcaaatagacggatggcacatggcggatatgctgtatgaagccataaaaaaaagaaacgcccctttgcgcttctttcctgtacctatttttctacagtaccatcataccacatcccttacggactttgcaggacacccacctgacaaggtgaatcggcgcgtagcggcgagatcgcggagcataccgagcgaagcgagtgtagaaggccccctggggggcatttcaggacacgtccgcgtttacgatcttcctcaatgccgacaaacgtatcctgcttagctgccgttcgcaatagccgatatccgccgccgcttccatgtgcgataccctgtcgaaataccgcagcttcacataccgccgttcatatcccgaaagccccgccgcgttcaaacgccttttcatgccctcgtactccgtatagatcacctgtaaccgctccaagatatctttgatctgcctatcgtaaacgtccaccagcttttccaccacatcatacaccggatccgccgatacgcccccctgcacccgcacgccgtccgtcatcggcgcgcgccgcatgctgtccacgatctcgatttttttcgccgccagttccctgacctcttcttccatctcccgcgcctgctccatcaggtctgcatacctgtataattcccgttcaattttctgcatttttttgcccctttaccaatttgttacgattgttaacaatttcttcattaatttaacactgtttattcacataagtcttttatagtagaatcataaacaaaataaattttttctttttcattttcttccttatatgaagcgcctcccagccaggggcgcttctttggttcaccaccaaacgcgcgcgctgaatttgtcaaattccccatgccccgctaccgcaagatcgataatatttcccttgatcgcgccgcccgtatcctctgcaacgcgccatcccacaccgtcgatgtagacgtgcgttccaagcgggatcaccgaaggatcgaccgcgatcgtgcgccccggcgttatctctgtgccggtcgccgtgccgctgaacccgctgttgcacaccgcacacgggcagtaggtcgtgaccgtaaaaacgccgccttccgtggcattcaccttgtcccccaggggaccctccgcgccagcgcgccccctctcgccttgcggcgattcaccttgtctgcctacggcattcaccttgtcccccaggggaccaacgccgtccttcgcctcgtaccctgtaaatcctccccacagccagcgcagcccgttttccgtgttgcaaagcacatattccgtcatgccgacgtagcccccggtctgtaccgcgcggatcacgtatagcgtgtctcccgccttgacttcttctaacgtctctcccatcggctgccccgcaaaagcgcagtctgtcgtcgccacgcgcagctccgttacttcctgtgtatccagcgtttcggcccgcgccgcagcagcgcccagcgtgagcgccatcgccgccgcgcaaatacaaaatatctttttcatactttctccattttcgtgtttaacgtaccccaaagcggttattttataggcagaaccccacatcccaggatgcgggatatcatatatgggaggtagagccaatgttctaccaactctgacccctggccgatgaaaaaccggtcgggggtcattcgcttttcccgtacagcttttcaagctcggcaaagctgtcctgtttacgccgctctttttgctcttcactgtactccctctgcgcaaacgcgcgcttatcttcttttttcacagtctccatgcgccgttcccacgtcctgacggacgctttccagtcgcgcatttgctggctgcccaccatccaccccttggactggtagaaatcatagaactgccgtgcgtccaccctgtttttacgttccgtgcaatattcccgcacctgcgcaagcgaaggccttgccggggaacctttctcttctgtttctttcttttcttctatcttcttattaggcggtagcgtttccttaccgctacggtagccgtccggcagcgggatcttcgaagctgtgggtttgttgatcgtctggaagcttttccagctttccagcacgtaatattccttttcgtcatgcgtgtataaggtgacggacatacgagaggctatctcttcaagcgtcttttccatgtcggccgcccttagtttttcgtcataaggaaacaagatggattttaaatacaatgcgttcgcccgcccgcgcccttcgtcgtccgcgttggaaaacaggccgatgaacaccagctttcccagcgtggagagcttcgcgaaatcctcgctttgccagatccccgggtcgatcattcgttttcgcgccattacatacttgatctcctttcaatcgcttttgacggcgggcgcaccgccctggcttggcgccggtaaaacgcgcttttgcatgtgtcggagccgcgccgccggatacagcgcctccgcgccttcttcctccctttgccgccacatcgtgttgttgccgctgcccaccgcccgcgcgatgtagggcgcgtccggtatctcgcagctcatgcctcgtccctcccatattctttgtccgtcacgaccttcacttccacgctttcaagcccataatcgtgcgtcagttccttcagttcgtccatcaagcgcctgatttcggtataccgcctgaaaaagccgaaccgtccgtttataaaatacagcgtccctatcatctttccttcctcttttccttgacattaagaggaaaatattctattattgaagcaagcattgaactggaaattcgctggttgcgccaacaattcagcgaagtcgttcaaataatggcatattttcctcttaatgctcattataatggtaaatattccttttgtcaatctttatttttggaaaatttgccatctagtaaggtgagccgcaaaaatgaaacttacggaacgcatccgtgaactgtgcatacaaaaaaacaccaactttgccgcccttgagcgcgaattgggttttgggcagggaacagtacgcaagtgggacgcaagctccccgtccggcgataagctggataaggtagccgattattttgacgtgtcggtagattaccttttggggcgcatcgacgtgccgtatcccgtcgaccaaatgacggtgggcctttcctctccggtcgggtattccgagcttaatgaggacgagcgcgccgagatcgacgagatcgtcgccatctacgccaaacgcaaatataagcgcgagcatggcaaggaataaaaaagcccgcttccgcgcaaggtcttttgtgcttttggatacaaaaaaaggacagggctttggcccggtccttttttcttggacgcatatactttttctatagtttttcgatcgtcacaagcggcgcaagcgcgtcaaaatcttccttcctgtagcttcccgtgctcatgctcagggtatttgccgttgccgccgcacacgcaaggcgcatggtcttacgtatatcatacccccgcgcgatccccacggcgaacccgcccatcatgctgtcaccgctgcccaccgtgttgacgacctgcacgcgcggcggaaccacatggaacgttccctcggcgcaggtgatgaggacgccgtccttccccagagaaattgccgcaatctgtacgccgtttttatgcatttcccgcgttgcctgtgcaagcgcctccgtgctctttgtgtccacatccatcaaccctgtgatctcatccgtgttcggcttcatcatcgttggcttcgcagcgtatgccgcctgcatttgcgcacccgccgtatcgaccagcacaggctttcccgcctgtgcggcagccttaaccagctttgcgcaaaagccgtccggaacgccctgcggaaaactgcccgagatacacaccacgtcgctgtcttccaccacgcccttgtaatcctccaaaaacagctcaatatcttccttgcgcaccgcaaaacccggttccaggtattccgtactgtcgttttgctcgaggtcccatatgttgatgcagcagcgcgtttccccacgcaccctggtaaaacgcttttcgattgcttcttccgtgatcagcgattcgaaatacattccattgtaaccgcccagcagtccggcagcgatcgcccgttcccctgcgagcgcggcgatcctcgcgacgttcagccccttgccgcccgccgtgttgatcacctgctttacgcgcgacacccggtgcgggtccagcctgtccaccacatacagcttatcgattgccgcattgagcgttactgtccctatgaccattcccgttcccccttgtcgtcaatcattgaccagtaaaatcttcccgtgtacgcgttccggcgttttgaacagctcaaacgcctgcgccgcatccttcaggggaaattttttgtcgatgaatttttccgtgatacgcagttcctgtgtagcgaaataatgcgcggtaagctcccattccctgccggggaacggcatggaatagccctgccagcagccccgtatccatagttccttgcgattgatatgctcccactgttctttggtaaacgttacgctcccgggcggcgtgccgatcaatgaaacgcgtgcctttgcccccgcaagctgcaaggccatgacaagcgtcgggttcgcgcccaccacctcgaatacgtccgcatagccccgcccgtccgtaagcgccgtcgcttcctcaaaccagctttcctttgccgtattgaccacggcgtccgcgcccatctctttagcaagcgcaagacgcctgtcgtcaaggtcaaacaccactgttttgcggctgccgaatatcttcgtccactgcatggccaggttcccgatggttcccgcgccgactacagcggcatagcccccgccctcaaacccgacgttctgcacgccgtgcagcgcgaccgtcgcaggttcgaaaaacgcggcagcctcaaacggcacgctctttgaaaagcgcaccacgttgcgcgccggaaccacgacatattccgcaaaactgccctgttcgcgcgatccgatgaaactgtcgtgtttgcattgcgcaatatttcccgcaaggcagtcctcacacgcaaggcagggaatgcgcggcgcggcggtcaccctgtcgcctaccgcaatacctgcgaccccttcgcccacctccgctacctcgcctgaaaattcgtgccccagcacgaccggatagctgtgcgcgccgtgagcgaacacacgcggcacgtcgctcccgcatatcccgcttgcgcgtacgcgtattttaaccgttccctgccgtgtttccggcattttaatatccgtatagcggatatcttcattgccaaacaatactgctgctttcatgcgtcatctcctcatcatatccttcagattttcatataattgcaaataggtatcataggctgcgtcgtagaccgccttgtccctgtcgcttgcggtatgccgcctgcggatggtgagcgtctttttacgcgcctgcctgaaatccccgtatacgcccacgcctacgcccgcaaggatcgccgcgcccagcgtcgtcgcttcgtcggcatacggcacgacgatatcttttcctgtgatatccgccttcatctgcgtccagaactccgaattcgcgctgccgcccatcgcgttgagcacagcaaccttagcccccgcggcatatgccacctcaagattgtggcggacggaaaacaccgccccttccagcgccgcgcggataaaatgcgcccttttcttgcggtagtcgatgccgtagtagaccccttttgcgtgcgggtcccaaataggcgagcgctctcccgccatatacggcaggaatacaagcccgtcgctgcccgctggtaccgtggatgcaagctgcgtcaacaggtcaaaactgttttgccccgtgcgcgcggccacctcgcgttcgtgctcgccaaactgttcatgcagccagcgcatcacacccccgcctccgaccgtgccgccctgcaaaaggtatttatccggcgccacatgcgtgctcaatatcagccgcgggtccgcgacatattcgtccatacagatactcatgccgcccgcctgtccgccctggtcctgcgtttccccttcgtccagcacgcccgctccgagcgatccgcaggccgcgtccaggccgcccgccacaacgggcgtaccttccaaaagccctgtgcgccgcgcggcctctttcgtcacacgccccaccaccgtgtggcagggaacaggctccggaaacatgccgggccgcagtccaagctccgcgcacagcgcgccgtcataccgcttttgcctcatatcaaaaaaatgcagcccatagctctggcaaacgtcctgcgaaaaagcgcccgtcagacggtaagcgataaagctgttcgactgcaatatcttatctgtcttttggtaaacctccggcaggtgctttttgtaccacatcaccttcggcgaggtgtaagacggtgaattgggattcccgcacacacggaatatggcctcgtcgccgatcgtccgcctgatctccccgcaaatatcctgcgcgcgtacatcaaaccaaatcggcgtattgcaaagaacgcttccttccctgtcaagaggaatggccgaccatccctgcccgtcgatgcccacgccggcgatacccgccggatcgatcttccctttttcgaggacatttttggtcgctgcgcaaagcgccgcgtaccagtcgtccggattttgctccgcccagccttcgtgcggataatatacctcatatccttgggtatcgctgcacaacaccttgccgtcttccgaaaaaacagccaccttgcatcccgacgtgccgatatccataccaagcaaatacttccccatgccttctcctttttcgccggtcaggcctttccgtccgcgccgcatacaaggatgcgctccgccgcttttttcttcacgcttgcgcgcgccgcagagccatattccttcgggtcgtacagggacgggttgtttgaaaacgcctcttccacaccttccgtatacgcgacccgcagctccgttgcaaaattcaccttgcagatgccccgcaaaacgcattcccgcacatccctgtccgaaaggccggacgcgccgtgcagtacgagcggcgcatcgaccgccgcgcggatacgcgttagcctgtccgtatccagtacgggcgttccggcgtaaaagccatgcgccgtaccgatcgcgaccgcgagggaaaacgcccccgtgcgctccgcaaattcctttgcttcttccggctccgtatagcccgcatcctttacttcgaggtcgtcctctttgccgccgacctttccaagctccgcttccacgcacacgcccttcggtgtgcacagctccaccacgcgtttggtaagcgcgatattctcttcaaagggcagcgccgacccgtcgatcatgatagacgagtaccccgcctctacgcattccctcgccagttcaaacgaattcccgtggtccaggtgcagcgcgacgggtatctccgcctgctgcgccagcgcgtgcaccatcccgtaataaagggcggcgtccgcatatttggtcatggaaggcgtcgtctggatgatcacgggcgcgcgcaattcctccgccgccgcgatcaccgcctgcaccgcttccatattttccgtgttgaacgcgccgatcgcgtaaccgcccttttgcgcgtctaaaagcatcctttcggtcgtaacgtatgccatcttaatccccctgtttatttgccatccggtcaaagacaggacgcaacgcgtcataacacatgtcgaaaatcttccgcgaccttgcgtaatccttcctggtatccatatcctgcctttgctcgcagtccatttcgataaaatcgtcgatcacgccaaagtccttgaaaacgcctacccccacgccgcctgtgaccgccgcgcccatcgatgtcgcctcctcgagcagcttcggcgccctgaccgtcacgccgtaaatatccgccatcatctgccgccagcaacgccctttcgcgcccccgccgatgaccagcaactccttgatgtccaccttttgccgcaggatatcgaggatgatgcccaggttcatcgtgaccccctcgagcaccgaacgcaaaatatccgcgcgcgtcgtctgcatgcccaggcccacaaagcttccctttgcgttggggttccagcgcggcgcgcgttctcccaataaatagggaagatatactacgccgtttgccccgggcgggctttgctcgatctgttcgttgatcagctcatacgggcttatgcccatcgccttcgccttttccatctcgtctgtgcacagcgtatttttgagccagttgtaagaaccgcccgccgtctgcatggtgccgtttggcgtatacagtccggggacgatgtgcgcccatgtaatcgtgcgcatctgttcgtcaaaaagcggttccccggtggtggttgccacccacgcggaagacccgacatagctgaaagaccttccttctttatacgaacccgcgccgatattggcgcatacgccgtcgccgccgcctaaaaccacgggcgttcccggcagcagccccacgctgtgcgccgcttccttcgtcacgccgccggcaataaaggtggaaggccggatgtccggcagcttatccgcgccgatacccgcgatatccagtatccgctccgaccactgcatattcatcaaatccatgcagttgttgcccgtcgcgtccgtcggttcggtataaaacttccctgtcaggcgcgctacgataaagtctttggcgttcagcgttttatatgtattttcaaaaacctccggctcgttatccctgatccacatcagtttttggattccgtacgacgccgtgttcctgtgtccggtaatatggtaaaaatcgcgcatcggcagcttctcttcgattgccgccgcctgtttctgcgcccgctggtcagcccagatgatcgaacgccggagcggatttccttccttatccacgcataggcagcccatcatttgtccgctgaaactgatcgccgcgatctcctttttatccacacccaattccctgatgatctgcttgctggaatcgcataccgcccgccaccagtcctccgcgtcctgctcgacgcacaagccgtcaaaataatacgtggggtattcgtatacacagcttccggccagctttccctcgcttgaaaacaaggtcgctttatttccggatgttcccaggtcatgtgctaaaatatactgtttcatttcttcttccttcgattgttcctgttattttgctgtccatgccgccgtttcagggcgcacaaaagactttccgcgacggatcccgctttcattacattgggcccaccagccccgctttggccggtgaacccaacgtatggtggtagttatatcgttttcggcctattttttgtccggctcgaacgctttcctcaaaaaggaaacggattctgccgccataaggtcaagctcgcggggcgtagcgccctcggaaatatcccgccaaaccttgatatcgctgccgacctgcccgcccatcaggatgaacggctccatgactacgtttccatcaaacccgatatcgcgcagcgcctgcccgatctccttccacggcatccgcccctcgcgcggcggtttcctgttcgcctcgcccacatgcaaatggttcaaatatttgcccgcgcagcgaatcgcggatacaaagctgtcctcctcgatgttcatatggaaagtatccagcataatgcccacattgtcgcggccgacctcgcggacgaagtcgagcgcctcgcgcgcgctggtcaggatgtaagtctcaaaacggttgaggacttccatccccagcgatatcccgtattccgccgccaactcccccagccattgcatgccctttaccgcgcacgcgcggtcggcctgcttatcaaacggccgggaataatcgacgggccagtaggaatacagcgcgccgcccaaaaagccgatgcccgcccgcttcatttttgggaacagcctgcggtaatattcctgccccgccccaaatgtttttgggttggaaaggttgatctccgcagacgggcccaggcccgccgtcagcgtgataccgtttttttgcgcggcgtccttcaggcgcagcgcataatcgtccgccgcatccgcaaggcctgccgccgctacctcgaggatgtcaaacccaagttttttgaccttatccacgtaagggataaagtccccgccccagcttttttcccagtaggcgtagtatatcccgtatttcataagcgttcctttcctactccatctcaaggacgatcttgatgctgccgtcgagctggttatacatcatattcatgcccttttcggcatcctcgagtttgagcctgtgcgtcaccagcttgtttacgtccacaagccccgcctcgacaaggcggatcgctttttcgtacaggttgtcatagcgcatgacgctggtgattgtaatttctttgttaatgatatccgcggcgttaaacgaatatacctgcttcgtccccaggccgaccagcgtgatcatgccccccttgcgtacgcagtccgccatcacgtcgtacgcctgctgtgcgcccgagcattccaggaacacgtctgcgcccatgccgcctgtttcgctgaggacggcttccacgacgtcttcttccgacgaattgacgatgacgtcggcgcccatttcccgcgccgcttccagccggtactgcgtgcgttccaccacgataaccttgcatgcgccgtatgcctttgccgccagcatgcacataagcccgatggggcccgcgctgaagataaccacggtgtccgccgccttcagacggctgtttttaagcgcctggagcgcgacgttcagcggctcgatcatcgcgccttccgcaaaggacatgctgtccggcagcaaaaacgtactgtacgcaggccagcttatatactcgcgcatcgccccgttcgtcaccgggtcggggtgcgccataaagatcattttgtcgcacaggttgtatttgccttccctgcaatatttgcacttgccgcacgcgtaaccgggttcgatggcgaccctgtcgcccaccttgcggtcggtcacgttgctgccgacctcgcataccacgcccgccgcctcatgtcctaatatgaagcctttgggcgtttcatattttcccagcctgccgtccatcgcgtaatgtacgtccgacccgcagatgcccaccgcttcaaccttgataagtatgtcgtcgccgccaacctgcggcatgggaacgtcgacgatatccattttccctttttgcgcataagctgcgcccttgcatgttttctgatccataatataaccccctataccgtcttttccgccttgtccgtcgccacctgcaagagtaccgccgctacgatgatgatgcccttgatgatgtcctgcggatacgaaggtacggccagaaggttcatgatgtttccgatgagcgccaataccagcgcgccgatcgccgccttgacgacgaatcccttgccgcctgcaagactcgccccgccgataacgcatgccgcgatcgcgtcaagctcctgccccgtgcctgctgtcgcggaccccgtcgaggccctggccgcgatgaatacgccgccaagtacgctcaaaagacctgaaagcgtataaacggacgcgatgtgccgttttacgttgatgcccgccagctcgacagccgtcttgttgctgccgatggcgataacaatgcgcccgtagaccgtatatttttgtatgtaccagaacaatacgaccaatacccagcagatgatgatgatcggaaacaggaactgcgcgctcgcaagcacgtcgagcgtacccgtttccagcttgatgggcgtgccgttggtaacgataaacgcgataccccttgccatcgtcatcatggcaagggacgccacgaagccctgcatgttgccgtaagcaacaaggatgcctgtgatgagccccagccctaagccgacgaccagcgaaatggagatcgcccccatcatgggaaagcccatatcccgcatcagcaccgccgtgatcgacgagcctaccgccatgatcgaacctaccgaaaggtcgatgccccctgtcaggatgacgaacagcatgcccaccgccacgatgataggcgccgactgctgcaacaggatgttcctgatgttcatctcggttaagaagttcggcgacaagaccgaacaaacgacgatcaatacgataaaaataagataggtattgttcttgatcaatccttgctttattttacttcctgttaatttttctgttttctccgccattgcactcaagcccccattgccaatttaattaggttgttctctgtcagttcttccctggagacctcgccgaccacgcgtcccaggcgcagtacgagcgccctgtcgcacatgccgatgatctccggcatctccgaggaaaccataatcaccgccacgccgctttccgccagctcgttgatgattttgtaaatttcaatttttgcgcctacgtccacgccgcgcgtcggttcgtccagaatgatgcatttactgtccgccgcaagccattttgcaagcgccaccttctgctggttgccacctgacaggctgtttacgttgtccgtgatcttgccgtatttcgtagcgagcgtaccaagcagctcctccaccgacttcttctctttgggataattgatgatgccgatcgcgttcttgaccttttttaaggatgccagcgtcgtattgatctcgatggattgctctaaaatgagcccctgctttttcctgtcctcgggcagcatgcccacgcctttttcaatggcgaatttcggatgcttgaagtttacctcctcgccgaacaaaaatacgctgccgctctcctttttgtcgataccgaagacgacgcgcatcgcttccgtcctgcccgcgcccacaaggccgcacagtcccagaacctcgcccgcgcgtacctcaaggctgacgtcctgcaccacaggcgggctttttaagtttttcacggataaaacgacgtcgccgatcttcgcattccgcttgggaaacaactgcgtcaaatcgcgcccgaccatcttcgtgatgagctgcgatttatcgatgtccgccgtcgctacctggtcgacaaagccgccgtcctttaatacggtgatgctgtcgcacagctcgaacacctcttccaggcggtgggaaatataaataacgcttacgccttcgtcccgcagcctgcgtacgatgctgaacaatttttcgatttccgtaaacgtgagcaccgccgtcggttcgtccagtaccaatatctgcgcgttgcgtgtcaggcacttgcatatttccacgacctgctggtatgcgacggggagcgcgcctacctgcgtggaagggtcgatatcgtcaaagccgagcctgctcagctgttcttttgcatttttcctcaggctgcgccagttgatcactttcctgccttctgtcagcctgtcaataaaaatgttttccgcaaccgtcaagtcgggcgccagcataaattcctggtaaatgaccgcgatccccatatcgatcgccgcctttggattgcggatcgttacttcctcgccattgaggaatatctttccggcgtctttttggtatgcccctgaaaggatcttcatcagggtggatttccccgcgccgttctcaccgacaagcgcatggatctccccgggctttattttgagcgtaacgtctgtcagggcctttacgccgccaaaatgcttggagatgttctgcatttcaagcttaagtccattttgcatcgatatatgcctccaattcgtagaaattaccgggcttttctttcgaaaagcccggcaaccgccatttttttagaaaatagaatccggatcatagaactcgtctacgtttttcgccgtgactgcgttcgggtcagtggtgataatcttgtcatagctgtgcatcttgtcataatcaaagtttgccgcaacgacttcgtcaataatatcgtatgcttttgtcatgaccttaacagggttattctcgcctgtgccgaagtatgtgccttccttgatcagcgcatacgcttctttcgcgccgtccgcggccgctacgatgtcaacgcccgtgatgcctgcgttttgcagagccgtcatcgcgccgaacaacatctggtcgttttcgcccagtacgcagttgaggctcgggtttgccgtgatcaggtcttcggaagccgtaaggccttcttcaaccgtccatgcgccccagccctggccggagatcgcgaagcccgcgtccttgttttccgctttgcccgtggaggtcagctggttttcgatgtcctctgccagcttccaggcttcctcttccgttatgccaagcttgccttcgatgatgccgcagaagaggccggtccttctttctttgcctgcaacgttgcctttcgcgccggaaagcaggatcgcgttgatgtccgtgtctttcattttttccgcatatgcgaggcctaccgccctgccgttctgcgggttgttggagtatactgtgcagatatcgttcgccggctgtccgcacgcgctgtctacgttgatcacgcctacgcctgccgcgtcagccttgtcgatgctcggaatgcacgactccggatctacgctgttcaggaaaatgattttacagccctgggaaacgagcgcgtccatgttctgcgcttctttttccgtgtctccgttcgcgtcgagcagtaccgcttcccagccccgttcagccgcaagctccttgaacgtttccgccaaagccacaaagtaaggggaatcctgcgtcttcaacgcaaatcctactttgatcttttctccggaagccgcattgtctgccgctgcagccgactcggacgcggcggcgggagactcggaacccgtcgtagccggctgcgcgcaaccaaaagccatcagagccaccagtaccagtgcgattaccaagtacaatttcttcattcttttttcctccaatgaatattttttacattaacacaatcactgtgctaaagcttaagaatcaaaatctacgaccaccttcataactttgtccttctgcgcgtcgatatattgatacgcctccagaaattcgctgctggggaaatgcttggagatgatgaggtccgtatgtattttcccctgccttaaaatgtcgatcgcaacgtcccagtcttcgtttttatacatcaatgtcccgacgatattcagctcgcggtcttggataacgcccaagtccatctgcggcttttcttcaaatacggcaacgacgacgatcgtgctccccttgcgcgcgttttccaccgccgctgtgatggtcgggggcacgcccgcgcagtcaaagatataatccgctttgtcgctcccgtaatatttttccaccgcgtccttgagcgtcatttccccggaattcacacaatggtctatcccgcatttttccgcgatcccaagccggtaatcgctcacgtccgtcatcaggacttccttcgcccccagcgcttttgccacctgccctacaaggtttccgatggggcccgcgcccaaaacaacgatcttcttgcccgcaacatcccctacgcgccgtaccgcatgtaccgcgaccgcgatcggctcgatgagcgcaacatcctccgacttgatgccatccgtctttaagaccttgtccgccggaaccacaaagtagtcgcccgcaacgccgtccgtctggaagccaaggaccttgagcgtgtcgcatatatggtaattcccatgcctgcacggatagcaccgtccgcatgtcacctgcgggatcaccgtgatgatgtcccccgccttaagcccgcttaccgcgctgccggcctcgacgacctcccccgcgatctcgtgcccctgcacgatcgggtacgaagtgaacgggtgtttcccatgataaacatggatgtcggaaccacatatcccgattttcagcgttttaacaagcacctggtcgtcggaatactttgggacctccacctcgcggtattcaattttccctggctcggtcattacgatctgtttcattttttccctcctggattgatagtgattcatttttcaaagcactaaaagttatatgccgccggtttggatcgccggcttaaaataaggtatttaaaataatgcataggatcgctcactggctgccattgccgtctatggatcttatgctttttgccgcacggaacgcacgtttattttctttcggttatttttcgtattcgattttatattagcgattatttttgttttaatttttgtcagtttatcattttatcatttgcttgtcaatactgtgtttgcaaatcaatcgtgaaaaaccgttgattttatactggattttcctttgttttaaagctattttccgctttttcccatagattgaaataattttccaggcgtgcttccgtccgcggctttttcgcgtttccgcgtcaggccggacggtttcccgtccatttcgcgtatttttatttttatttttcgcctgcacattatatatcatttatttttgatgcactgtttatcttgtttaatgctccttaaaaggcaaaaactatttatcataatatatgcttattcgtctttttatttgttgtttgttattttttattttcgtttatgggtcaaaaacgctaataaagtgttgacattagaaaatgtttagcatataatttcgaaaaaaggcagcagcgatcgatcatttttatttttacaatcacaggcaactttaaaatatgtttttactggttttggatttccataaaatattcttttaagaaatggggtattgaacatgaaaaaagacattttcagtttaaaaggcaaaacagcgctcgtgacaggcggcaggcaagggatcggtaaagtcgtggccggataccttgcggatgccggtgcaaatatcgcgatctgcgatatcaaggacgcttccgctgccgcagacgagatcgcaaaagagtatggcgtgaaaaccgcttcctatacgtgcgacgtcacaaaaccggagcaagtgcgcgatatgatcgcgcaagcggccgcagacatgggcgcgctcgatatcctctttaacaacgcgggcgtttgtctgcacaaagaagccgtcacgctggagccggaggaatggctgcgcgtgatcgacgtaaacctgaacggcgtgtttttcgtcgcaaatgagttcgcgaaatacctgatcgcaaacaagcggcaaggctctatcatcaatacagcctccatgtccggcagcgtcgttaactacccgcagcgccaggcttcgtacaattcctcgaaggccggcgttatccacctcacgaaatctctggctgtcgaatgggcggattacgggatccgcgtgaattgtatcagcccgggttatatgtggacggaaatgtgctcctttgtacgcgaggattggcggaacatctggacggatctcacgcctttcaaacgcatgggcaagccggaagagcttgccggcgcagtgatctacctcgcttccgacgcctcgaccttcacgtccggcagcgatattatcatcgacggctgctatactgccgtttgacacacccttctgttttttaaaagccggcccaagggataattcccacgggccggcttcattcgatgcggcccaaggccgcacccgcgccgttccggcgccccctgcgggttatatacgcaaccacaatacgataataaacgataatatataatataaaacaaaaataaatgcttgcaaatatcacatcactattatattatatacttacgtacagcagaatcaaacaaacaacacattttaagtaaaaaggtgaattccatatgtcttctatcatacggacagttaccggggatatcccctctgagcagcttggctggtttcaaacacatgagcacttgtttctggaaaaaggcaaatcctttgaggtcgatccctctttgtgcatggatagcttttccctctctttacaagagatcttacagtaccaccgtgcgggcggctgcgcgtttgcagacgcgcagcctgtcggcgcaggacgtatggcggaatgcctgaaacgcgcttccaaagaatccggcgtacatatcgtcggcgtcaccggcttccataagcagtgcttttatccggaggacagcttcttattcagcagcactgaaaacgccctcgccgacctttttgaaacagaggtcacagacggtatgttttcctccgacttttccggccgcatgcgcacagacgcgcgcgcggggcttatcaaggtcgccgtggaagcgggcggcgtccatatgaacgccgcttacgaaaaatcattttcggcagcggcgcacgcggcgaaaaaaacaggcgccgccgtaatcgcgcatttcgataaaggcgcggacgcgcttaagctggtctcctatctccaggaacgcgggatctgcccgcaccgccttatcgcctgccatctggaccgtgcgcgttatgacgcctcctaccacaaggaagtcgccgcggcgggcgtatggctggaatacgatacggtaaacaggttaaaataccacgataacaggcaggaactcgacctgatcgaagaaatggtcgacgcaggttacgcagaccgcctgcttctctcgctggatacgacaaacaaaagattaagaagctacggggcggacatgggccttgattatatcctcaaagatttttctgtgcttttgcgggaacgcggactggggggctacatacagcagatgatggtaagcaatcccgcagaggcagttgaaataacaatataagattaggagaggcggtaacatgagtaacgaaattgtagtatttaaggcggacaaaaacggctttgacgcgacgcccgccacacagccaacgatgtatttcatcggtgtgacgacaggcagatcttccattatgaaggttttccccgaatgggaaaaagccctttcactcggcggcgcggtcatgaaagggatcgacatcgcgatccacgaagacccttccgtatatcgggaagtggtttcctttctcaagaacgacccgctttccatgggcgcgctcgtcacgacgcacaagctggacctttataaggcggcgcacgacctgtttgagtttttggatccgtatgcgcagatgttcggcgaattgtcgtccatctccaagcgcggcggcaagctgtgcggacacgcgaaggacccgatcacgtgcggccttgccctcgaacacttcgtacccgcaaattactggaaagaccacccgcaggcggaggttttcatcatgggcgcgggcggcagcgcaatctccatgtgctcttacttcttaagggacgaatttgcgggcaactatccgtgcaaaatcgtagtcgccaaccggagcaagccgcgccttgacgaacttgcgcacatcaacgaaacactgctcaacacaaaggggcagacggtatgcgaatactacctcacgcccgaaccgggccagaacgacgacgtcctgcataaaatgagcgaaggctcgcttatcatcaacgcgacgggccttgggaaagaccgtccgggcagcccgctcacagacgacgccgtatttccggaaaaggcgcttgtctgggagatcaactaccgcggcgacctgcgctttctgcaccaggcggaagagcagcaggcttcccgcaggctggtcgtcgaggacggctggatttactttatccacggctggacgcaggtgatcgccgaagtgttcgatatcagggatatgaacgggcgcatcgacgaaatggacagaattgccgcgcaattcaaccaataaacaatccaaaggagagaaaacaatggcggattttaatacggacaacaagctgtttgattatgaaaaaggctttacgatagacttcaacctcttaaacgggatgtcttccttaaaggatacgtccaaacgctttctgagcggcgtcaaggaaacgttttacgatgcggcggccgcgcaggcggatatcgaaaagaacggcgacaagctggtgtacgagttccacgagatggaagtccccgaccacgcaggcgacctcgcgtacgggatcagcatcgtatatcccggcaaggtcggcgacgaatattatatgacgaagggccatttccataccatcctcgatacgggcgaagtgtattactgtctttcgggccacggctatatgatgctcgaaaatcccgaaggcgactggtcgtgccttgagctgctgcccggcaagatggtctactgccccaagcgctgcgcacaccgctccatcaacgtatcgccatccgagccgctgcgcacctttttcaccttccgcgcggacgcgggccataactatggcacgatcgaagaaaagggttaccgcaacctcctcgtggacgataacggttccccaaaggtcatcgccaatccaaaatggggaaaatgagcatgaagatactggtaacgcccacatcatttttaaaaccggaaaacgcagccgcaaaagggctgctcgagcagtttgcaagcgaggtcgtctacaacgacctcgggcggccgctcaagggcggcgagatcatagagcgtcttattggcgcagacggctatatcgcggggcttgactacatcactgccaatgtggtcgaaaaaatgcccgcctcattgaaagtcatttcgcgttacggcgcgggcgtggaccgcgtcgatatcggcgcggcaaaaaaacggaatatcatcgtaacaaacacgccgggtaccaacgcggtggccgtgtgcgaactcgcctttgcgcttatgctgtgcgccgcgcgttccatcctgacgctggacgcggcggtccgcaaaggagagtggccgcgcaacgagggcatcgagctcaaaggaaaaacgctcggtatcatcgggcttggcgccatcggcaaaaaccttgcgcagcgcgccaaagccttcggaatggaagtggtcgcctatgacccttactttgatgaagctttcgccgccgctgaagggatcggcggcggaaaggcacagcaagacctggatgggctttttgcacgggcgaacttcatttcgctgcacgtgcccctcacagacggcacgcgccacatggtgaacgcggagaccatcgctaaaatgcctgaccgtgccgtcctcatcaacacggcgcgcggcgggatcatcgacgaggaagctgcggcgcgcgccttaaaaagcggaaaactcgcggccgtatgtatggacgcgttcgagcaggagccggtaacggcttcccctcttttagacgcgccaaacgtcattatgacgccgcatacgggcgcgcacacaaacgaggctgtcgccggaatgggcatgatggccgtacaaaacgtgatcgccgtactcagcggtaaaccgtgcgatcatattctcaatccataaggaggatgaaccgtggataaacaggaaatcattacaaggctggaagcatgcggcgtagtcgccgtcgtccgtgcggagagcgcggagcaggccgtcaaaattgccgatgcatgcatcgcggggggcgtaaaagggatcgagattacctataccgttccgggcgcgtcggagatcattacagaacttacaacgaaatatacccctgaccggatggtcgtgggcgcagggaccgtgctcgatccggaaacggcgcgcgcggcgatcctcgcaggggcgaactatatcgtctccccctgcctcaacgaagatacggtaaccctgtgcagccgttaccagattgcgtgcatggcgggcgccatgacgatcaaggaagcggtctcctgcatggaagcgggcgcggatatcgtgaaaatcttcccggggaacctgtttggccctgcgatcatcaaagcgatcaaaggccccctgcctcaaatgaagatgatgcccaccggcggcgtgaacgcggaaaactgcggcgaatggatccgcgcgggcgcggttgcggtcggcgcgggcggagaccttacggcaggcgcgaaaaaaggcgactatgccggcatcacgcagattggcaaaaagatggtcgccgaagtgcgcgcggcgcgcgaaggaaaatagcttatgccggaattaaaagtcaaggccgtcatttttgatatggacggcgttctcatcgacagtgaggaaatgcacgattttgtgcacaaaagctttgtcaaaaggcttcttgcggaccgaaacggcgagcggttctgcgggcatgtggaaccgggcgtcagcgttacggaatgttaccgctctctcctcgccgcgaacgggtttgcaggggatatggacgccgcgctcaaaaaactgcacgggcagcatttcaaggaaatgacccgcctgctttacgcaggcgatatcgccctgtgcgaatccgtcgcgcgcctgctccccgagctttacaggcagggtatcctgcttgccgtcgcttcttcctccgtcaacagctttgtaaacgccgtgctcgaacactttggcgtcgcgcgttatttcagcgaggtcgtatcgggagagcaggtacagcgcaaaaagccggcccccgacatataccgcgaggccgtccgcaggctgggcgtttccccgcagcatgcgcttgccgtggaagacagcggttccggcgtaacggccgcttacggcgcggggctgcggtgcttatggtatcggccgggcggcgtaaatatgccgccggatgcatacgcggccatcggttctatcatgcaaatactggattatatcgggcgttaagcccttgcgtaaatacggcaatataaattttttggataacaactggagataaacttatgaaagcagcatattattacgaacccaaggtcatgaaggtcgaggaagtcgatattcccaaaataaacgacgatgaaatccttttaaaagtgcgcgtcgcttccgtttgcggcacagacctgcgtatctacaactacggccatttcaaaataaacgccggtgagcgccgtgtactcgggcatgagattgccggggatatcgcgcaggccggaaagaacgtcaagcactttgttgccggtatgcgtgtcgcgcttgccccaaacatcggctgcggcgtatgccccatgtgtatcaagggctataaccagctatgtccggattacgacgccttcggcatttcgatcgacggcggcttccaggaatacctgcgcgttccggcacaggccatcgcgcgcggcaatgtgatcgagctcgcggacaacctttcctatgaggaagccgcgttagcggaaccgttttcctgcacctataacgccttcaaggacttaaatacgcgccccggggatacggtcgttatcatcggcgcaggaccgatcggcgcatgccacgtcatgctccataaaaaggcgggtgcaaacaaggtcatcgtggcggatctctctgtcgaccgtttgcgcgaaatcaaaaaattcggcgcggacgtggtagcggacgcgggaaaagaggatatccaagcaatcgtggacaaggaaacgaacggatgcggcgcggacgtcgtcatcaccgcctgccccgtcccctctgtgcagcagcaggccctggaaatcgcgggaaggcgcggacgcgtatgcttcttcggcggtatgcccaaaggaaaagaagaagtgacgctcaacaccaacctgatccattacaaggaactgactgtcctcgcgacgaccggttccagcctgacagactattaccagaccctacagatcatcgccggcggcacaaagctcaaggatatcgcgaccggacgtttttccatagaccggatccacgaagcatttgagtatgcagcctccggcaaaggcatgaaggccttgatcctgtttgagtgaggagcggtttatggaaggcaaaatgaaagcggcggtcctgcacgcccccggaaagctcgtggtggagcatgtggacattcccgccctcgatgaaaaaaacgacgtcctggtcaaagtcagagccgtagggatctgcggctctgaccttgaccgcattttggtcacgggcacctattcctttccgaccatccccgggcatgaattctgcgggacggtggaagcgttttacggacagcctgacggggttgccataggcgagcgtgtcgtggtagcccctatccttccgtgtatggagtgcgatagctgtctgacgggcaacttcggccagtgcgaccattacggttacatcggttcgcgccgcgacggcgcgatggccgaatacgtagctgttccttcaaaaaacctgatcaaaatgcctgcttccgtaagcttttcttccggcggcgcggtagaacctgccgcagtcacgctgcacggtatgaggctggcggccatcgcgcccggggattccgtagccgttgtgggctgcggcaccatcggcctgttcgccgtccaattcgcgcgcatcatgggcgcaacccgcattatcgccgtcgatatcgacagcgctaagctggattttgcccgcagcttgggcgcaaccgactgcgtaaacagcgcggcacaggatcccgtgcaggcaatttccggcttcaccgcggacaagggcgttgccgttgccgtggaaacggcaggcttgcctgtcacgcaggagcaatgcctgcgcctggcccgcaaaaacgggcgcgtcctgctgcttggcacggcgcataaagacgtgacgctgcccaaagaaacctttgaacgcatcatacgctgcgaactgaccgtaaagggttcgtggaattcttattccgctcccttccccggcgtcgagtggcatgccgttttagattatttgaaatcaggattgctggatattgattccatgatcacgcgccgcgtgtcgctttcggaattgccggataccatccaaaagatgaaaaagcgggaattccctttccataaagtcattgtagaaattccataatcttttcttcctaaagccggatggcccgcgcgccctgcctatggcaagggcgcgctacaccgtccggtaatattcgtccattttaccaattgcgttttcatatgttctctttgccgcacggtactcgtcatataccgccctgttcggcgcatattcttttttcacgtccaggtgctgttttgcctttgccttcatatccgttattccgccgatggcgtaaaggccgataatggtcgcgccccattgcgacatactcggatggtgcagcttggcgaccggaagccccgtgatatcggcgtacatctggttccatacgtcgcttcccgcgccgccccccgcgaccgtgatccgcgggatcgaaagctcggggaacagttcccggagccgctcgatcgtcgctgcatgctcaaaagaataggattccataagcgcgcggtaaaaatgcgcggcctcgtgcgtccagctaaagcccagccatgtcccgcgcatctttccgttatacggcatcgcgcgtccgcccagcatgccgaccgccgtcagcccgtcgcagccgatggggatcttcgcgattttttcttccaatatgctgaatgcgtccttaagcaaaacgccttcgccaaggaaatggctggcaaaccagtcgagcgtgatccctgagccggcaaggtaaaagtggttgtaaaactccccggggatggcggacgggatgatgtcgatacgccgcgccccaaaatccggacgcatctccttcacgcattgcgaaaggctgccgtacgacgctccctcgatattcaggtcgcccgggtctacgatgcccgcgccaagcgcccctgccgctttgtcccccgatcccgcgaccagggggatgccgctcttaaggccaatactccccgccatcgcgcgggaaaggtatccgcatacctcggtcgaattcgtaatgcgcggaagctgtcctgtatccacgtgcagcgcatcgcaaatacgcgccgaccaccggtcatttttaaggtccgcgagccctgtccactcaaggtaggagcggtcgatgaccgcatcttctatgggcaggccgccaagccgtcccagcacatacccgctgatcatcatgtatttcctgatctttttcgattccgccggaaaatccgcggcaaaccatttgagcttgggagcggtaacaggacaattggtacccgattcttccaggatcaggtcaccgcagtcctgcatgaccatatccacataaccggcatacctcgtatcgagggagcacgaccatgtcgtaatatcgttccaatcacgatcgacgcccatgaagcccgccatctgccccgtaaaaacaatcgcgcccacgtcgtccttcagggcgcccaggctttccgccgcctgtttcatactgtccaccacagatgcaaaaatagaatccgcgtgctggatatacattcccgcctgcgggcgttcgtcctttacctttgcgctaaaactcccgtagcatttggaggtttcgtcaaaaaccgcacacttgatgaaggacgtccccaggtctacagacataatcaaagtttttttcataataaaccccttactatttttggccgccagccgcgttttccgcggtataccaccggccgtcaaatttttcgccatgaaacgctagcttattttgcatttttcgataataaaaattattaaatgataatatatgataatatttaatatatcaaaaataatactgcatttcaagtaatttgtgtaaataatgtacgcaaaatatgctataataagaaattaattgtactattacagaatttgccatataataatgatatgattagtaaacaattgttctttttcgattattagaattttaggaaacggagacttttgaaaatggaaaaggcagaggggatatttgcggaagaacgcagaaaaatgatcgtaaatcatgtgaacaaaaatgtaaaggcaaccgttgcggagctttgttcgctttattctgtttcttccgcgacgatccggaacgacctgcgggcgctggagggggccggtctgctcaagagggcccacggcggcgcgatctcctgcaagagcgtgaactacgagatcaattcttatgagaaggctgtggagcgtgtcgcgcaaaaagtgaaaatcgcggaaaaagccgtcgcttatatcaaggaaggggatactatcgccctcgatacggggacgacggcttttgagctgactaagctgctcaccaaattccaggaattgatggtcgtcaccaacgatttgcagatcgctatgttcctcgagcaatattcccgcgcgcagattttccttgtcggcgggcgtgtccgcagggattaccactgtacctacggtaaaaaggttttggattccgtcagcgacgtcaacgtagacaaggcgtttctgggggcgaacggcgtaagtctgacacgcggtttcacaaccccgagtattgatatggccgatatcaaggaagccttcatcgagatcgccgatacgacgtttatcatcaccgacagcacaaagctggaccgtgcttccttctccaagtttgcagactttgaggatgtcgacgcgatcatcacggattccgacatagaccccgcccacgctgcgagccttgcagaacgcgacgtcgaagtgatcatcagcgatccgtattgattcgataataattaataaaattcgaaagcaaatgcttgataattcgacagcatatgatataatattcttatcatatcatatctgatcggagaattagaatggaaaaaatcggtatttgcttaattggatgcggaagggccggcatgatccatgcccgcaatttcgcaggtaaggtccagacgacaaaaatggtcgcctgtgtggacgccgcgcccgatgcggcgcgcacggctgcggaggagctcggcgccgacgcatggtatgtggattaccacgaaatccttgacaatgatgcggtggacgccgttgtcgttgtctctcccaccaatttgcataagcagatcgtcatagactgcgccaatgcgaaaaaacatatcttctgtgaaaaacccatggccatgacaagcggcgaatgcgaagaaatgatccgtgcatgtgatgaaaatggcgtaaagctgcaaatcggctttatgcgcaggcacgacgcaagctttgcgcatgcaaagcgtatgctggattcgggtgcgatcggcgacctggtacaaatccattccaatacgcgcggccccagcaaaccccgtccatggatgtacgatatcaaaaaatccaacggaatactggcggaggtcaacagccacgatatcgatgcgatccggtggtttgcaggcagcgatatccgcgacctttatgcgatcggcgggaattaccggaatccggaagcggcggcggaatatcctgactattacgacagtgtgctgatgagcggcacttttgagaacggcatccagtttgtcatcgacggcgcggcttatgtgcaatacggatacgattcaaagatggagcttgtcggcaccaaaggcgtaatccacgtcggccgcagtacctcagagtttgtggaatgcaccacggcggaccacggcacctgcactccgtttatcaatagctggatgagtttgtttaccgacgcatacctggcggaagaccaatccttcgcgcaggcggtccttagcggaagcgagccgcttgtgacgggctacgacggtatgatggcggtacgggtcgtagaggccggaaaccattccatccaaacgaaaagtattatcaaaatggacggcttcacactgtgaggccgtccattgaccatttataacctaaactaacttattctaccttgaacgcgctccatccggcgtagcttgccgcgctgtgtaattcttcctcgatgcgcagcaggcggttgtatttcgccacgcggtccgtacgcgtgggcgcgcccgccttgatctgtcccgcgcctgtggccacagcgatatccgcgatggtcgtgtcctccgtctcgcccgagcggtgtgaaataatggccgtgaaccctgccctgcgcgccatttcgatcgcttcaaacgtctccgtcagcgtgccgatctggttcaccttgatcaggatcgaatttcccgcgcgcatatcgattccctttttgagcctctgcgtattggtcacgaaaaggtcgtcgcctacaagctggatgggaagttcgccggtcagcatcttccagccttcccagtccgtttcgccgaggccgtcctcgatggaaatgatcggatattccctgataagtttttcccagtaagcgatgagatccgtacttttaagctgtgtgcgttttttcagcaacgtatatttcccgtctccataccattcgctgctcgccgcgtccagcgcgatcttcacgtcgtccgtgctgtatcccgcatcgccgatcgagcgtacgataagttcaatggcctcttcgtcgccggataagtcgggcgcaaacccgccttcgtcacctaccgccgtcgaatgccctgcgcccgtgagccgtgcgcccagcgcgtggtatatctccacgccccagcgcagcgcatcgtggaaggtgggcgcccccacaggcacgatcataaattcctgtatgtccacgttgttggaggcgtgcttgccgccgtttaggatattcatcataggcacgggcagcacgtgcgccatcgccccgccgaggtaatggaacaacggcgcgctaagtgcgtttgccgcagcctttgccgcagccagcgagaccgcaaggatcgcgttcgcccccagcgccgtcttgttcggcgtgccgtcgaggtcgatcatcgttcggtcaaggagtatctgcttggaagcgtccatcccccgcagcgccgatgcgatgcgcgtattgatgttgtccaccgcatgcgtaacgcccttgccgccatagcggtttttatcgccgtcgcgcagctcgtgcgcctcgaattcccctgtcgacgcgccggacggcacgctcgcgcgtccctttgcgccgccgtttaaataaacttccgcttccaccgtcgggttcccgcgcgaatcgatgatctcgcgccccttgataccggatatttcaaacaatgtgttcatgccatcgtcccctttcattcactattccattcatacccaaaaagaggcataaaaaaacagccaattccatataagaatacagaatcggctgttttcattttttccactcaatccactcgctcaaggagcatgttatattgtatttttgcattagaaatcctatcatctctcctacgttcatgacagtacccgcctcatacctgattggatgatacaataccccgtcgatctcaaccgtatccgtttccacgtcatgcagccaaaatcatacacgctttctttttcatacctgctcctcccttatttcggcgacagtcaccacgcggagatcaacccacccgttcaaggagcagcgtatagtgtttcggtacctttcctattttatacatcgctgaatgtgcatacaaatattccccgccactgtaatccgtgagaaatccgagtgtatataccgctccgccgtctacttcaaagtgcggttcataccatatataaccaatcacgtcccctacgctaatcgtatcggttgggagttcgcttacctcacgatacgataccccgtcgatctccaccgtatggctctcagcattatattgatacactggaaatcctttgtatgtagtccgattcgacaaatcaactctacaactgatacagcatacaagcacggctaacaaacaaatcaaacataccgccattttcgctctctttttcataacctttcctccctcatttcggcgacaatccccatgcggagatcagtacgcgcgttccaaaatcatacggtattttctgcttgcctttcctatcttatagacggtataagaagtggcatataggtactctccatcctcaaaaccactcagtaaattcacgccgtataaaacgccctgttctatctcaaaatgcggtttataccacatatacccaatcctttcgcctacaacggtttttttcggtataatgtcgtccacttgtcggtacacgataccgtctattactactgtttgatcctctgtattaaactggtatattggtaatccttcataggtatcttgttcagaaaaatcttctatggcgcaccctccgctaaatataacaaacacacaaagcaaggcagccaaaatcatacacgctttctttttcatacctgctcctcccttatttcggcgacaatccccacgcggagatcagtacgccgttattatattcttgctgcaaatactcatgaacgcttttatattttaccactcccgccgttcccgtattcggatcataatcatatacacctatcgtatgatcggggttgctttccaccgccacatagtgcgcgccaatgctgccatccggattgctgtaagtaaagcacaatatcccatatccgtcttcgctgatcacctgttgcgcctgcgccctaaggagcgtttccttgtcttccatcggcacgaccatgccaaagagcgacgctgcgctgcggatattgacgtccggtaccatgtctttgatgtattgttccgtccgccacgggatcgtccccggaaaattcgaatcgccgttttccctgtgccatgcgtaaatctgctcgtatggtactccccttcccatcaattgaagcacattgttcgtcgctgtcgtggcacatccgttggcctccagtccgtccttgtcaaagggcagccccgcaatttgcggttgatcctgataaagcatacccgtcaggttatccatatgggttctgtatgctttttccgtcgcttcatcccattgccctgtttcggctattcccaaagcctgctgcatttcttttacatcgtcttctccgtggataaactgcggcgcggcgggaggctgtgtcgtccattgcgacccattttcctgcccctgcgctgcccttacctcgtccgctttctcctgcgtgatcggccccatacccaaatcaaggttgctgccgcccgtttgatccggctgcggcgcgcttttcggcattgatcgcgccggcgttacggtcgcggacgccggctgcatgatatttcctaccgcctgcgggtcaattttcattgtccccgctatcatgccgtccctcgcgaccttcggatcgtccttacccatagtatacaccatattcatactgtttgcggcatctttatcactatcctcgccgacgcttccggtcgaatccacctgtcctctcaattccgctatccgcgcttccaaaagcggcttgagtttttccgtctgctgccgcataaagtcatccttcaattccttttcaccaaataatccctgcaaaaacgggtcggccaaatccccgtccgaacgttccccgcctttgcccagtccttccgacggttttacttttcccgcgagcagcttgtccgcgtaatcgccaagcgcgttctcaaactcctttttccgcccgtcgcggtactcctgctcccaactgtcgcgattcagctccgtcaaaaaagcgtcgcccgtgtcccccttgccccccagggggccttctctcctctctgcgctcggattcaccttgtgcgcgagcaccctgtccatcagcgtcctcgtgtatggttttgcttcagcctgcggtgcttttggcagtaggctgttcccattcccgcttcgcctccggctcgcgttcacggacctcccttgccggggcgccgttatccgaaccataggttcggacggcgctccctctttcgcagccgtggcgcggcgttcgcctccgatgtctttgtaagcagcgcgcgcagactcggggcgcgaacgtccatctaaggctgcggtaattgttgtcggttgggcgggcggaacgtcctgcaccaagccgtcgttgcgctgcttccattgcggcgcgggttgccgcgtatcctgtagcttttgcattccgcccgctttttgcgctgcaccctcttgcgcgcgctgccgcattttcgtcatgaaatcccccagcaccgatgcaggattcgccacgtcctttttcggcattggctcccgccacttgttgccgtacaccgcctgagcataggtctgcggttcctgactgccttgcgcaaacttttgagcctgctgctcccgcttgcgctgctcctctgccctgcgcgcttcctcctgccttttgcgttcctcttcctgcctgcgccgtgcctcttcttccttgcggcgctgctcttcgcgtctgcgtgcttcctcttcgcgtctgcgccgctcttcctcctgccttttacgctcctgctcctgttgccgtttcctctccgtttgcctctgcatgttactgtaaagatcgttgttccaattcgtccccattttccttttcttcctttcttgccgttgatttgcagtctgccatcgtgccgtccggcgtatgcgagttttacgtcgcgcagcgaggtaggctgcccgagctaataggcggatggcacatggcggatatgctgtattaagttataaaaaaagaagcgcattcctgcacttcttttctatacataacatattattttacatcatcatcatatcacgctttaccctgacatggcaggacgcgcatcggacaagagcggacatgccgcatcttctttgcttaccctatcacatcccgcgcgaaatccgccgcttgcttttgtaccgcttcgtcgcttaccttgtcgccctgacagtggaactcctgcccaagcggggtaataccgcgcttttcaagctgttttttgatcaggtgggatgcgccgcgcggatcgcccgccgtgctgaacaccgcgaccttgccggtcgattccggcgaaagcgtcttgataaactttttcagcttgcccgcgatatggaatgcgtaaaccgcgccgcccaaaaagagcacgtccggtttttccgtcaacggaacgctcacatccttcgcctgcgtaccggccgccaccgcgatcgcctccgcgatcaccttcgtattgcccgaccgtgaaaaataccgcacctctgtcataatagcctccttaataggacttcgcgaaatacatcatctgcttggcgggtttgccgcagtgtacgcatacgtcgccgaggttcttctgtccgtcgaacggcatgcaccgcgtcgtgatgcccgtcttttccttgatcgcctcttcgcactccgtatcgccgcaccacatcgcgcgtacgaaaccgtgtcccttttccacaccttcgatgaactcgtcccagttgtgcgcgtcgaacgtgcgttcctcgcggaatgcgcgtgccgtttccagcatacctacctgtatcttgttcaaaagctcttccaccgtcaaagcgatattatcgagcggatacgcctctttttcgtaggtgtccctgcgcgcgagcatacattttcccgcctcgatatcccttggcccgatctccagtcgcaccggcacgcccttcagttcccattcgttgaacttccagcccgggctttggtcgcggtcgtcaagctccacgcggatacccgccgccttcagctctgcaaacaacgcttccgccttttccatcacgccctctttgtgcgccgctaccggcacgatcacgcactggatcggcgcgacgcgcggcggtagtttcagcccgcgctcgtcgccgtgtaccatgatcagcccgccgatcatgcgcgtggaagtcccccacgaggtctgccatgcgtatttcaattgcccgtccttatccaagaaccggatgtcgaaccccttggcaaaattctgtcccaaattatgcgaagtccccatttgcagcgccttgccgtccagcatcatcgcttccacggtgtacgtatggtctgcgcccgcaaacttctccttctcgctcttacgccccgcgatcacggggatcgccagcacgttttccatgaattcgcggtaaacgcccagcatcttttccgtctctgcttccgcttcctcgcccgtcgcgtgtacggtgtgcccttcctgccacaaaaattcggacgtgcgcaggaacgggcgcgtgctcttttcccagcgcagcacgttacaccactgattaagcagcaccggcagatcgcggtaactctgcacccatttggaatacatcgagcagatgatcgtctcggacgtcggacggatgcacagcggctcggcaagcgtctcattaccaccgatcgtgacccacgccgcctccggcgcgaacccttcgacgtgctccgcttccttttccagcaggtgcttggggatcagcaatgggaaatatgcgtttttgtgtccggtcgccttaaaacgttcgtccatctgctgctgcatcagctcccagattccatagccgtactgcttgatgaccatgcagcccttgacttcggaataatccaccatatccgccatcttgatgacgtccgtataccagcgcgaaaaatcctcgttttgcggcgtgatatgttccacaaatccatcattttgcttacccattgtgtgactcctttgaataaaatatcgtaaccatattattttatcattgcattgcctgatatgcaagggcgcccctcactccatctccggcacaatgtacgtttcgccgtcgcccgtgtccacaatgcggatcttcgtatcatataccgcctcgagcatcctgcgcgcaagaatgtcacccgccgcaccgcacgaaacgacgcgcccttccttcatgagcacgatgtgcctgcaataatgccgcgcaagatttaagtcgtgcagcacgcagatacacagcatgccgcgcttttccgtcagctccctgaccagtgaaaggatgcccacctggtgtttgatatcgaggttcgagacaggttcgtccaaaagcagggtactggactgctggcacaacgcccgcgcaatgatcatcctctgccattccccgcccgaaagcccgatcacactacggttttcaagatgcccgatccctgttttggcgatgcactcccgcgccagggcgatatcctgcgggctgtcgctctcaaacgtctttttgtgcggattacgccccatgagtacagtctcgagcacggtaaaatcatattccaaagcataattttgcggcaccagcgccattttttgcgccaacgccttcgcgcccagcgcctgtacgttttccccgtctatgcacaccgtgccgcgctgcggcttcaaatagccggatatcacgcgcagcagcgtggtttttcccgcgccgttgggtccgatcacccccaccatgcccgcatccaggttcagcgagatatcatgcaggataggcgtatcgtcaatgctaagatccacgtcgcgcacttcgattcccacagcctataccccctttcgtccgcgccgcagcaggaaaataaaaaacggcacgcccaagatcgacgtgacgatgcccaccggcatttcctgcccgtttagtatgacgcgcgcgatgatatcgcacaataaaaggtacatgccccctgctgcaaagcagagcggcatcagctttttattgtccggcccgcacaccatgcgcaaaaggtgcggcaccatcagccccacgaacccgataatcccactgatcgagactgcgacggcggataaaagcgacgtcaatatcagcatattcctgcgcgtcttgtgcgtgtccacgccaaggctgcgcgatacctcgtccccgttgagcatgatgtttaacggctttgcataaaacatcagcagcgtggagcaaacgaggatgacgggcagcgcgatccatatcttttcccacgacatgtttgcgaggctgcccatgttccacatcacgacgttttccatcttgtcgcggtttaatagcatgatcaggtagatcacggaggaaaacatcgcgctcatggaaaagcccgaaagcagcagcgaaaaggtggacaccttgccgcgtatccgcgagatattgtatacgatgaataccgccacaagcgcgcccgcgaagctgaaaacggcgatcgtccccacgcccattatgctcgcagtggtcaggaacgtcatggcaatggtcgccccgagcgccgcgccggacgaaacgcccagcacaaatgaatccgccatcgggtttttgaataccccttgcaggcagcagcccgaaacggcgagcgccgcgcccaccaaaaacgcgccgaccgcgcgcggcagacggatattcataaagatattgtatactgcgtttgaggccgttccattgaatacatccccaaattcggcgaacgaaaaacccgagcttcccacaaaaaaggcgcacacaaaggcggcgatgccgcctaagatgagcgccgttaagagcagcttgaattttacgtgccgttttatcatatgagcaccccgttgcggatgcagcgttcatacatgccgccttgcttttagtcgttcaaaatctcgctgacagccttgatcgcctccgcgatacgcgggcccgggcgcgtgaagatgtccgcgtccacaccgtataccttgccgtccttcaccgcgtcaaggtccttatacccctgtgccttgctgatatcgcctgcgctgcccatgctggaatccatgaggatgatgtccgggtttgccttcacaaggtcctccaccggatattcgatccacggagccgcctggctgtcggtgacgcatttgccgcctgccagttcaatcatcgtattgataaaactcccggggccgcttgtccagtttcccatatccccatagctcatcgcataatatacggttttttcttcttccggtttattttcctgtgcctctttcactgccgcattgatctcgtcgatgacctgctgcgccacgtcctccatgccgacgatcctgcccaccaactcgatggatttcggaatctcatcaaaggtcgtcgcttccacgattaccacggttatcccaaggtttttcaactggtcgaccgcgtcctgctgcaagcctgtccccgccagcacgatatccggctccagcgctgtgatcttctccacatccgggccgttaaaatcgcccacgatctcgagactcttggtgatctccggataatcggattccgcgtcaatccccacgagctgcttggacgcgccgaccgcgcacacgatctccgttcccgccggcgttaaagatacgatcttatccgccttcgcaacgcttacttcgttgcccgccaaatccgttacggtaacgccttccgctccggacgcgctttccgacggcgcggctgattgctccgccgaagcggaagcctgcgccgtttcacttgcggatgcgcttacttccggcgttgcctgcggcgcttgcgcgcatcccgcaaataccgccactgccattacgatacaaatgagtaatgagataatttttttgttcatgtctttctttttcctttctgtcttaccttgataacaaaaaatgcctttcggcagttgcaaaaaggcataaggcgcttttatccttcccgccgaggaaaaaaacttttccggcttatggcaggtcttccggcttgacttcatcgctccttgcgcgccttccgggcatgaggcctgtggcttctttgcgcaagcgctccgtcacacggcagcggtgggctgcagcggcatacgctttccctattctccggtttcccggcaccataaacactttaatgtttttttgttactataccataccatcccccaaaacacaatattacgctgccttccggcgggggtcgttttgcggtataataggaataaagggggaagcgcatgattatcgagatcctgcaaaagaggagcaaagagcaaaatctgtttgaattttcagaaaacggcaaaacgctgtacatagcccgcttgccgtggcaaagcgtaaccccgccgcttccatatgaaaaattccgcacggttacgttagacagcccgcgccgcgagcagcttttttccctgcgtttccgtccgtttgaggagatcgcgtcgtttcccttcgccaccggcaaacgttacgacgcatacgatatcataggtaaatacggcgtcgccggatcgttttacgccatgtcgaacggccggttggaaaacgagatccatcttgcctgccaagacaaatttttcacatgctacgaccgcgcccacggagcgcgccgcctgctgtctgttttccatatgggcagccagcgcgcacaaatcacctctcctcttgcggaacaaggctttgaccgtgcctataccctgcacatcgcgccggggttcgaatatctgctgcccctgctgtgtttttttacattatactgggattttgcattggacgaccgtcacaggttatatccacgcacgggcacagtctcgtgggaatattcctttaaggccgaccatcatgatccccactggatcgaaactaccttcggcagagaagaagcccggcgccttaacgccgcggtcaaaacacgccgcggcgaatccctcggcgagatcaagcgttccatgaagtttctcgccattttcagcgggatcatcgctgcaatcctatttgggataatcgccgcttcctattttggcgaatggtaaatttccttcaaattccctattgcataattattcattccaatgtataattatgtagaataaaagacaaggagcataaaagtcatgataaacgtaagcatcgtcggcgcaacgggctatgtgggcgcagagttgatccgcctgctaaaccggcatccccacgtcaatataacggtagcagtatccaaaagtttcgcgggcaaaacgctggatgaaatatacgcgaattttattcccgccaaaacgctcgctttaagcgatctcgatatccccgccattacccaaaaggccgattatgcatttttatgccttcctcacggccagtccctcgccgtcgcgccccggcttcttgccgcgggcctcaaggtgatcgacctgtccggcgatttccggtacgacgatacggacatctacgagcagtggtattccctgccgcatacggcaaaagaggaaaataagcaggcggtgtacggcctgagcgaatattataagaaggaaatcgaaaacacgagctttacgtcgaaccccggctgctataccacgacaagcatcctcgccctggcgccgctattaaaaaacggcctgatcaaaccgaacgggatcgtgatcgacgcaaaatccggcgtaacgggcgcgggcaggaaggaatccctgaccttttcctattgcgaaacggcggataacttcaaggcatattcggtggtgaaccaccgccatacatcagaaatcgaggagcagctttcaaagctttccggaaacgatatcaagctgttgttcacgccgcacctgcttcccgtaaagcgcggcatcctcgccacgatctacgcggaactgacggacgacgcaaacgaagcgtccgtggcgcagtcctacttagacgcatacggcgataaaccttttacgcatgtgctgcccaaaggcaagctgcctgagctgaaatatgtggtcggctccaacaactgcatgatcggctacgaattttcgccccgcacgggccggatcgtcgtcgtatcgtgtacggataacctcatcaagggcgcggccggacaggcgatccagaacttcaacatcatgaacggccttgcggagacaacgggcttgccgcaagtggcttggtatttataagctctcgtcggcgcgcttcctacaggtgtaacttaccgcagtcttagatggctatttgcattccgggtctgcgcgctatgcttgcaaagacgcctaatgcaaacaccgcatcacatctgcggatcgatcacgctcgaatccggcatcgtgatgccagacatatgcgattccggcacagggctgcgcagcctaatgccgacgcctttgcaaacgaagtgcgcaggatcggcgtttaggctggcagtcctgtggcagtaacagacgacacggcataactgtcaataaggagaaaataatggaagatatcaaaatggaacaatatttgaatcgggcgaacatgctcgtggaagccctcccctatatccagcgcctgttcggcaagaccatcgttatcaagtacggcggcgcggcgatgcagagcgaggacctcacgcaaaagatcctcgaggacgtcaccttgttaaaattcgtgggcatgaacccgatcctggtgcacggcggcggccctgatatcaacaatatgctgaaggctttgaagatcgagcctcaattcatcgacggcctgcgcgtcacggacgacgcgaccatggaagtcgtgcagatggtgctcacgggcaagatcaataaggagatcgtcgccaagttaaacggcatgggcgcgtctgccatcggcctgtgcgggatcgacggcaatattatcaaggcagtcaaagccccgccgaaaaacgggatcgatctcggcaatgtcggcaagatcacgtcgatcaacacgacgctgcttcaaacgctcgcgcacgaccagtatattccggtcatcgcgcctgtcggtacgggcaatggcggcgaaagctacaacatcaacgcggatacggtcgcgggcgagatcgcgactgcgctcgaagcggaaaaactgatcttcctcacggatacggacggcattcgcacgaatgaaaatgatccggaatcgctcttgtatgtagcgtctaaaacggatatacttaatatgatcgaagacgggaaaatcacgggcggtatgctgcccaaggtaagcgggtgcctctcggccatcgagcacggggtcaagcgcgcgcatatcttgaatggcacgatcccccacccgatcattcttgaaatcttcaccgattcaggcatcggaacgatggttaccggttaattaggagctttgatgaactacgaagaattaaaacaactggacaagcaatattatatggaagttttcggcgagcgtatgcccgccgtctttacgcacggaaagggcgcaaagctctttgacgaaaacggcaaaacctataccgatttcctcgcgggcatcgcggtcaattgcctcggctattcggacgagggtttcaaaaacgctttaaaagcgcaggtcgatacgcttatccatacgtgcaattatttttacaatgaaccgcaggcgcgcctcgcacaacttctgtgtgaaaaaatgggatttgcgcgcgtatttttcggcaacagcggcgcagaggcaaacgaatgcgccttaaagctcgccaaaaagtatacctataataaaggaaaagaaacagaccgctttgtggcgctcaatcaaagtttccacggacgcacgctggcgacattgacagcgaccggacaggagaaattccacgtccccttccgcccgatgatctacgactttacttacatcggagcgaacgacacagaggccgcaaaagccgctatatcagaggatgtttgcggtgtaatactcgaagtaatacagggtgaaagcggcgtatttcctttaaagcagggctttgtttccacggtgcgagctttgtgcgatacctatgacgttcccctcatcatcgacgaggtgcagacgggcatggggcgcacgggcaagctcttggcgcaggagcattacggcgtcaaggcggatatcaccacgcttgccaaagcgctcgggagcggcgtgcctatcggcgcgtgcctcgcgaatgaaaaactcgcggcagcgtttgttgccggcgaccatggctctacgttcggcggcaatccgctcgcatgtgcggcgggctgctacgtgatgcaaaaattggatgataccatgcttgcgcatattgcgcagacaggttcgtatttcaaggaaaagctcgcagggctgaaaggaaaattcccgcaggccgtccttgacgttcgcggcgaaggatttatgctcggcgcacagctcagcgaaaagtacgacgcgcacggcatgcagcttaagttgctggaggatggcttcgttatcggtacggcgggcggcaacacgctgcgtttcgtccccccgtttgtcatcgaaaaggcggatgtcgacgatttaataacggcactggccgccgcattgaagtgattcgtaaacaggcaatccgttgcctgttttttataaaaagtttatatacgcgctcgatagctacgttcgtcaggaacaaatcagttttgcaagcgggaacgcgccgcaaaacaactttgtgccaagggggtacaaggtgaatttgccgaaaagcaaagagagggtccgctggcggacgcgggggaacagcatgttccgcccgcgaagcgagctgcgcgagcgccacaagtaaggagtaattaccaaatgccaaaactaacagatattgagaagatcctcgtcatcggctccggccccatcatcatcgggcaggcggcggaattcgactacagcggcacgcaggcgtgcaaagctttaaaagaggaaggctacgaggtcgtgctcatcaactccaaccccgccacgatcatgacagaccttaatatggcggataaagtgtatatcgagccgatcaaccttgataccgtcacccgcatcctgaaaaaagaaaaaccgcagggcatcatcgccacgctgggcggacagacaggccttaacatggcgatcgagctcgaccaatcgggcatcctgcccaaaatgggcatccgcctgctgggtacgcagctcgagtccatcaagctggcggaggaccgcgaactgttcaaggaccttatggtcaaaaacggtcagaaaacgacgcactccaccatcgtcacgtcgcttgaggaagcggaagcattctcatgcgaatgccccttcccgctgatcgtgcgccccgcttataccctcggcggcacaggcggcggcgttgcgcataacttagacgagctgatggatatcaccgcgcgcggcctgaaaatgagcctcatccaccaggtgctcctggagcaaagcgtcgcgggctggaaagagatcgaatacgaggtcatccgcgacaatgcggacaactgcatcatcgtatgtaatatggaaaacatcgatccggtgggtatccacacgggcgacagcatcgtggtcgcgccatcccagacgctgaccgaccgcgaataccaaatgctgcgcacatctgcgctgcgcatcatccgcgcgctcgacatccgcggcggctgcaacatccagtacgccctcgatccggactcttacgactacgtggtcatcgaggtcaacccccgcgtatcgcgttcgtccgcgctcgcaagtaaggcgacgggctaccccatcgcgcgcgtcgcggcaaagatcgcggtcggctataacttagacgagatcaaaaacaacgtcacaggcaaaacgtacgcttgcttcgagcctgccctcgattacgtggtcaccaaagtaccgcgctggcctttcgataaattcacgggcgcggacaggctgctcggtacgcagatgaaggcaacgggcgaggtcatggccatcgggcgcaacatcgaggaatcgctcttaaaagccatcgactgcctcgacgtaaagttaaattataacctcggcatgaaaaacatcgacgactggacgctcaaggaactggacgattcgctcaaaaacgcggacgacgagcgtatcttcgtgctgtcaaaggcgcttgagcgcggctatacggtcgacaagctgcacgaggtgacgaagatcgataagttcttcatcaacaaactgaaaaacatcgtggacctttccaaaaggcttaggagctataccatcgaagacttgcccgaacatatcctgcgcaagtgcaaaaaggtcggcttcggcgacggctacatcgcggactgcatcggcgcgcacgaatcgcagatcacgttcatgcgcggcgccctcggcatccacccctcttttaagaaggtagatacatgcgcgggcgaattcaaggcggtcacgccgtattattactccacctacgacaacgaagacgaggtggaacgcacggacaaaaagaaggtcatcgtgttaggctccggccccatccgcatcggacaaggcatcgagttcgactactgctcggtgcattcggtcaataccctaaaggaaatgggctacgaatccatcatcatcaattccaatccggagacggtgtccacggacttcgatacgtcggacaagctgtatttcgagccgcttaccaaggaatgcgtgctggatatcatcgataaggaaaagccggaaggcgtgatcgtgcagttcggcggacaaacggcgatcaatttagctgaccccatctgcaacacgggcaagcgcgtgctgggcacgagcgtggaggatatcgaccgcgcggaagaccgtgacaagtttctgcatgtgctggaggaactcaatatcccgcttcccaaaggcgatacgacgttttcgctgcagcacgccctcgaggcggcggcggacatcggttatcccgtgctcgtgcgcccttcttacgtgctgggcggccgcgcgatggagatcgtgtataacgacgcggaactcaccgaatacatgacgatggcggcggaggtttcgcctgacaagcccgtgctcatcgataaatacgtggtcggcaaggagatcgagctggacgcggtgtgcgacggtacggacgtcctcgtggtcgggatcatggagcacttagagcgcgcaggcgtgcactcgggcgacagcttcgccgtgtaccccacgcagacgatcccaaaagaggcaaaagcaaaggtcgcggaatacggcatcgctttggggcgcgccctcaatatcaaagggctgttcaatatccagttcgtcatggacgagaaaaacaacgtatacgtcatcgaggtaaacccgcgcgccagccgcacggtgcctattctttccaaggtcactggcgtcaatatggtaaaacttgcgacacacgtcatgctgggtgaaagcctcaaagacatgggttacgagacgggcatccataaggaatccaaactcatcaccgtcaaagcgccggtattctccttccagaagctcgccacggtagatacgttcctcgggcccgagatgaagtccacgggcgaggtcatgggtacggaccgcacgttcctgaaggcgctcaaaaaagcgtttcttgcttcgggcagcacgatccctgacaaggaaggaaagatcctcataagcgtcgcaaaccgcgacaagcaggaagcgctgggtgttgccaaacagatgaaggaatgcggctttacgctgtgcgccacaccgggcacgcaccagtttttcaaggagcataaattcgatgtggagctcatccccaacgacaaagtcttagacctcatcaagaccggcgaatttacgctcatcgtcaacacgcccacgcgcggcaagcaaaaaacgcgcagcggctttgccctgcggcgtacggcggtgggcttcaacgtgccgtgcatcacctccatggatactttgggttccatgctcaaggtgctgcagtcggatgataagctgagcattattcccttaaacgaatataagtaaggcaggtgcataaatcatgatggatcagatcctgcttataaaagcaacagaaaaagacgcgcccgaggtgctggaaatcaccaagcgcgcttttgacctgtacgcaaaagagatccgcaagcgcgagagcgtcaaggctctttatgaaacgcttggggacgtgatcgcggacatcaaaaacaaaaacgtgtacatcgcgcgcatcgacggcgaaatggtgggcagcgtgcgttttgagatcttaacggacggcatcgcctatttaagccgcttttccatcgacccggaggcgcagaatttggggatcggcggcctgctcttagaaaaggtgcgcatcgaatgcctttctctgggcgtgcgcgccatcacgctgcacactgcgtccaaaatgcgctccaccgtcgcgttttatctgaagaacggctattatatccactccatctcgcgcgacagcgactacatccgcgcgctgatggtcaacgagatcgtcgaaatggatgaaatgttcgactacgaaagcgtgtgcgcgctggcaaagcattaggcgcgcttttatgtaagcgtatcgagcttgcctgatccggcaagccgaattgccatttcaattggcggtatacgtcctgtttcaaacgccgcccgcggtttatcaatacggggaaagaataatacggaggaaacccttatgatttcattgttattaggccttgccgcactcatctgcgatatcctcgcatggatcccgacgctgaacgtcggctacctttccctgatcggctttgtgcttgccatcgtcgccgttgcgacgggcagcaagatcatcaaggtcgaccccaaagacaagaacgcgcgcgccggaaaagcgatcggcgtggtgtgtatcgttctggcgattctgggcgtgatcttctcgttcatcctcatccccttggggctggtcgcgtttgccgcgatccactaagaaatccgctttacccccgccccgtaccaaatggtgcgggggttttttgttgttcacggaaatttaaccgaaccttaaccgtttctttgctatactcagctaccatggaataaggctatgaaaggaacgatacaatgaaactgttgatcatagaatacgaagaagatttgctggccgccttaaaagccggcttcgaaaaaaagatatgcggtggacaccgccgcggacgggctttacggctgcgagcttgcgttcgtaaacgattacgacctcatcccccaagaggaatacgccatcctcgaatacctgctgcttaaccgcggcaaagcggcgagcaggcgcatcgtcaccatacgcgacgggcggctcaaagaatagcaagcgaaacaaaagaggcgggggattccgcctcttttattttgtcgcccgccgtgcctatcctgcgcgttgcaagcgtcccccaccggaaaacaaactgtccgcaaacgccaaaatttatcgataatcgataaatttttgttgacatataataaaatcaggtttatacttgccatgatgcaacgaaagcgagaaaaaacggaggctattatgaaacacggacaaaccgcggcaaaaatattgaacggcgcgatcatcatatgcatggcggcgatcatcgccctgtttgcgactacaccatttttggcaaagtatatggcggattcttatgtagtgcaaagttttatattcttctacacggcgggcgcgcttgccttgtggtttttatatgaactgcgcaagctgatcctcagcgtccgcgacggcaatccctttatcaggcgcaatgtcgtcatcctaaaacgcttgtccgtttcccttgccctgctgcttgcggactttatcttcatcacctgcttcaagccgtccgtctccaagctgctgtgcatcgcgctgctgcttttgggcgtgctgtgcgcccgtgtacttgcctatctcatcgagcgtgccgccgagtaccgcgaagagatcgacctgacggtgtgaggtataatatggcgatacttgtaaacctcgatgtgatgatggcaaaacgcaagatcagccttggcgagcttgcggagcgggtggatatctcgcttgcgaacctgtccatcctcaaaaacaataaatgtaaggcggtgcgtttttcgacgctcaatgccctgtgcagggcgcttgcgtgccagcccgccgaccttctggagtacgtgccggataaagaataacccatgaaaccccaaaacttaaaaggtgtgcttgcctgcctcgcgcttttgcttgctgcgttgcagtcggttcgctttaccctgaaacagatcaacggaggctttttatgaatatacaagaaaataacaacaaagtatccaccgtccgcctggcgcttgccgccgcagtactcgccgtgtccttttgcgtgttgctgtacgacaatgtgttcaagctcatcccgctcggcctcaacgtgccgctttcgctcgtcgttttctaccttgcgctgggcgtcagcctgggaaaacgtttccttgcgggactgaagtcgaccgtcctgcaccttgcgtgcatcgctttactctgcatcccctttgtgctcataaacaatgtccttttgcttacgctcagcgcggtgctgatcatcctgctcgtgggcgaacaggccatgctgtgcatgaaaaagacgctttacgatccttattccatctgctttatcggcgacagcctcgccttctggttttctttttcgttcggcggggtgcgcggcgcgttcacgcaatataaaagcggcggcaaaggccgcttcacaggtatcttcatcggcgttgcggtgacgatccccgtgctgctcgccgtgatccccctgctgatgtccggcgacgcggttttcgacaaattcttcatggatctcttcggcgggttgcaaggcggcgacatcatcggcaacgtcgctgttttcctgctgttgtttacgctcggttccggtcttttctgggcgcttgccgcgcgtccgcgaaaaaaaacaacgcagccgtccctccggcctgcgcccatgccatacgatcccgcgtccgccgcgcagcagcctccgttctcacagcctgcggctccttatgcgcagcccgcagtcgcgcagcaaaaacagcccgtctgcttcaacctcaccgcgtcctttttcctgctgggcgcgctggcggtcgtgctggtggccttctgcgccatccagttcgcatacctgttcacagggaacgtaccggagggccttacctacgccgaatatgcgcgtaccggcttctggcagctccttgcggtagcggtgatcgtcgtcacactggtattcctgctgctccgcttcggcgcgccgtgctcccctgccgcgctccgtgcccgccggatcctgatggcgctgctgctcgcctgtacgctcgtgctcctcgtatcggctttttcgcgtatgacgctctacgaacgcaccttcggcttttcccagcttcggttgttcacacagtttttcatggccgcgctgttcctgtttttggtctttgggatcctccgcctgtggctttcgcgccttgacctcaaaaaatgcgccttcttctgcttccttggctgctatatcgtactgacgtttttcaatgtcgacgcgttcattgcgcgcgagaacgtcaaaaaccagggaacctccgccgatatcggctatctcgccacgctgggagcggacgcgctgccctactatatcgacatgctcgatcccgacgattttgccttggaggtcgcttccgaagacgaccacggctacggcgatacctgcggcctgaaccaccgctaccttggcggcgggaaaacccttctctacgacgaccccgccatccttgtgcaggcatggcgcttaaaccatatcatgcacgatatcgacgtctcggataactggcgttacctgaatgcgggacgcagtgcggcaaaagaagcctttgacgcgcaccctgccctgactgccaatattgaaaagatccgggctgcgctcacaaaaggctgatctatccaaataaaaaaactggcgcctgcaagagcaagctccaggtttttatttttatgcccgtccctgtttccaatctatgctgccccggccatagctgccgtattgatcacagccgacgcttagttcctgctgcgtgctgccgccgttttccgtgctgtttcggttcctgccgcgctgcgtaccttgctgcggcgcctcggctcctccctgtgtgtcaggctccatcgtatcgtcatatggcgcttcgccgcgccattcctcatcctgtgtatcgggaatcgcctcgccgtcctgcatatcctcccgttcgtcccacgcgctgtcatccctgccgccgcgctgcccgccgcggcgttcctccgcctgcgcggtcatcctgtattccggccgaccgtgtccgtcaaatacagcgtttgcaaggctgcctccggcaaaaccgatcgccaggactgccacagccgataaaatgattgccggaacccgctttttcgtattcgtcttatgctcgtccctcgaaggctgcatctccggatttccgtcgggcgttcccgccgtgtcttgcctttgctgctgtgcgtctacagcattgatttcctgcggcgtggctgtgcccgccatgttctgcgcgctttccacgccttgcggctgtgccgcctgtccgttattttcctgtccgtcgttcttgttcaagttttcgtccatatacctctcctcattttatttttatgattaccgctgtaaacattattttttgtgtgcggctatcttataatttatcgattttttgtggccaaattgttgaaaatttttgacgaatgtgtgaatgtccaaattttaatacaggcaggacgtttgccgcccccgcagcgttgtctgtcgctcttgtgcattgtctctcccttcgccgcatccgccgttcgcgcctgctttgtccacaaatcaaaacagtctgtactatcatttatagtacagactgttttttcgcttttttatgctgttttctattacatatcaggatcgagcgtcgcctcgcgcacttccttgtttgaaagcgccgccagcttcctgacccgatccatttccagtcccaacgcctgtgcgatgcgcgtgccgtattcctcgtctgcgtggaaacagtgtaccgcgtggcggtatttgatgttctttgtcaccggctcgatgttgcgcgccgtgtttccgatcagcacatcgcgctgctgctcgctcatcaggcggtacagcttgcccggagctttgaatacatcgtccgtcgggtcgtccgccggatcgaaggtatacattgcgccctcaaggtctaacggcggctccatgacctccggctgcggcgcccattgtccctggctgttgggcgtatacgatactgtcgcgccgtagttgccgtccacgcgcatctgcccgtcgcgatgatactcgttcacctcgacctttgcgcggttgacagggatctggttgtggtttacgcccaggcggtagcggtgcgcgtccccgtaggaaaaaagcctgccctgcaacaacctgtcaggcgaaaaaccgatgcccggcacgacgtgcgccggggcgaacgccgcttgctccacctccgcaaaataattctccggattgcggtttaactcgaccacgcccacctcgtgcaagggatattccccatgcggccaaacctttgtgatatcgaacgggttttcataatgacgcttcgcctgttcctcggtcatgatctgcacatagaacgtccagcgcgggaaatccccccgctcgatcgcctcgaacagatccctgccgtgactttcgcggtccttgccgatgagttcctccgcttcctcgtccgttaagttcttgatgccctgctgcgtgcgcaggtggaatttacaccatacgcgctcgtttttatcattatataagctgaaggtatgcgatccaaacccgtgcatatggcggtagctcgccggaatgccacggtcggacatcactattgtcacctggtgcagcgcctccggcagcatcgtccagaaatcccagttgttctgcgcgctgcgaaggttcgtcttggggtcgcgcttgacggcacggttgaggtcagggaaattgtgcgcgtcgcgcaggaaaaacacaggcgtgttgttgcctacgaggtcccagtttccgtcctccgtataaaatttcatcgcaaatccgcggatatcgcgctctgcatccgccgcgccgcgttcccccgcgaccgtggaaaaacgcacgaacatatccgttttggcgcccatcttaaatacctttgccctcgaccactgcgagatatcgtgcgttgcggtaaaggtgccgtatgcgccgcttccctttgcgtgcatcctgcgttccggtatcacctctctgtcaaagtgcgccagcttttccatcagccacacatcctgcatgacgaccggtccgcgcgggcctgctgtcatggcgttctcgttttccgcaacgggcgcccccacctcgttggtcagctttcttttcttgtccatatccataggatatacccctccttttaatgaaatgatatcctacctataaaccttttgtccgccttataaacggcaataaaaaagacagtcgggcttttgcctgactgtcttttactggtttttgtattagatgaacttcaaaggattgagctttacgcccgggcccatcgtcgaagcgatcaccacgctcttcaaataggtacctttggcagccgacggctttgccttcacgatcgcgtccatgatcgccttcaggttttcgccgagcttttgttcgtcaaagctcttcttgccgatcggaacgtggatgatcgccgtcttgtcgacgcggtattccactttaccggctttgatatcattgattgcttttgcgatatccattgtgaccgtaccggatttcgggttcggcatcaatcccttaggaccaagcaccttaccaatgcgtccgatcgtacccatcatgtcgggcgtcgcaacgatcacgtcgtaatcgaaccagctttccttctggatcttctcgaccatctcttcagcgcccacgaaatccgcaccggcgtcctccgcttccttagccttgtcgcccttggctaaaacgagtacgcgtaccgatttaccggtaccatgcggcagtacgaccgcgccccttacctgctggtctgcgtgacgcggatcaacgcccagcttcacggaaagctcgatcgtttcgtcaaagttcgctttcgcggtctctttgcagatcttcacggcttcttccggatcgaagagcgtcatcttatcaaaactttttacgctgtctaaatatttttttcctcttttcatcgcttagccctccacttctacgcccatgcttcttgcggtacccgcaatcatgctgactgccgcgtcaagggacgctgcattaaggtcgggcattttgagcgttgcgatctcttctaactgcgcgcgtgtgatcgtagcgaccttctgcttgttcggcacaccggaagccttctcgatcttgcatgcttttttaatgagcactgccgccggaggcgtcttggtgatgaagctgaaagagcggtctgcatacacagtgatcacgacagggatgataagccctgcctgctgtgcagtcttttcgttgaacgcctttgtgaagtccatgatgtttacgccgtgctggccaagggccggaccgaccggcggtgcaggcgttgcttttcctgcgggtatctgcaatttgatataccctgcaattttctttgccattgtttcttatccttctttcttataaatatgtggttgcgatgcaaggattacatctcccacttaataacttgcgttcgcttcgctctcttcgcgggcggaaattgcatttcccccgcgtccgccagcggactctctctttgcctttcgggcaaattcaccttgtgccccctttgctagcagttgttttgtctcgccttccggctcacaaaaccgatttattcctgacgaccgcagcaaggcagagcgtacaatttaaatcctcttgacctgtacgaagtccagctccacggatgtatcgcgtccaaacatggatacgagcacgcgcaccttctggcgttccgcgttgacttcttcgaccacgcccacaaaactttcaagcggccctgacgtaacgataacgttgttgcccacttccacatccaaattgatgcggacgttttcgatacccatcgagcgcacttccgcgtctgaaagcgggatcggcttggaagacggccctacgaaccctgtaacgccgcgcgtattacgcaccacgtaccacgattcgtccgtcaaaaacatcttgaccatcacgtagcccgggaacatcttgcgcgtcacatggcgctttttcccgttcttcacttccaccgattcttccatcgggaccttcacgtcaatgatcgtatcgtgcaggttatggttttccacggttttcaaaaggttgtccatcaccttgttttcatagccggaatacgtataaaccacataccaatacggtttatccgtcttttcctgcttcaaaaacttcggtttttcctctttgtccgttttgggcgtttcgtccaaaacttccgccgcaccttcctctgcctgcgtgttattcatatccatatcctcaggtgctttttccagcatatcccctgattcagtgatctctttattcataaatcggttgctcctagtttacgaagaagttccggaacacggtaccgagtccccagtccatcaatccgacgataacggtgaagataacaatgaaaacgataacggcaaacgtcgtcttaaaaagatcattcttggacggccatgtaactttcttgatttctccccacacgtccttaaagaaccttcccggactgcgtctctgcttcttattctttttcttggcgagcttcttctgctcttttaaatgcttttcccgttcctcgcccaacaatttggtcttcgccattgccttaacccctcaaaaaaatttacttcgtttctttgtgcaccgtatgctttttgcagaatttgcagtacttggaaagctcaaccctgtcgggattgttcttcttgttcttcattgtgtcatagtttctctgtttgcattctgtgcaagccagcgtaatcttatcgcgcatgatcgcaacctccggttttgtttttaaacaatctaaaaaaaggcactctctgccttttatcaaagatactttaatatgatatcacgcaaacgccctgctgtcaacggtttcgcctaaatttgccatgctttttatcggcctgcgcgctatgcttgcaaaggcgcctaaaccaaatttcgcattccgctcgtcggaacagcgcgcatcgtatccggcatcacagagcggatgcgacctaaataaacgcagcctgtgtgagccggctcaatcgtccttcagcaccgtctcgatgatatacttcggacgcttcttcgtttccatgtaagcctttccgacatattcgccgataataccgatcgcaagcagttgcagcccgcccaaaagccagatcgacatgatcatgctcgtccagccgatcgccgtgttccccaacgcgttcaccaccagcgaatagatgagcatcacaaggctcaccaggaaaataatcagtcccaccaccgtgatcatgcggatgggcttgatggaaaacgacgtgatcccgtcaaaggcaaagctgaccatctttttcagggggtatttcgactcgcccgcaaaccgctccccgcgcgaatattccactgtcgccgttttgtaaccgatctgcggtacgatgccgcgcaggaaaaggttcacctcaccgaactccgcaaggccctcaagcgcgcgcttgctcatcaagcggtaatccgcatggttatacacggcatccacgccaaaaaacttcaaaatcttataaaatgcctgcgctgtgttgcgcttaaagcccgtgtccgtatcgcggttgtttcgcacgccgtacacgatatcgcagccttccttgtatttttgcatgaacgcatcgagcacttcgatgtcatcctgcaaatccgcgtccatggaaatcgtcacatcgcacagttccttggctgtcataagccccgcgagcagcgcgttttgatgcccgcggttgcgcgacagcttcacgcccagcacatacgggtttgcctggtgcaactcaccaatgatctcccatgtcctgtcctttgaaccgtcgtcgacatacatgatgcggctaccctgcgccgccagtcccgccgcgaccatacggtttagcttgtccgtcaaacgctttgtcgtctcatgcagcaccgcctcttcgttataacatggaactacgatgtaaagtttatccatcttgtataccactcttttcaactttctttttttaatcgtactatattcgttctaaaaggtcaacgaaagaacacttaagaaatcccgagagcctcttccatcacttcgccggaatcactcgtataaattacaaaaaaatcatcctcatattctttcgtcatctcctgtaaagccggaacgaccggaagtaattgtgcttcttcctcttttgtcaagagcaagaatgttttcccaacatggtatcctgcctcataatatttctggggcgtaagccagaggaacggtcgtaatccaaggtcttcgtcctgcataatattggcgacttcaacttgtccgttacttaattcttccacaatgcctgcatcccaaaatgttgcatatccgaaatcataatcattttctaccaaataattgatagatgcttcccgttgctcattcagcgcattgttgactgtcacagtgtttttagatgcatagggtatgatatatgctggaaaaagcagcatgcaacataaaaagatactcactaaaatccgatccagtttaaatacagcttgatgcaaaaaaatcgccaaaaccggaatatacataataacgatcggaatatagtaacgcgcggtaaagctgtcctctgaaaatacaaagacaaacgtattaaacaggaatgaaacaagggcaaaaaggacaattaccctctgccctgaaagtcctgttgtttttgaattttttagaacccttaccatacatatgatacataaagcgatcaaacacaaactcagaatgttgagcaatccctgaaaggaaatcacttttacctcaggaagcacatcagcatatccaaaattgttcatagcgccttgcagcacaatagcaagacgatctatgaagttaatatctccataattcgcaaaaacagtatttgcctgtgttgtaaagtgatagatacccgtaagcagccgcgtattgattaaatatcccacaatacccagtacgaatgaaactaagctgaatataaaaagcttgccctcttttgtatggcaaacggaaacaaagttttgctttgtacactccgttcggaatgatgcaaacttctttgatcgaaataacaaccataatgcggtcagtaacaacgggatctgcattatcaaaatataacggcttccgctgattccattcacgaaggacagtaaaaaaaacaatataatccagataacatatttatattgtttttgctctttgatgatacgcaggatcaatcctaaatatacaaacataagtgcaatatgcggaatatagaatagccccactacagtaatttgcagttgaatgatatgaagcggaacaagcaggaacggcattgtgaaatatatccatttattttctacctttgtcccccgcatcataaaaacatatgccgccaacatcaaaacgtataatatcacactccctacggtccggatgactctccaatccgtaaaaaaatgaaagagcggcgccataaccaattgcgtgttgagtagtcttaactccgtcgtatagtaccaatttgtacttacaataccgccttcctgggataagagtttcgccaacatcatttcaccggacatatcggtatttaaaacattttgcgcatgctgatagatgaaccatgccatgattactataagaatggcggtcatactccaccccgcaaggcttaacccttctatccttttcttaggcatgcttatcgtttgcttcctcttcaatgttatcccccatttttatatcaaccgtcacaggaattattatacttaaaattaccggcaaagtaaattacacaaaacatggcgtgctggtctactgatttttatatattatttttttattattatatttttccattccgatgtgaagtaagccagcgccaccatccccgctgccagaaggaactgcacgcaaagctgcatgaagctcgcaatattgaacagaatcatcacattccccaacagcacccatactatcgcaagtgcaagcgcgtacagcaccggaaaaatgccattgtcaaacgccctgctcgcataaatacccgctgtaacaaacaacaaaaacaggatattaccgaaagagaaagctgtcggcgggaccacgaccgccagccgcgagaacaagagcacgcccgccagcgccgccaacgcgccggatacgatatacgcgaccagatacacgacaggccttgccgtcctgtcgcgctgcgcaaacggaatcttcagccgcgtcaggatcacgagcaaaaagacagccgcagcagccggagcaaaaaaggcagccgcacccacatgggacatgccaaccaaaggcgtgcccgtatcccgaagtgcctggtatggtaaaaacgtacagatcacgccgacgatcacgcccgtgaccagcgtgatcccccatgcgggcagtttcgtatacctgaccgccacaccgttcaaagcgccgatccctgcgcccgcaagcaacgcggcaatcagccccgcaacaatcccatacccctgcacagtgcatacgccgacgatccacatacaaagccccatgaccggcaaaacagaaaaatcagggcctttggcacgtacggaaaccgcgaccgcgcaggcgatgagcgccatccacacaaactgcatccatgtggcctgcgcatttgcctgtgtataaaaattggaaagcacactgccccctgacaaacaaacgatcaggatcgccgccacaggcaaaagccctgctcccgtattcaaaaacgtgtatttcttttccatccccaaaagcccccttttttccatcataccacaacccctgccaacaaaaaagaggacgttttcaaacgtcctcccttgctttacctgttattcccgttcttctttcctgcgcctgtgcgctacacaagcgcctattgcggccgcaccgcccatcaggatggccagccacaggtacggcgcgatatcctgcgtatcgcccgtcttggccgccgttgtggttttggtatcatccactttcgtgttcacagtcttcacgtcatcgttggccgttacaaggccgccgcccgcattgtttatgatggcgccgttatccgtaccgtccgttcccgtattcgtccccggcgttccgctgccgctcgggtcatcggtatttccgccgccgctcggttcgtccgctacgctccgcaggttggaaaccacatacggcgaagcatgcgcgatcgtatatgtgatatatccgtttgcatccacggtcagcacctgttcttcggagagccccgacgccccaacatagtaaagatataccgtatcgcccggcttaaagctgccgccgacctggtccattcttgtaatggagcacgggaatgccccgtcgtgcgtcaggttgataaacatcactgccgcatcagcgggaacgcccgccttggcctgctccgcgactgacccgctcaccgtattcgtgaatcccaaattgatatcctttaatttttcaggatcaacgccgcctgacaggtcgagcgtcaccgccgcagcgacgtttccgcttgcatccgtcatggaaaagactactgtctttgcgcccgtgccgtctgccgcggccttcgccgcctgttccaccacgtccgcgcttatcttaacatccttagcctcgtccgcgttctttgcttccaccttcactaccacggcctcatccggctgcgcgtttgcaagcgcgtccttcaccgcgccggaatcgaccgtattgtcctttacctccggctccaccacgacctgtgtttttccatccgtatccggcagtaccggctttgactccggcggttttatcactgtgacggtgcacgatgcactcttgccattgtacgctgccgccgtgaccgccgccgtccccggcgcaaccggcgtgaccatgcccttgtctaccttcacgacagattcgtcggacgatgtccatgtgaccgttttatcgtacgcgtctgcgggcgatacggccgcgctgagctgcccttttgttcccaactcaagggaaacagcgcccttgttgaggctcacgcccgcaacaggggtcacgatcctgtaccggtatgcgtccgtccccctgctcgcgccatatgaacctgtaacgcttccgtcatagacaggacgcgcccaatatgttccggccttcgccggtgccgccgcaagctgctttcctgccgcgccgttattgtccgcgtaatatacgaacccgaccaccggactctgtaccgctgcattgtttgcagccacgaccgacagatccttcatttgcagtaccggagcagcccccgtatattcaaacaggtcgctcaccggccctgcggcgcttatcgtcgtagcgtagcccgtcagcaacttgttacccacgcgtaccaacgaaacgtttgcgttgagcgcgctgtccggtataaagcactccggtcttacagactgcgcgtctgccgcgcttgccacttcgcagcccgccgccttgctgtatggcgtcacgccgatctgcgcgcccgcctccagccctgaaatatcgaccgtcatattcgccgtcgtcttcaggttacatgccccggctccatacttgttgcccgtgatctgcgtattgccggaaaggtacaccttaaagtttgcggccgacgaggaaccgcctacgctgccgtagctgctcacgctgtttcccgtgaccaccgcgtcgtgcagggtgaccgtgcaatccgccgccgtcacataaatactgccgtttttcgtattgttggagatcgtaccgccgtttacggtaagcatactgccgcttttgctcatcgatacgccgccgcccgcgatcgacgctccgtttgcggatatttcgccgccgttcatcacggctttcccgccgctgatcacaagcccgtaagcctgtttgctcagtgccgtcggctggcacgtattgtccgtgatcccgccgccgttcatttcaaatatcccatccggttccagccaaatgccggagttcacgttctgcgttatgagcgagccgtcgttcatgacgagctttcccgcgccgccggttccgcccgcgctgccaacgtcgatcgcgctgcgccccgaggacgtcgcacatcccttcactgtcgcgccgtttcctaaggtaagcgtcgagcccccctgcacattgaccccgctcgtcccgatccggttttcaccgtcgaccgtcacattctcaagcgtcacctgcgcgccattgtttaccgtgataatggaagtcgccgttatagtgcgcgcagcgccctcgctgcggatcgtgagcgacttgttgaaacttccgtatgttccatagccgatattatcttcgtcatatcccgtcagcgtggttgtgccgaacacaacatcgtcgcccagcagcagcgtatcgcccgaaaccgccttgttgaccgctttttgcagcgtatcatatacctcgccgctgcgtgcgttcttcacgccgtattccacaagcctggtcatttccgcgtccgcataataaggcatggtcttaagctgcgagctgtctgctgccgcaccgcctgtccgatatgccttgagcgccgccgaaaagtccggcttcgccgcgttccaataattctttgccgcgtagagcgtcccgtccagctctgtgatcttgatggcctgcgcgccgtcctcgcccgcagccagtgtgcgcgacatactgtttccggtaatgctcatgctcgtgttgtccttggccgtcaggcgcatcgcacgcccgccgcccgcaacatcggaatcccagttttgcaggatattgccggagatcgtcacatccccgcctgccgcgcctgtgatctggatgctgttgagcgtcgtattgcttatcttgtttcccgtaatgcgcgtcgtgcctgccgtcgcggacacccagataccagaaccgtttgccgccgtcacattggtgatggtattgttcgcgatcgtcaggttttcaggcgcgcttttcgcgtccaaattgaaattgatcgccgccgaccattcgctgatattttcaaaggtattgttttcgatcgtcaggttattgaggttcggctcgttgccccacgcgatcgcgtagatgccgctcttttcaaacttcaagccttttatgaccgtttttgtgttgtctccaaacggccccgccagcgtgatcccgcctgtgagcacggcgctgccgtcccccggcccttcgagcgtcaccgcctttgtaagcgtaacggcctcgtcgtatgtgcccccgttcgccgcgacaaagatcacatcgccctcgcccgccgcgtctacagcctgctgtatggttgcgtattttgcccccgccgtttcgttcgacacggacaatacctgctttacgacagatacgctgccatcaccgttgtttttgaccgtataaccgtccacaacatagctgccaatgcccgaatccccgctgccatccttgaacgtgccgcctgaaataaaggtcgtccctgtgttctgcgctttcaggagcgcgctgtttccgccttcaaacgtcccgccatggatattcaggcacgcgctcgcgttgatgccgccgtcgccgtttgtgttatcgtttccaatataaaccgcctgcctggggctggaaaaattccccccgtaaacgtcgccacttacctcaccgtcttcccccgccacatataacgcgtaaaaggaacgggagttcccctgctccgtggaaaaattcccgccgttgatccggactgtgccctgcactgccgcaacgccgccctggatccccgttaccgtcgcattattaatgaccaaccgtgctcccgcgcccgtgctcttgatgcaatacgcccagtttggcgtcgcattggaagatgtggaatggaactgtccgccgttgatcgtacaactgcctgaatttccgaccgcaaaagatgccgcgtctacaacgcagctttcgaccaccatcgtcgcgccgccggcgttatacagcgcgctgcctcccgtatcatcggtcgtgatataatgcccgccgtgtacggaaagtgtcccgttgttgcgaatacatccgcgcggcgcattgatcacagcgccgcccacggaatcagacacgctcatggttccttcgttcacaagcgggttcgcgatcgccgccgtaatggtacggccgcctaagtccagctccacattcgtatccgcgcccaccgtgaccgccgcctccagtgtaatgtcctgtatcaaaacgatacgcccgccgccttcggctgcgcttctcaattcctcttcatttgaaacctgcagcgcgccgtcagccgacaacgtcatcgccgccggctgctgttctgccgcgctttccgatggctccggctgcactgttgcagaagcgcttgcgtctgcctgcggtaaaatggccggtacttccggaggtccttcgcccttttcaggcgtaacggatggcgacggctgtgcagatgcggacggcgacgcgcttgccgtctgttccggctccggcgtctgttccggcgcaggagaaggtttcaagcccgcttcctgctgcgcctcctgtcctgtttgcatattttcatccaacggctgcgcgccggatatcccaaacatgccgagcaccagacatatcgcgagtaccgcagcaatcatatttttcttcatttcttcacctgtaattgaaaatcctgcatctgtcgttgtttcggcgcaaaggtgcgcgccttgatatggtacagggctttttccgcaatatccctgcaattaaaaatacctgcgtttgcaggtatggtatgttgcgttatgatagtcataacatactgcaacccggccatcctacgaaaacgcttagatccgtggctttgcgtccctgcctttcagcaggtttgctaaatataatattgcagactgacaatggcataaaatcgttgcattgtcaatcactcccttccattatacctataatttacgggaaagcaacatttattttggttaaaaatctcatacctatgatgaaaatattaaaatattgcaggtttgtaatattttaacgaaaatgtaagtttacagccattttgtcttatttgcacaaaaaaggacaggtcacatggcctgtccttttgtctgtctgttctgtgctt

SEQ ID NO: 14 - DNA, 73804 bp, Christensenella sp.
ctcgacctctagcgtgacaggctagcgttctaaccaactgaactaccaggccataaatataatggtgggagtaacagggctcgaacctgtgaccctctgcttgtaaggcagatgctctcccagctgagctatactcccacacattagcgctgaggtgtttcacacagcgcatgtattattttattataaaagatattacatgtcaatattttttatgaaaaaatacttatcttcttccctgcaattctccaaacaactcatcaagcgttaaacccttctcgttcatcaacaccaaaagatgatacatcagatcggcggcctcataacgtagttcatccgtcccctggtttttggaggcaataataacctctgcgctctcttcaccaactttttttagaatcttgtcgattcccttctcaaagagataattcgtataggagccttccttcggatgcaccttcctgtcggcaatcaaatcataaagctcataaagcaaagaagcgttgctgattttgccgttttcctgaaccagattgaaaaagcaggagtattcacccgtatggcatgcaacgccggtctgctccacctgcagaagtacgcaatcattgtcgcaatcaaggctgatcctgacgaccttttgcacattgcctgacgtctctccttttttccaaagctgctgacgcgacctcgaataataatgcgcataacctgtttccagcgttttatcaaacgcctcctggttcatgtaagcctgcatcagcacaacgcccgtatgcgcctcctgcgcgattgcagggacaagtccgtcttttccgaatttgatctttacatccatgtttaactcctaacggcaatatctttgccttttaaatattctttgacttcgcgaatcgtcagttctttatagtgaaacaacgaagccgcgagtaccgcgcttgcatcagcttctaaaatgacctcagaaaaatgctcgagtttgcccgcgccgcccgaagcgatcaccggtacgttcacgatatcacaaatcgcttttgtcaattcgatatcataaccatttttggttccgtccgcatccatgctcgttaataggatttcgcccgctccaagtgcgaccgctttttttgcccactcgatcgcatccagtccggtattgacgcgtccgccgttcaaaaatacttcgaacttgccgtcatcattgcgctttgcgtcgatcgctacgacaacgcactggctgccaaacttcagcgcggcctgcgaaataagctccggattttttacggccggggaattgatggagatcttgtctgcgccgcatttcaaaatacgcctgaaatcatcgacgctccggatcccgccgccgaccgtcaacggaataaagacctgttcggctgtcctcgagacaacgtcggccataatacccctgtcatcgcaggacgccgtgatatccaaaaacaccaattcgtcagcgccttgctcgttataagccttcgcaatttccacagggtcgcctgcatcctttaaatccacgaaattaacgccttttacgaccctgcctgcgtgtacgtcgagacatggaatgattctcctcgtaagcatatttacttagccgccttcagcgcttcttccagagtaaacgcatcgtcataaagcgcttttccaataatacagccgcatgcgccggtcccttttaccctttgcaggtcgtcaatgctgctgataccgcccgaagcgatcaggttgacccatgttttcttaacgattttttccgtattttcgatatccggtcccgtcatcatgccgtcctttgatatatctgtataaataatagtcctaacgcctaatttacgcatctgctgcgcaagctcgaccgcatcggtatccgttttatccgcccagcccttgatcgccacttttccgtccttggcgtctattcccacagcaatcctgtctttatattttgatacggcccacctgacaagctccggatcctctactgcaacagttcccaaaattacacgggaaatccccacttcgtccaaacggacacggatatcttcctttgtacggataccgccgccaacttgtacgggaattttaagcgactgcacgatttgggtaatcacttccctgttcacaaattcgcctgcaaaagcggcgtccagatcgacaacatgtaaatagtaggcgcctttttccgcccactttccggccatcgccaccggatcgccatattctgtggaactgttcatcgcgccctgcttcaaacgaacgcatttgccgcctttgatatcaatggcaggataaattttcatgcctttagccctccgaataaattaagcatctcaagacccgtttccccacttttttcagggtggaactggaatccataaatattttccttctgtacggcagaaacgaaatcatatccgtactctgtcgccgcaatcacattttcctccggcacatctgccgcatggtacgaatgaacgaaataaacacaaggcgaggctatatcgcccaaaagacggctatcgcgtgttttgagcgtattccaacccatatgcggtatcctaagtccagtatcatcaaacggctttacaatgccccgaataagccccaaggccttatgctcaccgttctctaaacttttgtcgaataacaactgcataccaaggcaaatacccaaaaaaggcttgcccgatttactctgggtaatgatctcctccgtcaaaccgcgcttgtttagattcgttatggcgtcggcaatcgctcccacgccgggcaacacaagatgactggcgtccttgatcttgcggatatcgttcgtcacgcagatatcgtatcccaaaaaagcaaacgctttctctacgcttctcaaatttcccattccatagtcgatgatcgctatcatagtaccccttttgtcgagaaaacgccctcaagctgcggatcgatcgcggcggcttcgcgcaaggcttgcccaaaggctttgaaagccgcttcgatgatgtggtgcgtattgcttccgtactgcaaattgacgtgtagcgtgattcccgcgttaaaagccacggcgcgaaaaaattcttcgccgagctcagcatcaaagtcgcctgttttaccttgcagaaaagtgacatgataggaaagataaggccgtccactgatatcgagggctgccatcatcagcgtttcatccatgggcacaaattttgttgcataacgccttatctgttttttatctccaagtgcgcatttgatcgcctcgcctaatgcgataccgcaatcctcaaccgtgtggtgtgcatccaccataaggtcgcctgcgcaactaagttccagatcgatttgcgcatgctttgtaaagagttcaagcatgtggtcaaaaaagcccacacctgtattgaccttatatcggccggcaccatccaggttcaatttgacctcgatattcgtctcgtttgttttcctctgcactgcgctttcccgcatgaaatttatcctctcaatcttcaaagcgtatcgcagcggacctggcatgtgcatccagtccttctgctttcgcgaatgtagcgaccttctgatattctttttcaaattcttcctttgagtagtatatcacactggatttcttttggaaatcgtcaacattgagcggagaagaaaaccgcgctgtgccattggtaggcaatacgtgattggtccctgcaaaatagtcccccaacggttccggcgaatattcaccaaggaagatcgaaccggcattttgaattttatggagcagccccatcggctcgcgcacgcatatctcaaggtgctcgggcgcgagcatattggagatcgaaaccgcttcctcaatattgtctgcgacgataatcgttccgtaattttccagcgatttcataacgatatcttttttgggcagtcgttctgcctgccgcaatatctcacctcgaacccgcattgctttttcttcggataccgttaccaggatgcaggctgcaagttcatcgtgttccgcctgggataagaaatcggcggcaatatatttttcgtttgcctcctcgtccgcaatgaccaatacttctgacggtcccgcaatcatatcgatacccgcctgcccatagatactcttcttcgccaaagcgacgtagatattccccggtcctgtgattttatccatttgaggaatcgtctcagtgccgtatgcaaaggcggcaattgcctgcgcgccgcccattttataaattttatcggcgcctgcgatcttcgcagccgcgatcgtcacaggatttacgcagccgttccttgccggtgtggcaactgaaatattcctcactcccgcgcatttggcgggaatgatgttcatcaatacgctcgacggatacgccgccttcccgccggggacgtaaacgcccgcattttccacaggtatataaagctggccgatcattttaccgtcctgctctaaaaaccaattctcgcgtttttggcggttatggaacgtttcaatgtttttggccgcttcctgcatgaccttgagcaaggaaggatcgaccttcaaaaacgcttcgtccatttcctcccgcgtaaccaatatgtttcccgcatcaacatcaaatccgtcaaattctttgatataggcaaacagggctgtatcgccacttttttttacgttggcaaggatctcatcaacgaccttttgctgggcggtataatcggtttcgctgcgtttgagcaaacggtttttcaactgttcgatgtctttcgaaaaaaggacaggcagcatattacatatcctccaatgcttcgccgagctttgtgatcagcggctggatcttttcggcctttgttttcagactcacctggtttacgaccagtcttgcgctgatatcgcatacttcttccagaatggaaagcccgttttcgcggatcgtcgtgccgctttcgacgatatccacaatgacgtcactcaaatcgaggatcggcgcaagttcgatactgccgttcagcttaatgatctcaatatcctcgcccttttcatcataatacatttttgcaacgcggggatattttgtcgctacgcgcgtgatgcttgacgtgatgcggtcttgcagtttctccctgtatcccgccacgcacatcttgcatttaccgcatttaaggtccagcatttcgtaaagcggcagccccgcttccagcaaggtatccttaccggcgatcccaatatccgccacgcccctgtatacatatacggggacatccgacggcttcaccaatataaaccgcagttcattttttttgtcgtatattaccagctttcgggtatcttccctcaattcggacgtatcaataccacatttcgaaaacagctctatcgcaaattttgcaagccttccttttgcaagcgcaattgtcaattccattctttttccctctcgtcaaattcgatgatacgatatgtttgcgcatcatattcgcttccattgagctccaggacagcttgcctgccctgtgccctaagttcctgcacatatgcatacgcctctttcctgtctttggcgctgcacctgatcaccgcaacgggttcctgctctctgcccaattttccggcctgctccaatacgagcagcacttccttgatccccatcgcaaaaccggtcgcaggagtacttgcgccaaattcgctcaacaggtcgtcgtaacgcccgcccgagaggatcggcgtgccaatggcgcctgatatgccgcggaacaagatacccgaatagtaattaaagttattcagtataccaaaatcgatcgaaatataatcgccatacccaaaatcgcataaaatgcggtatacctcttctatattttccacagcctgcatacacaactcgtttttagccagcttcttcgccctttgaaggacctcctgtccgccgaacagtctccccagttccagcaaggtacgttttgtcgctgctgggatattgaggcgggacagttcgtattccagctccacattatttttggtatcgatcatcaagcggattttctctgtctgctcttcactgagcgacacatcggcgatcagccccttgaaataagcgacctgtccaatatcaatcttaaattcttctacgcctgttgcaagcaggcattggatcgaaagcgcaatcacctccgcatcggcgtccgcgccctttttgccgatgagctctacccccgcctgcgtaaattccgtctttcccgcgattccatgattgaaaaaaccataggcattctggatatagcaaagccgaagaacgtcctgctggtttaataacttcgttgcagccatccgcgcgatggggccggtgatatctggccgaagcgccaatatccttccctgcaggtcaaaaaacttgatcatattctcctgcacatatggcaccgcgtcatgcatgaatacctcgtaatgctcaaaagacggcgtttcgatctcctgatagccgctcatcaaaaactctttcctgattctattttccactttacgcttggctgcgcattcctccggcaggtaatcccatgcgcctgccggcacttgtaatttcaacttattcatttgccgcttctttcaaataatttatcgtagtaaatcactaccacgatactataatagtataattaaatccgcttgtcaagcgcaaatcgctatcaattcagggcgatttcaatcattttctgctgcaatgcctgctgcgccgcatctgtcaccacacggtattctccttgaaactgcggcgttttcttcatgatcttcaaaacgtcccttgtttgttcaagctgccggatatcggcgatcaggttagccgccttcaaattacttgcgccatgctgtcgcgttccgaggatatcgcccgttccccgcatcctcatatcctgctccgcgatctcaaatccgtcgttcgtccccacaagcaccctcagccgttcataagccccctggttgtcggacactaaaaagcaataggattgcgcatccccgcgccctacccgaccgcgtagctgatgcaattgcgcaagaccgaaacgctcggcattgatgacaaccatgactgtcgcattgggaacattgatcccgacttcaatcaccgtcgtggaaaccaggatatcgatcgagcctgcggcgtacgcctccatgatctcctgcttttctgcatttttcattttcccatggataagcgccatccgaaatccggtataatattgcttcatttcatcaaaaatttgttttgcggactttgcctccatgttttcgctgtcttcgatcaaaggacagacaatataggcctgccgtttatgatacagctcatttttgataaaaccgatcatatccccgtacttattctgatggatcaaatacgtttttatcggttgtctccccggcggaagttcgtccacaacagaaatatccgtatttccaaagagcacaagctgcaaggaacgcggaatcggcgtcgccgacatgatcagcgtatggacatcgtttttatcgcctgaaagcgcagcgcgctgtttcacgccgaaacggtgctgttcatccgttataataagccccaaattagaaaagcatacatcgccgtataggagcgcatgtgtgccaattataatcttcgcttcgccgtccgcgatttttcgattggattctttcctgctttttgcgctcaaggctcctgtgatacaaacgatttccgcttccggaaataatgctttggcagtttcataatgctgcaatgccagaatttccgtgggagccatgagcacgctctgaaaacctgctttatacatgcagttcatcgcataaaaagccagcatcgttttaccgctcccaacatcgccctgcaccagcctattcatagccatgcgccctgcaaaatcttgcccgatctcatccatgacgcgtatttgcgcattcgttggccggaaagtaagcctttttaaaaattcatccttgttaacttgtgaaggatcgagccgtgccgcgctcttcctccgcttttcttctcccagcaattccatcatgcggttaaagatgagaagttcgtcaaatacgatacgtgcccgcgccgccgacgcagtttgcatatcctccggaaaatgcacgtcatgcaatgtttttttgatatccggaaggcggaattcatgtaaaaaagctgaagaatataattcctgcatccccgttttatacagggcttcttttatgaacttgcgcatcatattctggttcagccctgccgtaaggggataaatcggcaaaaaaggcgattccggctttttgaagtaaagctccggagccgaaatgaccattttcccaaatttgtattccagtttcccatataaatacagtgtctggcctacactgatattgttcttgatataaatctgattgaaaatatctacactcgcgatccccgtcgcatccgtcacctgaaaagaggtgatttccaatcccctgcgaatccgtttgacctgtggctgcgtaaatatttttacttccatgaaagcaagctcgccgaatttgacttcgctgatctttttcacgcttgacaggtctttatacgcgcgcggtaaatagtacagtaaatcctttaccgtagcgatatcgattttctgaagcgtttttgccgttttttcaccaacgccgcttatttgcgtgaccggaccgttcccttccatcaaatccccttcgacaatgaatgtatgtatctgtaataaaaaaccgacattatttcatgccggttttaaatgcctcaaaaattattctacggaaataatgtacggatataccggctgaccgccatagtgaagttccacatcacactgtgaaaattctttctccgtcaatgcaagaagctcgtccgccgtttcttcgtccacaccctcgccgtaataaatactgatcatttcggaatcgtcatcgatcattttttcgagcaatgcgccataaacctcgcttaatacaggcccgtttgcaacgatcgtattttcttcgattcccagaagctctcccagcttgatatccgtgccattgattttggtatcgcgtacagcatttgtgatcgatcctgttttgatcgtctcgatcgccctctgcatccgctttgcattcgcatcgatatctgcctccggatcataggccaccgctgccgcgattccctgcgggatcgtctttgactttagcacaataacattctttttagacaaatcggccgcctgttctgctgccaggataatattcttgttatttggaaggacgataatgttatctgacggtgcgctttctattgcgcaaagcaggtcctccgtagatggattcatcgattgcccgccttccacaaacatgtcgatctgccaatcctcaaagatggaccgtatcccgctaccggcgacgacagccacgactgcgatttctttttgcggccgctctgcaagctcgggtacgtctgtaatatccgaaagctcccgatgctgttcgcgcatattatcgattttgattttgctgagttccccaaggatctgcgcatactgcaatgcaagacccggctcgttggtatggacatgtgttttgaccaaattcaaatcgccgacaaccaaaacacaatcgcctattttggataaattattgcggtatatatcgatatcgcgttccttggtgtccgggtagaggttcttaacaaagaactccgtacaatatgcatactgtatgtcttcatccgttgcggcaaggttagaaaaatcgacgataggctcgctgtttgcaaggagatcgccgctttccactgcttctccgtccaatacggatttaaagcccatcatgatgaccagaaatcctgcgccgcctgcatccacaacaccggcttccttcaaaacaggaagcatttcaggggtttgtttcagcgttttctcgccctctgtaatgatgtgctcaagctgctcgtaaagatcgtctgttttctccgcaatctcttccgctgcatccgcggcgcttgaggtcacagtaaggatggtgccttcttttggcttcataaccgccttataggcatagtttacgccattcctgagcgcttccgccatcagccccgtcgttatctcctgctgtttttttacgatcgcatccgcaaagcccgcaaaaatctgcgataaaataacgccggagttgccccgcgcgcctttcaaagcccccaggctcattgcctggacgatctttaccacgtcttcttcctgctcgaccgcagccacttctttggcggcagaaatcatggtaagcgacatattcgtccctgtgtcgccgtcgggcacaggaaacacattcaaggaatccaatgtttccttgttcttttcaaggatcgcggcagctcccaaaatcatttcctttaaaagcttaccgtcaagagtttttatcaacctaggcttcccccttagaactgaattccctgaacgatgatatctacactggctacattcagccctgtttctttttcgatcgaatatttgactttgtctataatattctccgcgactgccgaaagtgaaacgccatatttaactgtgatatataattctacgacaacgttttcagaaccgtcggtctttactttgacaccctttttcagattatcgcctttaaaaagatttgtgatcgcttccgtgatgtttttctgggacatccccacaagaccataacattccattgcgctgattcccgcgatggaagcaacataatcttccgtatacgtaatggtccctaaatcgttttttaaagcagcactcataggtagaacctcccattggtttattattcatattatataccatctttttggcaatatcaaacgaatgagcctgttttttatgctgtaagcaaatttctttttcaaaacacttgcaaaatactcctagaaatgataaaattaacgctgtttgaaatgtatacaccaagagggaggtgttttctgatggcaaaatattgtgaaatctgttctaagggtgtttcttccggcaacaaagtcagccattctcacaggacatccaagaggatttgggctcccaatgtgcagcgtgtaagagtagtcgagaacggtactcctacaagaaagtatgtttgtacgcgttgcttacgttccgggaaagttgagcgctacgtttaatagaaaaaaaatgcagagcagacggatgtctgctctgtttttttacttctggttcttgattaccaatacatacttatcgctcgtcagcttcgcgcattcttttgtaagtacgttgcttatcccacgtggctggtcgtttttaagcatgagctcattaagcggataatatagcccctcatgcgcagtgacacaggcttcttcatccattgggatgagtgacactgtctgccctacgctgccatggatttcaaaacttcctttttcaagcaatatctcctgctgttcatcgcagatcaaaagtttcacattttgcttaaaagcgcgctttaacagcatcaaattggaaagcaagtggtcgatcctgcctcctgtggccccaaggaggatgatttcatccgcgccgcgctcaatggcggtatcaagggcaagcatcccgtccgtttcgtttttttccgtcggcatgcggtataatgggatatccatatccgtatagcgcttcaaaagttccgtatctacagaatccatatcccctaaaagcacatccggccggataccgcattcgtcaaacacgcatagtccgccgtctacagcaatcgtcagacctgctttgcttacaaaataatcaaccaattctttagatggcttttgccccgcggcaatcagtacagcaagcataacgtttctcagccccgcagttgcctgatggcagcaaccggatccttggcgttaaagactgcgcttcccgcaaccaacacatttgcgcctgcatcgacgatggttttgcagttgtcgatactcacaccgccgtctatttcgatatcaatatcttttccagtcgccataatcatcttgcgcaggtcagtaatctttcccagcacggcgggaataaagctctgtccgccatagccggggttgaccgacatcaacagtaccatttccacatcatccagcacatatttgatcgtttccagcggcgtcgcaggatttaagaccacggccgcttttgcgccgcaatccgtgatttgcttcagcgtcctctgcaaatgattggtcgcttccacatgcacggagataatgtccgaccccgcctgcgcgaagcgctcgacataacgctccggctgttcgatcatcagatgtacgtcaagcggcattttagccactttcttgaccgcgctgatcatctggaagccaaacgtcatatttggtacaaacataccatccataacgtcacagtgcacataatctgcgcccgcctgattgagcatttcaatatctctggccatgtttccaaagtctgccgataaaatagaaggtgcaatcttgatcattcttttctttcccctatcaaatttattaattttaagtatctttcgtaacggcttgcattgatttccccctgctccaccgccgttttaaccgcacatcccggttcctggtcatgtatacaggacgcaaacctgcattcccctgaatattcggcaatatcacgatagtattgacccagctcctgcttttccatatcgctgatatcaaacatagaaaaccccggcgtatcgacgatataagcgtttatatcctgtagataaataagctctgcctgccgtgtcgtgtgtttgccgcgttctgttttcttgcttaaaccgcctgtctcgagctgtaactcttcgcttaaggcattcacaagtgaggattttcctaccgcagattgtccggcaaggcaaacgcacttgccgcgtataatatcctttagctcctcgataccgtgcttttcaagagcagaaacataaatcgtgtcatagtacgaatactgctcgttgatcgcagcagcatttttcttgtcaacatctgttttattgatggcaagcaccggatggatgtgcagccgatctgcctgcacaagcattttatcacacaacaaaaaatcgatatccggctttccggcagatacgacaaaaatgacgctgtctatattcgctaccatagggcgaaccaactgatttttcctgggtaatatttcttcgatcgccgcatagccttccggctgtaattcaaatagcacacggtcgcccacacacggcgtaatcccttctttgcggaagcgcccgcgcgctttgcactcatatatggctccgttttcatcactgatataataaaatccgccgattcccttaataatcctgccctgaatgactaatttcctccttggaccttgctgaataccacattttgtgcagtcgttttcgtatcaagcgtatcattcaggaaaacgaccagttgcttattcaatgtctcatcgttggaatgaaacaccttttgtatatccagcggaatcgcttgccgccccgccgcaagcgtttgatcatacacaatataataaaccgaaatatcgttgatcgaaccggcgatcccaattttaaccgaagtatcgttgtttggaacggtaatatctattgttccgttgtaagcataaggcgtataatcgaactttgaaatatgcaggcttaatggcttgcttgtgatttgctcggtacctgccggtggatcctgggaaagaataatcccgcctttttctgcgctttgctcgtcatagataaagaatttttccaatccgtctgcttttagacgcgtaatggcatccgaaatctgctgtccttgcacatcggaaataactactttaagcgtatccggcgcttttttcactgtcagaataacgctgccgccattttccgaaacggaaccgcccgcctccggcgactggctgacgacagaattgataggagcatctccatccacctgctccaaaatacggctgacggtaagcccctgctctgccaataccttcttcgcctgctcaatatcgaggttcataacatcgggcatgatatccgcgcctgtcccgctgctcacgacaaaggcaaccggatcgcctttctttatttcagtgccttcgaccggatcctgtccgattacgatatctttttccgcctccgcggaattttcatatgttattgtcggcacgatgtcaagatttttggccatttctatagcgtttttctgtgacattccgacgaaattcggaataggctgcggctttgagctgttcacgctgatgatgccgctgactgcaaaaatgatgacgaccacgatcaaggcagcgatcccgtacgtcaaaacaagcttttttaaacttttcttcgagcggcgcgcatgcatctcttccatatgctgctgtgttcgtttgctctcggtatatttgatatacgccccatcgggttcattcaggcagcgctgcaaatcttcgtacatattgaaggcagacttataacgaaaatgtttgtccttttgggttgctttctggatgattttattgacgctttccggaacgccggagacaagtttggttacatcaggcatttcgtcattgatgtgcttaagcgcgatggcaacagaactgtctgcgtcaaacggcactttcccgcataacatctcataaaccaaaatacccagggaataaatatccgagcgcttatccgcccgttccccgcgcgcctgctcaggtgaaaaatagtgtacggagcccataacgctgttgtcttccacagtgatcgtattctgcgcaatattttttgcaattccaaaatcggcaatatatggctcacctgtcatatcaatcatgacgttatgcggtttgatatccctgtgtacaaagccttttacgtgggcgtattccagcgcaagacacaatttttttgccacactgatcacatacttaagcggcaaaggtccgttgatattgatcaggtgtttcagcgtttttccctcaatcagatccattacaatataatacgtaccgtgatcataacccgcatcataagcacgaataatattggcatgctttaatttaagcgatgcctgcacttcttttttgaagcgctgaataaattcctcattttccgttaattcgggcttcaatactttaacggcgaccgtttgctttgtcatttcgtcaaaggctttataaatataagcggaaccgcccgcatctatttgcttgatcagcctgtaacggccggcaaggagcatgtttggttcaatcatacctgcccatctcctttttcagcatactgtgcgatcaccacggaaatattgtccttaccgccgccctcgagcgcaatattgaccaatttctccgttttctcatccaaagtagcgccagaggccaaaacctgttttaataccagttcattcgcatagtttgtaagcccatccgagcaaagcaaaagcatatcgcttttcgcccaattaaattcaaaaaaatcaattttcaggtccttcatgcctacggcgcgcgtgatgatatttttaaacggataatcgtctgccgccttattcttaataacgccgctgtcaatcaggtattggacataggtgtgatcgtccgtcactttgcggatgccgtcgccattgaaatgatatgcgcgtgaatccccgacctgtgcaacaataatttcatcttcctgaacggcggcaaacgtcagagtcgtccccatccctttgagtttgtcgtccttgtccatctcattacgcaaagtcatattcgcaaaatcaatcgcctttaaaatgtcttcctttgtgaggatatccaaatgatgtttatcgatataatcacggatcgaatcacaggtgatcctgcttgcaacctcacccgccgcatgaccgcccataccgtccgcaaccatcatataatacggatgactgtccgtatggacaaggattgtgtcctcattgatcgtcctgattttgccaacatggctttttgctacagttttcataaacaatttcccttaccgccagatgtatattgttgtttaagttggccgcatgcccctgaaatatcgcttcccatcgatttacgtacagtagcggataatccggccttgttcagcttgtcgcaaaatgcgtacactttacgcgtcgctggcgctttcaatgttacgccaatgttactgttaagggggatcaggttaacatggcaattcaggcctgaaagcaaatttttcaagagcgccacatcctctgccccgtcattcaaatcttctattacagcgtattctattataatacgtctgccgctttttaaaaagtagttatttgccgcttttataatttctgttatcggataacggtttgccgttggcatgatttgcctgcgcttctcatcacttgctgcatgcagggatacggaaagcgtaaccggaaggtcttcctgcacaaattccagcatacgctccaccaatccgcatgtcgaaagcgagatattacgcatgccgatgccaagcccatttttgtcatttaccaaacgcaggaactttacaacgttgtcatagttgtccaggggttctcccatacccatcagcacgatattggtaatgttgcgcccttcgccctgcgcagcgtttaccgcaatgatttgcgccaggatttctcctgcgctcaaattcctcaccaagccgtttgcgccggaagcgcaaaaagcgcagcccatacggcagccgacctgtgtcgaaagacaaatagtgttgccataatttttttgcataaaaacgctttcaacgctgcatccgtcttcaaagccaaataaatacttttgggtcccatcctctgatttaagtactttaagggtgtttgcatacccttcacgaaacatcatctttagcttttggcgcagcgcgatggacaaatctgtcatttcatcaaacgttttcccttgcataagccatttcattacctgctttgcacggaaaggtttttcaccgatgcctgtcaacaattcctgtaattctaaaaggctgtaatccagtaaatttttcattttctttgcagcctcgccatatagaatccgtcaatttcattccggtgcggaaatagctgtaaacaatatccatctgcatattgcctcagggaatccggcagaaattcctgaatatcggctttcgaaaaatttgaatgattttctaaaaaccaatgcatgttctcttcattttcctgcttatcgatggtgcatgtggaataaaaaagcacgccgccgctttttacgtatctcgagcaggtgtccagtatcttcctttgtatatttatcagatcggcaatgtcttccgcctttttgaaaatcttgatatccgcttttcggtacaaaagtcccaaagcagagcacggcgcatctaccagaaccacatcaaatttttcttttaatgtctcatcatatttggttgcatccgtcacgcgaatatctgcattttcaatgtgcagcctttcaaatgtatttttgatcaggtctgcacgatgctcatgcagttccatggccgtaatatgcccgtccggcgtgaacactgctgcataggcgctcttccctccgggcgccgcgcaagcatcaagtacgcggctttcagtaccaatgccggccgcctgcacacacaacatagatgcttcaccctgcacggtaatgataccttccgcaaacatcggcatattctcaatattggatgcgtttttgatataataagcgtcaccaatgtatttgcctggtaaaaattgctctgtgtcgcaaaacttttctttgtcatgcacacgaatgcaggtaagggatggatccgcttcataagaaagcatctgctctgtaaaatcgatcccataatccgcaatatatttttcgcatagccatttcggataactgtaaaaaacatgaaagaactccgccggatcttctctgcggtcaggatatacgatttttcccagatttttggaaatattacgcaatacggcgttcacaaaccctttgagctgcggtttattactattgccgaccagctttacgctttcattgactgccgccgatacaggcacggattcaaaaaaagcaagctggcatacgcctaaccgcaaaatattcctgatcaccgtgtgcaaccgctttcccgttgtaaattgctgtaggatatagtcgatcctgtaaaggttctcgatcgtcgtatttacaagtgcggtaataaaccgtctgtcctcaatgggccatgacggttttagtgtacgcttcaattcaaggttcaaataactttggttttttagcacatcagacaatacatccaatgccacttgccgcgcattcaatcaatgttccccattcttttcagactgaaaccgatatccaatatcgattttcctgccgcgcaaactgtcttttgcactcatacgccttgccccttgccgttgtatctcttcgagcagtatcagtccatcacacgttttgacgcctagcccctgtttatcgtcggcaaaaacaactgtgccgcatttctcgcttcctgcataatcgcgcggcactgcacgaaatacctttactttttcttcgccgtacatcacgtatgcgccgggagcgggattcgtcccccttacaaagtttacaatatcagccgagttttgacaaaaatcgatctccccaaacccctttttgaacatcggaaaataggtcgcatcctcttctttttgcggcattcttcttagcgtcccgttttgaagcttttcaagcgtacgttttaatacccgcgcccccaaaccgctcaaccgttcgtaaagctgccctgccgtcatatcatctgcaatgtccgtttcgatctgctcaaggatatcacccgcatccaacgcgcggactgtatacattgtcgtaacacctgtttttgtttctccattgatgattgcccactggattggagcagcgccgcgcaatttcggcaataaggacgcatgcacgttgatacagccatatgacggaatatcgaggatttcctgcgtcaggatatgtccatatgcggcggtgatcatcaaatccggattaatggctctgagagccgcaacgccgccttcactgcttaccttttcaaactggtatataggaatacccgcttgctgcgccaaaacctttaccggcggcggaagttgcttatgtccccgccccgccttacggtcaggctgcgtaaaaactgcagcaacatcataattctcatctatcaacatttgtaaaacgggaacggcaaagtccggcgttcccataaatacaatcttaaagttctgtttcatgttcgtcctgttccccgtcgtggtcgtcatcatagatgcgctcaaccattttatcggtaaataacacgccgtccagatggtcgatttcatgcgcgaacgcacgtgccagcaagccctcgcccgtatattcctgctcttcgctgttgcggtcaagagcgcgcaccacgaccttctcaggccggatcacatacccgttatcgtccggcaaagaaaggcagccttcttcttcgcgctgtgtaccttctgcatgtacgatctccggattaatgagttcgatcagtccttcgcctacatcgatgaccactacgcgccgcaacacgccgacctgcggcgccgcaagacccactccgcgcgcttcatacatcgtttgcgccatatcatcaagcaaatcaataattctttggttgatagtaccaacaggtctggaaatttttctcagcctcgggttatccccctcaagtatcgttcttgtagccacttttttcctccgtttatgccatgcttaccggattgatatcaataccggtaagcacattatgataagaaaattcattaaaaacatcgtaaatcagccggatcaggtcgctctcgtcattttttagatgaatcagtatattataccgctccatattcctgatccgcttgatggcggcttccgctgccctgatacttattataccatgtttatgcggcaacaacacggtttttaatctgcggatgaattctttgaccgcttctaccacctgttcgtttttctcaccggaaaactgtatttggacgtaagtcgagaagggcggaagcattgccatttcacgcatttggatctcataaccgtagaatccttcatagtcgtggcggcttgcatagcgcaccgcatagtgctcaggattataggtttgcaggatcaccctgcccgcttcctttcgtcccgcgcgtcccgcgatctgcgtgatatgggaaaaggtccgctctgcgctgcggtagtctggaatattaagcatagtatccgccgcgagcactgccgacaatgtaacattttcaaaatcgaatccctttgtaatcatttgcgtgccgatcaggatatcggctttatgcgccgcaaactcttcaaaaatcttcatatgcgcgtcttttgtcgccgtcgtatcaaggtccatccgcaagatacgcgccttggggaacagttcctttacttgttcctcgatctgctgcgtgcctacgccaaaatatttgaggtgcggcttcccgcattccggacaaatctgctgcggcgtttttaccttgccgcagtaatggcatttcagaatatcctgcgctttatgatacgtcatcgtcacgtcgcagctatcgcatttcacgacgtatccgcatgagcggcacataacgaatgtggaatagccccgtcggttcaaaaacagcattgcctgtttcttttgcttcaaggtatctgcaagcgcttcataaagtgttccgctaatggccgtacggtttccgtcgcgcagctcaagacgcatatccgctattttcacatccggcaatttaaggtcaaacaggcgctccggcatcttcagaatctgaaattcccctttttgcgcacggtaatatgtttcgacctgtggcgtcgcacttccgaggatcaggtatgcgccgtttaatccacagcgcatttgcgctatttcatgcgcagtgtattccgggtaattatccgctttatagctcgtttcgtgctcctcatcgataatgatgacgcccagattttccacaggcgcaaaaacagcgctgcgcgcgcccagcacgattcgcgcctgtgagcgtttcaccttcatccattcgtcataacgctctcctgccgaaagtcccgaatgaaagacagcgatatcctcagcaaaacgctgctttaaaaaacggtatgtctgcggcgtcaaggatatctcgggcacgagcataatggcggttttcccctgatcgagcgcatcgcggatcgttctgatataaatctcggttttgccgcttcccgttacgccgtgcagcaaaaaggattttttgtcggagccgcggatggtatcaaggatctcctgctgcttatctgtcagcgtataatcttctatttgcttcacgtcctttttgaaaggcgtgcgcagtatttcttccttttctatacaggcgataccttttcgctcaagcgcatggacagccgaactattcaactcttttagcggaaagctgccgcatgttttcagcttttccaacacttccgcctgtcttaaaaatttcacttcgccattcggcttataaagggtctgctccgcttcttcaagcgcctttccctccaacaccagacgaacgatattttgggtcttcgcgccaacctttgccccgcgcaattgggcagggatcataaaacgcaacgccgccgcaagcgtcgtattatatttgtctttgatgaatccggcaagcgtgatctgttcctgcgtaagcgcgcaaaaatcttccaacggcctgccgatcggcttgattttttccggcgggaattccggtgtttcgcaaaggccgatcacgacgccctcggtcgtcttgttcttcccaaaaggcacgcttacgcgcatcccctccgcaatattcatttgctccgggaccagatattcaaataccctgtccacttgggtatgagaaatatccacgatcacttttgcgtacaatttttatatcctccgtgcttaaaaaaagcgtactgcgtacgcttttacttgagatgctttatgatttcgtttatgactaaggccgcaatatcatttttacttcttttcggcaaatggacagcctgtccatcttccacataaatcgatacggcgttatcgtcgctgtcaaagcccgtttctgttccggatacgtcgtttgcaacgatcatatcaaggtttttcttcttcagcttttccttagcatattgctcgaggttttgcgtctcagccgcaaatccgaccagatacgcttttttatctttacccacctcagccagaatatcgcgtgttttcacaagattcaagcaaagcgtttcctgctttttcattttatgttcattgcacagctctggagtgtaatccgctaccgccgcgcacatgatgatcacatccgcctcgtctttaagcgccgcgacctgcccgtgcatctgctccgcgctttcgaccgcataaacggaagcaccgggcggaggcgcaagattgacaggtcctgtcaccagcatcacttccgctccattcagcaaagcgctctttgcaagcgcatagcccattttccccgaagaacggttggtgatatagcgaacgggatcgatcgcttcccgcgtgggtcctgccgtgatcagcacttttttgcccgcaagtcccgcggatttttcctgcgttatttcctgcagaaaatcaatgatttcctgcggttctctcatacgtccggcgccggatgttccgcatgcgagccggccttcggcaggcggtatgatgatatatcccctgtctttcaaaatttgcagattcacctgtgtcgcgatattctcatacattgccgtattcatggcaggcgcgatcataatcggacaagtgcatgcaaggatggtcgtcgtcagcatattatctgcgataccgcatgcgagtttagcgatcgtattcgctgtcgcaggcgcgatgaccgccaaatccgccttttgggcaagcgcaatatgctccacttcccatggtttttcacgcgaaaacatatccgtggtaacagcattggcgctcaatgtctcaaaggtcaagggcgttataaacttcatagctgactctgtcatgataacgtctacttcagctcccgcctttttgatgccgcttgcaatatatgcacttttatatgcagcaatgccgcccgtaacaccgagcagcacttttttaccgttaagcatttatttaatcccgtctgtcaccctgatatacgtcaccttgtcgttcaatacttcactgactgcctgcgaaaccggattcggatcgattttttccgtgagcggctgcgcaccgtcaataagctggcgggcacgttttgctgtctctacgatcaacgtgtacctgcagtcgacctttttcagtaaatcatttaattcaagatgtatcatatttctttctcctaacttatattagcttttcattcccgcacgcctaagcgttttcacgtgcatggtgaataatatccattacttcacatacagctatgtcaaggacatcgttcacgacccgatgaccgtaacgctgcgcatattccatttccgccttggcttttccaaaacgtttttcgatctgctcatccgtttccgtacctcgacctttcaggcgtgccagcaaaacttcttcggagggaggcaaaatgaaaatcgttaccgcctgcgggtaattttcaatcacctgcatagcgccctggacatcgatctccagtattacattcctcccctgttccagtttacccagcacatattcctttggcgtgccataacatttcccaaacacatccgcatattccaagaaggcatgctcttcaatcattttctgaaattcttcatgggttttaaagaagtaatttacaccgtccttttcaccattgcgcggcatgcgcgtagtacaggatatggaaagctccaaactctcgtccttattaagcaacttttctacgatagttccttttccacagcctgaaggtcccgaaataacaatcaatttccctttttgtccatccataaaaatttcttcttttccccacttttttgtcagccgtcctgttcgtcgttgtcttttgaaacgatcctgtgggcaaccgtttccggctgtaccgcagacaaaataacatgatcgctgtccataataacgactgcgcgcgtccttcttccataagttgcatcaatcagcattccctttgcacgcgcttctgagatgatgcgcttgataggcgctgattccggacttacgattgcaatcaggcggttcgccgatacgatatttccaaatcctatattgatcagtttaatagacatccttttcgcctcctgccttctatttattcgatattttgtatttgctcgcgtattttttctatctcgccttttccggcgatcacaagattcaatatttctccatcctgcgttttcgaaccgatcgtattgaattcacgattcaattcctgcacgataaaatccatgttccgtccctgcggcgatgtttgctccccgcttgccttcatttgcttgacatggcttttaatacgcaccagttcttccgtgatattgcagcggtccgcataaaaggcgacttcctgcgccagcctctgttcgtcgacttgcgttccgtccagaatatctgcgatccgttccttcagcttgtttttgtattcgtccacaacgatatgctcttttcctgcaatggtatccacgtaggaaaggataaggtcgagacgatggaagatatcttttttaagctgcccgccttccttttcgcgcgctgcgcaaagctcccctgtggctgcttcgaggttcatatgcaacagctcttttaacgcgtcctggtctgcgttttcatcctcataggtcactgcatccggcaaacgcatcaactgtgaaaccgtgagatcgtccacaatacccgtcttggcgcaaatttcctttgcggcgcttaggtaagcggtcaaaagcggcatatccgtaattacttttttggcgtccgcgcgttccgatgaataattgataaaaacctcgacgcgtccacggctcaatgtcttttttaaaaatttccggatatcatcttccaaaaacatcatgaaccgcggctgccggatattgatatccaaaaaacgatgattgaccgttttgatctccacgcgcatcttcctgccatgaagcgctatttcactcttaccgaacccagtcatgcttttcaaagctaatccctcttcccctcaaatcgctgcaatatagtataccataaaatacatcaattagaaagaccgtctttccagtactttatacaattcatctgcgcggtacgacacaatttcccgtcttatgccatcggtaatgtcgcatatccccgcctgcgtgaccttcccaatgatcgtcgcacgcactcccgctttttcaagtatctccgtaactgcgccgccgtccttcgcggtgataatcatgctgccgcttgaaatcaggcccagcacgtcgatcccataccggtcgcatagcttccctgtcaccggatatacaggcactttgctaaagtcaatgtccgcgcctgtgcccgaagccatacacatctcgcaaattgcgcccttaaggccgccttccgttacgtcatgcatcgcggaaacgccgtcaacagtagcggcagtcgtcccgtccgcaacaacgctcagcgaatttttaatctgcacaagctgtttcttgtcttccgccgtcaatatgttttccaactcatctgaaaaatcgcttgcaatgatgcttgtaccttccagccccgcaaacttagtcataatgatatcttcgtccggcttcatatccgacgttttgaatatcctgcccggcacaacgggttttcccatcatcgtgaccgaggcaaccagacgcgatacgctgtccgttacttccgtgtgtccgccaatgatatctatcccaaggctgtcggccgtttcgatcatttgctgcatcaccatgctgatccgttcttcccctgccgagggcggtatcaataatgtgacaagcgcggcgatcggcttcgcgcctgctgcggcgatatcgttcgcattgatatggatcgcaagaatacctgtctgctcattggaagcggtgatcgggtctgtggataccacgcacaaatcgccgccgatcttgatcgcgcagcaatcctcgcccacgcctgcaccgacgaccgtctccgcgtttttgggcgtgatcttgtcgaggatcaccttctgcaactgttcgtttgttaattttccctgcttcatgctttatccagttctgcctttaccaattcgttgaccgttttggggttcgccttgcctttcgtcgccttcatgacctgtccgacgaagaatgtcattgccttggcgtttccacccttataatcggctacaggcttcggattatccttgacgatctgctgcacgagcaaaaggatttcgtctgcgttgtcgatctgtttcaatcccttttcttccacgatctgcgccggatctttgccggtcttaaacatttcttcaaaaacctgttttcccacgctcgaattaacgaccccgtcctgcaccagcttcaaaacatccgtcaaacccttggcggtaatcgggatatccttgggctcgatattattttcgttcagcagccgtgcaaggtctaccatgatatagttgctgatcgcctttgcttccggatagatcgcaacgcattcctcgaatagctttgccgtgtacttcgacatggtaaggataccggcgtcgtattccggcaaaccaaattccgcaacataccttacccgcttagcggcaggcaattcgggaagcgacgctttgattgacgcgatcctctcgtccgtgaggtatacgggcacgaggtccggatcaggaaaatacctgtaatcatgcgcttcttccttatcccgcatcgggaaggtctttccttttgcatcatcccagcggcgcgtttcctgtacgatctcgccgccatcctcgatcacttcaatatggcgttttgcctcatattcgatggcgcgctgcgccgccgaaatactgttgatgtttttaagttcactgcgcgtaccgtactgcgcagagccctccgggcgcacggaaatattgatgtcgcagcgcatagaaccttcttccatcttgcagtccgaaacgccgatatattccatattcgcacgtaccgtgtcaagaaacgcttttacttgcgcggcgttcctgaaatcaggctctgttacgatctccatgagcggcacgccgccgcggttatagtcgacaaggctttccgtcccttgatggacgagcttccccgcgtcttcttcgatatggatacgcgtgatcctgattttatgcttttcgccgtcgacatccagctctacctcgccatgcgaacatagcgggtaatcgaactgcgatatctggtacgctttcgcaaggtcaggataaaaatatcctttcctgtccagcttggaaaaatttgggatctcgcaattcagtgaaagtccggcgcgcacgccgtattccaccgcctgctcgttaaggacgggcagcgtccccggcatggaaaggcaaacagggcaaacgttggtgtttggcgcgctgccaaactgatttttacacgaacagaatatctttgtttccgtcgccatttcaacatgcacttcaaggcctattactgtttcatatttcatcgtcatcttactccatcataacgtcggttttttatcaaatttcactgcctgttcaaaattccaggcggcgcggaacatcgtattttcgtcaaatgccttggcaataatttgcaccgaaacaggcaagccttccttcgtaacgccggaaggcagcgagatcgccgtaacccctgcgatgtttacaggtacggtaaacaaatcgtttacgtacatttcaagcggcgtagacgttgcgcctaccttgaaagccggcgtcggcgccgtaggcgataacaaaatatcatatttcccaaacaggttatcaaaatcatttttgatcagcgttttgactttcagcgcctttaaataatacgcatcgtaatatccagagctcagcacataattccctaacatgatacggcgtttcgtctcgtcgccaaagccctcgctgcgcgtatttttatacatctgcttcaaatcgtcgtagtgctccgtgcggaaaccatagcggataccgtcaaacctcgaaaggttggacgctacctcggcggaagcgatgacataatatgccgaaagcgcgtaatcaaacgttggcagggatgtttcctctacgatggcccccataccctcaaacagcttgattgcgtcgaggtacgattgccttacttccggatcgattgcctgcgcaaggtactccttggggatgcctaccttcatgcctttgatgtcctgcttcatgccttcgccgtaatgcggatactccatgatcgcagaggtggaatcctgcttatcgttccccgcgatgatatccatcacgaaagcggaatcctctaccgattttgtcagcgggccaatttggtcaagtgacgacgcaaatgccataagcccaaaccgcgaaaccgttccatacgtcggttttaagccgaccaccccacaaaacgcagccggctggcgtacgctgccgcccgtgtcggagcccagtgcgaaaatcgcttcgttcgcggcaacgcatgccgcgctgccgccggacgagccgcccgggacgcgcgatgtgtcccaagggttttttgtcacgccgaaataggaggtttccgtggaagaccccatcgcgaattcatccatattcgccttggcgaccattacgtaatcctcagctttgagtttttcaactacggtcgcatcataaacgggcttgtagttgtaaagcattttggaggacgccgtagaaagcactcccttggtacacatattatctttgatgatcgcagggattcccgcgagctttccaagcggttcgcccttagcacgcttctcgtcaacttttttagccgccgtaagcgcctgctccgcgcatactgtcacaagtgcgttgatttccggctcgacagcttcaatccgttcgatgcaggccttcgtcagttcctcagaggaaacttcttttttcccaagcagctccgctgcctgctttatgtcaagtgaattcaattccatgcgttcctcctcagtccactaccttgggtacgacaaagcagccctcgtccgtttccggagcatttttgagcatatcttcccgctcccacaccttgccgggcacatccccgcgcacgacattttgctgttttaaaatataactcgtcggctcaacgccttccgtatcaagctcattgagtttttccgcatgctccaaaatatcgtccagattcttttgcagcattttctttttgtcgtcgtctaagctcagcatcgaaagcgatgcgatcttttctacttcttccatcgttacacgcatacaaaacctccatataaaagttacaaacattaataatttattatatcacaaatcagcttccggacgtcattttttcaaattcttcttccgacaggatcgtaacgcccaatttttgcgctttttccagcttgcttcccgcattttcccctgccagtacataatctgttttcgcgctgacagaagaattggcgcgtccgcccaatttttcaatcagctcctgcgcctgtttgcgcgtaaaacgcgtgagcgtacctgtcagtacaaacgttttcccctcaaagataccgccctgcggcgcgccttcatcgtctatcggcataatacctgcgtcaaacagctcctgcacgacgcgcatatacgtttcgttatggaaaaaatctatgatatcctgcgcgaccacgccgccgatatcatcgatggctaccaattcatcatacgtcgcgtttttgacgccctcgtaagtgcggaatacgcgcgctaaatccttggccgtcttctttccaacattctcgatccccagcgcgtagataaaatgggcaagcggcggctttttgcttgcctcgatcgccgccaaaatattatccgcgcgtttgtccttgaacccttcctgctcaagcagttgctcgcgttttaacgtataaatacccgcaatatccttgatatcgagtttctcaaacaacaattctatcgttttgtcgctcaaatgctcgatatccatagcgtcgcgcgatgcaaaatgcaccatgcgcgatgtaagctgcggcttgcagctcagggaattgggacaaaacaaattcggcccgatctcttccagtttcgtaccgcaggccggacaaaattccggttttccaataggtatcagctccttgtcctgaaccggcgacgcgccgagtatttccggaatcacgtcgttggagcgccggataaagacagtcgagtgcagcgcaacgtttttacgcttgatgtcctcaaagttgttgagcgttgcgcggcggatcgtcgctcccgccagctctacgggttccacatgcgcgagcggcgtcagctttcccgtccgcccgacatcccatgtcacgtcaaggatttccgtcgtcatctcttctgcgggaaatttatacgcaatggcccagcgcggaaatttttgcgtatagccaagcgcctcgcgcgttgcgaaatccgtgattttaacgaccattccatcgatcagaaaatccaaggtgtcgcgcgttgcttccacctgatctaccgcggctcccaaatccgcaacatcgccgaatgatttctcgtaatcactgacatggaatttattctcacgcaaaaaatcaatcatttcaaagtggtttttaaatgctatcccttcaatataaccgacattgtaaataaatgcatccaaacagcgcttggccgtttgcgcggggttcaggttccgtatcgcgcctgccgctgcattgcgtgcatttttaagcggttcgtcatatgtcctgttgtattcttccagcgtagagagatgcatgatagcttccccctgcacttccattttccctttaaaatctattttaagtgggatggactgtattgttttcacctgttgtgtgacatcttcccccacttctccgtttccacgggtagcggcgcctgtcaaaaaaccgccgtcatacgtcaggttgatggtaaggccgtcaaatttatattccaaagaataagttgccggtggaaggccaagctgcgtaatctgtttattggtgcgctgctgccactgctccacctcttcaaggctttgcgctttatcaaggctccacaaaggcgcgatatgcgtatgctttgcaaagccctccagaagctttccgcctacgcgctgcgtcggggaatccggctcgatatgaccgcttgcctgctccagccctgcaagctcgtcatacagcttgtcatattgcgcatccgccacagccggatcatccagcacgtagtagcggtaagcataatcattcagcttgtcgatcagttctctcatgcgttccattttgatatcctatttcagtattttcagggaggcaaaggccaaaaacatctttttttctcctgcctcgtaaaaatcaacgaccgctacctgcgcctgccctgcgcctgcgatcgatttgatttttccgcgtccaaacgttttgtgctccacaaccgttccaatacggtactccccgcttaccttttgcggcgccgctttcttgccgggcaatgtaccgctgaaaagcggttttgcatgcgccccctcagcccttcgttcagaaatcaccggtttcttcgccttgccggtacgggtaaccatgtcctcatcaatctcatccaaaaagcgcgacgggacggatggctgtgtccgtccatagagcgtgcgcatctgtgcatgcatcaggtacaggctctttttggcgcgcgtcaccgcaacataacacagcctgcgctcctcttcaatattgtcttcgtcgatcgcgcgctggctggggaaaatactttcatccatccccgcgacaaacactacgtcaaattcaagtcccttggccgcatgcatagtcatcagcgtgacgccgcccttatcatccatgctgtcaagatcggtgatcagcgcgatgttctgcaaaaagccttccagcgacgcatcctcctcctgatcgtacgtataagcggaattgatcaactctgcgatattttccatacgcgcttccgcttcgggcgattggtccgcttccagcatcgctttgtatcctgaaacatcataggctcgttccagtatctcatgtacctgcatatcggcatagccgacgctcatctcctcgtatatctcataaaactcttttgcctttttattaagcgctttatcctcgatcaaaacatttgcgttctgcatcacgtccaacatggaaatgccgttataggcggcgatctgcgcaagcgcggtcacctttgcgtctccgatggcgcgtttcggcatattgataatacgcgtaagctggaggtccgccgcagggtttgcgataatattcaggtacgccaccatatccttgatttccttgcgctcataaaagctgatgccgccataaatgcggtacgggaccgcgtacatacgcagcttttcttccagtattctggaaagcgtatggatgcggtacaaaatagccatgtcggcatagcgtaccccttcgtccgacagtctttgtatctcccgcgcgatggtctccgcctcgtcaaattcactgttcgccgtatacaggatgggtttatcgccgctggtgatttcgctccataacgtcttgcctttgcgcccttcgttgttcttgatgacacagtttgcaacgtccagtatttttttatccgaacggtagttctgctccagccttatgaccgtagcgcccgggaaatccttttcaaattcaaggatattgcggatattcgctccacggaaagcataaatggactggtcgtcgtcgcccactacaaagatattgccgtaaccttccgaaaggattctgaccagcttgtattgcaccatattggtatcctggtactcgtctaccaggatataacggaatttattttgataaaaggcgcgggcttcctcgtctgtttccagcagtttcagcgtattcaaaagcagatcgtcaaaatccattgcattctgctttttcagttcattgtggtatctctcatatatttcccccgcatgctccgcgataaaaggatttttgagctccgcatagccgtcgaaatccagtgtggtgctgtcgtttttatatttactgatcaggttcttcatatagcggtcgccatatgatttgtcttccttcagtccgagggcttccagtattttcttgatgatgcgcagggaatcgtccgtatcatagatcaggaaatttttcgtataccctactttaggcgcatacttgcgcagcatacgcatacacattgcgtggaacgtgctgatccacatatcgcgcatatccactgcgatgatgcctgagatacggtctttcatctcttgcgccgccttattggtaaacgtgatcgcaaggatctgccacggggcgacattttcctcgttgatcagatatgcaacgcgctctgtcagcacttttgtttttccgcttcccgcaccggccagtaccaacaccgccccctgcgttgttgtaaccgccttttgttgtttgtcgtttaatgtctgcaaaatcattctccctgttttttgtttctgttaaggatcaggtcatagccgccgctcccataattcaggctgcggttcacgcgtgaaatcgttgcggtcgaagcccccgtcttttcggcgatcgcatgacatgtcgttttatcgcgaagcatatgcgccaccttgtatcgctgcccgattgcagaaagctctgcgaccgtacacaaatcctcaaaaaacatatagcattcctcttcgttttcaagggataaaatggctttaaaaagctcgctcaattcctttgatttcaatttcgattcatacatagtaaaacacctctcaatgcaaaaatgcaggtatcataatcatacctacattttaacacattactacgcgaaaaaaaaccgctaaagttccgcttattcaaatatattcctatacaatttcacagcgtcgttgcccatgatcgccagtacgacctgctctccctttgtattgcgcgcatcctgcgggatcgaatccgtcataagcttatgcatgtctcctgatttttgtatcacggtgactttggatatctgatgaagcagcaaagcgcctatgatcgtcttaccggtattgtcattcagcaaatacgccttcagcccttttccgttgcgcccttgctcttcaaattcgctgatgggcgtgcgttttgcatagcctttttccgtcatcaacaggatttcaccatcctgtccgttttcgatctgttccgcaaaaacaagcttcgcatgcttgccgagtttgattgccccaacgcccttgccgctccggcccatcacggaaatctcttccttcctgatgttaatggacatcccttcggacgtaataaagagtatattatgcgtatcagcgtccgacggttttgcataaatcaattcgtcgccgtcttttaggccgcacgccatgatcttggatttctttacgtcgaattccttcatgtccgttgcctttacaaggccgcctgccgtcgcaaagtacatcagctttttctcaaaatcggccctgatgatgatattcaaaatttcttcacctgcatcaatgccgggcatgagtgcgtttaaggacttgcccgtttctttcatgcgtgcttcaggcacgcttagaacaggcatcataatcatattccctttattggtaaaaatgtatagtttgcttgcggtatccgtttgcaggagcatattcggctgcatcttctcatccagctcgcccgcttcgatccccttttgcagcgctttttgcgacatgcgcttcaagttgccgccgcgcgtcaaaattattgcgcagtcctccacgaccatgaattcgctttcgtccacctcgatattcgcgtgttcctcattcatgagctgggtgcggcgtttatccgcatatttgtcgccgatcgcggtaagctcatccttgatgacttcgagcagcttcgtctcagaaccaaggattgaccgcagatacttaatcagcgcaaccacttccttatattcgttctccaaaagctcgacttccaggttcgtaagccgcgcaagacgcatatcaaggatcgcctgcgcctgtatccccgtcaggttaaactcctgcatcaacgacctttttgcttcctccgaattcttggaagcgcggataatcttgatcacgcggtcgatgtttttaactgcgataatgagccccagcaggatatgctcccgtttttcagccttttccagatcgaactgcgtgcgtcgcgtgacgacatttttctggtgcgtgatatagtgatcgatgatagataagagcccaagctgtttgggggagccgtccgcgatcaccatcatattgataccaaaggtcgtttgcagatcggtgtacttatacagcaggttcagtatcttttcaggatcgtgccccttttttatctcgataaccgcgcgtacgccttccctgtcggattcgtcgcgaatatcgtcgatccccgcaaacagttcctttttcgactcgctgacagaaaggatcttttccagcattgcggatttcttgacttcatagggtatttccgtgataacgatcaggttcttaccagaattcgttttttccatatgtgtttttgcacgaatcagtatcttacccctgccggtctcgtaagcctgttttagcccttcgccgtccaaaagataaccgcccgtcggaaaatccggtgccttgatatgcttcatgacgtcttttaggctacattgcgggtcgtcgatacgcgttaccacacctttgatcacttctcccagattatgcggcggtacgtttgtcgcaagccctaccgcgataccggacgacccattcaccagaaggttcggataacgtgcaggcagcatatccggctcgcgctccgtatcgtcaaagttcgggcggaaaggaacggtatctttatttaggtcgcgcagcatttcaagcgcaagcggcgaaagccgcgcctccgtataacgcatggcagcagcgctgtcgccgtccatagacccaaagtttccgtgtccgtcgacaagcggcatgcgcatggcatacggctgcgccagcctgaccatcgcgtcatacacgctggtatcgccgtgcggatggtatttgccgagcgcctctccaacgattcttgccgacttcttgaaaggtttgtccggcaggattccaagatcgtacattgtatacaggatgcgcctctgcacaggctttaaaccgtcctctacgcgcggcagggcgcgttccatcgttacatactccgcataggtcataaaagaagtatgcatgacctcctcgagggctgcgtctacaatttcctcattgaatgcaatctgcttagtcttcatattgcgttacctcaaaattatcctgcttgttgaaatttgcatattctgcgatgtattgcttgcgcggctccacattgtcacccatcagcgtcgttacaatattctcgacatccgcgaggtcctctatcgtcacgcggataagcgaacgtttttcaggatccatcgtcgtatcccaaagctgctccggattcatctctccaagccctttgtaacgctgcaccgtatacccgcgcccaacttccgttttcgctttctcgagctgctcctcgttataggcatacagcaccttattgccttttgcaatcttatagagcggcggacgtccgatatacaaatgcccgtctgtgatcaggtccttgaaataacggtagaagaaggtgatcaaaatcgcacggatgtggccgccatcctggtcggcatccgccagaataatgattttattatatttcatattttcgagcacgaagttatcgtcgaagcctgcgccaagcgcggtaatgatcgagcggaattcttcgttggccaaaacctgatcgacccgcttcttttcgacgttgagcggctttccgcgcaatggcaaaatcgcctggaaacgtcggtcgcgtccttgtttcgcactgcctccggcgctgtcgccctcaacgataaagagttcgttaagttctgccttcctgcccgtacatgcggacagcttcccgacaagcggcgcgctttccagcttgctttttgcgcgttccattttcttggctttgcgtgccgcgtcgcgtaccttcgcagcggcgatcgctttttccaatatcttggtgcacatctgcgtattattgaggtccgccatgaatgcggatagcttttccgttaccaccgcctccactgcaacgcgtgcttccgcattgcccagctttgtcttggtctggccctcaaactgcacatccttcatcttgatattcacgacagcgcacagcccctcgcggaaatcatcgcccgtgagattcgcttccttttctttgaggaggttattcgtacgggcataatcgttcatcacctttgtgatagccgttttgaagcccgtttcgtgcatcccgccctctgtcgtcgggatattgttgacatatgaaaaaatactttccgtatagctcgaattatattgcattgcgatgctgaccaaaatatcgcccttctgcccttccagtaagatcggcgcggcatgcaggggcgttttatccctgttgagatacaaaacaaaatctacaataccacccgtatattcaaacatctcctttttgggacggccgcccacttgttcgcgttcgtccacaaaagtgattttcaatcctttggtaaggaacgcaagctcgcgcaaacggcggcgaatggtatcatagctaaaattcacttcgtcgaaaatggtatcatccggcaggaaggtcacctttgtcccatgctttctggattcgccaatttctttcagcggcgcaaccgcctgccctgtatgcagttttcctttggcatcgatttccgttacgtaacgctgaaaatataccttgccattttggtatacttccacttcaagccacttggaaagcgcattcacaacggatgcgcctacgccatgcaacccgcctgagtaagcataattttcattgttgaatttgccgcccgcatgcagttgtgtaaatacgacctccactccggaaatcttaagttccggatgcagccccgtcgggatcccccgcccgttgtcttctactgatatcgaattgtcaggatggatcgtcaccagcaatttatcggcataattattcgccgcttcatcgatcccgttatctacaatttcccaaagcaaatggtgcaggcctttgatgctcgtcgtaccgatatacatccccgggcggcggcgtaccgcatccaggccttccaatacctgtatatctccggcggtatacgtttttgacatgttttgtcctccgaaaagtaccatattatgttataaatcctgtataattatatatcaaaccacaaaatatagcaaataaaaaagggcggcatttttgccgcccttcatttttggcttaggaaaccgattcctgttccggttccgcagtctttctctgttccaatttgcttggctccggcttttcacccacgaccagcattggttttttatttttgatcgtatcttttgtaacgacacatttcaggatatcgttacgcgacggaatatcgtacatgatatccatcatcgagctttcaatgatgctgcgcaaaccacgcgcgcctgtctttctctcgatcgcaagctttgcaacctcctccagcgcgtcatcgtcgaattcgagctctacgccgtcgatctcaaacaactttctgaactgcttggtaagcgcatttttcggctttttgagaatatccatcaaggccgccttatccagcgaatgcaagttaacgaccaccggcaagcgtccgacaaactcaggaatcaagccgtaattcagcaaatcctccgattctatcatctcaaacagctgaccgatatttttgttcgttttactttgcacgtccgcgccaaagcccatggacttcttaccggtacgacgctcaatcacgtcgtcaagaccgtcaaaagcgccgccacagatgaacaaaatgttcgttgtgtcgatctgcaggaaatcctgatgcggatgctttcttcccccttgcggcggaacgcttgcaaccgtaccttccagaattttcaatagcgcctgctgcacgccttcaccggatacgtcgcgcgtgatagacggattatcgctcttgcgtgcgatcttatcgatttcatctacatagatgatccctttttgcgcacggtcgatatcaaaatccgctgcttggatcagctttaaaagaatgttttctacatcctcacctacatagcccgcttcggtcagcgatgtcgcatccgccatcgcaaacgggacatcaagtatccgtgccagagtctgcgcaagaagcgttttaccgcttcccgtcggtcccagcatcaatatattactcttctgtatttccgtaccatcgtccgcagtatcggcattgatccttttataatgattatataccgctaccgcaagatactttttagccttttcctgcccgatcacatagtcatcaagcaaccttacaatttccggcggcttcggaatatcctttaactcgaattttgccgcttccttgaattcctcgtcgataatctccctgcataattctacgcattcatcgcagataaatacgccggggcccgccaccaaacgctttacttcatcctgcggtttcccgcaaaaggagcatttgatctgcttcttatcatcgccttcataattatcgtacatgtttcacctctaaacgttatcgtttcgcaggtatgatctcgtctacgataccgtatgcaagcgcttcatcagccgacataaagtaatcgcgttccacatccttctggacttttttaagagactgacctgttctttcgctcaggatcttattcatcttatccttgatatccaagatcctctgcgcatggatagcaatatccgtcgcctgcccctgcgtaccgcccaaaggctggtggatcataatttcactgttcggcagggacttacgctttccttttgcgcctgccgccatcaggaacgcgcccatagacgccgccatcccaatgcagatcgtgctgacatcgcacttgatatactgcatcgtatcataaatcgccatgccggctgtaatggaaccgccggggctgttgatgtataaataaatatccttgtccggatcatccgcttcgaggaaaatcatctgtgccaccacaagatttgcggtaatatcgtcgatttcccctgtcaaaaatataattctatccttaagcagcctggaaaaaatatcataggacctttctcccctgtttgtctgctctattaccataggtactaaactcataaagggtcctccctcctttgatgtacgcctcgcgtatatctttttatattattcttttgtagtcgcttttttcactgcaggctttttttctgtttttttagccgcaggcttggcgtctgcctttactgtttcttttttggccggcgctttttttgcggtcgtctttttaggctcctttttctcagcgtctttcttcgccttttccgcctgttccttctcccatgcctttgcatctacttcctgcacttcggccttggatacaagataatcaaacaactgctccatcgcaacacgatccttgaaataatcaagctcctgcgcgcccagcgcgtccttatattcctgaactgtcttgttttccgcttttgcaagctcttcgtatttcttttcgatatcttcctgcgtcggatcgattttcagttgttcgagaagcgcttccacagcaaggcgcattttgacctgctgggctgagccttccctgtattccttacgcagatcgtccatcgtcataccgatgtactgtaggtaatcttcaagtttcataccctgatacataagctggtatgaaagctgctgcacctggtaatcgatctggttatccaccatgacttcagggatatcggccttgatgccgtccgccaccgccgtcaaaagttggttttccatctcggcttttgctttcatgtcggcgcgttcctgcatctttttcttgatatcttttttatagtcggcaagcgtatcaaattccgacacatcctgcgcaaaatcatcatcgatctccggcagctctttttctttcaccgtatgcattgtgattgcaaacacagcgtctttccccgccagttccggtgtataaccctccggaaatttcacattgatatcgcgctgctcgccggctttcatgccaatgatctgctcttcaaatccggggatgaaacgtccttcaccaagcacgagcgattgctcttttgcctcgccgccctcaaacggaacgccgtcaaccgaacctaagaaatctacgataaccgtatctccgttcttcgaagcacggtcgacttctacccatctcgcattctggtcgcgcgttttttcaacttccgcgtcaacctccttagccgtgactttttcaaccggttttttgacctttaagccttcatatttaccaagctttacttcgggttttacaaaaacctccgccgttatcacgacgccgtctttcttgtcaatgctcaaaacgtcatagtccggtctggaaaccacgtccagtttattttcttcgactgcctcacggtaagcttcggggatgatctcgtcaagcgcatcttcatagaacacctgcggtccgtagaagttctcgatgatccctctcggagcctttccttttctgaatccgggaatgttgaatttccctcttaatttttgatacgctttctgaatacccgcttcaaacttttcacccgaaacagtgatttcaagttttactttattgccatccagcttctccagttttgcagtcatatctttcctcctaaattgctacaatgcttacaaattcgtagaacaatacaggaaacagtatactatatttataccccgcgcgcaaccattattaacacattctgtaattattcgtgcaccaaacaccgtttgccgtttccgattaaatcgtcccgctccgctttgcgcaaagccttctttaccatcgccctgtttttgggatttttatactgcaaaagcgccctttgcatttccttttcctctggcgacttggcaacatatatcttttttcctgtgactgggtcgatccccgtataatacatacatgtcgcaagcgtacccggcgtaggataaaagtcctgcgcctgctcgggcatgaaacccgtatcccttatgaattccgcaagccgaaccgcatcgcctaagctgctgcccgggtgcgacgacataaaatacggcagcacatattgctttttattcgcgcgtttcgaggccgcctcgaatttttggcagaatcgccggtatttttcgatatccggtttgcccataacgtgcagcacatccggactgacatgctccggcgccaacttcaattgtccgctcacatgataggccgcgagctctcggacaaattccccgcttttgtcaagcagcgcataatcatgacggatgcccgaacggatgaatacctttttgatccccttcatttcacgcagcctgcgcagaagatgtaaatacttcgtatggtcttccttcaaaaacctgcatttttccggcgttaaacaacggcgcacactgcaccgccccttgggattggtgcatgtaaggccataaaaatttgccgtcggcccgccgacgtcatggatatatcctttgaattctttgtcatgcaggaagatatccgcttcacggacaatgcttttttcactgcgccaagaaacatcctttccctggtggtaatagagcgcacaaaacgcgcatgcgcctgcgcaccctcgtgttgcggtaatactgtactgtacctccgacagggcgggaatatcctggacatacatcggatgcgcttttcttgcatacggcagcgaatatacgaaatcgagttcctgctgcgtaagcggcggcgcaggaacgttctgtatcacgaatccttcattttgctgttgcacaagtacatgatccctgtcgtacatctgctttaaaaaggcttttgcatatactgttttattaccttttacctgtttataggacggtaatgtttcatattcgtaaacgcgcgcaaggtctgcggcacggtatgccgtcccctccacataggtaatgtcgcgcgcagcaagccccccgtccagcgcctctgccacctggacgatcgcccgttctcccatgccgtatacgaggatatccgcgccgcttgcggaaaggatagacggcttcacatcgttggcccaatagtcgtaatgcgcaaaacgccgcaggcttgcttcaattccgccgatcacgaccggaacgtccccatatgcctcgcgtatttttttggtataaacctctgtggcgcgctccggccgtttgcccatcttcccgccgggcgtgtataaatcctgctttctcctgcgcttgttcaccgtataaaggttgaccatgctgtccatgtttcctgcgctgatcaaaaaaccgagcctgggccgtcccagcacttcaaacgccgtcgttttgcgccaatccggttgtgcgatgatgcccacagaatatccatgcgcgaccaaataacgcgaaataatggcatgcgcaaaagaaggatggtcgacatatgcgtcgcccgtcactaaaataaaatccaactgctctattccagcttttttcatatcgcccttattgacaggcaaaaatccatccatatggctccttatgcgatgttagtagaaaagcctcttaaaaagaggctttcaaaaacattttgagacaggcctataagccgggttctgttttgatggtcatctatctaggccgcctgttaccaaacggctcatgcgattacagaggacttggcgggccgccattgaatgtccccatatcaatcttgcaccagacggggtttacattgcgcgctaagttgccaaaacgccggtgagctcttgcctcgccttttcacccttacatccagaagatgcggtatatttctgttgcactttccttggagtcgcctccaccgggtgttacccggcgcccttgccctatggagcccggactttcctcacgcctttcggcgcgcaaccatccagcctgctcaaactttattcttcgattacataaaggatcctgccgcagttttcacagagggcaatattattcccctccgttttaaggctttgcagaacgcccgacggaagctgcatcttacagccttcgcaccggtcgcctaccagcttagcgatcggattcggccgatgctgcttgatttgtttgtattgttccataagcgcagtatccacgccctttgcagcctttgccacattaacgcgcagtttttccagaccgtcttttccggcgtccagttcttttgcatgcgcttccttaagctggtcgaacagctttttggcattgctcatcttgacaagcgtctctttgatctcgccttccgacttttcaaggcggtgcatcacttccacgaccttgcgcttattcaactccaccgcggatttgatgctttcacattccttgatcatctccctgacatcttccaaaaacagatcttccaggtcatagtccgcaatctcggatatttcttccttcttggactgcatttgttttttcaagatctccacctgaccggcggcttccgaaagcttattttgcaacaggacagactcctgctccaattgcttcagcttttgctgattgctttggaaaatctgttgctgctgtactaattttttccgtgtttccgtgttcctaagcgacttttcatagttttcaagttctatttccgcgctctggtaatcccataaagcttttaagttactcaacaataatcctcctcaaatgtttgcatacggtctatgcaaactcgcgatataaatagctacattatagtttacatcatcaagcaatttttgtaaaccttcggcatacagtttacaaaagcacttttcgctgtcataatgccccgcttccacaagtaccatctcctgccgctccatgtaaaaattatgcttgatctctcctgtcaggtaaagctgcgcccctttcttttttgccagaccggccatatcgccggccgcgccgccgcatacggcgaccctttcgatattacgctccaaatcgcctgcgacccgcacgcagtcaatctccagtttttctttgatctgcctgacgacctctcctgcgctgcatgcactctccaaatcgcctacgatgcccaaccctgcgtaggtctggcgcggctcctctgttagaagggcgctgattgccggctcctcgtaaggatgcacgtcgcggatcgcgccgagaactgccgcaagcctatccgttgggcatacggcgcttacgcgtacttcgtccacgatctctaaagttccacttctgccaatataagggttcgcctggtcactgggacggaacgtaccttttccggaaatattataggtacattcgctgtaatcgccaatattgcccgctcccgcttccgacattgcacccctgatctgtccaacatggctgtccggaacatggaccgctacctcaaaataattcctgatcgccgtttcctcaagatattcctggttctgcagccccaactgatctgccaaataccgattgatgccctttggcgccgtatccatactggtatgcgcgcagtacagcgatatactatttttaaccagcgctgcaatgcatttcccctgataggatgcagtatcgatctgcttcgccgcatgaaaaagcaatggatggtgggaaataataagattgcaattcctctgcaccgcttcttttatgacctcttccgacacgtcaaggcaaagcatgacccctgtaacttccgcattattgagattgatgttaaaaccgctgttgtcccaatcatatgcaaactctttgggagccagagcttctatcaagccttccatgtcttttaaacttaccggcataccagcacctccgtgatcttttgagataatttcctgagacgttcgatatactctccagtatttctacccaatttcgcactttttataatttgttccaattcgttctttcgaaacatcaggtattcccttacaagcggatctttgctttccagcaactttttgccgaacaggagttcaaattcgtttgggatcgcttcctgtcctgtttgcgcttttattatttgataataatgccgatcctctttcaccaaacgttcttctgtgatcaaaaacctattttcataaaaaaaggtgcgcagctcgtattcatttccatgtggtacgcagacgattctgtctgcagaatgcgccacaccaagcgatctttccagaatccggcggatcaacagcccccccattccagccaatataataacatccgcttcgcccgcttccaaaacggacagtccatccccgcaccgtgcatccagatgacccgaccagtgattattacacgccaaatcgatcacttttttcaaggatttttcgctgatatcgcatgctatgaccctgctcgcccgcttctcttcgatgagggcctcgctgactatgccgtgatcgcatccgatatcggcaacagtttttgcatatcctgccatatcgacgatcgcacgcatacgctggggcaatttatctctcataatgctctctaatcaaacaaggcggcttcaagccaccttgaattttgtttgtttattattataacaaatattttccgcttactcaatttatccgctatatttgtttccggcaaacctgccaaacccgtgtcgccgtttatctcgaacaaagacacgttataaactttaagtaccttctgtttgcttctgcgcggggagcgccggttcggtcttcatcccttgatccggcccctttttcttctttttaccgccaaaggaaatttttaacagaatgggcgaaaggatcgtcgtcaccaccaccacgatgacgaccggaccaaataacaagggtgacatgagccccacggccgcgcccttgtttgcaacgatcaacgctacctctccgcgcgacaccataccacagccaatttgcagcgattccttattgttgaatccggcaattttagcgccgagaccacagccggcaattttcgtcacgatcgccacgcccagcagtgcgagggcaaacatcacgatcatcatactcatgtccgtgagtaccacggaaaggcctacactcgcaaaaaaaatgggcgacaacagcgtataggaaagtgtctcaaaacgcgacgccatatattttgcatggctggtgttggaaaggatcagccctgcgatgaacgctcccgtaatatccgcgacgccaaaccattcctcggcgcaaaaggacatcaacaggcatatgacgaaagccatcaccacaaagcggcgatgatcgtcgatgtggcggtcagaccattttttgaacgccagatatgttacgaaaccaacgcctatggcgaacgcgaagaatccgacgatcttgaggagtacgatgcccactgccacagacggatcggcaagactggtaatgaccgttagggcaatgatgccgaggatatcgtcgatcacggccgcccccagaatcgttataccgaccttgctgttcagcttgcccatttccttgagcgtctcgactgtgatactgacggatgtcgccgtgaggatcacaccgatgaatacattctgtaaaaagtgattggtttcaaggtcggtctggaggacagatggattattgaacacccccgcaactgcaaagcccacaataagcgggactaccacgccaagtgccgcaataatgaatgacgctttgcctgcttttttaagctgtcggatatccgattccattcctgcggaaaacatcagaacaataacgccgatttccgaaagggccttgataaaatttgtgttgtcaatgatgccgaggcatgctggaccaaggatgataccagcgagcaacgctcccactacctgcggcatcttaaacttacgcgtcactagtccaagaatctttgtgcttaaaaggataagcgccaaatccaacaaatacttataatccatatatccacttcccaatcataatccaattttttatcaaccataatattatacatctcgtttctataaaatcaactaaaaataatctaagaaaaattcttgcaatataaaatgaaattgacaaggatatcaagaaaattatacaccatctattaaactgcacaaaaaaagtattgaacttgaaagatgccagctcaatactctttttttcaaatcacctttttaagttttcgcaacaagctttattccagaaaatccctcagttttttgcttctgctgggatgacgcaatttacggagcgcttttgcctcgatctgtcggatcctttcccttgttacctgaaactctttgcccacctcttcgagcgtccttgcccgtccgtcttcaagcccaaaacgaagtttcagcactttttcctcgcgcggtgtaagcgtatccaaaacatcgatcagctgctctttcagcaatgtaaacgccgcggcctctgccggagcaggcgcatcgtcgtccggaataaaatcacccaaatgactgtcttcctcttcaccgatcggcgtttccaaagatacaggctcctgcgcgatcttcaaaatctcgcgaaccttttcttccggaatatccatttccttagccaattcttccggcagcggatccctcccgtactgttgtaataactggcgtgaaacgcgaatcagcttattgattgtttccaccatatgcacaggaatcctgatcgtacgcgcctggtccgcaatcgcgcgcgtgatagcctgccggatccaccatgtcgcatatgtactgaatttatagcccttttcatagtcaaatttttcgaccgccttaatcagcccaaggttcccttcctggatcagatcaagaaataacattcccctacctacgtaacgttttgcaatgctgacgactaggcgcaggtttgcctccgcaagtttacgttttgcttcctggtctccctcgcccattcgttttgctaactcaacttcttccgaagccgacaaaagcggcactttaccaatttccttcagatacatcctgaccggatcgtcaatattgatattctccggcatggatatttcaaagtcgctggcttcttcttccggtttttccgcttctttctcgatttcctcatcaatcacatcgatattctgttcctcaagcgtttcgtataatttttcgatctggtctgggcgtaactggacgtcatcaagcgaccccatgatctcctgatatttaataatacccttcgctttacctatttcgacaatctttgcgatgcgttcttccgcctgtttcgcctgtgcttccgtcacatcgcccgatgccatgatttccttttcttttttgtctgccaaatccatttcacctactatataatatttaaaaacttgtcttgagtttatgtatttcttttgtcagcttgctgatttgctccaacgatatcttcttttgttccggctccgtttcgttttcatactttatgttggctattttcaaatttgcttccaacctgcctaactggatacgccgtatacaatcttcaaaaaaatcatcaaaattcttcagttcgccgaacacatcgtcgggcatgctaaaaagttccgtcgcatgccttaagtcttcttcgctttgcagtacggataataattcggcattggtgggggaaaaccctttttttgcgcactgcaaagtatatgaaaatatttttttatttgccgggtgcttaaaatcctcttctgtaagcttcccttcaagcctggtggcgttctgtgggttcgtcgccagtaacctgatcaggcaattttccgttttcagatccgcaggttctgtttcctgtactttttgcggtggcttccatgaaattgccggttcctgacctgtttctgtatcctgtgcaatcgcattgacagagaatcctgtcatatcggaaagcttcttcatatatttttcgcgcaccattgcgctcgtaataccttttaaaagcgccacacattccttggcaaatttttctttctgatatccgtcgcccagatcgtatttttgcgctgtgatccggaacttataatccataagcggtaaagaatctttcatcagtttgacataaccgcccttcccatattgtttcaggaattcgtctgggtcctgaccgcccggaatactcacaacacgtgtctcgatcccttcctgcgcaagaatatccagcgcgcgtaaggtagctttttttcctgctccatccccatcataggaaatatagacattattcacataccgctttaacaacctggcctgatcctgtgtcaacgctgtccccagcgtagcgacacattccggaattccgtatgcgtgcattgcgatcacatccatatatccttcaacaagtatcaggtgcgaaaggttcttttgcttgcgtatcatattcaggttataaagattgcggcttttgttgaaagcagccgtttcaggcgagttcaaatatttcggcaggctgtcatccatcacgcggccgccaaacccgatcacattggaaaaagtattgataataggcataatgaccctgttacgaaacatatcataacatttaccatcattgatttttaccagccccgcaagctgcatatcctgttttgtatagccctgcttttctaacaaattaagaagattgtcccatttatccggggcaaaacccatgccaaaagttttgatgatcctatcgttaagtccacgtttatgtaaataatccagtgcagattgtccctgtgcttcgtataagcatgtatgaaaaaactgcgcggctatcttgttcatcacaaaaattttctcgcgttgttgcttgcgcttttcataattggaatcatcctttatatccggaatcggcaatttcaccttgtctgccaaataacggcaagcctccggaaacgtcattttttcctgctccatgacgaattggatcgcattcccgccctttccacatccgaagcaatgaaaaaagcccttctctggattcacggaaaagctgggggttttctcgttgtgaaaaggacagcatgcccaccatcttccggatttattctgtaatgtcacatattcgccaatcaaatccacaagattcacttttgcaagcaagtcttgtatccagtcttctgaaaaataaggcatcccatgctcctttccaaaatttcccctattataattattatacacgaggccatgcaaatcctttatcccgaacatgaaaaaagcggctgcttcgttcgcagccgcttttaaagtatctttattgttccctgtatttgggcttttgttcgtagaaagtatgcaaaagcgtatgcgctttatggctgttcggctctcctaagaaatccttataaagcatctggatatcaggattctcgtgagacttccgaagcggcttatcgcaatcttcgtcatatagtccctgcgcacgtacaacacgcgggtcgaggacattcttcacccttgccgaaacgatcggctgacctccgccattgacgcaaccacccggacacgccataacttcgatgaagtggtattctttctcgccgcggcgaatcgcctctaaaagctttttcgcattaccggtgccgcttacaatcgctactttcacgttcatatcgccaattttgacttcagcttccttgatccccgcgattccacgcacatcgcagaaatcaacatttttcaattcttcccctgtcagaacttccgccaccgtacgcaatgccgcttccatgacgccgcctgtagctccgaagatcacgcccgcgcccgtagatgtcccgagcacttcgtcaaaatcttcgtccggcaggtttgcaaaatcaatattcgcttctttaatcatctgcgccatctcgcgcgttgtcaatacggcatcgacgtcctcataccctgtgccggcctcgccatcccgttccttttcgtattttttcgctgtgcacggcatcacggatacggtaaatatcttagccggatcgattccgttctgctcagcgtaatacgacttgatgatcgcgccaagcatctggtgcggggatttacatgtggaaaggttatccagcatatccgggaagaaatattctgcaaacttgatccatcccggagagcaggatgtgatcatcggcagggttccaccgctttttacacggttgatgaattcgtagccctcttccatgatcgtgaggtccgcgccaaaatctgtatcgaataccttatcaaaaccgaccttgcggagagccgccgcaagcttgccggttacccgcgttcccatcggcataccaaattcttcgccgatcgctacgcgtacggccggagcaggctgtacgaccacatgaaggtccggattgtgaagcgccgcccataccttatcgatttcgctcttttcagtaagcgcgcctaccggacaagaaacaatacactgcccgcagttgatgcacggtacgtccaccaaggatttaccccaaacaggctcgatcatggttttgaatccacgatttgtcgcgctgatcacgccgactccctgctggttcgcgcaggcagccacgcagcgcttgcaaatcacgcacttattcggattgcgcacaacggataccgactcatcgtcaatatcttttttgattttttccccttcatagcggatcgtccgcatattgaattcttccgctaacgtctgcaactcgcagtttccattacgcgcgcacgtaaggcattcgcggtcatgattcgaaagtaataaatcaaggcttactttccttgccttcaaaaccttttcggatgaagtaagcacttccatcccttcggaaacaggaagcacgcatgctgcctgcaggttcggattccccttgacctctaccaggcaaatacggcacgcgccgattgcattgacgccctttaagtagcaaagcgtcggaatatcaatgtttgcttgtcttgcagcgtccaaaacgcttgtatagtccggcacttcaacttgaatgccatctatttttaatgaaaccatatcacagtatctcccttcttatctcttgatcgcggcaaacttacatttttcaacgcaggctccgcacttgatgcacttatccggatcaatatgatacggctgcttcttttcgcctgtaatcgcatccgccgggcacaccctggcgcacatgccacaaccaatacatttttcaggaataatctcgtaggtaagcaactgctggcattgacctgccggacaacgcttatcatagatatgcgcttcatattcgtccctgaaatacttgatcgttgaaagcaccggattcggcgcagtttttccgaggccgcacaaagctcccgccttgatactttctccaagctcgatcagtttctcgatatcgcccggctttcctttaccatccgtgatacgttccagtatctccagcatgcgctttgtaccgatgcggcacggcgggcatttcccacaggattcatccactgtaaagtcaaggaagaacttggcaacgtcaaccatacagttatcttcatccatgacgataagaccaccgcttcccatcatagaaccgatggacgtaagcgtgtcgtaatcgatttttaaatctagatgctccgccggaatacagccgcccgaagggccgccggtctgggctgccttgaatttcttgccatccggaataccgccgccgatctcataaataacttcacgaagcgttgtacccatcggaatttccacaaggcctgtattattgatttttccgcctaacgcgaatacctttgtccctttggatttttccgtccccatcgaggcaaaccactctgcacctttaaggataatctgcggaatatttgcaagcgtttcaacattgttgatgatcgtcggctttccaaacaatcccttgtttgccggaaacggcggtttgggccttggctcgccgcggcgcccttcaatggactccatcagcgcagtttcttcaccgcagacaaaagcgcctgcgcctaagcggatctcgatatcgaaattgaagtccgtatcaaatattttttcaccaagcaggccgtattctttcgcctgatcaatagcgatttgcaatcgtttaaccgcaatcgggtattccgcacgtacatacacataccccatatccgcgccgatcgcatatcctgcgattgccattgcttcaatgaccgcatgcggatcgccttcgagcacggaacggtccatgaacgcgcccggatcgccttcatccgcgttacagatcacgtatttttgcgtccctttggcgtcatggccgaactgccatttcaagccggtcggaaacccgccgccaccacgcccgcgcaagccggattgtttgataatatcaatcacttcctgcggcgttttctccgtcaggcacactccaagcgccttataaccatcaaaagcgatgtattcatcaatcacttccggatcgatcacaccgcaatttctaagcgcaacacgattttgttttttatagaattcaatatcgtcaagcgtcgtcgccacgtcgcttgtatcttcctctttgtgcaacagccgttcaacgatacggcccttcaaaagatgttcttctacaatctcgtcgacgtcatccggctttaccctgctgtaaaacgccccctccggatatacaatcacgatcgggccagcttcgcacaaaccaaagcatcccgtccttactaccttgacttctttttccaatccatgtgctctaaggccattttcaaatctttcaatgatttcccccgaccctgaagaagtacaacccgtacctccgcacactaatacatgtgagcgataaaaatccatctacctcttaacctccccaaattctgccacttaagcgttgttctgttctgcatacccaatggtatattccgttacgatcttgccattgacaatgtgttccgcgatgacttgcttcgctttttccggtgtcatttttacatacgtaactttctcctgacccggcataaaaacctctgcaataggctctaaccggcatacgccgatacaccctgtctgcgatactgatacgtcgctcaaaccgcgcgtcgccacttcgtccacaaacgcttgcagcacaggacgtgcgccggcagcgataccgcatgttgccatacctacaacaatacgcttttccgcatcattcttgcggacatcgaccttgtcctgcattttctttctgattgcttcaagttcctcaagtgatttcatgacctctcccttttagtagaccgttatgccctattaagctgcataatttttcggctgccgcttcttttttacggcgaacggcgcaccgtaatcattttccaaccgaacttccaatattaaaatgtccgttttaaacgaatagtgaaaaaaaagacaaatcaatccgttattattataacaatataagaaagcgaacgcaaccaattttgtgaaaaattaaccatattatcaatctcggaaaaaagccacaatttttttactttttcaaccaataccgtacaacttttttcaagggtgtatttgaatcccccacatcgtccaatatataatgaccgtaaatatacagtacaaggagatcggctaacatgaaattcggcatcagttcttatgtgtttacttccccgttcggtagcgacccctacggccaattcaaaaaagcaaaggatttaggatttgatatttatgaaatcgccgtggaggatttcaataccataaatgtggacagtattttgcaggcgaaggataaaacaggtatcgatctttcctccatgtgtggggccttcggtgaacgcaatgatatttcttcagaaaacaccgaataccgcaaagctggtgtaggatatatcaaagcccttgttgatcttgctgtcaggataggcgccaaagtagttgcaggcccaatgtacgctgccgttggcaaggcgcgcatgaccacctccgctgaaaaaaagcagcagtggacatgggcggtggagaatatgaaaaccgtatccgattatgcaggggaacacggcgtcaaactggcgatcgaacctctcaaccgttttgaaacggattttatcaataccgtagagcaaggacttgaattgattgatcttatagatatggataatgtcggctttttattggataccttccatatgaatatcgaagaatccaatatccccgctgcgatccgcttggcgaaaggaaaaatttttgattttcatacctgtagcaacaatcgcggaacgccgggtgaagataattttaactgggccgccataaaagcggcaatcagggaggccggatatgacgattactgcaatatcgaatccttcacaccggattgcgttgcaattgccaaagccgcttccctttggcgtccgttggcgcagtcgccggaggcgcttgccaaaaatgggctggcgttcttaaaaactgtttttcaatgagcagcgtcgcatctgttattcgcgcataaaatcatccaagaaaaaacaggcagatttgcctgttttttgtttaaaaatcaatatattccggtttgaacatctcatcaagactttctttcagccaaaccgatacttccggcatatcaagcggtacctcttcccccagcgtctccctgatctcacgtgtatccagtacctcttccgactgatccacaatcacactgaccacaaaatcaatgtccggattgctgataataatcgtatgcaccgttcctgcaaaatcaccgatcggcggacggtccaagtgatcgagagcgtatactgcctttacagtggttccaacaccttccttggaatcaatactgaaactcccgccgcaagcctctgcacccgccttaaaaagcgatatccccagtccgactctgcgcgtcgtccgtgttgtgacaaacggactcgtaacatgcgcaagcatctctgcactcatgccctttccattgtctgtaatcaggaccgaaaccgtattgtcagcatattggatatccagcctcaattcaatcaaggtagcgtttgccgtgattgaattctgcacaatatccatgatatgcaatgaaatctctttcattaccccgccttcaaagcaaacgtcttattgcttgttcctgtagatattcagtatccccgggatatcttccggcttcagtctgccatatacctggtcgtcgatcatcatgaccggcgcaaggccgcagcatccgaggcagcgtgttgcttccagcgtaaacaggccgtcaggcgtcgtatttccaggtgctgtctgcaaatcgtccgccagcgcgttcaaaacgccatccgcttttttgacatagcaggctgtccccatgcatacgccgatcacatgctttcctttgggctccagcgcgaactgcgaataaaaagtcgccacaccataaatatccgtcatcggtatgcccatctcctccgcaataaaacgctgcacatcaaacggcagcgagccgaaaatatcctgcgctttttgcataatcggcataagcggtcccggttttttcattgcttccccaatatacgcctttagttcatcatattttgcctgagtttctgctgtgttggtcatttgaaaagtgcctccttctacatcctaacccttaaatttagtagatcattcttcacacgaaaattattttaccatattatcaatcgcattgcacgattttttgtgaatttatacacataattttttcaaaacagcaggaaccgtattttccgtaacctcaatactattttcacgttccgcaatttgccacaaattatgcgcgtccgaggaatgaattttttgaaaaccggaaatgtcattggtgacagccagccctttcacgacctcgatcgttttaaaaacaagctgcggtggaaagaagccaaggttggccagcacagaatttgcccctttgttgatatgcgcaggtatggcatatcccccgtattccgcgatcagcgcgcagcaccggtccatatcaaagggcaatgcggaaatcaacagcttttcgagtttccccgtcacttcgtcgttttcgtccatcatgagctgctcgccaaagaaatccggtcggttcggtatccccggcagcgcctcataaaccatatcgccaaacaccgccgccgactctgcgttttcaaacaacgcaagtatatgcacttcttctgctgtagtcatttccatccccggcacaaagataatccccgcctctttagccacctttgccactgcggcgacatttttagtgctgttatggtcgcagaccgcgattgcatccagccctttaagcttagccatattcacgatattatttggcgtcatatcattatctgcacatggcgaaagagcggagtggatatgaaagtcgtaataaagcttcatggaatcactgtcctacgccaagcccgcacaatccgcagcataacgcataagacgttttcggcgaggaataaatcgccacgccttccgccgtcgctttatcgatcgtcgccgccggcacatcaatgctttccggcacgatcacacaggcaaattcatgcaggcatgccaccgcaacgacattcagatgcgtctgtaccgtgatccatgccatgcccggttcgccgcgtgccataacccaacttaaaagatcgcatacgcacccgtccgtcacttcggccgtttctccaacgcccgtcgtcaataatttcagttccagcttttgtgccaattccgccgtagtcattcttcttccccgtcccctcttactttatccttacttgcaagatcaaccatttcttccgccaagtaacgtactttttctttgagcataaacacgcagtccatttccgtcgcatgccccctgacaatatcttccgcaagcgcgcgacagcttggcgccccgcaactcccgcaatccatacccggcagtatttcaagcaactcgtcgatctgctgtatcttcttaagcgcgatcatcctgtcatcatcgagcttcataacgtccagcggctcgatcgatttcattgtggctgcaattccttcctgtgcataatctttcgcatgctcctccacatctttgttaaatccgatcagatcgcaaatcgtattgacgcgcgactgtgcgacaaaagaactctcaaacaccagcgggccgcctacacagccgccgatacacgccagtccttcgaaaaaatcaaggtctttcagcttgtcgttttcaatatcttccaaagcacgtgcgacattggcaataccatccaccgacagggcgtttttttcacccacggcaaatgcttcgccgccgctgtttgcccagccaatccccttggctgacgccttttcgccttcgaaatgcttggcatcagtcgctttcaactgccctgccagcaatccatatacttccagaatcgaaattgctccgtccacctcgctcttttccttggcaagcggtgatttgatgctggtcatcttggccggacacggtgtaatgaaatatgcgccgatttccgaaatgtccacattatttttctctgcaaattcctgttttgcaacctttgccgccacctcgaccggagcgtccacattgacgacattatcaagcagttcaggaaaattcacttggatcaggcggacgaccgcaggacatgccgaagagattaatggccgcttttttctcgttcgcagttcttccgcaattgccttggagcagatttccgcaccgcgcgccacctcgaacacatcatcaaaccccatcgttttaagagccgacaaaacccgttctaccctgtctgcactattggacatcttaaactgcgcatataacgcaggtgcaggaagcgcaatcttatacttgaaattattgatactggaaagcggatcagtcacagcgttttttgcatggtaaggacaaacgcggatacattcaccgcaatcgatgcagcgctccgccagaatctttgcttttcctttttgtactctgatcgcttccgtcggacaccgcttaatgcaattggtacatccggaacatttctctttttccaatcgaaccgaatgaaaatacttttccataattaagcctcatttcagcctatgcagcatcacattttaaactttaaagtaagtttcgttccagccggacttgattcgatctgcatattgtcactgttcttgttgatattcggaaggcccatgcctgcgccaaagcccatctcgcgcaccgtatccgaagccgtagaatatccttccttcatagcaaggctgatatccggtatccccgggccgctgtccttacagataatctcaatcgcatcgtcgtcgatatttagtgtcatctgtccgccaaagctgtgaataatcatattgatttccgcttcataggacgcaatcgctattttcctgataagcatagggtcaacgcccatttttttcagcttgtttttgatgcccgcagacacctcgccggctgcgacaaaatcatctttcaccacatcatattcctgagagtatatcatttttatacctcccgcatgccgcctttgataccacttgtgtataaaacaccgcatgcagaaaacatcggctgttctgttgccagaagcaccatatcgcgttcctttgccatattgacgatatcgtccgccggacgcttgccgcgtacaaagaggatgcattggatatccatcatctccgccgtccgtaccacatggttattgacaagccctgtcagaagcaccgcatcgtgctttgtaaacgcaagcacatcgctcatcatatccgcaccgcaagcacaaaggatctccatatccgccttgtcttccccgcaaaggaactccgcgtctactaagttcgctatttcttttacgatcataaaaaacctccctgatttcaatcagtctctgaactgctcaatctgcatatctaccgcttcgaatatctttttggcaaaatcatccggataagggtatttgtatacgatacggataattcctgcattcacgatcattttagcgcaaatggcacacggttggtgggtacaatacatcgtcgcgccgtctatcgcaatccccagctttgccgcctgaataatcgcattttgttccgcgtggatcgcataacacaattcgtgcctctctccggaagcgattcccagattattgcgcaggcattctccgcgttctttgcagctatcgatacccgcaggcgcaccgttatagccggtcgttacaatacgcttattctttacaataatcgctcctacgctgcggttcggtttatagcaactggaccaatgcgcaatctctcccgccagatccataaaacgtttatcccacttatccatgattttaccccttacatttatgatattagaatatgattgcttcaggctcaagaactgttatacattattttacatggtttcatgttccaagtcgaaacaaaacacacaagaaatatcgagattttaccagtattcaagagattgaagctgttaaattactttaaaattaaaatattccctatttttgcatttcgtgttagttgcgtattttaacgattatatatatcataggaataacgatattagcactcgacaacttcgagtgctaacaagaattttaaaaatctaattcacaggaggcatggatatgacaattaaacctttaggcgacagagtcgtcatcaagtctgttgaagcagaagaaacaacaaagagcggcatcgtgctgcccggttcggctcaggaaaagccgcaggtcgcggaagtggtcgaggttggtcccggcggcgtgatcgatggtaaggaaatcaaaatggaagtgaaaaaaggcgacaaggtgctctattccaagtacgccggtacagatgtaaaattggacggcgaagaattggttatcgttcgccagtctgatattctcgctattgtgaaataagaaggaggcaaaattattatggctaaacagttaaaatttggagaagaagcacgccgcgcgcttgaaagcggtgtgaatcagttagctgatacagtaaaagtaacgttagggcctaagggcagaaacgttgtactcgacaaaaaattcggcgcaccgcttatcacaaacgatggtgttacaatcgcaaaagagatcgaactggaagatccttttgaaaatatgggcgctcagctcgtaaaagaagttgctacaaaaacgaatgacgttgcaggcgacggcacaacgaccgctacccttctcgcacaggcgatcatccgcgaaggcctcaaaaatgttgcggcaggcgcaaacccgatggggatcaaaaaaggcattctcaaggcttccgaagctgctgtggcaggacttcaggaaatgtccaaaccgatcgtagattccaaatccatttcccaggttgcaagtatttctgctgctgacgacgaaatcggttccctgattgcgcaagcaatggaaaaagtcggcaacgacggtgttattacagtagaagagtccaagacgatgaatacggaactggacgtcgtagaaggcatgcagttcgaccgtggctatgcttccgcttacatggtaacggataccgaaaaaatggaagccatcttagatgacgcgcttatcctgatcacggataagaaaatttccaatatccaggaccttctccccattctcgaacagatcgtgcagcaaggcaaaaaactgctcattatcgcagaggacgtagaaggcgaagcgctcacgaccctcatcgtgaacaagctgcgcggcacattcaactgtgttgctgtcaaggcacccggctttggcgacagaagaaaagcaatgcttcaggatatcgcaacactcacgggcggtacggtgatctccgaagaggtgggcatcgaactgaaagatacgacaatggaaatgctcggtcgtgcaaagcgcgtcaaagttgacaaagaaaatactgtcatcgtagaaggtatgggcgacaaggcggatatcgacgcacgcgtgaaatccattcgttcccagatcgaagaaaccacttccgattacgacaaagaaaaactccaggaaagacttgcaaagctggcaggcggcgtagcggttatccgcgttggcgctgctacggaaacagagatgaaggaaaccaagctgagaatcgaagacgctcttgcagctacccgcgcggcagttgaagaaggtatcgtacccggcggcggaagcgcgcttcttaaagtcagcgacaagatcattgctttgatcgatgcattggaaggcgaccagaagacaggcgccaagatcgtcctgcgcgccctggaagaacccgtacgccagattgctgccaatgcgggacttgagggcagcatcatcgttgagaaaatcaatgcggataaatccaaaacttttggttttgacgctgccaaaagcgaatatgtcgacatgatcaaggccggcattatcgatcctacaaaggttacgcgcagcgctgtccagaatgcggcatccgtttcggcaatgctgctgacaacagaaagcgttgtaacagaccttcctgctccggaaccggctatgcctgcgggcgctcccggcggaatgcccggtggaatgtattaatttcgtttcaaagtataaaataaaaactgcggtacaaaaagtaccgcagtttttttatatcatataaataaaataccctgctactatttagatgcttcccctttttgccttttccgcttcaatatcaccatcaaaggtcattgcgtcaaaggaataagtcccttttccgtcaagcgcatcgattgagcgcatatcttcctgtgataatgaaaagtcaaaaatatcggcattctggatgattcgttcctttttcaccgattttggtatgattactacgtctttttgcactgcccagcgaagggtcgcttgtgctgcgctctttccatattttttaccgatctccggcataagcggttcctccgccagatgtccatggaacatcggcccccatgcagtcacgataatcccctgctctttacagtattggcgtacttccctttgctgatgccagggatggaattcgatctggttatttgcaggaagcattcctgtttctttgcgaatgccttctaaatggcttaccaggaaattagaaacgcccgctgtcttgattttttgtttctgcacctgctcaagcaaaaactcccatacccgaaggcgccgcgttgcatccgcccccggccagtgcatcaggtataggtccaaatacccgcaattgagcttacgcatactgaggtcaaacgcttttgccggatcgtcaaagtctgtcggccatatcttcgtcgtcagaaagatctcttccctcggcacgccacagtcgcagattgcgcgtccgacatcttcttcatttccatacagcgtagccgtatcgatatggcggtagcctgcatcgatcgcatagcgtacagcgttatagacttcttctcccacggcgtcaaaaacgcctaggccaaagcccggtattttttcaccgttgttcatcgttactttgtcttccaacccttgtatcatcacttttcctccatcaatattcccaaggcttttacatagccttctgcgcccaatccgcaaatctgcgccacgcacacatccctgatcacggatacatgcctgaaatcttcccgtgcatggatatccgagaggtgtacctccacgcacggaatgccgaccgaggatatcgcgtcgcggatcgcatagctataatgcgtataggctccggcattcagtatgatgccatccttccgcccataacactcgtgcaatttgtcgatcagtactccttcatgattcgattggaaaaattccaattcaacatcatcatttcccttttccgcttcgcccttgatataatcattcaggtcgcccagcgacatgctcccgtatacgtccggctccctgatccccagcaaattcaaattcgggccattcataaccaatatctttttcatgtttttacctgctcttaaaagtgtgttatactttttcttggaactgatttttattatagcatagatcgaaaggattttttatctcatgaccaaaaaatactgcgtcatcggctatccgatcgcccacagcctgtcacccgtgatccacaatgcattatatgaaatgtacggccttgattgtcagtatacggcctatccggtggatcatcagagccttgattcgtttgtgggacaaatccactcacgcggtatatgcggatttaatatcacgatgcctttaaaacaggatattctttcccatcttgactttgtggcgcacgacgcccaggacagtataaataccgttgtagttgatcatggcaagctatgcggttattccacggatgcacaagggttctacgcttcccttcgctcgctcggcgctgattattcagataaaaacgttgtatttatcggtgcaggggctgtcaccagcctattatgcatggatgctgcatccaaacaagcaaagagtatcgctgtcgtgaaccgtacgccctgcaaagcgcaaaaaattgcggaaagctgtcatgcgaaggccgccggccttgaccgtatccaagactttatgctgcagtgtgatttactggtcaacactacgccgcttggaatgagcggaactggccataattttgagaacctggattttatcgatctgcttcccacctgcgcgacagtatgcgacctgatctatagtccgcccgaaacggattttttgatgaaagcgcgtacgcgcgggcttcaaacgatgaacgggcttggcatgctgatatggcaggctttctatgcctttgagaaattctgcggcatcttgcctaccccgcaggattatcaaaccatcttatcaaagatcaagcagagcgatcaatgaatcggctgcctgatcgatggttccgtcgttccggattcggtgacggcaagtcgcttcataccgggcccgccgctctttgaacactttttctatatttttcacatcatcctttaataccggacgattcttgatatttaccttgcctgtgatctcttttatatcgcgctggacgtacacgatcacgccgctttcccgcatcagacggatattttcctccgacaggataatacctcccccgcacgaaacgatcgctgcatcttcatcctgcgctatccttcgcagcatttccgtttccattctgcgaaagcaaggttccccttgttcttcaaaaattccggaaatcgtttgcccttcctgacgctcgatgcacgcatcgatatcgaggaattttcgttttgttttccgcgctgcggcacggcctattgccgatttgccgcatcccatcatgcctgtcagatagatattccccatatcaggcctgctctccgttttcgtatacgcccaacagccgtaattgtgcacaatacggctttatttcttccagcgcgtgctcaatgatattcgaaataccttctcctgcaaaatccacataaaagcgatattcaaaatttttatcccgcagcggcctggattcgatttttatcatattcaaatgcagatgggaaaatgcgttgagtacgcgcgccaatgcccccggccgatgctccagaacaaaactgatgctcgccttattcgcctccctattttcaagcaactgagcgcccagcacgataaaacgcgtcgtattttccccgcttgtactgatagacggtaccaaaacctgcaacccgtaaatcgaacctgcatattcactggcgatcgccgctttcgttttatcaccgcattccgacacatactttgcgctgatcgccgtattataataaggaatttgcttccaatctgcatgtctctttaaatactcggcacactgcaaaaagggctggtcatgcgaatacacctcgcggatatcttcgatcgtgctcccctcgatcccaagcagcgcgttttcaatatggatgaattgttctccaacgatgctgacgtcatattggtttaaaagatcgtatacctgctgcacgcttccggcataggaattttcaataggcacaaccccatattcgatcgctccgcttaaaacggctttgaataccccttcaaaagtatcaaagctgcttgtacttactccattaccaaaatatttgttttgcgctaaatcagaataagctcccttcactccttggtaaccgacaatcccttcgcaagccttcttggttcttttcggctgtgccgcctgtaaaagctccgactgatgctccctgctgatcttcatcaaaagcccgaaaagtctgtcaatatcatcggctaaagaaggatcatccgccatgctgcgccgcttttcgagtactgcttcctcccgcgatacatcgagcacgggcaattggtgttcgatcttatattgtgcaacgccctttgcaatttccaggcgctttttcaaagcatcgatgatagccctgtccacctcgtcgatctgtttccgcaatttttccagttcagtcatgctgcgcctccaaaaacaaatctgcaaccaccagcgccgctgcgcatttgatcacttcgaccgcccgcagcgcaatacaggtatcatgccgcccgtgtatttgcagcgtttcattcgtcatcgtcctgatattcactgtctcctgcggcttaaaaatagacgccgtaggtttcaccgcaacgcggaatacaatcggcataccattgctgatcccgccgttgatcccgccattgtggttacttcgaaaagtgatcccgccatcgcgcaccgtcggcgcgtcatttgcttcgctgccgcgcatctgcgtgattgcaaagcctgtcccaaactcaatgcccttgactgccggcacagaaaacatcatgtgcgccatacggctttctatactatcaaaaaaaggttcacccaatcccgcaggtacgccgccaaccttgcattcgatcacgcctcccagggaatctccgtcaaggcgcgccttaccaatttcatcctgcatctgccgcccaaccctgtcatccagcacaggaaattcctttttttccactgccgcaaaatctttttcgccaaactcctgtgtatccttgatatgggagacagattggatacgcgcgccgaccgctatgcctttttgacataataactgtcgggcaacgctgcccgaaaataccagcggcgcggtaagccttcctgaaaaatgcccgccgccgcggtaatcgttagcgcccagatactttatgatccctgtataatccgcatgccccggccgaagcaatgccgctgttttctcataatcctgagaacgggtatcgcggtttttgatcatcgcgcataagggggttcctgtcgccttccccttaaaaaaaccgcttacgatttcgtataaatccggctcgctgcgtttggtcgacgcatcgctggtatttggcgcacgccgtttcataccttcgcgtaccaacgcctcatcgatctccataccagcaggcaacccctccataacaactccaattgcagaggaatgtgattctccaaatattgtcgtctttaatatacttccaaaagtggcgctcatttgacttgtcctcctacgctcgcccattcctcaaagaaattcggggctgattttttcacactgcctgcgccgcttataacgatttcatcttttgcgatacacgaggcaactgtaagagccatggcaatacggtgatcgttgtggctgtccacttctccgccattcaatgttcccgttccgttgatcaccaggctatcctggtattccacgatgtccgcccccaatttttcaagctccattgtcatagcatacaacctgtcgctttctttgtaacgcaagcgtcccgcattatatatcctggttttgccctgcgccgcacatcccaaaactgccagaaccggtactaaatccggaatctgcgaaacgtctatttctataggctttaaatctcctttttgaacatggagcccttgccctttttcttcggcctgcgctcccatacacttgagcaagccgacaatggctcggtctccctgcatggaatcgctcttcaatcccttgatcacaatgtctcccgtcatagctgcagccgatgcaaaaaaagcagcatgcgaataatcgccttctatttccatatcacatggcacatacccctgccgtccggaaatttcaatgtcgttaccttcccacctgctccgcaccttgaaatgtttctgcacatcctgcgtgagatcaatataaggtttggattccggctccgttgagatatggagtcccgaatcggcaaacaacgtcggaagtttaaacaacaaccccgaaacaaactgtgaagaaatatctgccggcatagcatattctccgccgtcgatcgtcccgcaaatattgatgcggtcgtgcgtcctctcaatactgacatggttacgtataaaaatttggtcatagccgctcatcggccgtttcagcaaccgtccatgaccggtgaaagaatgtttttttccgtccagcgccaacggcaaaaggaaacgcaacgtagaccccgattccctgcaatcaattatactcttgcttgtatttgacattccgccggatacaatacagcaatcgtccaccatattatattcgcataaccccaaatccttcagggcaattgccgtggcttcaatatcgtctgataaagcaatgtttttcagcgtagatatcccctttgcaagcgcggcgcaaatgagcgcccgatgggagatactcttggatggaatcacttgtatactgccagaaataactgatggtgcaatccgtttcatacattcatttcctttatcgttttctgtatcagtgcagccggaagtttttttattattgcatgcccgatgcggtcgattaggatgaagttgatatctccgccttccgcctttttatccgccgataatatttgcagggcatcatgcaaaatacctttttccagcataacaggcaatccatattttcgcaacaaaagaatcgtgtcctgcataagcccctgcggagaaactccgagctgttctccaaggcaggccgcatacaccataccgatcgccacagcctcgccgtgcaggaattttccgtatcctgccactgtttctatcgcatggcctatggtgtgcccataattaagctgcatacggatgccggtgtcatatgggtcctcgcgcacataatccgccttgatctcacaacagcgttttacaataccgtcaacatggatcgtctcttgctgcagagctttatgtaatccgtcgtccgcaatatacgcatacttaatcacttctgccatacccgcagcatattgccgcttatcgagcgttttcagcgtatctgtatctgcaaagacagccgccggctgataaaatgcccctaccatgttttttccgcttttcagattcacagccactttgccgcctaccgagctatctacttgggcaagtaatgtggtcggatattgcacaaagcggattccgcgcttaaatgttgctgctgcaaatccgcaaatatcgcctactacgccgccgcccagcgctatcagcagcccgcccctatccattccaaatttcatcaggcggtcataaatcaactccagattttccatgtttttcgatgcttcgcccgccttaaggacaataaattttgcgcctgggaaacgttctccatataaaccgtataccatatcatccgtaacaactacgcaatttgcaaacccttccaaatatgaattattgagcaatccttgaccgattttaatatcatactgtccattatccgcattgacatgcactgtttccatgtttgccccatccttacattacgctttttaaaacgttgattttattcattatactatgaaattgctccggtgtcagcgattgtgccccgtcgcacaaagcatgcttcggatcgttatgcacctcgatcatcaaaccgtccgcaccggccgcaactgcggcaagggccagcggctccaccatatatggcaggcccgttgcatggcttggatccacaatgatcggtaaatgcgacatctttttgactgccggaatcgcgcttaagtcaagcgtatttctcgtatatgtttcaaaggtgcggatcccgcgttcacacaagacaacattttcattaccgctcgacatgatatattcggcgctcatcagccattcttccagagtattggataatccgcgctttaacagaatcggttttttagtctgccctacttccttgagcaagtcaaaattttgcatgtttcgtgcgccaatctggatcatatctacctgttcagcaaataattccacataccttggcgccatgatttccgttacgatcggcatatgtaccttgtcgcggacatttacaagaatatccagtccttcctcccccagcccttggaatgcgtaaggggaagtacgcggtttaaatgcaccgcctcttaaaatctgcgctcccgatttttggatgctttgcgccacgcatgtaagctgctccgtggattctacagagcagggacctgccatcactttcaaatccccatccccaatcttaacgccatgtacgtcgattacactgtcttcgggatgaaacttgcggtttgcttttttaaagggctcctgtacggagactaccctttcgacgccacccatcaagccaatccgttctttatccaccgtataggtatccccaagaacgccaagaaccgtacagtcaataccgcggttagtctgtacctgcatacccttttgtatcagcctgtccgttaccttcaaaacttccgcttccgtcgcatcgcttttcattacaacaatcatgactcaaatacctctttctgctttctcaaaataaaaaatgctgtaagcccttgccggtgcctacagcatttgatcactaaaatttctaggaatacatactacaccgacatattaacacaaaaacaagccatagcgatagaatccgctaaagctaaatgtgctaaaaaatcgttgcgatgtgcgtgccattcacacttactccttttcattactaattgcattatatttgatttttccaaatatttcaacttttttttgattttttcaaaaaaagttcgatttattacaattttattacaaaaaagtctttacaagcacttttttatatgttatcctaacaacaaagaacagaatttttttatatgatgttcctccagtactatatttataagggaacctccgcgtcaggcggaggttcccttttttgtcagatttgcgtaaactttcagtaatattaattttctttttgcgtatacgtgcaaattactatataatgataaaaaagctgattctacagcacttgcgtccaataaatatacgaggtacgatacagtgattattattgtcaaacaaaaagcccctgaaaacaaacttaaagaacttattcataatctggaaaagcaaaatttcaaaattcacctgagcaaaggtgaaaatactacgataatcggtctggtcggcgatacctccctcgtcgatattgatatgattaaagccaaagatatcgttgaagatgtacgcagggtgtccgagccctacaaaaaagccaacaggaaattccatacggacgataccgtcatcgacgccggagggcaattgattggcggaggacattttgccgtcatcgccggtccttgttctgttgaaagcggacagcaaattcttgacattacgcgcgatatacagaaggccggcgcaaatttcctgcgcggcggagcttataagccccgtacctctccttatgcattccaggggttggagcaggacggtatccgtttattgcttgaatgtaaaaaacaattctccataccgatcgtaacggaaatcatgggcatctctgatatcccatattttgaacatgtagacgtgatacaggtcggtgcccgcaatatgcaaaatttccgtcttttaaaagagcttggtaaactcaggcagcctatccttttaaagcgcggtcttgccaataccattgaagaatttttgatgagtgcggaatatattatggccggcggtaatgagaatgtcattctttgcgaacgcggcatccgaacctttgaaacatttacgcgcaatacgtttgatctgagtgcaatccctgttctcaaaaataagtcccacctgcccgtcattgcggatccaagccatgcggcaggtctcaactggctcgttgagcctctttcgaaggctgctattgccgctggtgcagacggtttaatgatcgaagtgcataacgatccggagcatgcgctttctgatgggaagcaatcattaacaccaccggcttttgaaagcctgatgactcgccttaaggcctatatggaattggaaaataagcagattggttaaaatccctttccagaaaaagacacaccataattgtgtgtcttttttgttattcaggatattttcttgtctcttgaatgcgcaaaataattatattatagaataaaaatatcgtttttcagctaaatcgcatagtattatttcttatttaatagtatttagccg

SEQ ID NO: 15 - DNA, 62764 bp, Christensenella sp.
atagatatattatagattaaaatgctttaatttgcccgctttttaatgaaaattttcctaaatttttcaaaataaaaaaccgcctgaaaagcggttcttttaaacttatcatttaggattttgcaatctcggcaatgtatccgctcgaaatgaacggtgcgcctgtactatcggccctatggtttttcgcagcaggacttcgtcatgtccttccacgatatagtcatgcagcttgcctacttttacatagcccagcctatcatatagctttcccgcccggggattgaaactggaataacaaacgaacacattttttacgtggcgaaagatatagctttcggcaaactccatgattttactgccgatgccttttccctgccattgtttttcgatgcaaactgcttggatatatcccttgagccagccgttcatatcaatcaccaaaattccgatttgttcccgcttcgaaaaaacgccgaaccgctccttagccggatcatgcatcgtttccatacactgatcgggcgtgcgccgcagcgtgatccaaggttcgctgcccataaggagttccgccgcttttttcttttcctgttccgttttaagtcgtttgattgtgatatccattttattgctccacccattgattcaccaacacaaaaaggagagaggctctccttcttgtgttggtgcatttaaccaaacccatttgcaggcgtcagtgatcgtctcttacctgatagttctccgcatccttttcaacgcgcacatgatcgaattcattgattttttcgatgaactggttatcaataactttatcgactgggatcgcctctgacaaagtccccagttctactcccatatcgatgattgtttgccaccttgtcggatccatatatccgtaaccgtgttctgcgattgccggatcgctggataccgtaacttccccgaatgatttcatgacagctaccgcatcattccacgttgtcgtaatagacgggaacttatccaatacgatctcgcaggctgcttccggattcaactttgtaaaataagaacccattgcaaagccttgcaggaaacgctggataacatccgatttttcttccagggcctttctggaaatcgtcaacgagttacccactgctttaaaacggtcaaatgcgtttaggaactggaagtccattccctgcccctgccatacctgatattccatttcccatgtcagtacggcatcggcctcttttccttcccatcctacctgtgcacgattttccgaagcaacgatatactctacgcttgccggatcgacgccgcaggctttcaaaatcggatctgcaatcatagaccaaccggcatcgccaagcacaatcttcttgcctgccaactgcgcgatatccgtaatccctttatccgggttaacggcaaacccaaaatggtattcctgcagtacctggtagacattcacgatatcaagtccgctttcaatgcctgtcagagagatataaggcgatggaaaacaaacgtcaccctgacccgctgcgaccatcttgatatcggatgtaccaaacgattgctgtatttcgaccttgatacccaattcctcaaaatagcccatagcttctgccacatgaatatgtgcgtcctcaataacctcgacttcccgtggtacgatgaaggtcaccacatcaagattatctttgccttctttgttctcttcacccgttttgtcgtcctgagccgctgtgctttctgttttaccgtttacgtcggcgcttggttcagttgacggagttgatgtgcaggctactgctgcaaccatcatgagtgcaaccgctaataccagacagagtatctttttcataacttttcctccattttttatttaagcatttctgcttttcctacagtctttcgcaaccgatagacgccataatctaaagtttcaatttttttgtcggctgcaacatatggattccggccatcatcacggatgaggcgcgcaactccatgtaataatcgcctcctcgtcgccaatattgaatagcttatgaccacacccctgcgggatcaacaatgcctctctctcatgcagttcataataatgatcgtcctccggaaaatagcacaacacctttcctttcatacagaaaaacacttcatccgcctctggatgtccggggtccagttccccgttttttccgggcatcaggcgcgacataccgaacgtaatcctagctgtgctgaagtatgtacggcataattcatccccttcaaacgcaggcgcagcctgttgttctgtttttatggtcccaagttttttctttgattccatagtttactcccaatcgtgtatacaggagctatttacaccagtcatagataaagctcgtatagacttttgccgcatctatgacttcgctcctgcgtacaaattcgttatatccgtgaccgccatcattgatcgcccccggcccgcaaaccacggacggaatgccttcttcttcgagaaaagtcccgtcgcaaaccgcacggaaacccgatatgatcgcttccctaccaacggaatcacggaatgcattcttcagcgtgacaacgggttccgattcttcgtccgtcacaaaccccggccacagctgagaaaccggtccgttgacgatcggcggatgttccctcagccagtcatctgtctgtgcaagcgccgcaacgcgttcgcggatctcatccattatcgcttctgccgatacttccggcggatgccaaagcgcatatgtaatcttcatactgcctgcaactgccgcaatataggtgcctgcttccacgaaagaggggttgagattaaaggcgccaatcccctgcgtatcgtgcttcggttttcctcccgtacccacagcagaacttttccacctatggttccattctttttccaaccggtaaaagaactccatgaatggcaaagccttttccacggcatccacaccgacctgtgccccactggcctgatatgctgactgcggaaagataacctgattccggcaacacgtatggattgcttttccttcgataataagctcgaagcaaagcaggcttgccgtagaattgtggatctctacgcttgtcggttcacatacgattgcaaacggagctctgtagccgcgcttgacacacgcacgcgtaccgatcgttccgccttcgcaggattcctcgccggacgtcagcatcaggatgatatctccgcccagttcatctccgctttccttgatggctttggctgcccagatcgccgccgcaacgccgcccttcatgtcgtttgcgccgcgtccataaatcaagccgtccttctcctcgcctccaaagggatctacgtaccatttttcaagctcggataccatgaccgtatccacatgggcattcaggataatatctttgctctttcctttcctgttgccatgcagtaccgcacagatgttcgggcgtttcccctcgtcatctactgcgaatttatccactgaaaatcccatatcgtgcaatactttgcttaggtattcctgaatctcaacttcctgattgcccggattggtggagttgattttgatcagcttttttagaaagtcgatcaactcttcctggttttgttccaggtagcttagtgcattttgcttgcccatattttctttcctccttctttcgtgcttattgttgtggttatattttccacttgaccacttttttctccacaaaggatactatcagatatagtacgatcccgatgacggcaatcatcaatatcgccgcaaacgccagatccattttaataagcgtcgttgccttcataataacgaagccaagtccctcgctgccgcctgaaaactccgcgctgatagcggcaattgttgcaaatatcccacccaagcggatccctgtaaaaatattgggcattgccgacgggataattacataccgcagacgctctccgcgttttgcgcccagcgattgcatcagctctattttaagcggatccacgttgttaaagcctgtcgccgcattcatcatgataattgaaaaactctgtaggatgactgcgatcagcttgacctggaagccatagccgatcaacacaatcaacaggggtactagcgtaacgagcggcgttgtcacacacaaaatgacatacggagaaagcgcgctgttgacaatcggaaactgtgtcatcaagatcgccagtacaatgccaaccggaatcacgataatatagccgctcaatatttcctgcaatgtgaccaggaaattcggccacaactctgccgagaaatttttgacaaacgcctgcccgattgccgttggcgtgggcaccatccaactcgggacttcaaagatgtaaataactgcttcccatacagcgatgataacgacaagcgcaatgataggtgccaaaacagacattgctttgctgtggggtttttctactactaaattgcctttcattagctctctttccacggtcaaatcccctccttgtacgttacttaatattactcaggtccagttcgccaatcaggtttactactttttcttccagatgtacgaacctctccgatacgatcatatccgttgttctcggtcgtggcaggtctaccggtacttccgataccacacgccccggattggtccccattacgataattcggtcagacatcaacaccgcttctgcaacattgtgcgtaataaaaatgatcgtctttcccgtttctttccaaatacgcaaggtttccagatcaagctgttcccgcaggttttcatccagagccccaaacggctcgtccataagcagtatctcaggattgtgcaccatcgcccgaatcacacccaacctttgctgcatgccaccggataaatctacgggataggaattcttgtacttggtaaggcctaccatcgccaacaattccccgacccgctttttatcctcttttgtatgcatcttaaaaattctcaaaggtagcgttagattttcttccacagtcatccaaggcagcagattgctcgactggaagataaaaccaagctttttcaaaacattttccggcggtttttcggtgtaagcctcgcctcctactgtaatcgttccgctggaaggggaaatgatcccatcgatcatgcggataatagtagactttccacatccagacggaccaaccagggatacgaactctccgtcactcacttcaaagttcacatcgcttacggctaatattttttgccgcctcgtcttaaattctttcgtaatatggcttaatttgattttatatgtatccggcatacgttttcccctccttcctatgatttccagataacaattttgttttcaatcactactgtcagtccgtacatcagaagcccaattagggcaaccagaacgatacatgcaaacacaatatccgtttcaatcaatttggaatagtagaccacgcgatgtccgatcccagagccaaagccgttcatctcagcggtgatggatgcaattgttccgaagatgcatcccagccttaaccccgtaaacacttcaggcaaggcatttggaaagatacattttgtaaaagtctgtaagcggtttgcaccaaccgcgctcatcaactcccgttttccctgctctacgcgtgaaaatcctgtcagtgaattaagcgttaccacaggtataacctgtaccactacgcaaagaatacgcacctcaaagccatatccgaaaatcaacatcagcaacggcaccagcgttaccatcggcgttgttaccaacaagatgatatacggtgacagcgctttttccaaaacccaaaactgggatacgaccgctgctatcaaaatcgcgataggcaagccgatcaacacgcccagcaaaagagcgcctagcgtctgcaaaaaatgggaccagagcagtgtcggaaagtattctaccaatgcagtgccaatcgccgaaggcgtaggcaggatcatgggtggtatattaaacacacggatgatgatttcaagcgcaataatcagtacgactaaaatgatgagcggcggtaacactttttgtaatatattcgttttctttttcatccaaatccccccttattccaaatgatccatgatatctttgagctggatgcgcagctttccaaatgtcggattaagctcaatttcattcaagcgttcttcataggaaagcgttacgggaatttcttttatgattttaccgggtgccggtcccataatgaatattctggatgaaagcaacagtgcttcatctaaatcattggttacgaggatgcccgtttttcccagctcatgcatcaggtgaagaagttcgtatcccatcatttttctcgtaatcgcatccaacgcaccaaacggctgatccaacaaaagcacgtccggattactcatcaacgctcgtgcgacgcccaccctctgacgcattccgcctgaaagctcgtgcggaaaaatatcggcatatgcttcaaggccaaccaacttcagcatctcctgcacgcgcgcatcggctttatcggattttaatcccattgtctccatcggcaggatgaggttcttgcgaaccgtccgccagggaagcagattatcattctggaatacgaatcctgtttttttcttatattcgcttggaacgcggtcagtaaagtttttttctccaattgtgattgaccctcccgatatgccggtgataccgccgatcattttcagcaatacagacttcccgcatccggacggtcccataaccgtgatgagctcccggtcttccacagaaaaagagatattttctacgaccacttcaatttcatctttttggccttttacagcaaatgcttttgttaaattgcttaatgtaatttgattattctgcaaaattatctcaccccttttatccatgtgacgtgtttgtgctccggaaatccggagcacaaatgcctgacttaaagtttaaccatgactttgatcgtattttctttatcatttaatgcgatctccagcgcatcctgcaatttatcaaacggatattcgtgggttatgatttcacggatcgggcatccattttcaagcgccttaatcgcaaggggataacaatggcgatatctcaaaattcctgtcagttctgcctcttttgcaagaattttggccgtgtccagcgggatatcttccgagttgggcgtcatacccacaaacacaatcctgccaccggattttacgaggtccagcgtctgcattgtcgtgactttcgttcctgccgtttcaagcacaacatctgcgccttttccgccggttgcttccatgacaacgtcgatgatgctttcctcacgggcctgtacgacacgcgatgcacccaactttttagctaactgtaatcttttttccaccatgtccgctacaaaaatctctttgacaccccgctcctttaaggcaagcagcgttgtcaacccaatggttcctgcgcccagaacaaccaccgtctgcccgaattcagcttttgctttgaccgcggcataaaacccaacagccaagggttccataagaaatgcgtcaacggtatcaaatcccttaggcattttgaaaacccgctctgccggccaacaaatatattccgcataagcgccgtccgtagccggaatgctccctgtttccggaaccgtcataaaacgaacttccggacaaagattatatcttcctgtcaagcagaaatcgcattttccgcaggtatagcccggttctaccgctacaatatctccctgcttaaaaccgatgacatctttgccgcacgacgcaatctcgccaccgcattcatgccccaatacaatcggctcttcaattgtccaaatactgcatttcagttcttcatagaagtggatatccgaaccgcaaactccggcatgccggactctgatcaatacttcgttatccttaggcgttggaattgcaacttcccgcatttccaactgccgcttgcctacaacataagacgccttcattgtatccatttccagcttcctcccatcgtcactatttttccagatactccacaacatgctttaagttgtcgcggaacgacccgtccgatacaaacttcttatcaaacaatgcacttcccatagtcataccccacggctttaactccttcataaagtccatgcgggcatgagaatcgatacttcccgcaacgactaccggaaaatcgacttccttcataaaacggcgtaataattcttccgcatcccctacaaagcggtatgccaggatatctgttccttcgacgcctaacgcctcaaagcgcttcgcccccccgattacgtcttcgtatgtatcgccgagtatcgacggatttccccagacctttccacagaatgggaaatatttcagatttgcttttttcaacgccttgtgtacggattcgaaataaaccgttcccatcaggtaatcaaagttacactcaatcgccagcttggcggcatcaaggcactcttcttccgtataggtcacgacttcaaggtacgtcgtctttcccgcctccttcatcagcgcgaccaggtccttcatctggtccgtaggaataccgatatttttaaagccccaatcctgtaccggcagatccctgcagctttcaaatacctgcgccgcatccttgaccgtttggtcgtgatacgtgagcataactatcattttcatgttttccattttttcttcatcctttcttgtgtcctgttttttttaaatatcatgcctcgttgaacatactcgtgaggtctgcaaacagctttttgaacttggcatagccgtcggcgtaaacttcttcgttttccataataggcatatacttcctcttgacgctgaccatgcgttcgcacgcttcttctacactgtcgaacatccccactgcattaccggccaatatggccgcgcccaggcaagccgcttccttggtattgctcgtgcacaagtttttacctgtaatatctgctttgatctggttccacagcacgctttttgagccgccgcccagggatctgatctccgttacctgtactcccgcgtgctcaagcgcctcaatgttgcggcggatcacatacccgacagattccataaacgcacggataaagtgcggtttcttgtgcgccagggtaaagccataaaaaacgcccttggccttgggattgatatccggtgccatcgatccgttaaggtgtggcagcgccagcaatccttcactgcccggttcgatgagcatagcctccatagtcatatagttataggcgtcctcgtccgtcagcctgctgatcgtctgctcttcctggcagaaacaatcgcggaaccatcggagcgtcatgccgcccgtcgtgaacgtatgcagcatatacatatccggaataccgaaataatgcaacggcatcaggccgttcggatcaaacttgggcgtgttgatgggcgcgcagattgccagcgcggctccgatgttttcggaaaaaattccttccttaatattgcctaccccgattgcaccggccgcttggtcgagcgcgccggtacatacccaaagatttttggacaatcccagctctttcgccaccttttcggatagcttcgccaccttctggcccggttctataatcttcggaagctggtcctcgctgatttccagataatcaagcatctccttccaccatcccttggtgttgatatcccaataggcggttgagcacagcagcgagccttccgacacaagcttgtctgtcaggcggtagatcagccaatcttctatgagcagaaattttgcggttttatcaaacacttctctgcaatggtgcttcatccacaaaatttttgatgcgggccagcacggatcgaacttcacctgtcccgtcacgcggtaacaggtctcatccgaaaatttttccgcgagcatacggctttcccgctgcgcccttccgtccatccatacgatcgcgttggtgagcggtcggccgatttcatccatgaaaaacaacgtttccccctgcgcagatatgccaagcgcacatatattttccggatttaccccgctattgcggacaatatggtgaaccacgtctttaaatgcgttccagtatgtatccggactgcattccacataactcggacgcggcgtaatcaaatcgtattcgcgtgtcgcaccggtgatggatacgcccgatgaatcgatcagcgccagtttcaaagctgtggtgcccaaatcaacgctcaaaatatacttgctcatacattgccctccaaaatgttttttgatatgtaaaatctgcaaaaccgtttttaattttggcctgccttcgatgctttgtagtaagatggattattttttcgatttttctagcattttaagattttagaaaaaatatccggtaatagtcgggtgggttggaatctttgaaacaaagattttttgtgtgccgcgtttttgtaatttcttttaaattaggatttctgctgacccgtgcaacgtatagtttgcacgctgatgctgtttgtgtttgggcttaatctcgtttgcaaggaagtttcttttgtttattttattatatttccaatatttcgagatgtcaatagttattttctgcaaaatagagattatttttcctaaaacgcgattatttctcattctattattgcgagcatccagtcccgtaatcgccgaatttattcatcgcaatcgtaaatttatatctttttcctatataatttttacaaaaaaatcgcatttcgcaagattttttcacataaatttcccatccgcttttttgtaccgccttttttatttgtttgtttatgctcattattcgagatttaattgttcaatcgctttgttttctctcgtttgaaaagatttaatccctctttctgaataaaccagatagtaaaattgaattttcaattattcttgtagacaaataatgagaatttatatatagtatagttaacaatcagttttagtgaatcgcattcgtttttattgaatgccgatataaaatttggaggaatacaaatggacaatctgggcatgcgtttgaaattatcccgcgagcgggccgatcttacgcaaattgacgtttacaaggcgatcaatctgaacaacaaatccttatcgagatatgagaacaatatttcttcccccgatcccgataccataagggctcttgccacactttataatgtaacgaccgattatttatttggtctggcggagcctgcggaactggtaaacgaacaaaaactctctccggcggaaaacaaactgcttcatatttttcgctccttatcccccattgggcaggggcgccttctggagcgggcggaaattatccgggacagcgactcgttcagttctgtgggcgaggaatctcttcatatggcaaaatgatatttgtcattcaggcgaaaggagttaaaaatgaaagaaatcagttttggcgaaagcgcagccctttccggtccgcacttatttgccgccatcgtgacccgcgacgaaaatgacaaggtaaacattatgggtgtatcctggtttacctttgtatccttaaaggacggtaagcttttattctgtacgagcaacaaaggatatacgggcggtgtgatccaaaagaccaagaaggcttctctgtgcatggtaagcgaatcaattaaggacaaggttctgcaatgctgcagttgctctggctccaatacggataagacggcagaattcgacatcgcgcttaagacgtgcgatgggtttgaggtccctgtccttgccggcgcaggtgtatgctgggcgcttgagcttgacaatataatggaagccggcgaccatacaatttatgtgatgaacgtgaaaaagaccgtattacttggcgctgcgcagcatgttatggcttttgacggttacaagcggcttgcaaccgtttgacgggcatacaaaaagagccggcatcagaccaggtaccggctctttttatgtactttaaaattcgtataattcgtcctggcaaataagcttgatgctgtttccagacaacacttctatcgctttttcattgtcttccacacggaaaatcatgtacgcaagctcctttttacggctgataaaggcgtaagtatattcgaggtttattttattttcccccaggattctcagcactttattgaggccgcccggttcgtccggaattgctaccgcgagcaccggcgtgatagagcagatataacctgcgtctttgagaacggtcgccgttttataggaatcgttgacaatcaggcgcaagataccgaaatcgcgtgtttccgcgacggaaagcgcacgcatatcaatcccattttcatcgagcacgtctgtcaaggccgcaagctggccggcatcattttccaaaaatacggaaatttgttttactgtcataacgaaactcccttcccttaataaagatggcgtttgtcgatcacgcggactgccttgccttcgctgcgcgcgatcgttttcggagccacaagatgtacctcggcgtaaattccaagcatcgccttcagtgcatcgatcaactctttttcacgatcgtaaaccttactgatcgtatcggagaacatctcgctcgtcatttccacctgcacttccagcttgtcgctgtttttctcgcggctgacaatgatttggtagttcgccggatagcccttgtttaaaagcaccgtctcgatctgggacgggaacacgtttacgcccttgacgatcagcatatcgtcgctgcgcccaagcggtttggtcattttgacatgcgtcctgccgcacgagcatttttcacggctcaagatgcagatatcgcgggtgcggtatcgaagcagtggaaatgcctcttttgtgatactggtaaatacaagctcgcctttttcgccgtccggcagcacctcgcccgtaatagggtctatgatctcggcaatgaagtggtcctcattgatgtgcatgccagtctgttcactgcattcaaacgaaacacccgggccggaaatttcggtcagcccgtaaatatcataagccttgatcccaagcttgttctgaatatcctgccgcatttcttcgctccatgcctccgcgccgaaaatacccgctttcagcttgatctggtccctaagtccgcgttcgcagatcgtttcgccgagataagcggcgtacgaaggggtgcagcacaaaatcgtggaacccaggtctgtcatgaactgtatttgacgatccgtatttccggacgacatgggcagcgtcagcgagccgaccttgtgcgacccgccgttgagtcccgggccgcccgtaaacaggccgtagccatagcttacgtgcactacatcatcctttgtcccgcccgcagccatgatcgcgcgcgcacagcattcgtcccacaggtcgatatcgtgctgcgtataaaacgccacgacgcgtttgcccgtcgtgccgctcgtggactggatacgtaccgcatcgcttaagggaactgccaaaaggccgtagggataagcctcgcgcaaatcgtccttcgttaaaaacggcagtttgtgaagatctgccgtagaccggatatcagcaggcgtaacgcctttttcttccatcatctttttgtagtatggtacattttcataaacatgtttcactgtttttacaagacgttcgtcctgccatgcctttatctgctcccgcgacgcacattcgatctctttttggtaatagtgctccatagtcggttggttcctttcctttaacaccggattttcgtccgaattttcctgttgttactatcataccattttaacgcgggtacgcaaataaaaaactttggaaaatttgaaatcaacgcttgacttcaagtaactttaaggtggtagactaagcgtatggataagaaagatacgatcaaacaggtttccgaactgacgggcttaactgcttcggggatccggtattatgagaaggaaggcctcattgaaacgatagagagaaacgccgcaggcgtgcggatgttctcccaaaaggacgtcgactggatccgttttttggcacggctcaaggatatggaaatgcccgtaaagatgatgaagcgttatgcgctgctgcgcgcgcagggggctgggacgatccgcgaacgcatggaacttttggccgtgcataaagagcgcatgcaccgtaaaatcgaacacatcaagagccacattgcccttctggatcaaaaaattgaaatctacaaagaaatggagcgtaatataaatgaataacgaacgttatgaacagggattgaagaaactctttgaagtagacggacaggaagggactgacatcacggaccgcctcggcgaccttggccggtacatcgtggaatttgcctttggcgatatttacagccgcgataaactgtccctgcgcgaacgggagatgatcaccatcgctatgctgactgtgctcgggggaagggaacctcaattaggcgtccacatccgcgccggactgcatgtcggccttgaaaaggacgaaatcgaggagatcatcatccattccgtgccgtatagtggttttcccaccgcgatcaatgcccttaacatcttaaagcagtgctaagcctaccctgtcagcgggactggcgataccatgcagaaccgccctctttacttaccacagccggtccaatccacggatgaacacatattccttagccgtcgatcgattggctatgtagcggtacccctccatatcaaaccctttcaatccttccggacttgtgatcctgtttttgacgatataacgcgccatcaggccgcgggcagcgcgtacggtagccactgtgccgcgcgcgccgtcaggcctttgcactaagaaacggcagcggatcatctcatccgccggcgaaagatagggcgtgaccaatttagtatattccagcgacgcaaggtttacgactgcgccgtcctgcggaaaaatttgctcataaatccggcttccccagaatgtatacaggtcttgccctccaatgcgaaagtcctttttcattcccagtcggtgtggcaatataccatcggccggacgcaatataccatagaatgcacttaaaacacgtaaccggctttgtgcaaagcgaaaatcgcttggatcaaaatccatggggttcatattgcgaaaggctgcgccatagtatgacagcaacgcgggcgtccccggcgcatgcggctcaaactcccgatagcatctcatcatttccacggcacgctcgggattcaaatccagcaggctctcaagctgccacggatcgtattccttcaaaacatcggccagctttatcgcctcgcttaaaaaaacaggcctttcgacctttatggccgcgtccgcaaacggacggatattccgtgcgggcgacaagagtaccagcataaaaattcccctttcgatctttcttgttctattatatgccacatatcgtttcaattccacatggaaatatgaggtaaaagaatagcagcgtgataaaatcaaaggtcgtaaagcgccgatattattaacattataaaaccaggaccgcctatttatcacgggcagtcctgtgtcttccaaaaggttatgcgccatgcacggtttaccacaactcagcgatatatccgttccaatgcaaaggatgcactggcagccgtgaacaaattaagccttggggagtatcaaaaaagtggtgaagtagaaaatggttaaaatggtgtagcagtggtgtagtagcagaaaataattcaaaagagaaggagataattcatttataaaacgagcttttcaaagcaacaaaaaacccgctcaatgagcgggttttcctttgctctggcggagaaggagggatttgaactcgctcatagtcatttcagcttgttttatttcatatcatcttgtaaaaaaactgtgtcattcagccattctttgttttattctgtaacacataaatttcctgttcgcattctctaaagggtaaaataaagggtagtaaacagattggaaaaagtgttaaaaaaagggcttttcagccctttttgttgtgataatctgaataagtagcaaacaaggttttgatcttatttcgatcaacggtattaagaacatcataaatcattgtaatatcttcagcctgatatttttccagcaataaatgtaaaagcatttcagccgacttgtttccactgaaatcgtctttaaagaaatcagaaagcgttaaatcaaaatgtttgcataacgcatctaatttatccacgcttggcaatgatctctcattaaccaaattactaataaaatttgcgccaaaacccaatatctgactcaaagcagtttgattcttgatattgttcgcttttagtaattcgcgcaccctgttagcaataaaatgctttaattcattatttctatccatgatttaagtataattttataacaagcaacaataacacagctaactaattgaatagattgtgtttacacacataattatgtgttataattattttgtgcttgatattaagtttacattatattatggcaataatgggttaaaatgcctttgcaaagctaattttaatctaatataccaatactattatttgcatagtaagaattaaggatcaatgtgtcatgaatgaaaaaaacacggtttgcggggtatggggtaattgcacaatcccacaagagaaaactggaactttcaagcaacaaatcaaaatgcaactgttagaaaaaattgaacagcgctgcaacgatttttttgttatctttacaaatcaagcagatatgatttttatggatgtggcgcttgagctgcaaaaagaatatcaaatcacgattagaatattgatcccattttttaaatggatgggtacaataagtaagagcgaacgccaacaacgggaaaagtatttggacttagtaaatgaaccatgttgcttttgcgccgataaagcatatcacgatattatgtctatctgctcctgcacacttgttgattactgtgataatttgctgattatttacgacgggcagccaaacgatgcaacagtcggcatgatcacacttgcggaatttcttgactataaaaccgaatatatcaggctgtaaaataatgtgccagagaaataaggtgaggaaatgaccgacgataagcacagaaaaatactggaagcgcgtatgaatgccgcatataacgatatggaaaagaagcggactaagctatcgcggatcatccaaaaaataaaagctgatccaagccgcaatatatgtgaagatgaaaaagtattgaaagccaatatgatcctgagcaatgccatacaaaaatatatgcgtttggaaaaacttgttatgaaagacaaatccaaattcataacaaagtgaagcgaggtcatttgtttatgacctcgcttttcaatctttgaatgattagaatattttagaaagaatatcccatagccctgcaatcgtaggtatgatccaaagtgttagaaacagtaccttgcaagctttcagagtattgagagactttttgatgtcttacgtcactacctgtatataggattttgtgattcccttgatctgcttcattgattcatcaaaaccgcttaaatgctgatcacaaacatcggtcgtcgtctcggctaacgtgtcgacggtttcgtcgatcttttgttccagaacctcgttgctttgtttcattcctttgatctggctttgcatttcttcgagcgattgattgatccggatgaactccgttacggctgattcctgaaatttcagcgatctttcttcggatttgatcaactgatctttcagcactttgttctcctttgtcaaaacgtccacgttgagcctcgtatccagcagagcgtccggattcgtaatggtcaccttcaaatctccattctcctcgatttgtttcaacacatcttcgcatttcattctctaatccctccttgctaatatccaccttgaagactttggacaggcggcaatcgcgtaccttatgcccgtcctgatctacaaagacgatatatttcctgctgtccgtccaccttgcctcaatcccttgatcgcgcattttctgaacgaaatcctcgcggcttgtcgcttgggctttactcttcgtaatcgctctcacaatattgagcatccaactttgataggttccctttgccgctttttcaatcgccttgtatgcgccgatcatatatgtggtgatttcattgttcttttggcagatcgttttgccgtgctccctaaggatgctatccgagaaatcctttaattcctgtaatttggcttttgagtaacggaatttgtaaccatgctcgaagctgaccgagttgaccacgatgtgcgtatgaatgtgatccctgtccttgtgcgttgcatagcacacctcatacccttgaaataacgggctgcgggtgatcagttcgtaggcgatccgattcgcttcctccggcgtaatgttttcatttctagggaagctttgtataaagtgcttatactgcctgccccctgttttccgccatgcgcgtttggtcgctttcatctcgtcgattgcatcaagcgggttgcagttatacccgccaatcaatttcttttcagtcttttcatgcttcataatgtagtttatgatcttgccgatactggcttttgaattaacggctttcaggattgccaaactgtcatcaactcctttatcgcggaatacatgctttcaagctgcggcgtacagtctacaatcaatccggcgtttacctgatacgcgatttggttcacgttgtttccaatggctttcaattccttcacgacctctctgcctccttcctttacgtggatgtctttgtcgagcatactacgcagggcatattcccgaagcgtcaatcctgaacgttcgacctttgattggatcaagacaagctccttgtccgacaccctgaaactaacacaattttttctgctgcggttagccatgttccacctccctcgaatgtgttctgacgggggttcaaagggggattccccctttgcaagcgtccaagtggcacgccacttggggagcttgccttcctctgtacgatgcggagcaggagtaccgccgcgagggcggtattcctgtctgctgtatcgttcggggaagtgaggcgcttatccggccttgccactgtttgtatcgatccacttgataaactgctcttttcctacgatcatccgtttgccaatatacaaggttgggaaaccgtttgcgtgcataagcgtatatgcacctgctctggaaatgcccaacacttgcgctaccatatcggcggtcaatgtgaccggcaactggtcatacgatgtttgattctgcttcatgcgctcctccttattctgttgtcaatgtgcgatggtctaaaaaccgtatcgattcacctccattcattccgacaatatttatttgcaataaatattgtctactgcaacatcataacataaggatgggcactctgtcaatatattaatgtataatattattgtctttttattttgcgaaaagcattgacaatgttttcggaatcaattatactgatgatattaaattgtctaagcggagggctttatgcagattttgacagatatactgttttcactcgaatattcacaggaaaacgaaaaacggatttatcagtatgtggaagatacaaaccctgaatacagggaattacagaacgatgtccgcaaaagctttgaatacggtagtatgttattggattttgcggaaaccgatccgaaactgtttgagcaaatatccctgcctgccgctatgttattgggaaaaatgaatctttctcacgccgaggaagcgaaaaacgaactgagaacactggcaaagcaaacaaagaaacggcttgcggaagtgcctgaacttttcagtgtatacaaggcaaaaggattaagggcgatagaagctgtgcttgaacagaagcaatgggagcaacaggaacgtcagcaatatattttagagggtttcaaaggaatattcctgagcgcccatgtgattgccgcatatattgaacaactcaatatcctgctgaatgcaaatgtatttgcggaacagatatataaccaaaaagcaacggcagaaatacggatggatatgatctatcatctgcttggcgtgcatgacgaaagcgtcaatgattatttttatgcaccgcaagccgcatcaggcagcacaataaatggaatatctgtaagcctgccacctgacatcatggctccgtcggattattctttcctgcacgatgcggaaatacggcaaaagatgatgataacagcggataacgacctgcatcgattagaatattatatccatgcggatgataccatgcaaagtatgatcatgggatatatacgggatatgatcgaaaatgacgctgtgatccgaaaatgcaaacattgcggaaggtattttgtcgcgcagggcaaaacggtttattgtaaccgcactgtggacgcgcagggcaatacctgccgaaagaaaggcgcaatggcgcaatatacgcagaatttagacagcgcacccgaaaagaaagcatacagactgacctacaagaataattttgcaaagatgaaaaagggtgctttatccgaagcgaaatttgaacagtggaagaaagaagcaaagaagctgaaaaaagatgtggaaagaggctcaatgccagtggaagcgtttctcgactggctcaaatatggggagtgatcacatggatatgaaggaacacaacgacaatcgtaaggcgaagagaggcgcacagggcggcggctcgatgcgcaagcgtgctgatggtacttgggaagcgcgttataccgtaggacgcgatcctggcactggtaaacagattcagaagtctgtttatgggaaaacgcaaacagaggttcgcaaaaagctacgtcaggtcacgacggaaatagataatggtatttatatagagcctgtcaaaatgacgtttggacaatggcttgatatttggttgaaagagtatacgggtaatttaaaaccgttgacgctgaaatcttatgttacgcaaatagaaaggcacatcaagccgtcactaggagcggttaagcttcaaacgctcaatacgccaacaatacaagccttttacaacaaggttcataggggaacaaatgatacagtaggtctatcggcgaaaacaatcaaaaatttgcatggtgtcgttcataaagcgctttcacaagctatggaaattggatatgtgaagtttaacgcttctgacgcctgcaagcttccccgtgtcgagaaaaaagaaatcaaaccgcttgaaaatgatgaaatgagcgcatttttgcaagcaatacaaggacatccatatgaaacgatctatcttgtcgatctgtttacaggtttacggcagtcagaaattcttgggctgacgtgggattgcatcgactttgacaaaagaacgatttatgtgtacaggcagctacaaaaaatacagggagtttatcagttccttccgttgaaaaacaataaggcgcgtatgatctctcccgcatccaccgtgattcaagcactaaaggcgcagaaacttcggcaaagcgaatggcgcttaaaagccggagcagcttggcagccgtgggaagggaatcagcttgtgttcacgaacgaaatcggcggtcacctcgcccactttacggtttataagcactataagaagattgtgcgtgatcttaatattccagatgcgcggtttcatgacctgcggcatacatacgcagttgcttctctgcaagcgggagacgatgtgaaaacggtgcaggagaatcttggacatcacacagcggcgtttacgctcaatcaatatgggcacgttaccgagcgcatgaagaaggaaagtgcggatcggatggagaaatttataaaaaacttataaagcaggagatttctatggattggaataaattatttagtatactgggcttgtgcttgggtctttttggaacaatattttctttgtgggcagcattagcaataaaaattgaggatataaaaaaagagcaacatgggcttatttggagggcggtgcatctaaagattcagctaagacaaaatttcaaggtaaaattgggttaatgattttgtccataggaactatctttcaaattattggaattagcgaaatttttagtgatatgactcctgtttgtataattttcatgttttcctttgtcgcctttgtagtccttttattcatttttaaacaacaagagaagaaagagcagcaagagattgatgactttctccattctgatgatagtagcaaaaattaaagaataattagcatcttataattatacttttggtttttgtcgacttgtatattgatttgtgttagtattatttatatacttgtatttcaagtgaggtgatttcactgaaaaatctcaagactttttatatgaatttaccctatgatttatccggaagcattagtaaaaaccgctttagaaatgaagtgctatggggcttatcaaaaatatatgaagtttataaaactggcaaagattttattgttgtgtttgactttatgtgtgatgttgaagttcacgttcccgatgaaaacacattagaactatatcaaattaaaactaataataaatctaagcctaataccttaaaaaagattttgtataaagacacaaaaagtggtaattctattctcggaaaactctattttttaaaatgctcgactgccgatgatgtagctgttaaagttgcgattgtttctaattgtgcttttgtagataatcaaaaaaataattacatgaacccacacggcttaagttttaaaaatttaagtgatagttgcaaaacatttattgcaaatgcttttaaagatgaattggcggatcaagtgaatgcggataaggtcaatgtccataaaattgatttcgaaaatatattctatattttcacgtctattgacctgtttgatccacaagagagtttgattggaaaaacagtatttttctttaaagaagttactggagaggaaccaaagaagccttatacattgtactgtctgttgtctgatatggtaagtcaaaaagcatgctgtgaattagttgaaaatacctatgaagatataatcgaaaagaaaggtatatctcgcgctgatattaaccttgttctcgataactattcttctaaaattgacaatgcagtacaaaaagcaaaggaacacattagtcgtattgctaattttcaagaacgtcttgatatgctcaaggcactgggaaatgcaaaaagggaaatcattcagaataaatcaatccatattgtacgtaaaaaaatagaagcttatattgaagagaatggtgaagttttgagtgatacaaccgagaatgtacttgcttcattatataataaatttattgatgtttttcccatcgaatattcagcacttgagaaaaaagggttcattttgcttgcgatgatggggatggaggaatctatctatgaaaaatttgagaattaatcgattatttatcttttctttaaatgagaaaaaagctaaggtggtcgattttgaaaacgggataaatattgttacttcgagcaaagttgatggaactaaaaaggggaaatcgaccttgttaaaaagtatttattacacgttgggtgcagattgcaaatttgaagatatgtttgatgctcaaacaaaatcatttatagttgagttttgcattgatacaacaaaatactatatatatagatttgacagaatgtttaagctttttgattgtgacttaaatcttttatttaaagatattgatagacgggacttggctagagatttagcagaattgtttcaatttcaaataaaattgccagacaagaaagaagaaaaattagaaattgctccgcccgtttatagctatttgctcaattatgtagatcaagacggtatgcgtggcccatattttgattcattcacaaatctttcacagtatagtaattataaagaaaatgttctatatgctcattttggcgtttttaatgacgaatattatcagttgttaaaaaacatcgaacaattggctgataagttgaaaaagtatgtatctgattctgaattgttagaaaaaatgataaataagattgacaataatatgggggaagcttcttattcaacaaatatggagattctcaaaattgaaattgcaaaaaaccgagaagaatatgcggaaattgcaaaaaagcttactgacacaaaaaataagttgttacgcttacgtaatgatgaatatgatgtccaagaaaacctttgtgaactacaaaagataattaagtcttccaacagtgacttgaaaaaattgaatcagcacgtatgcccagtatgccaatctcacatagaaaatactatgtctgcaaaaatcgaaagatatagtgatattgaagatgtttttcttctgaaaagtgcgttggaagaatcgatgctacagttgcagaaaaaaatagcagataaagagaatgagtatcgagaagtccttagtcgactaaaaggatatgaaaagaaaataagcaatagttcagaagaagttgaagaagtattacggcataagggatttgttgaagtcaagaatcaacttatgcaggattggagttcgtgcaaattaaatattgatattacaagcgaaaatttaaaaaacgaacaaaataagagagataagtacgataatgtaaagaaaaatataaacgccagatattatgagtttatggcttctgataaacagaggtttagtttgcaagaaattgacaatgaacgttttaaaaatataagaaatgttttttcggcaggaggtagtaataaacctatttccactataatttggtactttaatttattaaagataaaatatgagtttaaccctaaagcaataagattcccgcttgtacttgatagccctaataatactgaattagatgaagaaaaacgcctgttattatttaattatttgtttaataacattgatccaaacacccaattaattatttccacattgggatttgcaaaagaagattatcctgatactaccttttctcagattgttgagcttgaaaacaataagtacagccttctgaatacaaaagattatcaggacaatgtggagttgcttattaagttaacaagcacaaccatttaattctatctttattatatctaaagggtaaaaataccgcgaaacgcaaaagagccgcttaacaaagcggttctttttggcggagaaggagggatttgaaccctcgcgccgatcacctcagcctactcccttagcaggggagccccttcagccgtacttgggtacttctccaactgaattcagattatttataaaaagcggctttgcctccgcaattttttaaaaattggcggagaggatgggattcgaacccatgtgggcttgcaccctaacggttttcaagaccgccccgttatgaccgcttcggtacctctccaaaagaaatattccgtagctttgtgaacatctcccattcaaatatgctttaatagtataccaaacagaatcctttattgtcaagcgactttcggctgattcatctcatatacagcaaacaaaaaggatcacttctgtgatccttttttcgcatttttctttttatctctcttttcatcttctccccactgcgaatagcagatggcggcgcgctgcttgcggtccggaaatttatctgattcctcttttgtcatggtagcgatacagcgcgaaaggaaggactgcttttcttcaccgtttttcggttttggtaatggcatgtttgctcatctccagtcttttcatatcgctcttaagatacccgtatgtccgggaaagaaacatgaaaatcaagcaacgctttttgccatgtcttcaagaagcgcctgcattttgtcgatgatcggatccatagcaagaccgtacgtctcagcgatataggacattcgcggaaacgcaagccataccttaccattctcgtcttcccataccgatatacgcagcggaagttcgatggagacgctctggttctcctgcataagctttgtacctacttcgggcgagccaaacacaagcacctcggttgggcgcagcagtaaccctgcttcttgcgcgtttttttcatgatcgaactttgcaaatatgggaatatttcgctttttcaattcttcttccatacgccgcaccgtttcctttgaatcaaaggtactttcaaaaatgcacagacggccgccgttttttattttgggcatagtttttctccattcggtttttcagtctattgataacacgaaaaacatattccaaaacgattgctgtgtattactttaaaaataactattgcatatcctgcattagtttttcaagaagggtatcaagctctgttttttctttttcacttaaattacgggtcatgtgcgcctcccattcctcttccgccgcgcggatggcgtcataagcacgccgcgttttttccgtagggaataggccatattgcctgcgatctttttttgagaggacgcgcgtgatataaccatctttctcaaatttttgcacagcacgtgcgacagcgcccttgttgatccaaagctcttccgaaagctgttcttgcgaaagcccctcgtgctcgcagatgcacatgaggtatacgagctgcccccgcgtaagaccggtatcctttaaattccgatcaaggcttattcccgcccttcgtgacaagatggacaatttttttgcaagttcgcgcatttcgcatcccctttcaatatgttttcattttaagcgggtttcctgatgctgtcaaatgcctgtcagtgcttgactcttttttttatttccgttataatagttgctagggcaaccatagggttgcccattatcatgcgaatttagttgcctaggcaactataaaaggagttttatattatggaagcattatctgaaacaaagttgctcggcaccgcgcctatcccaaaattggtaatgaaatatgcggttccaagcgtcatctctcttctcgtaaattctctttacaacattgttgaccaaatttttatcggccagggcgtaggctatcttggtaacgccgccaccaacgtaatttttccaatcacagtcattgcgcttgcgttcgcgcttttggtcggcgacggtgctgcggcctatcttagcctgaaacttgggcaaaaccgtaaggaaagcgcgcagaaaggcgtaggtaatgcactcacacttctgattatcttcggagtaggattccttgtgattggtattttctttttagagccgcttgcaaagattttcggcgcgacagaaaattcccttccatatgcgcttgactatggacggatcattgttctgggcctgccttttgtattggttggtaccggcctcaattcatgtatccgcgcggaaggaagtcctaagatcgctatgctgtccatgattacgggcgcggcgataaacacaatcctcgatcctatctttatctttgtttttcaatggggcgttgaaggcgcggcatgggctaccatccttggccagattgccacttttatgatcagcatcatgtatatccctaaaatgaaaacggtcaaagtaacgcgcgcggatatgaagctgacgcctaaggtatcaaaaacccttatgggttacggcatttccagcttcatcacacagatcgcggttaccctctccatcctcgttgcgaacaatatgatcgtacagtatggtatagcgtccgtttacgggccggatatcccgcttgcggcttttggtatcgtcatgaaggttaatcagattctgatgtcttttatgatcggttttggcctcggcgcacaacccatcgttggcttcaactacggtgcagggcacggaaaccgcgtacgaaaagcataccttatttccattgcctgcgctactattgtggcagtggttggctttattatgttccaattttttccacagactattatcaacctgttcggctcagaggacggactttataacgaatttgcacaaaagagttttcgtattttccttttgctttgttttttgaacggttttcagatggtaacaggcatcttcttccaagccttgggcaagcccgtgaaatccgcactcgtcacattatcccgacagatcctgatcctagtgcccgctatgctggtcctgccgcactttcttggtctcgacggtgtgctatgggcagggcctgttgcggatggagtggcttttctcattgcgctcatccttgcattgatcgagataaaacatttgcagactgtcgttcctccggaaaaagcacctgcgctttgttcagagcaagtatagtggttttgataattccccgcttgcaaaatgccatgaataaaaaaaggaacgctccgtcggcattcctttttttatatcatattcgaatcccacacattataaattccgtatcaccttgcacggattccctgcggcaatacaattctctggaatatctttgttcaccacgctgcccgcgccgatcgttgtgtttttgccgatcgtcacgccggggcacacgatcacgcccgcccccagccacacgttatcgccgatcttgaccggttttccgtattcttttcccgtaaggcgttcctgcggatctgtcggatgcgtggccgcaataatctgaacgccggacgcgatcaatacattctccccgatttccaccttgcatacgtcaagaattgtgcaaccgtaattgatatacgtcccttttcccactgtgatattatttccataatccacataaaaaggcggccttactgtggcgctccctttttccgcatgcaccagctcacaaaaagtttcatcgatcttttcaggttcgtccggactcagcgtgttgagccttttacacaaaagcgcagcgcgcatctgttcttcctgcaactgacggtccgtcgcgtcatatagtttaccttgcagcattttttctttttccgtcatcgttttctcccgtatgcgccgtggtctgtttttttgctgttattcttgcggcgcttccggttcctctgcctcgcatccgcagccttccggatcactgtcttcatattcgttttccacaaattttgtcacgcatacgacctttgtatcgtcgccgacacgcatcaggcgcactccctgcgttgagcggcctataagggatatctcgtccacgctcatacggatcaccacgccggcatcgttgatcagcataatttcctcactgccgtccacgatcttaaggccgcacatcttaccggttttttcggtaatattcatggtcttaagcccaataccgccgcgcgtttgcagcctgtattcgcttgcctgcgtacgctttccgtatccgttttccgtgatgacaaggatctgctggcctttttccacgatacatgcgtccacgacctcgtcgccgctgcgcagcttgatcgccctcacacccgtggaaacacggcccatgggtcgcacatcttcttcgctgaagataatagacatcccgttgcgcgttccgaccacgatatttttcgtgccgtccgtctccatcacggagatcaattcgtcgtcttcccgcagattaacggccctgagtccgttttggcggatattggaatactcgctgaacggcgttttcttgatcacgccgccttttgtaacgatcaccagatttgaatttttctcgatcgccgattctattgggaataccgccgatattttttcatccggatcaaggtttagcatattgacgatcgccgttcctttggccgttcttcccgcttcggggatttgataacattttttcatatataccttgcccttattcgtaaagaataaaagctggttgtgcgtacacgtcacgaacacctgctctgcaaaatcctcttcgcgcgtggacatcgccgttatgccccgtccgccgcgtttctgcgcacggtacgtctccaggctgatccgcttaatatagccataatgtgtgagcgttacgaccatatcctcgcgcgcgatcagttcgtcaagatcgatgtcgtcttcgtcgaaggtgatttccgtgcggcgttcatccgaatatttatcgcggatttccgctaagtctgtcttgataatgtcgagcaccatctgcggcgtggaaaggatcgcattcaggtgttcgatctttgccagtatatctttatattccgcctcgattttatcgcgttcaagtcctgttaagcgctgtaagcgcatatcgaggatcgcttgtgcctgcacttccgaaagcccgaagcgttccgtaagcgctgcgcgcgccgattgggcgtccggcgattttttgatcagattgacgatctcgtcgatattatcgagcgcgataatcaagccttctaaaatgtgcgcgcgtttttgcgccttttccagttcgaattttgtacgacggacgatcacctctttttggtgctccaaataatgctcgagaaccgcttttaaactgagtaccctaggttcgccgtccaccagggcaagtgtgatcaccccaaaggtatcctgcatctgcgtatgcttatacaggtggtttaatacaacgttggcgtttgcattgcgctttaactcgatcacgatgcgcatacccgatttatccgattcgtcgcgcaggtctgaaatgccttccagccttttgtcatgtaccaattccgcaatcttttccaccagcgtcgctttgttgacctgatacggaatctccgttacaatgatcctttcgcggtcatcgccatacttctcgatctccgcttttgcacgcacgcggatcctgccgcgtcccgttttgtacgcttcgcggatacccgatacgcccataatgatgccgcccgtgggaaagtccggcccggggatgatatcgatgagttcttctaccgtaatctccggattatcgataagcgcaatagtcgcgttgatcgtttccgccagattatgcggcgggatattggtcgccataccgaccgcgatgccgcccgtaccgtttacgagcaggttcggaaaacgcgcgggcagcacggagggttgttccagcgtctcgtcaaagtttggataaaaatcaaccgtgtctttatcgatgtcgcgcatcagttccatcgtgatcttagacatgcgcgcttccgtataacgcatggctgccgctccgtcgccgtccaccgaaccgaagttcccgtggccgtcgacaagcggatgccggatggagaaatcctgcgccatacggaccatcgcgtcgtaaaccgccgtatcgccgtgcggatggtatttaccgagcacgtcgcccaccagccttgcgcttttgcggtacggcttatccggatacatattgagctcgcccatggagtacaaaatacgcctgtgtaccggtttcaaaccgtcgcgcacatccggcagcgcacgattgatgataaccgccatcgcataagcgataaatgatttttgcatctccttattgatatcaatcggtacgatattctttgtaatttccaaaccaattacctcgtccttcaaagattataaactttgcctgatccttaaatatcgagatcagcaaccaatttcgcgttttcttcgataaattccctgcgcggctctacgctgtcgcccataagtatggaaaacgtttcttcgatctcgatagcgttatccatgtctacctgtaaaagcgtacgcgtttcagggtccatcgtcgtttcccaaagctggtccggattcatctccccaaggcctttgtaacgctggatcgccgcaccgtcgcctacttcctccagatattcctgcaaggactcgtcactatacaggtatttatcttccgtaccttttttgctgactttataaagcggcggctgcgcgatataaacatacccattttcaatgagcggacgcatatagcggtagaagaacgtgagcaataagatacggatatggctgccgtcgacgtccgcatcggtcatgcagataatcttgtggtagcgcagcttttctacgtcaaattcctctcccattcctccgccgaacgccgtgatcatcgctttgatctccgcatttgcaagcgcgcggtcatgccgcgccttttcaacattaaggatctttccgcgcagcggcaggattgcctgaaatttcctgtctcgtccctgctttgcgcttccgcccgcgctgtcgccttcgacgataaatatctcgcatttgctcgcgtctttttcagagcagtcggcaagctttccggggagtgccgcggattccagcgccgttttccggcgtgtgagttcccttgccttttttgcagcctcgcgtgcgcgttttgcagtcaggcatttatccacgattacctttgccgtcgccggattttcttccaggaacgtattcagtccttcggcaaccgtactatccgtaagcgcgcgcatttcactgttaccgagttttgtttttgtctgtccttcgaattgcggctccgtaagctttacgctgatgattgctgttaaaccctccctgatgtcctctccggagagcgtaggctcgttttccttaacaagcttcatgcgccgcgcataatcgtttacaacgcgtgtcaatgcatttttaaagccatttaaatgcgtaccgccttcatgcgtggaaatattgttcgcaaacgagaatatattttccgcatatccttcgttatattgcatcgccacttccaccatcgacgtgcccttttcagtacagaaataaaccggctcttcaaagagcggatttttatttttattcagatactgcacaaaggatttgatcccgccttcatagcaatatacctgtttaagcggtttttcgccgcgaagatcctcgagcgtgatactgatccctttattcaggaacgccatctcccgcagcctgacgcgcagcgtatcgtatacaaaattgacgtcctcgaaaatttcgagatccggccaaaaacggatctccgtccccgtttcatcctcgccgcattctcctgtgatctccagcgtcgttaccggagcgccacgcgtaaattcctggctatgtatttttccttcacgccgcaccgtcgcaacaagcttttcggaaagcgcatttacaacagacacgcccacgccgtgcaaccctcccgaaaccttatatccgtcgccgccaaacttaccgcctgcatgcagcatcgtaagcgccacttcaagtgtggaaacccctgcctgcggatgcatgcccgttggtatcccgcgtccgttatcacgcacgtaaaggctgccgtcgttttctatcacaacataaatatccgtgcaaaatcccgccatcgcttcatcgatagaattgtccacgatctcatatacaaggtggtgtagccctcttaggtccgtagagccgatatacatgcccggacgcttacgaacaggctccaacccttctaaaatttgtatttggctttcatcataatgttcattctggttactcattttagtacctctcttttatctcaaaacacaattctcttcttccagttcaaaccgtctgctgcgcccaagaagcgtacgcgacgaaataggcgaaagaaaacctcgtctcccgccttcattttccgtaacgataatggattttggcgtatcttccgttaatttgacacattcgataccctttaaaaaaaggcttgtatcctcgttgcttacagcctcttcatactccaatatcgctatgatatcttttgtttttacaaaataatcgcttcctaaatgtaaaatcataaaaactcctactatatatatattatactatatatatatataatagggaagctctttttacgttttcggggcgattttgccccctgaaacctcaaacttatgcacactttctgtggatttaatctgctcgctgcctgcagtcgtaataaatacctgtattcccgtaagcgccgtcagtaaatttttcttccgcgtatcgtccaattccgaaaaaacatcatccagcaaaagtaccggcatttctcccgtactttcctcaagtattttaaggcatgcggttttaattgccagcataagcgtcctgagctgcccctgagacgcgtaaatgcgtacgtccttatcatttatcgtaatatctatatcgtccctgtgagggcctgctgcgcagccaaaatcggcaatctcttttttcaccaattttttcagcgtctccctaatctggttttcagggaccgtctccttataacggatgcttattttttcctttccccctgatatttcccgatgcgttttttttacgtattcattcaatttatccacatatgctttacggtttttgaggataattttgatataatcttcgagctggtcattatacgcttccagtatcgtttctaaatttcctgcacgccctgcgcgcaacgccgcatttttttccgcgatgatctgcgtatatctttttaaagcatccacataagaaggcctgattttggatatttccccatccaaaaaacccctgcgcaaggaaggcccctcctttgccattttgatatcctccggagaaaagactacaacataaagatttccaagtaattcctttaagctccgtgccggaatcccattgatcttcaggcttttctttttttcttttccgatcagaacttctatgatattagtctgctcatttcgcacaaattcagctttaatatatgcttcgccctgctcgaacatgatcgtcttactgtccatacttacgcgaaaagattttccgtttgcgcagatattgattgcttccaatacatttgtttttccctgcgcgtttttgccgtaaaggatattgatgcccgtataaaaatccatattcaattgttcataatttctgaaatgaatcagccttagattttttaaaaacatctttttcctttacatagtttaaaaagtgcgtataccaaaagaagtatacgcactttcctttttcttttttttccaaattactcttcacgcaactgtaccggcaaaatcagatattcataaatatccgaattttcctgttttacgatacatgggcttacgctcgtattatattgcatcagtatttccgattcctccacgcattttaagatatccagcacatattttgcattaaaggcgatctttaagtcgtttccttccgtaagtacgggtatcttttcatcgatatttcccatttccgaattggaagttatatccaagttcttatcgcggatctcaaatttcacaacgttgttgcttccttcgcgggcaaggatggacgcgcgctcgatactatctttgagcatccctgtctccaccttgacgcttgtcgcgcagtcttttggtagaagatttttataattaatatattctccttctaagagccgcgtaaatatctgcgtacggttcgcttcaaaaagcgccatattcccactgatggaaatctttatattttcttccgtatcgtctatgatcctggaaacttcccgcaaagtccttgccggaatcacacaatttttctcaatatccgaaattgcctgctgctttctgaccgccatgcgatacccgtcaagggcgactatcgttaaggaatcctttgcgatatcaaataaaagtcctgtcaaaataggcttatcctcattgaccgcagcggcaaaaattgtctgattgatcatgcttttcagcacattttgcggtaattttatctgctcattttgttcgataacaggaaatacaggaaattcatccgcattcatctgctgcaacacgaccttggaattcaggcaactgatctccactgaattttcattgatgctcgtaaaacttacgtcgctgtccggaaaacgattgataatttcatataacagtcttgctggaatcgccgcgtcccctattttttcaacctgagcttccatttctgttttgatggaaagcgcaatatccgtcgcctttagcgtgatcatattttctgaacaggaaaataaaatacactccagtattgttttttgcatttttgaagcagcgcggttcactgttccgatcgctgtgagtaaatttgatttcgtacatgtgaattgcatgactccattcctccgtttttttattatcaatatatgtgtcagtagtatatattagggcatgtgcatattgtgtataagcacatttttccgcaacatatatggatttgtggtcgtttgttcaggtgcataaactctgtttaaatccaaatcgttcgtgcagaaaatgtatgttatacgtggataaagaattttaaaattatttcaatttaaaaatctatattttttatccacaatctattcgttcgttatcccttgatccttgcctcgatatcctcaacaattcgtttcagttcgatatcttctttgatctggttctttattttttcttcggcatagattactgtcgtatggtcttttttaccaaaaaattcagcgattttaagataagaaaggtctgtcatatcgcgcaggatatacattgcaatctgtcttggaaaagcaatctccctgttctttttgtgtccccttaggtcgtcttctttaatatcataataattacagataatatcggcaactgcttttggcgtaattgcctttaccgcaggggtactgaaaaaatcatccagcgctttttgcgcgatcgtaaggtcaatttcctggatagaagagatatcgttatgaagctccgcatacatgataaccttttgaagcgcgccctcaagggtacggatgctggcatccttttgctgggcgatgtagtggaaaacttcgttttttatggggaggatatccggattttgttcctttaatacctgcattttcttaagaagaatggccacgcgtgtttcatagtcaggcattttgatatccgcgatgagcccccattcaaagcgggaacgcatgcgttcttcaagcttttccatttctttaggaggcctgtccgaggaaatgacgatttgtttattgagttcatgcagcgcgttgaacgtatggaaaaattcgtcctgcgttacgtcctttcctgcgataaactggatatcgtccaccaagagcacgtctacattgcgatatttatttcgaaattgttcgcgcaggtcaatatttgcgttgttgttggtgagctggatcatacggatcagctcgttcataaaggtttcgcttgtcacatatacgatttccgcatccggcttttcttttttgatatggttgccgatcgcatgcatcagatgtgttttgccgagacctacgccgccatataaaaacaaggggttataggaatgcccgggggactgcgctacggcaagcgcggccgcattcgcgaatttattggattcacctacgacaaaggtatcgaatgtgtatgcggggttaagagttgagcccatcggttttttgggctggggcttttccggcgtaatctcatttaccttaatattagccgcttcctgcggggttacaaataataaagaaatatttaccgccgaagcgccgtaaagctcttcgtaggcaagctgcattgtctgtttgatcttatccgcatatttttccgtgatcaggtttttatgcatagggctggatacttcaaaataataagtattttcctcttcatggatcggttttaattctttgatccatacattaaattgaaacatgggaagatcctcttccaggtaacttaaggttttttcccataggatgttaaatacgctcatctaaaaattttcctctgccttcttttatgtggataactatgcatacagcgaaaaaggctgtgtgtcaagtttttacaagtccttgtaaaagttatacgaatgttatccacaaatctatccacaaaatccacaaaaatgtgaataaccatgcgggttcctgcgtgctttattatagcataaagggataaaaaaaggaaaggaaaaaagaaagaaaataaagcggtgatttgtattgctggaaaaactgtattagaatacaatcatatcaaagaataaagcaggcttgtttatttggtaaggagatatgaaaaagagagcggaaatcaaacatatatcccaattgggtttttcaagacagtacggaaaggctgttttagtagcgttgatcgtttccattatccctttttttatgatgtggacgggaagcatccttactgttgccgcaatacacaggtccttgtttattttccaggccagcctgcttcggactgttactgtggcgatttcttctgttgccctcgggatcattatgattttgatgcagccgatccttgctgtgggaaatgccggattttttacagatatatatgacggcgggaaagcagggatacctaaggtattgagcggattccagaattttggaaacgcgcttggcggaatgctgtggatgatattgtggatattcctgtggtcgatcctgttcattgtcccgggtattgttaaaagttattcgtatgccatgacgccgtatatattatcggaatgcccgaacgtctatggaccggatgcagtggaaatatcaaaacgtatgatgcatggttttaaggcaaaattatttgttgcgcagttgagttttcttgggtggatgattttatgtgtattgacgctgggggtattgtggatattttatgtgggtccttactataatactgtgatggcgggttattatcggcagatcaggcaggcggcaattgaaaatggcgtggtgacgcaggaggaatttgacggagcggacttaaggccattggagccataagccgcacaaatgcctttttttggttgacacttgaccttaataaatatataataataatcgtctttttatcgaaaaaaatatgatgcaagctaccggcgtgagggccggttagtaatacgattacacagaagtggagagattaagattatgaaaatgacctatcagcctaaaaaaagaaaacgcagccgtgtacacggttttatgagcaggatgaagacaaaagccggaagaaacgtacttaagagaagacgtgcaaagggcagaaaagtattgtctgcataaaaagtgaacatactgacgctgaaaaaaaacaaggagtttaactttgtttacaggcgtggaaagcctgcttcctcgcgcgatttgacgcttgtgtgcgcgaaaagcagatacggcggtgtgcgcgttggattttcggtcagtaaaaaagttggaaacagtgtggttagaaatcgtacaaggcgcaggttaaaagaagcgtttcgtacgtttttacctgttttgagcggtaactacagtcttgtttttgtagcgcggcccacaataagcgatgtggagttttcaggtatctgtttgcagatgcaaaagctcctgaaaagggccggcctgttatccctgaagggagaaaaacatgaaaaaagtgatattggcgttcattagattttatcagaaggcgatctcgccttattttcgtccgtgttgcaggtatacgccgacgtgttcacagtacgcgattcaggcggttacgaaatacggggcgctcaaagggacttttttggcaatcaagcgggtattgcgctgtaatccgctttttcacggcggatacgatcctgtgccgtaaatttgggaggatatagatattggattttctatataacaactttttatcagactttttcagcatttgcatgaacgggctcaacagcctgtttatggattatgcgctgtgcatcgtcatattgacgatattgattcgtttgtgtttattgccgctcgatttgaagatgagaagcaattccgcaaagatgcaagcgctggggccggaaatccagtccttgcaaaagcgctatgcgaacaatccgcagcaattgcagagaaaacagcaggaattgtaccgcaaaatgaatgtaaaaccgatgttcggctgtttgccgtccctgatccagttgccgatcctgtttgcgtttttcggcgcgatgagggtgttgcagagccagcagacggtagccctaatgctcgatgcggcgcagtatggcgcaagtacggtccagcttcctgagtttttctgggtgcataacttctggcagccggataacggtatgtccaacatcctgccgaactcgacggagttcttgtcgtttatccagcaaaactccctgtatatcaccccgcagacgatggggctgctacagagtcatggactgctcgatttttcgacaggcgtaatgagtgtgccggaggatgcatatacggcgctgacgaacgggatactccaggcaaacggctttatgaacgatgcaggggaagtaaccaattataacggatactttattctgccggctctcgcgggtgtggccctcttcctgcagcagaaattcaatcctgccgcaatgaacggcggcatgaatatggcggctgcaggtagcgaacaggcggatgcgcagggatgcagcagtaagatgatgctttggatcttcccgattttctcgatctggatctgcgcaacgtccaatacggcgtttgccctttactggttcatttccagtttgtatgcattcacgcagatgaagattgtggacctcatcaaaaaggcaagggcgaaaaagcaacaggtcagcgttgtataaaaaggggatgaaattatgacatatgtggaatctaagggtaagacggttgatgaagccattttcaacgggctagaagaactgggactcgcccttgacgaagttgatattgaaatcgtacacgaaggaagcaaggggctttttgggatcggaaaaaacgcactggtaaggcttaaaaaaaaggaagcggaacaggcggcgcagggcgcacctgaagaatttttgaatgaattgtttaaaaaaatgaatgtagatgcacagtgcggggtcaaagaaaccacggaaaaaagtatccagatcgaaattacagggaaagatacggcggtgctgattggccgcaggggagatacgcttgatgcgctacagtatttgacggggcttgcggtcaataagggtaaagacgattataagaagatcatgctggatgcggaaaactaccgtgaaaagcgcgagcgcactttggagaaactggcaaagcggctggcaagtacggttgcaaagacaggcaagccgattactctcgagccgatgaatccatatgaacgacggattttgcatgcgacgctgcaaaacaacccgcgtgtggaaaccatatcggagggtgaggagccttaccgccgtgtagtgatcaaaagaaagagaagcgccgattaatacgcagataaacggacccggcttaaaaagtcgggttttttgactcatgggcataagaatccttgcgcataagcgagggttcttttataatcatacagaggaaagcaatatgcaggaagaaacgattgcagcaatcgcgacgcccccaggcaccggcggagttgcggtcatcaggatcagcggagcgcaggcaaaggaagttttgcagcgcgttttttcgcgcgaccggttcgagcatgcaaaaatgtattatggacggatcgaaagaaacggcgagctgctcgacgagggcatggccgtcttttttgaggggccgagatcctacaccggagaggacgtggcggagcttcattgccacggcagcttgatcgggctccaaaacgtactggattttgtgtttgcatgtggcgcgcgtccggcgcaggcaggggaatttacaaaacgtgcttttttgaacggaaaaatggacctgacgcaggcggaagctgtatgtgattttatttcggcttcctcgcaggccggcgcgaaggcttcgctgcggcagcttgaaggcgggcttaaggatacggtgctcgcgctgcaggaggagttaacggatcttcttgcgcgcgtcacggcggcggtggaatatccggaagaggatctggagcatgaaatcacggcggatgcgcttgtgctgatcgggcaactgacggaaaaaataaagatgctggccggaacttttgaccagggacaggttttgaaggaagggcttgacgtggcaatcgccggaaagccgaacgtcggaaagtcgtctctgctgaacgcgctgcttaagcgggacagagcgatcgttacggacgttccggggacgacgcgggatacgatcgagcaaagtttttatatcaatgatattcggataaatttgacggatacggcaggaatcagaagcacgaatgatgctattgagaatgagggtgtaaaacgttcgaaaaaagctataaataatagcaaactagcgatttttgtgttggatgcagcggccgaactatcggctgaagatcaaaacgtttttgaggcgcttaaaaacagtgaagtcgatactctggtcgttttaaacaaattagatgcgtctgagaggctctcagaaaaggatgttttgcaacgttttccggcgtttcccctgcttaccacttcggcaaaaacaggcgaagggatagaggctctgaagacatggatttatgaatatgccatgaaagatgctcgcgcggagcgcggcgtcatcattacaaacctcaggcacaaacatgctcttacgcaagccgcgtttcatttggctgaggcacaggaggcgcttgaggcagggatggacatggactgcgtgacgatcgatttgaacgatgcgtggaggagtcttggagaagtgacgggaaaaaccgtcagcgaggatatcattgacagggtttttgagaaattctgcctggggaaataagaaattgtttgcgctgaaacaacttccggcagacgcagatgaatgaaaagcatgaggagaacgcatgacagaatatgacggcggacaattcgatgtcgtggtagtaggcgcggggcacgcaggctgcgaagccgcgcttgcttgtgcacgtctgcataaaaaaacgttgctcgcgacgatcaacatggacggtatcgcgcttatggcatgtaatccggcgatcggcggcagcgcaaagggacatttggtacgcgaaatagacgcattgggcggacagatggggcttgcggcggatgcgacgtttatccagatcaaaatgctgaataccaaaaaaggtccggcggtgcattccctgcgcgcacagcaggataaaaagcagtaccaggtctatatgaaacagacgcttgaaaatacggagaaccttttgcttgtgcaggatgaaatcacgcaaatcctcacagacgataagggcgttaccggcgtcatgggcgcgatgggcgcaaggtacggcgcacgtgcggtaattcttgcgacaggcgtttatttgaaaggaaaagtaatcgtcggggaatatacgaaagacgcggggccgagcggcctttttcctgctgaatatttgagtgggagccttaaggagctcgggttttctttgcagcggttcaagacgggcacgcctgcgcgcgtggacgcacggtctatcgatttttcaaaaacggttccgcaatatggcgatgaaaaaatagtgccgttttcctttatgagcggcaggattgagcgggagcaggttccctgtttccttacctatacgaacgaaaagacgcatgagattattcgcgaaaacatacacaggagcccgctttacagtgggatgatcgaggggatcggaccacggtactgcccgtcgatcgaggacaaagttgttaaatttccggataaggagcggcatcaattgtttttggagccggaaggattgcatacgaatgaaatttatgtgcagggcatgtcttccagtttgccggtggaagtgcaggttgcgctttaccggacgatcccggggcttgaaaacgtacattttgtgcggccggcttatgcgatcgagtatgactgtatcgatccgacgcggcttatgcccagcctgcagacaaaggatgtaacgggactctttatggcaggacagataaacggcacgtccggctatgaagaagcgggtgtgcaggggctgattgcgggcgtcaatgcgtgtcggtttttggatgaagaagggccggtcgttttaggaagggatcaggcatatgcgggcgttttgatcgacgatcttgtaacgaaaggcacaagggagccgtaccgcatgatgacggcgcgcgcggaataccgtttgcttctcaggcaggacaatgcggatacccgtcttacgcagatcggacgggatgtggggctggtaagcgatgcacggtatgaccgctttatgtataagatggaaaatgtttcacgtgaaacaaaatatttgcaggaaacgacgatcaaccgcgcggatgcggacgcgtttttaaaaaaatgcgggatgcaggaagcggaaaaaggtatgaaactcgccgagttattgaagcgcccgggggtaacgtatgcaagcattcgaaagctggatggaaactgtccggagcttgaagaggatatcgcactgcaaatcgaaacaaatatcaaatacgcggggtacatcgataagcagctaaagcaggtcgcggcggcagaggcgctcaacaagaagcgcattccggaggacatcgattatgcgcatatcaagggactgcgcttggaggcgcgggctaagctaaacgatgtgcggccgttaaatgtcggacaggcatcccgcgtctcaggggtatctcctgcggatatttcagtactgctggtatatttggcggcaagaaaaaaataacgcggcgcagcacatacgatgaaaggagaaaatcatggactatagtattgaatcggaaaggctcggcttaagaagacttacagacagcgattttgacacgatcgctgttttcctgaaggaccctgaagtaatgtatgcgtgggggcacggattctccgacgaggaagtgcggcaatggctggataagaacttaaaacgttacgataaagacggatacgccttctttttggcaatagaaaaagaaacgcaaaaaccggtcggcgtaatcggtatcatccataatgaaatcaatggagcgcagcgatgggagatcggctatattattgacaaaaggtattggcgcaaagggtttgcaaaggaaggctcaggggcttgccttgcgcatgcgttttcaaagatgggccttgaggaaatggtttttcagatgcgcacggacaatattgcttctcaaagggtggcggagtcgctgggcgcgcagcgcgagggagaatatgtccgtcactactggggagaggatatgccgcattatatctatgcaataaagaataaatgatcctgtgtggtcgtttgatgcaggcagatgtaagtaagcgtgcggcggttgggcggtccccgattgtttcacgtgaaacaatggcaaaggagtaagcatggaatttgatttaaaatcggcaaagtggttaaatgagcctgaaaagtatgaggagacaaagagcaaagtcacgatatatacgcagccggaaacggatatttggcagcgtacttattacggcgcatgccaaaacaacccgcatgccctgctcatcgatacgacggaggatgaatttacgttcagcgtaaagacgaccttcgcaacggcttcgctttatgatcattgcggcgtgctcctttatctggatgaggaaaactgggcaaaggcatgcgccgaatatgaaacggaagagcagcagatgttgggaagcgtggtcacaaacctgggatactccgactggggcggcacatatatcagcgaaaaggtaaaacgcatgtattatcgggtcagccggcgcggaaacgatttcctgtttgaaagcgcaaccgacggagaaaacttcaagcagatgcgtttcttccatcttttttgccagcaggagccggtttccatcggtttatttgcatgcagcccgggcgaaaaaggattcaaagcggtgtttgagaatatgaagttttcgccgtgcgtatggagcgcgccgtccgtgaaagaatgaggataaaaaatgtctgtatttagcgaaacactgaacaggttatgtgcgcacaacggttttgacgtaccggaagacgcaatgaggagcatggaaacctattatgactgcctcgtggaaacaaacaagcaatacaatttaacggcgatcgtggagccggaggctgctgcgctcaagcatttttttgacagcatcgtgccatatgccctgcttcccaaaaacggaagggtcgcggacgtcggaagcggcgcaggctttccgatcgttccgcttaaggcggtgcgcggggatatccgtgcctttgcgatagaatcctctgcgaaaaaatgcgatttcatcgtaaaagccgcccaaagcgcgaagctggacatcaatgtgttttgcgaacgcgcggaaattgtggccgcgggaaaaccaagggaaagctttgacgcgtgcgtttcccgtgcagtcgctccgctaaacgtattatgtgagttatgtgcgccgcttttaaaaaacggcggcttgttcctggcgtacaagggggaatatgaaaaagagcttacacaggcgaaaaacgcgctgaagaccttgaacctggagtttaagcaggcggtcaaaatgccggaggcagaatatgggcaccacgtccttgttttcaagaagacaggggaaaacgcggcaaaatatccaaggcggtatgcgcagatcgtaaaatccccgctgtaaaagttcacactggattcgtaattctatgttagaataaaccattatcagggaaaagaaggcaaatactatgaattggctgagaaaatttatgatgggacggtacggcggcgaccagttcggtatcttcctgatcatattatccattattttaagcatcgcgctgatgttcgtacccatcgcattcattagctggctaagctggataccgcttatttttgcgatctacaggatgttttccaaaaacataaccaagcggcaacaggaaaattttgcatatatgcgcaagtggggcgcggtcaagacgtggctttggaagttgaaaagcggcaccctgatcgataagacacacaaaatgttcaaatgtccaaaatgcgggcagaaactgcgtgtgcctaaagggaagggcaagatcagcattacgtgcagcaaatgcggaaataaatttatcaaaaagacttgatcaatatttagcagaagaagaacacgatcccccgcctagacacaacatattgcgtttgacgggggattttatattgaaaaataggaatgcggaacggagaagaaaacttttcaatacaagcgttttcagttataataagaaataccggctttgaaacggaaaaagcatatatgcttaggagagtgaaatcatttgggtaaaatcattgcgatcgccaaccagaagggcggcgttgggaagacgacgacggccattaatttaagcgcatgcgttgcaagtatgggaaaacgtgtgcttttgatcgatatcgatccgcaggggaacagcacgagcggccttggcgtggaacgtacggggcttaagaagtcttcctataatgtcctcgtaacggggacttcccctttagaggctatccggccgactatgctcaaaacgatggatctgatgcccgcgaatatcgaccttgtgggcgcggaggtggagcttgtttccatgatggcgcgcgaatcgatcttaaagcgtgccctagaggaagtcaaggggctttatgattatatctttatggactgtccgccgtctttggggctgatcactttaaacgcgcttaccgctgcggataagattttggtacccattcaatgcgaatactatgcgcttgagggcttgacgcagcttatgagcaccgtcaagctcgtacggcaaagcctaaacccgggattggaagtcgagggcgttgtactgacgatgtttgacagccgtaccaatctttcgatccaggtggtggaagaggtgcggaagttttttaaaaacaaggtatacgagaccgtgatcccgcgcaatgtgcgcctaggagaagcgccaagctatggactgccggtcttgttatatgatgagaaatgcttggggacggaagcgtacagcgagttggcgcgagagttcctttcgaacgataaatgatgtggaggaagctatgaaaagaggtttggggaagggcctgagcgcgcttatggcggatgcggcgaccgaacatacgggtaatatgggcgtccatgaggtcgatattttcctgatcgacaacgatgcgggacagccacgaaagaaatttgataaggaaaagctgaatgaactggcgcagtcgatcaagatccacggtatcatgcagccgatcgtcgtttatccaaatgagggacgttatacgatcatcgcgggggagcggcgttttcgtgcggcgaaaatagcgggccttggcaaggtccctgtcatcataaaggagctggataagcgcggtatactggaattgtcgctcatcgagaacatccagcgcgaggacttgaaccctatggagcagtccgcggcgctatatgaacttatgatggagtacgggcttacacaggacgaggtcgcaaagcgcgtgggaaaaagccgcagcgcgatcgcgaaccttcttcgcctgcgttcattgccggacagcgtgaaaaagctggtggaaggcgataagctgtcggcagggcacgcgcgctgcctgcttccgttggaggatgaaaagcgaatcgctgacgcggcaaagacgatcgtggacggcgagctttccgtgcgcgaagcggaagcgctggtaaaagagctgttaagtccgtctgcggcaaagccaaaacctgcgaaaaaggcgaaaaaaatgccggtggagatgcaggaagcacaggaagaactgtccaatgtccttgcgaccaaggtacagcttgtgggcagccggcaaaaagggaaaatctcgatcgcgtattacagcgcggagcagcttgaagagctttatgaaatgctcaggaagatgtaaataaaacgggcggctgtacgaaaaaaagagggggtatcccctatggatgagcaaatgaaaacagtataccattattgcagtgtggaaagcttttacggcattatttccaattgtacgttgcgcctttccgatatcgataaaagcaacgactatatggaacgcaaatggctgcaaaaatttattctcgagactgcgctcgaggaatatgcaagggagccgttcgcgttttctttcgtggacggggataaaaaatacgaagggccggaggcggtcagggcgctgatcgattacgagctgaaaagtacgggacagcactggtacgacgattacatcacgtacgcgatctgtttttccgaaaagggggacagcctgagccaatggcgcgggtacgcagacgacggaaacggcgtatgcatcggctttcgtacggataagctgcacgaaaaactggtgagtatacatgaaacggacgagccggggcatacctttcaattccagccgatccgctacacacagcaggaacaaaaggacatgatccgtccgcatatccgcagcatttttgctattttgaacgacctgattgggcaaaaatcacagccgacaggcgagatcatcaaattgttccgcgcgatcaacggggaaagcgcgttttgcaaaaatcctgcgttccatgaggagcaagagtggcggctggccgtcaatttccctttgcctacgttcgatgcttacgaaaaatttgaagagcgttccgagcatgtggcgcaaaacgatattttcagccgcatcaaaacgtctgtggcccataaaaccatcaaatcatatgtggagcttaacctgcaaaccatcggcatggatgcgctggtgagtatacgtttaggacccaaatgttccctttccaaaaacgatgtgaagctgtttttatacagcgaagggctttcattgcccgacggaagcatcctgtcttcggcggcgacctaccggtaataaaagaaacccgtgcggacattttttaaaaagcggttgacaaacagaattgatattactataattatagtaataaaactattgcaatcataatacatgtgaaaggaaacgatgatgaaaacgactttgacagggccgcagtgggccgtgatgtccgcgttatggggaaagcagccgcaaacgctttccgaggtaatcaaatccatgggcgatactgtttcctggagctatacgacatacgcgacctatttatccacattatgcaagaaaggctttgtgggctttgaccttaagggacgagacaagttttattacccgctcaggcagcaagaggagtgcatccgcgaggaaagccgaagcctgctcgacaaaatggacgcggctgccgcgaaacagtttttggtctgtatgatacaggaaagcaaattgacaaaacaggatcaaaaggagttaaaggagctgatcgacgagctttcggaaggaagtgagtgatatggcggcaatggatacacttttgtccgtttctttgtacgccgcggtgatcttctgcggcattatggtattccggaaggtattgaaaaataaactttcgcccgcgctgcagtacgggctttggtttttgttggccgcgcggctggttttcccgtttacactggaaagcggctttcattttgtgacgcttccggccgcttcgcaaaacgccgtatatacggcgggaacggccgcgcccgcaacggaccttgcggcgatcgcgcagccggtaacgctcacaatgcagcaggtcgtactcatcgtatggctggcgggcataggagtggcggcggcatgtatgttgttttatgcggcgcgtttgcatgcggtaatccgaaaaaacgccgtactgccggacagcaggatcgggcgtatctttgaggaatgcaagcaggaggcggggattaaatccaatattcccctgcgcttgtgcgcgggattgggtacgcctgcgcttacagtctccttccggcccaagctgctcttgcccgttggtatggaacaagcggacgacgtgacgctgcgctatgcgatgcttcacgaactgacgcactgctgccgcggggaccacttgatgcgcatactgatgaacgcgctgaaagcggtatggtggttcaatcccgtggtatggcttgcggacaggcatattatcatggacatggaaacggcatgcgacagcacggtcgtgaaacgtatggaacaacaagagaaaaagcaatatgcaaacacggtgcttaccatgttttcacaggaaaaaacgccaaagtatattttgggaatggctctcggcaattccaagcaggttgccgaacaaaggataagagggatatatatgaaacaaaaaacaaaacgaagcatccggctggctgcggttttgctggcagggatattgctcattgcatgctttaccacggcgtgctcgcccgtgcaggctgcggacaaggatatggagccgcaggaatccgccggagtcattggcggtgcggacggcccgacggagatcgatgtaacggagcaagatacgcaagaacctcagcctacggaaatgccgcaagttagcggcggggaagtggacgagcaaggcgtgcggttcgcggctacgctgtcgcccatggaaccgaaggccggcgaaaaagcagagttcaccttgactgtggagaacaacagtggtaaaaccataagaaattgcagggtagagatacctgcggtcaaggaaggacaaataggagacacgtttacgcttgcggacgggcaaagcagaaagatgcaatggacgacaacaggggaatttaccgtaacaatagaagcgctcttcgcatttgaaatggacggaaaaacatatgattgcgcagtagggatggctccctacagaggcgatacatacgcagggggaacggcaaccgaacagcctgaacaaccggctccggcagtggaacccaccccgcagccatcgatggaggaaggccccgtgcccacgccgcagcctacattgccaccaggagcttcggctccgatcctgtcgtctacgccaacgccgatgcctacacctgcgccctcggcggaagaagaatcgccgccatggggaaatgttccaaggccgactgccgacccgggacccgtgcccacgccgacccctacactatctaaggcagaataacaggttaacccaagcaaaaaccatataaccgaaaagaggaagcagccacgcttccttttttcgtgcagtacaaaatacctgccgctgttaaaaagtgttgacaaataaatatgcaggcgttatattgtatatacagtatatatacaatattgaatggaggattggatgagtggatatcatcatcagcaactccagcggaaagccgatctatgaacagattacctcgcagatcaaaaatatgatcctgacgggggtactgaaagaaggggacgcccttccatccatgcggctgctggcaaaggaactgcggatcagcgtgatcacgacaaaacgtgcgtacgacgatctggaacgcgacggatttatcgaaagttttacgggaaaaggcagctttgtcgcgaaaaagaacatggaatttgtacgcgaggaacagttgaagatcgccgaatcgtatttaaaggatgcggtagagacggcgaaaagcagcgggatttctttagaagaattgcgcgacattctcagcgtgctttatgacggagattaaaaaatggaaagtattgaactgaaaaacgtaaccaaaagatataaggattttgccctgagcgacgtgagcttttccgtgccgaagggcagtatcatggggctgatcggcgaaaacggcgcggggaaaacaacgacgatcaaactgatcctcaacatgataaagcgggatgcgggaagcatccgcgtgctggggatggacaacctggaatgcgaaagggagatcaaatcgcagttgggggtggtattagaccggagcagcttcaatgagcagctcaagttaaaggatgtagcgacgatcatgcgcgcgatctttcagaaaagctgggacgacgcgctcttttcaaactatgtacgaaaattccagttgccgcaggataggaaaatcaaggcgttttcgcgcggcatggtcatgaaactttccattgcgacagcgttttcacatcacccgaagctgctgatcatggacgaggcgacaagcggacttgatccgattattcgcaatgaactgctggatgagtttttggattttatacaggacgaggaacattccatcctcatttcatcgcacatcacgagcgaccttgaaaaagtagcggactacatcacgtttatccatgacgggaaagtcgcgctttcagcgtccaaggatacgctgctgtacgaatatggcgtcttgaaatgcggggaagagctgttttccgcaatcgaaaaagaggatatcgccggctaccgaaagtcgagctttggttatgaggcgctcgttcccgaccgtggaaaagcggcaagaaaatatgaaggcgcggtgatcgacagtgcgacgctggaagacatcatgctttttacagtgaagggggaacagaaatgaagggtctgatcatcaaggatttcctcggcatgaaaggttttttcaggatttttattatcatcatcgcgatctgcgtcatccctgtgatcgtatcgcagcagggagaattttcaggaggctttgcgagcggcatctgcacctttatcggcgggatgatgtgctttacttcgttcgcgtacgacaaggcgtacggatgggacacttacgtactgacccttccctatacgagaaaacagatcgtgctttcaaaatacctgttttcccttttgatcacaggcatcggcgcggggatcgggcttatcgtaaacctgatcctgacggcaacggggcttgcgcacatggatgcggatacatggacgatcatcgggctgcttggctgtatggtgcttctgttcaacagcgtcacgatcccgctgatgttccgcttcgatccagaaaaaacacgcgtcatcgtcattgtgatcttcctggttccctttatgcttttggcgctgctgggcgggggagacccgaaccgtatgatggatacgatccaagcggtcatgacggctttgccggttgtttcaatcgcggcgctggttgtttcgtggtttgtcgcggcaaaggtctacgagacgaaggaagtatgaggaatgacataaagcaggatacaaaaaagacgccgtatacgccggcgtctttttgatatacagagcaatcgctatatgacgcctgtgattccagccagcaggaaattgttgtgatagaagaacgacacgaaggaagagccgtttatgatgtccgagatcacatccgtaggcatggaaacgaggatcacagggatgatcataaagagcgcgaacatacccagaaagccgcgcaatacgcctacgccgccgccgatcaggctatcgaatctgcgcagcacgggaagcggggaagcgtaattgtaggcgttgatcaaaagtgcgatgatgatacgcgcgatgatatagatcaccaggaaagaaaagatgttcacgacgacattggtgatcgtgtaactgacgtaatcggaaaccgtatgcagtcccgcagactcaaaggcggcgtttgccatattctgcgttacaagatgatcgaaaggagccggcaggtttgccgtattcaccacctggtcgatctgcgattgggacatggtcgttacgagcatgttgcccgacgcctgcaactggtccacgccgttggtaaaatacaaaaggaacttataaaaaggtccgttggcgatggcctgggacatcagagggctgaacacaaacccaatgatccaggaaagcgccatgccgatcgtatttgaaacggaaatcaggaatcccttatggaagccctgcagaatatagattgcgatcaaaaaaagcacaatccagttcagtatacccattcgttcccccttaactcaaatgcataatgtagcttttatcctgatcccatacgagggcgatatctgctgaaagctgcttgacgccgatgatcgtttggtcgatctgcgtcgttttttccagcttgccttccggcgtataggaatagatggcgttgggcgtaaaagcaaataattttgtaggtgaaagcgccaatgaaaaaacatcccgcggcagatgcacggtatgatagcttaaatcgctgttgtaaatacgtgcggactcgatatttgcaagggtggcgcgcgagatataagcggctttcaggctattgccgtcgatgctggcgcctgccggtttccagccatagatgagcgtatctgcctgtttggcgccgacgtagctataggaaagcaaatcgtttgtacccgaggcaaaaatagtgtccgacgtgacataaaccttttcgaccacttgcgtatcgatctcaatgctgccggtgatggagccatctgttttgtaagtcgtgatatatgaaacgggaacgacgcccgagctatccaaggaaagcacccagaaaaggtctccgcctgcattgaatccgaaatcgatcacaggcttggaagcaagttcaatgcgtttggcagcggcttcgcccttatcgttatacaaagaaatataatattgcactacgcccgtttcatccgccgcgctggtcagcgccgctaccgaagacaggccgcagcgcacatccatgatgtccgaatcaagggaagtggagaaaagctgctctttcgtgtaagaaagcacctgcagggatttctgcgcataggtgcaaataaggctatccgagcaagcgaccttggaatccgtaaggtcctgctttacgtcccatacagccgagccgttttcgtcaagcagataaagcgtcccttcgttgatatataaaataccgccgctgcttgcgacagacatttccggcaagcgcgtttccgtttcctttaaaagcggtttggtaaatgaaaattccgtaaaattatcgagaaacaataaaacgccggccacagccgcgattatgataattaccacgatcaatatagatgtacgcctgcgcatccttttatgccgcgatggctttaaatacataaactaccctcttacactgtatgtaagccacgcagttttacgcacggcttacgtttttcaggacaaaattcctgcaacttatataattctgggaaaaatcctcaaatcctttatttttaatcttattgtaccataaaacgcaggttcgttgtgctataatgtgttataatacataataaattaacaatttgaaagggctttgcggctgccgcgggcagcgtttgcgcgggcctgtttataggcgaaatgtggtgaaaagatgcatattacgaaaatgcacggactgggcaatgattttattgtcatagaagaaaaagagcttgcgggatgcgacgtcccgcatttggcgcaaaagctgtgtgcgcggcgtcttaatgtaggcgcggacggattgctgatcgtttcggaaagcgactgcgcggatgcgcgcatgcgcatcatcaactccgacgggtcggaagccgagatgtgcggcaacggcattcgctgctttgcgcggtacatatacgatcgcggcatcgtaaaaaaagaatgtatggaaatcgaaacgctggcgggtgtgatgaggccggagcttgtattggaaaacggcgaggttgcagcggtgcgcgtcaatatgggaaagccgtcgttcgatccgcaagagattccggtccatgcgagcgacccgatggattttactgtggaaacagggtgcgggacggtgcaggcggccagcgtgcttatgggcgtgccgcatacgatcgtctttgtgggcgagatggacgcggtccccattgaaacgctgggtccgcagatcgaaacccatacgctttttccgaacaggacaaatgtggatttcgtgcaggtgctggatgacggggcagcacgcatggaaacatgggagcgcggcgcgggacgcacgcttgcatgcggcacgggcgcgacggctgcggcgatcgtcatgtacgaaaaagggatcatgggcccgggcgtggatatccgccttttcgcagggacgctgcacatcgacattctgccggacggacgggcgatgatgagcggcgcggcagaatacgtatttagcggagaaacaaaatgaatatagagctgggcaggccggaaaaacggctgctcgggatattggaaggcgcgggaatttcgcctgcctacctagtaggcgggtatgtgagaagcaagctgctcttcctatccgaaggagatagggacatcgcatccccgtttccgccgcaggcgctcaaaaaggttatatcttcggaaatcgaactaaaagaacgcgtatacggcttgggcacggtcgttgtggtacagcggttcgaggggaatacctatccgtacgaatataccgcctttcgctgtgataattacggcaggggcggcgggcatgtcccgcaaagcgtggcctttacgcgggatatcaaaaaggatgcgctgcgcagggattttacggtcaatgcgctgtacgcggggggttcgggcgaagttctcgaccccacgggcagggggcttgcggcgctgcaggaaaaaaagctcgagcaggtatgtccggatactttgaagcaggacgctttgcgtattctgcgcatggtgcgttttgcctgcgaactggggtttgagatcgaagagaatacgtacgcatgcgcaaaaaaatatgcgggtcagcttgcggatatttccaaagagcgtatacgtgatgaatttataaagatccttttgtccgatgtgaagtacggaaacaaggatgcggtgtttaggggattgcgcctcttaaaagacctgggggctttgcgatttgtttttccccgtctcatggaaggtgagggggttcgtcaaagcagcgtatatcatgcgtatgatgtgctggagcacggcatgaggacatgtgccgccgcgccgcccgaccttatactgcggcttgcagggctgctgcacgatatcggaaagccggaagcgctgcgcagggcgggaaagatgtatggacatgaccatattggaaaagcactggctgaggaagcgctcacaggcttgcgctttgaaaaagagaccgtgcgccaagtcggcgagctggtagacagccatatgttcgacctgaataatgaagcacatgagaaggcggtcgtccgcatgatcacaaaagtggggccggagcagttttcgcgcctgtgcgacctgcgcgaagcggactttttaggatcgggcaaagggaacgttgcctattctgcgcagaaatggcgggagacgcttgcaaacctgatcgaaaagaaggcgccgctcttgcggaaagaccttgcaatcaacggtgacgacctgaaaaaagaattgggaattccggcgggaaagcggataggtatgcttcttttccgtttacaggagatggcggtaaaaaaaccgtcccaaaataactacaaaagtttgcttagatatgctaaaataataaatgcgcgtgacggagcgcaaggtggaaaagacagccgctaaaaaggacccgttgatatttggagggaaacaaacgtgtttgaacagatcagcgtaaagaattttttaaacagggaacatatgggcgaatacgcagaagtggaattcgatacatatatcgatagccgcgggaaagaggaagtacaggacgtacgtcttccagtacattattatgaagcgggcgacggcgaacccctgatcctggtacacgggatcgggcagtcgctttatacatggcggaggaattttaaggaactcagcgagtatttccatgtctatgctattgatttgccgggacacggattttcagggaaaccgcagatgagctatagcatcgaagaatttgcgctcactctggaagcttttatgaatgttatggagttgccgtccgcaaatttctgtgcgtttggcgaaagtgcggtgtatgtgctggacttcgcgatccacaatccaaagcgcaccaaaaagctggtgatgatttcccccatggtttcagaaggcgtgagcagcggacgtggcaaaggcctgccgtcggcgcttggcactacggctgggaaaatgatgctcaatcagggcgcggtgcgcgctacgctcgaggattgctattttgaccgtacgctggtgacggacgaagtagtaaaggagtatgccgcgggtcttatggaccgcgattttaaagtgatctcaaagatgtgcgtaggaaattttattgacgatagtatagccgcaaacgtgcatgcactcaaaacccccatgcttgttatcattggttcggaagacaagatcaccggcgggagcgataatgaatttatgaagctgcccatcgcaaacggcagtgttttgacggtacgcaattgcggcttttttgtgcatgaagaaaagccggaaaaagtcaatgaagcggtcgttaaattttgtttaacaccaaagccacgggaaactgaggaagcataaaaaggcggaaaaacagatatgatcaagtttacgctgaatgaacaggcgtttttgcctgttcctactatttttatccggaaatatatgtgcgacgcgccggaaaaatacgagcgcgtgtatttgtataccttgtatcttgcaaataagggagttcagatatcggaagtcgaactgatggacgaactgcaccttacgatggaacagatcgaaacggcgcttaactattggtgtttcaaagggctgatcacaaaaagcggcagccggtatgtgtttgtggcggaacaagggacagccggcgaagaaccggtgaagaaaaaacgcgcgccgctttatgaaatgcaaaatttcaataatatgctgtgcgcgatcttaaaccgcgaactttcggtaaacgaattaaacagcatttatgattattcagacgtgtttggactgccgcaggacgttgtgctggcgatggtcgaatattgtgcgcaaatgcgcggcagccgcgtgagcgtcgcttaccttgacaaggtggcggaagcgtggagcgaggaaggcatccagacgctcgagcaggcgcagcagaagatcgaggaacacaaggccgtatccggcggcgcaaacaagctgatgcgcctgatgggcctgcacggaaaatatccgggcaaaacggaaatggatctatataataaatggacggaaaagtggggcttcacccacgaggccattgaatatgtgatgaaggacaaggaatttacgaaagaccaacccttcaaatacttagatgcgattttaagatccctttatgatcagggcatcacatcctcgcgcaagatcagcgaatattatacggcgcaaacacgccgcagggaagcgatcaaggaagttttgaaggcgctcgattattcgcgcatcaatgtaacgccgcgttacgaaaaattttatgccgactgggaacaggcaggcttttcccagtctattatcctgctcgcctgcatgcagtccgcaaacatgggcagccgcaaattcgagtcggtagacagccttttaaaggaatgggcgcaggaaggactggaaagcgaagaggatatcaaaaagcacctgcgcaaacagaacacgctcgaccgcaagatcaagcaggtatacgattgcgcaggcgtgacaaaagtgatcggggatgcggaccgcaagaattatatacagcttaccaaggaaaaagggctgtcacacgacgtgtttttgtatgcggcggagttgagttcgctctttaacgatccgctttcgtacatgagaaaggtgctaagcgcctgggcggaagaaggtgtggatacgctggaaaaggccaaaaaacaaaacctaagccgcgcttttaaaggtgctgaaaccaaaaagtcttttgagcagagggaatatacggaagatcaaatggaacaacgcaagatagatgcttatgcggaattggagcggctatatggcaaataagaccgccggcgacctgctggcagatttcgaacttaagcacgcgcagaaaaagcatgcaaatgaaagaaggcgtgcgcgcagtaagagaatacaggaactggaaacaaagaagcgcgcgctgctcatgcaaaagctggagtgcgtttttttgcaggaaggcatagaccgttatgacgaagaggtcgctcaaatagaagaagcgctgcatacggccgaacgggaagaagggatcggcgcgccatatgattgcagcgtctgcaaagataaggggatcgtaaacgggcggtactgcgactgctttttgcgcgaggtctactgtgaaatttacggcgcgacggacgttaagggcctgcacgaaagtttcgatgcttttgatctgggcatattcgacgatcataaaccgcagaaaaatggcaagacgcaaaagcagatgatggcactttacaaaacgatctgccaggattatattaaaaattttccgcagacagtcaagcaaaatatactgctgcgcggcaaagcgggcctgggaaaaacatacctgctaaactgtatggccgtagaagcgcagaaaatgcatatcgacgtttgcctgatccgcgcggctgcgcttttcgacgtgttttttaagcaccgtatgggagaggaaatgccgctcggctttttgcgcagcgtcaaacttctgatggtggacgatctgggtactgagccgatcacgcaaaatgtatcgatagaatatcttttcgatctcttaaacaggcgtatggaaacggggctgcacacggtggtggcaactaatatagatgatttgcaaaaacggtacgatgagcggatctcatcgaggctggaagcaaagcaggcctgcactacgctgttttttgatggagacgacctgcggctgaaatgaatgtttgcatcgccggtatttgtgttataggaaaaaggtaaaatgaataaggctggtatttttaagatgcgtatcaggattttaaaggacggaccctatgaagtgagcggcggcgtacccctcaaggatatggtgatcggtgcaaacgaaaaaggggaatccacacattggatcgaaggaaaacagtataagacaggacagacataccgtctttgccggtgcgggaaatccaaacatatgccgttttgcgacggaagccatgcgcatggatttgacggcaagctggcggcgggacataaaaaatatgatgaggctgcgattcgttaccagggtgatggaatggagcttttggatcaggaagagctgtgcgcggtagcgcgtttttgcgacctcaagggcagtatctggaacctgatcaatgatgcggataaccttgatattgccgtgcagcaggcgtgcgactgtccctccggacgactgacgattatcacggaagacaaggtaagggtcgagccggaatttgagccggagatcggactgatctatgaccgtccggaaggcaaaatggggccgatctgggtacggggcggtatcgagatcgaagcggaagacggaacggtatacgaaaaacggaatcgggtcacgttgtgccggtgcgggaaatccgcaaacaaacccttctgcgacgcgatgcatatggaagaggacgaataaaaaatgaagaggcggggggggggccccggggggggggggtgtgctgtgggtggggggggtgggggcagatttttaaatagcggggggtgttttttgggggcgggggggggggggggggttttttttt

SEQ ID NO: 16 - DNA, 61210 bp, Christensenella sp.
tgtctatataattatataatatgtatggtttttttaatcgaacaggtctgtggacaaataccgctcacccgtatccggtaagatcacaacgattttcttccctttgttctccggacggcccgcaaccttgatcgccgccgcaagcgcagcacccgacgatacgccgcataatacgccttccttatgcgacagcatccgcgccgcttcgtatgcttcgtccgtaaagatcggcacgacctcgtcgataatctcgcggttcagtatcttcggcacaaagcctgcgccgatcccctgtattttatgcggggacggtctccctcccgcaagcacctggctttccgccggttccaccgcaatgacctgcgtttcctgcctcttacttttcagcacttcgccgcaccctgtaatcgtgccgcccgtaccgactccggcaataaaaatatcgacgtcgccgaccatgtcgcgcaggatctcctgcgccgtcgtttccttgtgcgagagcacattcgccggactctcgaactggttcggcatatatccgttttcccgctcgcagatctccttcgcgcggttgatggctccgcgcatgccttccgccgccggagtcaatactaactccgctcccagtgcgccgagcagtctcctgcgctcgatgctcatggattccggcatcgtcaggatcagatgcagcccaagacaagtgcaaatatacgcaagcgcgatacccgtattaccgctcgtggattccacaatgactgtattttcaccgattaatccccggttgattccgtcctgcatcatataataggccggacggtccttcacgctcccttgcggattaaagtattccagctttgcccaaatcatcgggttgatgttatttaactgcaaaagcggcgtttcgccgatcagatccgtcagtttttctgctaatctcatgatcattccctcttattcctcatttttaatagctttcacgtcataaggcgtttcctgatatacgtaataattaagccaattattaaagagcaggtttgcatgcccgcgccaacgtacgaccggcggtttactcgggtcgttctccggaaaataattggcgggaacaggtacgtccatcccccgtgcgatgtcacgcacatactctgtttttaaggtgtttgcatcatattccggatgccctgtcacaaaaatctggcgtccacgcttagcggatacgatatatactccgttttcttcaaatttgcataatatctcaagcattggatttttttctatttccgactttttgacataggaatgccgtgaatgcggcgcccagaattcatcatcgaacccacgcaaaagcggccagttgctcggcgtacgcttgtggaggtatatacctgaaagtttttgctcacatggatatttctcaattccatagtggtagtaaagcccggcctgcgccgcccagcaaatatacattgtggaatagacgttctttttactccagtccatgatctccgtcagttcctgccaatagttcacctcttcaaaagggatttgttctacaggcgcgccggtgatgatcaggccgtcatacttttcatctttgatatcgctgaacgtcttgtaaaaagtattcaggtgttcaatgggcgtattcttggaaacatgggtcgccgggtgcaataacacgacctccacctgcaaaggcgagtttgcgagaaggcgcatgagttgcgtttccgtctgctccttagttggcattatattcaggatcacgatcctaagcgggcggatatcctgttcctgcgctcgttccaggggcattgtaaatatgccctcttgcgccaatgttttcgcggcaggcagtctgctgttaatattgataggcatattgcatttcccctttcctaccgtatttaaaagaacgtttgactatcattatatagtaatctataattattgtacacgtttttatagaaaactaatcccgttttttacgcgaataaatatattggagtcgttatgcttacagaatggaaagacaaaaaagcgcctgagcttgcaaaagaaatcatggcgatcaataaacccaatatcacaggggatacgatcagcggttttggtatgaagcgcaaggtcgctacctttattgaccttataagaagcgcgatgtatcctaacatttatgacagcaatatcacgcgggaaaccgagttgcaggaaacggttacccggcggcttaaggaagctgccgtactccttgactgcattgtggctgaagttcttgtaaaccagtgccatcttgaacaacgtcaccgcgtggactgcgataagtgcagggatacggcacaaaagatcacgctgcattttatggcggatttgccctgtatcgcacggcttttgaatacagacatcgacgctgcttactgcggtgaccccgccgcaaaatcgcatgaggaaattcttctggcatatcccgggtttgaggcgataagcatctatcggatcgcacataccttttataagctcgatatcccgcttttgccgcgcatgatgacagaacaggcccatagtaaaacagggatcgacatccatcccggcgcgaccatcggcgaacacttttttatcgaccacgggacgggtgtggtgatcggcgagacttgcaggatcggcaatcatgtcaaaatttaccagggtgtgacgctgggcgcgaaaagctttgagcttgacggcaacgggcatccggtcaagggtgtgaaacgccatcctgatattatggataatgtcatcatttattcgggcgctaccatcctcggcggcgatacggtcattggtgaaggctgcgtgatcggcggtaacgtatggcttacgcattctgtgcaagcctgtactacggtatataatacatcgccgtctccaacgctcattaccaatgttcaaaacgattgatcccccataacacagttaatgataaggcttccatcaggaagcctttttttcatgcaaaaactcttttcctgtcacacagttttcacacatacgccttatagtaaatgcaaaagccgtggaaaggagcggggatatgaaaaaaatagtaaccatcagtttgatcgctttactcttgtgcgccctttgctcgagccttgtttcatgcgtcttcgaaattgccaaagcgcaagatactccttccggtcaggaagaggcaagcgcagcttccaccccttccgcattaacttccttccccgacgcttcgcaaagcggctcttatgtggtaactgaggatggcagaaaaacatcgcttcgtttcgagtatcaggatgtgaattgcgatatcactgccgatgcagacagttctgtttccgtctccttggtcagcgccggattatatggcagcatcaatgcggataatatggcgaaaatggcttcagttgaccttgattcaggcagcatatggaccctgacggcagattcttatgtgacagtaatcagcgactctgacagcagcttacaaaatatagcgagtaacgggtacaatatttattatgacatatcgagcagtgaaaacagttggctcggaggcgtaagcgttcccctgcccggcggcggggagttaatccccatttcttaagaattattcatttttcttcctccaaacaagaaaacccgacaacttttagtatggatagccgaatatatttccgcgtcctatttttgttgacaaataatttttcatccattagaatgtacaacgttggacgaatttgtacaatattgtacaattggaggttgttatgttcgcaccaagtgaaaaccaattttggaagtatatcctgccatccatgctcactatgtttttaagtggtttttatgcgatcgtggatgggttcttcgtcggccaagccgtcggcgacctgggcctagcggccatcaacattgcttggcctatcgcttccttcctgctcgctgccggaaccggcattggcgtaggcggttctgttgttatgtccacgcgtatgggtgaaaagaatcttttgggggcaaagcgggcgttcggcaatacatttttcatgctgcttctcgcttctgctatcatgaccgttttattttcagcgttctataccccaattctccgccttctgggggcggaaggtgaacttttgcaggccgccgaagaatatgcgcagatcgttgcgctgggcagtaccttccaaattctcggaacgggcatcgcccccctgctccgcaaccgtggtaagacgatccaggctatgatcgctatgatcagcggccttgtcaccaatatcgtattggatgcgcttttcgtcatggtattttcctggggtatccgcggcgcggccctggctaccgtgatcgcgcaggcgcttgttgccttagtcggttttgtcatgctatatctgaaaaaagaaaaccgcgtttccgtcgccatgctcaaaccggatcaggtgacaatgcggaagctattaaaaatcggactttccccttttgggatgacttttgcgccatctatcgtcattatcctcgcaaatctgcaatgcctgcattatggcggtacggtggcggttgcagcttactctatcctgatgtatgtcgtgacctccgtacaaggccttttgcagggtgtgggcgatggcgtgcagcccctacttagttacttcaacggtgcaggaaacgccaaaagcatgcagaatgtcttcagaaaggcgcttgtaaccgtgctttttctcagcgttgctttgctatttgccgtgatcctcctccgtgcgcagatccctgtcctgtttggcgcttcctctgagtctgcaggactggtggaaacagctttgttctttatggcgtttgcttttccgttcatcgggttcaccaagctttcttcctcatatttctatgcgatcgacgaggtaaagacgtcggccctgatcatttatatcgatccggctgcattgacgccgctttatttgttcacgctgcccgtactttttagtttaacgggaatctggctggccctgcccttagcgcaggcgacccttacggtgatccttctgtttatttatcggcggcggcatcataataaaataaaatctagtacacatgacaggagtgtaaattatggatcaaacagaacgaatccggcgtgaaatcgacaaatattatgataattggtttcggcttaaccgtgcctacgatgattgggcgcagaggcatgggacgtcggataacctgctgttcaccctctacgcgatttcttcatgcggagataaaggctgcacgcaacagaaaatatgcaatgccctgcttctgcccaagcaaaccatctcttttattctttccaagctggaaaagcaaggcatgctccaccgccggccgaatccgaaggaccggcgcaataatattgttttgctgacagaatccggaaaggaatatgcggaaaccatgctgactaagcttgaggctgcggagatccgtgcttaccacagcatgagcaaagagcagcgcaaggccctgaacgatgggtatgcggcgcttaccgtggcgattgagaaaagcttttctgaaaacgactagcttttgcccgtcgcgcactggcggtataccgttcgtcaacaaaaaaagaatgtctttcgacattcttttttgttatcgcattatattaatacaaatcgtcatcctccgtacggacgacttcttcgcggcggatatccgcgcctaattttttcagtttatcttcgatatggtcataacccctgtcaatatatttgatgttatgtatttccgttaccccgtctgccatcagccccgccacgatcaacgcagcgcctgcacgaaggtctgtcgcttctacaggggcgccagtcagcttgttaacaccgtctacgaccgctacacggtcttctgtggtgatttgcgcgcccatccggcgtatttccttgatgtgtttaaaacgcgactcaaaaatcgtctctgtgatcatgctcgtaccatccgccgtcgagagcaataccgtcgccggttgctgcaggtccgtcggaaacccgggatacggcatcgttttaattttgactgccttaggccgtccactacactgaacatgtataaaatctgcgccctcttttacagaaatgcccatctcctccatttttgcggacaatgcttccatatgtgtcgggatcacgtttttaatcattacatcgccacgcgtcgccgctgccgcaatcatcaatgtgcctgtttctatctggtccggaatgatcgaatagttacaaccgtgcaatttctcaacgcctgtaatacgaatgacatccgtgcccgcgcctttgatcttcgctcccatgcacacaaggaagttggctacgtccacgacatgcggctctttggcggcgtttacaatagatgtctggccctttgcgcataccgccgccagcatgatattgatcgttgcgccgaccgatacggtatccagataaatatcacttcccacaaggccattcggcgcacttgcaacaacgcgtccatattttacatccacgtttgccccaagcgcggtcatacccttaatatgcaaatcgatcgggcgttcgccaatcgtgcatccgccaggcaagttgatttccgcttcaccaaaccgtgacaacaatgcgcccaataaatagtaagatgcacgcatgcgctttaccagattcatggtaacatggcaggtattgatattggtagtatcgaccgtcatcgtgccgttctcaaactcaacctccgcgccaatttctgcaagaatgcgtttgatgatcagcacatccgcgatattcggcaggttttcaatgacacaaattccccgtgcgagaatggttgcgggcaaaattgcaaccgcagcattttttgctcccgtcacatccacagacccttttagtgggatcccgccttttatcactattttttcattcatatatatttcaaccctattcgatactatttttaaaatttttgtatcgttattgtaacatttatcaggactattgacaagctatgctttacatttcagcatacctaaaacatttttttcttccataacaaatatgctgcgagtcccgagcatgcgcatgcgattatgatgacccacataaagccgagggaatctgccgcaaaaggaaccggaacattcatcccccacaagcttgcaaacagggtcgggatcgccagtatgatcgtgagggaggtcagtatcttcatcacgatattcaggttattcgagataacgcttgcaaatgcgtccattgtccccgaaaggatatcacggtagatagttcccatctcgatcgcctgcttgttttccacgatgacatcctccagaaggtccagatcgtccggatagcttttgattacacgggacttaagcattttctccaaaacaacctcgttggattttaaggatgtagaaaaatacaccaatgatttttccagcttgagcatctgtatcagttcgctgtttttcatagattggtgaagcgcgttttcaacctgcgtagatgccttgtcgatctggcgcagatattgtaaatatttgcttgcatttttatataatatctgtaataaaaagcgtgtttttttgcatgtgtcaaagcctccgcggatattctggttccagaaatcctccaaaatagatgtctcttccaggcataccgtaataatattgtctgccgttacaatgattcccataggaagcgttgtatacacaaatgaatttctttcggaagtaaccaccggaatatcgacgagcaccagcgtctggtcgtcctccgcatcgatacgcaccgtttcctcactgtcaagcgccgcacgaataaactcgtcttcaatgtgaagcttatcgcgtacaaaaacaacttcctcttcagaaggatccagaaggtgtatccatgctcccggttcaattgtatcgatttctttgaatttgttgttttcagccgtactgaaaatcctgatcattgcctttcacctactttctgcaaagcaggcggtatcacgagcgaaaatacgctgtccgcacaccgctgcccggcattgttattctcgttcgtttagggtctgcgtccacgtaattctcacctcctgtatcttccggcattcataaccaactataattatagccttccccaaatttatatgcaagtctcattttctcctatgtttttgaaaagaaatattgtataatgtataaagcatatgcttgtgtatgtattttgtaatctttgcgtggtgctttcatgaaacaggaattttgtttaaatgatattgtcgagatgcgcaaaacccacccttgcggcggcaaccgctgggtcgtgatccgcaccggagcagatattaagataaaatgtctgacgtgcggacgcattgcaatgctagattacgaaacatttataaaacggataaaaaaggttattactacatgaacagatacgatagaaaccttgatgatgcgccgcgccgtccaaaagaccgttccaattttggcggatacggcggttacgataaagaggattatgaagatagcaaccaaaaaacttaccggaggaggattattgtgccgccggagggttatgatatcgagcccgataatgaataccgctacgaaggccggccggttttggacgaaacggatccttattacgatacggacgaggatttttacgacgaggattacgagcccgatacgcgggatgattcctatttcgaaccaatagacgatgatcttttggaatatgacgagtttgggcgtaaacggaagcctgtacgtgctatcccgcgaacggaaagtaaagcgcgcgcggtgtggggatggatcatttccatcattgccgccattattatcgcctttgtcgtccgtgctttcttctttgaaattattctggtggacggcgagtctatgctgccgactttgcagtctgacgagcgccttgccgtagaaaaagtcagccgttatttcgggcttcccgaatatggcgatatcattatcgtgcactacccaaatatggacggcacgtacgtgaagcgtgtgatcggccttcccggggatacgctcgaggtcaaggacagtacggtataccgcaatggcgaaccgttaagcgaaacatatatcagcagcgacccgtatgctgatatggacgccgtaaccgtgcctgaggatacggtgcttgtcatgggagataatcgtgcccattcactcgacagccgtaccgcctatatcggccccatcgacaaggacgagattgtaggccatgcgacgtttgtgatctggccgtttgaccgtatgcattccgtaagttgatttttaaaaataaaaggcacgcggttgcgtgccttttttgtattcctattttagtccagaaccgccttgatcctgcgcactcccgcgctgctgctctgctctttcttgattttaaagtgcccaagctccgccgtattctttgcatgcggtccgccgcagatctccttggaatacccggggatcgtatacaccttgaccagttcgccgtatttcgaatcaaatacgcccatcgcgccctgttctttggcctgctccacgctcatttcttcttctaccacgtccagccccgcatcgatcgcttcgttgacatactgctccagcttatcgagctcgtcgcgctctaccttgcggtcaaaattgaagtcaaaccgcaagcgctctgccgtgatgttggaccccttctgcacgatatcctcgctcagcagctttctcaacgccgcattcagaaggtgtgttgccgtatgcaggcgcgccgtctgttcgctcgtatccgcaaggccgcctttgaagcgctgctccgcccctgcgtgcgacaattcctgatgatgctcgaaggccttgtcaaagccgtccttatctaccttaaagccacgctcatccgcaagctccaatgtgaactcgattgggaacccaaacgtatcataaagccggaacgcgctctttccatcgatcatatcgcccgcagtaaagccgcccgttaccttttcgaattctttgagcccctgcgtgatcgttttctggaagcgtttctcttccttttcgatctccgtcaatatttttgtttcattgttatgtaattcttcataggcatgcgcgtatttatcgatcacgacctttgcgatcttggaaaggttcccttccgcgatccccagcttgcctgcaaaacgaatcgcacgacgcaaaagccttcttaagacataaccctgatccacattggacggcgtaatgccgcgctcgtcgccgatcatgaacgtagcgcatcggatgtgatccgccacgatgcggaatgctttcctcgtctcttcgtctgcaccctcgtacttgcttcctgaaagttcctcgatcttcgcgatgatgggcgcaaacacatctgtttcataaacggattttttgccctgcaagatcgcaatcgtgcggtcaagccccattcccgtatccacgttcttctgctcgagcggcaaaaacgtcccgtccgcctgtttattgtattccatgaatacgtcgttccatatctcgaggtatttcccgcagtcgcatgccggactgcaatccggtccgcatgccggtttacccgtatcgataaacatttccgtatccggtccgcacggtcccgtgatccccgcaggtccccaccagttgttttccttgggcaggaagaagatatggtcttcggccacgcccgcagcgcgccagttttcataggcttccatatcgcgcggcgcatctccgtcgcccgcaaaacaggtaaaatacaatttatctttttcaatgcccagccattgctcgctcgtcaggaattcgtagctccacgcgatcgcttcctttttgaaataatcgcccagcgaccagttccccagcatctcaaaaaaagtgcagtgactttcgtcgcccacttcgtcaatatcgcctgtacgtacacacttttgcacgtccgtaagccttgtgcccgccggatgcttttcacccagcagatatggaaccaacgggtgcatgcccgccgtagtaaaaagaaccgtagggtcgttttccggtatcaaagacgcgcttttgatgaccgcatgccccttgctcttaaaaaaatccaaatacatttgccgtaattcgtcacttgttaagcacttcatctaaaaactccttcgtcgcttcctatttgcaaagcaccaaaatggcgtttgctataatatccgctatctttacgagcgaatcgatttcaatatattcgtccggctggtgctccgtgcccacctgccccggaaacaatgcgccgaacgctacagaattggggaatgcgcgcgcgtaggtcgcaccgcccatcgtcatgcaataggccttttcccccgtcacttcctcataggcctgcttcagcccttgcacaagcggggaatcctcgctcacatgatgtgagggacgcgaaaatgtttcttccacctcaaagcccgtgagcgcctccctgatctttaagaggatcgcttccttgtcgctgtttacgggataacggatatctactccgacagcaagaccgccgtcagcgtccgttttgcaatatcctatgtttaaggtaagcgcacccgaaaaatcctcttgtgcgatgcccaggctcttaccgtccgtctctgtcccgaccgttgcggcaagctcataaaccgcatcgctcagcgcattttttttgagcggcagcatatttaacaactgtatcatataggtaagcgcattcctgccgtcctcaggcttggaaccatgtgccgatacgccgtgcgcctgtagtatcattccttcatccgtatgcacggaagtgattttgacgggagaatcctcgttaaaaagctcgatcatctgcggcaacgcctgcgtgttgccgacgatcgtgcactctgcgagcgcgggcaccacattgacccgctcccctgcgcgaagatcggtcagtgtgagcgcgccgccctgcttgtaatcataagcagcacgccgaagcgtcaggtgcaataatcctttttccgcattcacgataggaaactccgcatcgggcgagatcgccatcgctggaatttctccgccgtttttcttataaaaatcaatatctccccaaccgctctcttcatcgcagccaaagatgatacgcacgcgtttattgagcgtgatacaattttccttgatccccgaaagggcaaacaacgcggcaatcgcggggcctttatcgtcaatcgcacctctgccgtacacgcgtccgtctttgaccgtcccttcaaacggcgggacagtccagccttcgcccgccggtacgacgtcaaggtgcgtaacgatcgcaaagatctcgtcgccgtcgccgtattctacatatcccaaatgggagaagaaattcacactgtcgaaatccagccgctccgcgatgttaagcgtcttgataagcgcgtcaaaaacgcctttcccataaggcatattgccttgtgcctcactttttacgctcctgattccaagaatcgttttcaaagcgtcgatcatctcatttttgcgcggtgcaagtgtaaagtccaacatttccttttttctcccgatatttctgcaaacgaatgcgtatatattatagcagaaaacgatttcataatacatagttttttatattttaacccgttttacaggaatgcgggattgtcgcggcgaaatattaagtactgcaccaaatacgatcattggggggatatcttatttctatccatgacgggcaccgcgagcgtttgaaaaaacgatatctgcaaaaagggctcagcgcttttgaagaccatgaagcactggaactattgcttttttatgcccttccgcggcgggataccaatgccctttcgcatacgctcctcgaaaaatttggcagccttgagcggcttttccaagctgatgtgaaggatattgcgggaatcgatggaatcggaaggcaaagcgctatcctgatcaaacttgcctctgaccttgcacgcagaagcgtgcaggacgacatttccaagagtcccaagctgaaatccatcgatgctgcgatccgctatgcacaggcgttactcgcagataaaacggaagaacagttttatgtgatctgtctcgacgcacatttcagcgtcatccatgcggagcttttaagccgcggcacagcaacggaaacgcctgtctatgtccgccatatcacgcaaagcgtcatccgcaccggcgccgacaaggtaatcgttgcacataaccatccgggcggcagcgcacagccgagcaaaaacgatattgaaacgacgcagcgcatcttaaaagccatggatgccctcgaaatcagcttcctcgaccatgtcatcgtcggcaaatcggacgctttcagtattgcggaaaaattactgctgcgcagcgattatccggaaagggatgcgcggtttgcacaatattccgcccgcgtaatgcaagacttcccgtccctgtttcaaaggtaactattgcaaaaccaattgattctatgtataattttgaagaatggtttatcgtttagaaacgactttactggaggaacgtacaattatggcaattgaatattttcatataaaagagcgggatttcgatctcgtagagcaattgatacaaatagaaaattcgtcttatgatgcgggtggccttgatgttttcgacctgatcgccatgctccgccatgcgcgcgtatatgtcgccgttgaatacgacgaaattttgggagccgtttattttatgcggaatttcgacaatccggataaggtgtttttacacagtatcaacattttggacccgcagacaaatccgaatcttggaacttcccttttaaacatcgcctttgcggatatgaagaccttcggcatcaagatcgtcgaggtaaatgtcgatccgtccaattaccgtgccctcaaaatctaccgtgaacatttggggtttgttgccagcgacagtatgcaaagcgaaatcttgaacggtgaagagatcctgatgctgcaaaaagaactgtaatcatcctaaccatacgtcatttcaagagccgcatatgcggttctttttttgttatgatcatgccatctcagaccgcttttcaaaaatagggttgacaaatacctcccatcgttatatagttaattacataagtagttaactaattatgccagaggaggatgcaatgaagatcgattttgaaagcgacattcctatctatttgcaggtttccgcacaaatcgaggattccattttatccggtgtatttgcggaagaaacgcagatcccttctacaacggaaatttccatgctatacaaaatcaatcctgctaccgtattgaaaggtatgactctccttgcatcggacggaatactctataagaaacggggggttggtatgtttgtaaaacagggagcggctgaggcggtccgcaaaaaacgacagaagtctttttacgacgactatatcgcggctttgcttgaggaggcggataagttggggatcgattccgcagagatcatccgcatgatcatgaaaggagcaaagaaatgattgaattgaaaaacataaccaaaaaattcaaagaggtgacggcgctcgaccatatcaatgtctccttcgacgatcatcatatttatggccttttaggccgcaacggcgcggggaagacgactcttttaaaccttgttaccaaccgcctgttccccaccgaagggtttatatatacagatgatatgcccgtcatggaaaacgaccgcgcgctgtcccgtatctcttatatgggagaggaaacattttatgaaccttctatccccgtacggcgcatctttgaatggtccaggctgttttatccggaattcgatatggactacgcttattgtcttgcggaaaaatttttactaaaccccaagaaaaaaatcggcaaactctccaccggttaccgctccattgccaagttgatcgtgacgctggcttcgggcgcggagtacctgctgttcgacgagccggttttgggtcttgacgcaaaccacaggcagcttttttacaatgagcttttaaaacggtattcggagcatccatgtacggtcatcctgtccacgcacctgatcgaagaggtcgcgggcatcatcgaccgcgtcgtcattatcaaagaaggcggcatcctgctggaccgccccacggaagatatccaaaggatgggcttcaccgtctccggccataaggatgcggtcagcgcatggtgcgcgggaaaaaatattctcggtacgcaggaattaggcgggcttatgctcgcgcacatactcggagaacgcgaaagcatccctgaagggcttaccgtaaccccgcttgatttgcagcagctctttatccacctgaccaacgcgtaagaaaggacgtatgacatgagactgaaacaaatgcttttatggcagtggaagacaaaccgtaacgcattcctggtgttttacctgatcgtagcggctgccaccatcgcaggatccatcctgtttgcctacggcccgccagcagttgccgacagcggtatcagcgtggtgggcgtgaccatcaactctgacagttcctccatgggctcctttaacatggctaccctgcccatcgcggtgatttttctgctggtcgtaggcttggccagctttgcggaaaatctccgcgtcgcccttgtaaacggcgtatcccgacgcacgcaccacctgagttttttactcttttccattgctgccgcgatcgttacatcgctgctgagtatcttgttcgacgcgatccccagtttctttgggtcaactcccagctcccaattctctggttcctttgtggagttgtttctgtttttctttacagtctacctgtttgtagtattattcggctattttatcgcaggcgcgtactacaggatgaacacccctgcaagagtgatcgtttccatcggcgtacctgtcggcctgattgtatttttcagtaacgccctgaactttcatcagggatcgcctttgtatcctgtcggcagggcgcttctcgtgttcggcgactggatgacccaaaccctcaacgcttccctgtttttcgcacttgcggccgtcctgttcctgtttttcggctggctgctgacgcggcatgcaccgatcaaagcgcctgctgcataaaacacatgaaaaaagaggctgcctcacggcagcctcttttatttttacgaaatataatgtcgtaccctgaagtgcgctcccacgtcctccgcgatctttcggcatatctcgatatcctccgaactgatgatatctaccacggaaagcgttgtcttgatcccgtatttcacgcaatcccgcgcaaaatcgatcatataaccgaacccgtcctcgccataagcgctgtgcaccaccgcttcatatttgtgcgcgtccgcctcgtttaagctgatggatacctcgtcgatcaacccgaccaactcctgcgcgatatccctgccatgataaacgcttgcatgcccgttcgtattgatacgcgtatgcccgccatagctttttacatatgccgccacttctttcagctcgtcgatcttgatcgtcggttccccgtatccgcagaaaaccacatccgtttgatctttttccaattcgtcgataatatcctttgccgccggttccttttcgagccacagatcgtatcccgctactcccttttccgtcctgcgtacgcagaaatcgcagtcgttcgtgcattggtttgtcaggttgatatatgtcgcgttgccaatcttataagtatatgtgctgtccaaaacgttctcctttaagaaattccaaaaaatcgtttggcgttttcaagggtcttgcgcgcaacctcttgtgcgtccatcccttttacttccgccattttttccgctacataacggacataggccggttcgttccttttgccgcgcaacggtacgggcgtcatgtacgggcaatccgtttcaaggagcagccgctccattgggactgcctgcgccgcctcgatcgtcttgcgcgcattcttaaacgtcagcgcaccgccaaatgcgatataaaatcccatatccacaagctcccgcgccgtctgtgcgctgccggaaaagcaatgcatctcgccgcgcagccccgggtattgttttaaaatcgtcatcgtatccagtgtcgcttccctgctgtgtaccacaatgggaaggtccagctccattgccagctcaatctgctgtgtaaatgccgttttttgcgcctcgcgcggtgaaaaatcataatggtaatccagcccgatctcgccgattgccaccaccttttgctccttgctcaatgagcgcagaacttccttcgacctttcatcccattcctgcgcgctgtgcggatggatgcctaccgccgcatagaccgcatggtgttcctttgcgagcgccgccgcacggatgctgcccgcaatatccggcgaacattccacaatatactcgatcccctgctctgcaagctttgccagcaccgtttcacgatcctctgaaaaatgttcgtccaaaagatgcgtatgtgtatcaaataatttcataccgtcatcctactatgagaccatcctcgctgtctgcggtcaccagtgcgatattcggattatcgcctacggcaagtatcataccttccgaaagcgttccccgcagcttggccggcttcaggttcgccacaatgacgaccgtcttgccgatcatttcctgcgctgtaaaactttcgcggatacccgaaacgatcgtccgttgctcgtcgccgcacttcaccgtcaacttgagcagcttgtccgaaccctcgagattttcacaatcgaccaccttggcggttttgagctgtaccttcttaaaatcgtcgatggtgatctgctgcggcccctcttcgctcttttcctttttcggctgctcctgcgcggccgccatcagcttatcaagctccttcagctctttttcgatctcgatacgcgggaagatgggcgcgcccttcagcacattcgtacccgcttccagctttccatattccaagatactgtcccaacaaacaagcggtccacaattattgatacccaattgttcccgcattttaaccgccgtttccggcattatgctctcaattaatatggaaatgatccgcagtccctccgccaggtggtacatgacgcttccaagacgcgctttttgcgcttcgtctttggcaagcgcccacggcatcgtaatatcgatatatttgttgagcataccaatatattgccacacttcgcccagcgcttcagatactttacattcgctcatcagcgtctcgaactgctgcggcagagccgctgcaaaatcaatcagcttcctgtcctgcgcgtccgtttcccctgccgccggaacctctccgccgaaatatttatcgatcatcgcgaccgtacgcgacagaagattaccaagatcgttcgcaaggtctgcattgatgcgggataaaagcagctcgttggaaaacatcaggtcgcttcccaaaggcgcttcgcgcatcaggaaatagcggatcgcatctacgccataccgccccaccaatacgaccggatccacgacgttgcccctgctcttgctcatcttcccgccctgtagcgtgagccatccatgtccatacacgcgttttggaagcggcagtcccagcgccatcaggatcgtcggccatgtgatggtatggaaccgcacgatctccttgcccaccaaatgcaaatccgcaggccagtacttttggaactgactgtcgtcctccgataaatagccgagcgcggagatatagttggaaagcgcatcgatccagacatacatcacatggtctttatcaaaaggcaccggtatcccccatttgaaggacgaacgtgaaacgcacagatcctcaagcccgggcaggaggaaattattgagcatctcgtttttgcgcgattcgggctggataaattccggattgtccttgatataccggatcagcctgtctgcatatttggaggcacggaaaaaatagctttcttccttcacgcgctgtacttcccgtccgcagtccggacattttccgtctacaagctgcgtatccgtccagaatgcttcgcatggcgtacaataccagctttcatattcgcttttatagatatctccctggtcatagagcttttggaaaatcttttgcacacagtcctcatggcgtttgtctgtggtgcggatgaagtcatcgttggtgatattcatcagttcccacagggacttgatctgcgccacgaccccgtctacatattccttgggggacatccccttttccatagcgatcttttcaattttctggccatgctcgtccgttcccgtaagaaacatgacgtcataacccgtctggcgtttaaaacgcgcgatcgaatccgccgccgttgtgcaatatgcatgcccgatatgcagcttatcgctcggataatagatgggtgttgtgatgtaaaatttttccctcattgctcttgctccttttgttttcatgcgtaaatattattatatcgcgtcccttgtgctatttcaatagcgtccgcccccccaaacaaaaaaccgccgcatatactgcggcggtttgatcatgcaaccaaccaatcaaaacacttcgtccccgcttttgaagtccagccccggatgaaggtcaaaccggaccgcgcccacgacggcctttccttgcaccgccttgctgaccagcgacacgccttcgtttccaaaacccgcgcataactcaattgccccgacgccctgctccgccatttctctggcggcaagcacgccttcctcgtagtccttcacgccgatgaccgtcaaacgtacgcccggcgtatcgaccacactgcgatccttcttataatccgcgcctggcgcggcaaaaataaacgctgcgtttactttcatttcaattgctccctcatcctttaataatcacgccttcctgataaaccggaaccacctcgaacatatcttcgcgcgtgcagtattccagatcatcataaagtttaagctgcttcaaatattcaaaatgagtactgccctcaagggcggaaagaatatcatgatttgcatcgtggtacaacttcaatgcaaccttgcccatatcatctgtttccagcgtttcgtcgatctttaaaagcctgtcgatgatgcagcccattgcaaggatatcgtccgtagaaaacttctccttggtgcccgcgcatacaagaacgatgtcgcggtctaagctgagcgccttcctcgcaactgcctcggcattgataaacgaacccaccaatacatcttccgccgtcataagggatttgatggcaaccgtaccgtttgtcgtagaaaaaatgatgatcttgtcctcaacgacatcctgtgtaaattccaacggagaatttccaagatcgaagccgttcaccttctgtgccgcaatttccccgcacaaaagcacgttcccttcggatatttttttaatcgctgcagcttcgttcgcctcttccgtaggcacgatcctgtcgcagccgtttgaaatcgccgtaatgatcgtggcagacgcacgcagcgcatcgatcatgatcgccgttctgtcctgcaattcctgtctgggcagatcgctgaacactgccgaactgataattttcatgttgacctctcgcaaatatatcttatgtgtttattatgatattaaactctactacatttcatacacaaattcaagtaaaatcaatttagtacattaaatttttggctttataaagcaatcccgcaatcgggaatttattgataaacagacatttttttacaggcttttccttccggaagcatcttggacttacattgacgaaagtatgtttatttgttaagatagtcctgttcgttataggaggtaaaacacatgaaatcaacaggtatcgtaagaccactggactctcttggcagagtcgtactccccattgaactacgccgcgttttaggtttcaactgcaaagaccctgtcgaaattttcgtagacggcgactatatcctgctgaaaaaatatcagccggcatgtattttctgcgacagcatggaagatgtgaaagtctataaaggacgaaacgtatgcgcaaaatgcatacaggagatgcaagagcaggtcaaataacctatttttcctataaggtcaggagcaattgataggttctgttcttagaaacgtcaagaagcgtcgtaacataggttacggcgtctttttttgtctttccctccgcaaggcacgccttgagcgcatataatatctcttcgttagtcgcttccgctttttgtcgggacggatttaggatcagtacaaattccccttttatcgcatcccgctgtgaaagggtctcaagcgcctctttcgccgtcgaacggatcacctcctcatataccttcgtcagttcgcggcaggcgcatacaggggtatcttctccgcacaccccgcaaatatcttcgagcgtctttttgatcctgttgggactttcatagatgacgcacggcccgcctgccacgctcatttcttccaactcctttttccgtgccgccgttttggtattcaaaaaaccgtaaaagaagaacctcgaacaatccataccgctcagcgtaatggccgtaatcgccgcgcacgcaccgggcaggctctccacctctatcccttcctctatgcaccgtcttaccaactcaaaacccggatcggatatgatcggcgttcccgcatccgatacaagcgcaatgtgctttccgttcctgaggcaacggaagatctcttcataccgcgcttcattgctgtattcatggaaactcagcattttatttttgatatcaaaatggttcaggagctttacagtccgccgcgtatcctccgccgcaaccagatccgcctgtttcagcgtatccagcgcgcgcaatgtaatatcctgaaggtttcctatgggcgtggcaacgatcgataattttccgtccatttttattggtctccatttctgttatatatccgcccgatttccgctgtttcacttccgtccttttcatacacaataagcggcggaagcaccttaagtgccggctttccgtcctttaccgcactgagcagcatacatacagcctcgctctcagcaaaactatggataaaacgcatctccttgggctccatcctgtgcaaacgcagtgtttcaaaaatttccgcaaggcgcgctaccctgtgtatcatataaaagcgtccgccggattttaaaaggcgctgcgcacaggcgcaaagttcctcaagcgtgatcttcgtctcgaaacgtgcaatcaaatggctttcgtccatactggggatcgctgcccccgccttatcgtacggtggattggagactacgctgtcgtagccatccccaatgaggcggcatgcgtccctgatatcaccctccacgatatggatgctgcctgataaaccgtttaattcaatactcctttgcgccatttgcgcaagccttttttgtatctctaccgccgaaaccgtgatatccggctgcctgccatacaaaagaagcgggagtatccccgttcccgtccccaggtccgcaatacgcgtaccctttttcggggatgcgaaatccgcaagcaatacggcgtccgtaccaaaacaaaaaaactccgtatcctgtatgatcttcaatccctttaattgcaaatcgtctatacgttccatattttttattataacataattgaaaagcctgcataaaaaaagaaatctgcctaaacagatttcttttaaaactcattttgacttcgattacgcctcggaaattgcttctacaggacatgttgaagcacaagctccgcagtcaatgcatgcatcagcattgattacataacgctcgccgccatcagaaatcgcatctaccgggcaatcagccgcgcatgcgccgcaggaaatgcatccttcagaaattttgtatgccatgtttgctcacctccataattattacacttttattctaccattccatcgcaaaaaagcaatagttttttagtcatccaacaggtttttgatttcttcgtccaccacggtctcttccgttgccgcgggagccgcggccctcttgtttctaatttcaacatcggcaaggtcatattccctgatttccgacgtcccgtccggcagcgtgcgccttgcgcgcaccttctccgtcagtgcattcgtatccataacttccgccatgccatcgcacgttttcaccgttgtgccaatacgcggcagttttttacgcatcttatggtagtgctcatattcatagctcaagcagcacatgagcctgccgcacagtccgctgatctttgtcggcgagagcgataaactttgctccttcgccattttgatggagaccggctggaaatcgcccaaaaatgcgctgcagcagcaaggtctgccgcacggccccaagccgccgacttttttggcttcgtcacgcacgccgatctgccgcagttcgatacgcgttttgaaaatcgaggccaggtcctttaccagttcgcggaaatccacacgcccttccgccgtaaagtaaaagacgatcttagagccatcaaacgtatactccacatcgatcagcttcatctgcatgttatgcttgtttattttttccacgcagatgtcgcgggcttcctgctcttttttcctgttcttttccagctttttgaagtccttttcgtccgctttcctgagtactttcttaagcggccgcgcgatttctttttccgtaagttcgcgtggggccaaaaccacttcgccgaactccatgccgcgcacagtctccacaactactttatcgtttagttctatttcaaggctgccgggatcgaaatagtatatcttcccgacttcggagaatctcactcctattactgaactcataaaattacctccaatatatgaaaaagcatgctctccagcgcgagcttcgtattcagcccggcgcactgggcgcgtgctgccacgcaatcatagattttttcctgtgtattgaccagaacgtagtcgctaaagcgagcatgctgcgtgatttccggcagtttatcctgattgacgatgcggccggattcccccgtatgcttataaagcagcacgtccgcaatataaagaagcgcaaccgaaaggcataaaggaattgccgcctcatgcttcaaaaacagggcaagcgtcgcgcttgttgccatgtttttcgccgtccacaggcgatttaaagccaatatcatatcgtcgcgcacctcgaagaaatcatcctgcaaaaatgcaagcgcctgatagtagtcgccgagcgccgcgcctgcaagcgcacgcgcttttaaggtgggtagtttatgctcttccttaagcctccgctccacctcttcctttgataatgacgtctttaaaattatacaccgcgacagtatggtaggcaatatatttttgacattctgtgcccccagcatgaacactgtattttccggcggttcctcaatcactttcaagagcgcattctgcgcctgcggcgtcatcgtatccgcctgcgcaatcacgaccgccttgtaaccgccttcatatgccttgtttgcgacctccgtcggaacagagcgcacatcgtcgatcttgatcgtaccttttgcttcgacatagagcacatcagtatggtttttgtgcatatatttcaagcagccgggacatgtgccgcacgcgctgtgtgtccggcaatagatatgcatcaaaaaatcgtcgatgtccttttgcgtcgtttccgccgacgctccggctatcaggtacgcccccgctatttttccggttttaatcgcattttcaaagatttcattcatacgcgaaagccgttttcctttaatatttcgtccatttttgcgcgcacgatttcctgcgtcgcaaatttatcccctgatgcgtcgattcggatgatccgctccggatacatctcggagagcttcacaaaaccgttgtaaagcaaaatatagaattcctcttcctgcgtttcaagcctgtcatgcacgcgttttttgctcatgcgctcaaaggccaggtgcggcggaaaatccaggaaaaacgtcttgtccggcatcatacttcccattgcaaaacaattgatatccatgacattttcaattcccagtccccgccccactccctggtaagcaagcgaagaatcgataaacctgtcgcacaggacgatcttcccttccgcaacggcaggtcctattacctcttctgcgtgctgcgcccgcgcagccgcatataaaagcgcttccgtccgatcgctcatttctttattttcgatatccagtacgaggtcgcgtattttttccgcgatattgcatccgcccggctctctcgtaagcaccggtttcattccctgctcaagaaggtgctcggacaaaaaacgcatctgcgtacttttcccgcatccgtccacaccctcgaacgtaataaacaaacccttcaatttatgccttctgcctttctatctattcttgttacaggcacgcaacttcgattccgtcgtccatcccaaacaattgatagccgttatcccgtaagcggaacaaataatcgaccatttgttccgtgatctcgatgcccggaaggatgatcggcacgcccggcgggtatgcccccacgcttgacgccgcaacataccctatactttcctccggctttaacctccgccggtccgcaaaaaccgcatcgcgcaatttttcggaaggctgcacgccgaatactgcctgcaggtcgtccgccgtcatactgcggcgaatattataattagaccccttgatatttttcagcgccattttaagcaggtcaaaatcgtccacgccgtccgccactgtgcaaatcaaaacgatatttgaaagatctgccgcttccaccgtaacgccatttttaaaaagcaacctggcggccgtaaaaccactgactcccctgtccgttacatcgatgaccagttttaaaacatccctgtcatatgcgcccgtatctttcggtatatcctgcaatatgcaccggtatccgcccaacgcttctatgcggcgcatgttgtcttccacgagattgatggttatcccaagctccgtatgtccgtgctcgcgcataaagccaagcgcatagtcgcacgatcccagcagtacatacgacggactggtcgtctgcaacatattcaaccggttttgcaccgtatcatgcccaatcttcgcattttcccccacgcacagcaccgagcactggttcatcgctttgagcgttttatgcaggctcgtcacccagatgtcgcatcctgccgccgccggagaaaccggcagcagctccgaaaagtcaaacgccgcgctgtgggctgcatcacagattacctgcatacccgcactgtgcgcagccgcgcaaatacgattgaggtccaaacacattccatagtagttcgggtatgtgatatagaccgcctttgcgtccggatgcgccttgatcgcgcgctgcatatcttcttcgctcaccacgcacggcaattgcacagctttcgccgacggatgcacgaataccggctgcgcgcctgcaagtacaaatgcattcaccgcgcttaaatgtatgtcgcgcgcggcgatcaccttatcgcccggcgcaagaacgctgagcaccgccgcatggataccgcccgagctcccattcaccaaaaagaaactttcccgcgcatggatatattgcgcatgcaattcctgcgcctttttgatcgctccctgcggcatgtataaattatccgcgcccggtatttccgtaatatcataacaattgacttcggacggcaaaaagccgggttttcctttgtgccccggcatacaaaagcgcgatccggacctttgcgcaaattcctgcagcatatctacaataggcgtattcaatgcgcatctcctcctgatccgattctttccttcagttcatctgtcgggctaatcagggctaccgttgtcccaaagtccaacacaaaagcttcattttttttgaaaaatgtaaatttgcgctgctttttcccctcaacgcgctccttcatggccggataaggtcccatgcttttgatatcgcgcagcggagccgaaaacagctccttttcgcgcgcgcccactttgcgtccgaaataaatttttccttcctgcagcacgtagacatagtctgtcatatggtatttgatcaggaaaaaaccgattacgaccaccgcgccgtacaggataaactgcggccagttgatccccagccaaaagcgcaggaatgccaccacgaacaaaccaaaaaagagtatggccacgattgcaagcgtccataatatccctttgagcgtactcaccttttcatgcttcagttcttcgcggaattccattgttcctcctactttttaccttttcccatcatatcaaaaaacattccttttagcaaatttcagccgtttccgttttgctctctcagacgctttataatatcgccaggcagcatcgcctgcaccgcaatgtattccggctcataggcaagggaaacgtcctttccatgcttattaacaagcgccagcaaatctcccctgtcatagccgatctttccgcaaaagctgttcatttggggctgcagcagctttgctatgcgcgacagcagttcctccatcccgtatcccgtatgcgcggatacatacactgtattttcatcgttttccggcataggcccctcaagcatatcggccttattcatcacgaggatacgcggcccatcgcccgcgcccaaagaacgcaaaacctcgtccaccacttctatatgcacatgcgcctgcggacttaacgcatccgtcacgcacagcagtatatctgcatttttcgcttcttccaaggtggaacgaaaggcgctcacaaggtcgtgcggcagtttttcgataaaccctaccgtgtccgtgaatacgacctctcccaactcgcccaggctcaccctgcgcgtcaccggatcgagcgtcgcaaacaatttatcttccgccaaaacgcccgcatccgtcaggtaattcagcatgctcgatttccctgcgttcgtgtacccgaccagcgcgacttccttcacatccttttctttgcgggcattccgccgaaggtcacgctgctccctgatcttatccgcttcctgtgtcagttcaaaaatgcggcggcggatacggcggcggtctacttctatcttcttttcccccgggccccgcgtgccgataccgccgccaaggcgggaaagcgccgtgccctcgcccgaaagacgcggcagcgcatacttaagctgggcaagctccacctgcaaacttccttcgcggctgcgcgcgtgttttgcaaaaatatcaaggatcagcgtcgttcggtcgatgacctttaagcccaaaacctcttccaggttcttcgtttcaagcggcgttagttcgtcgttggcgatcaccgtatcgatatccatcgccgatatcttaagcgacaattcgcgcgcttttcccttgccgatataataggcatggtccctggacctttgctgcgtttccgcagcgatgatctcagcccctgccgtatccgcaaggcgcctgagctcctccatactcccatccggcgcattcagccccaaaagcatcacgcgctctttttcttcctgcgtttccgcaagggcgatctgcgcgctcacacgctgtgtcgccatcccgatttccgccatcagcgcacgctgcgggatccgccccgtgtaaaacggccccgtcaattttatttcatccggcgtatcgcctataaagcctaccgtcattgccacaggcttcccgtctttgaccgcgatagccgccattgcatcgaatttggacgacctcaaagacccgatatccacgtccgagagcatgggactgccgtttggatgcgtatgcaaggcgcggatgccattcagccccaaaaagctgcgccgcatacgcatatatggcatttgcacactgccgctgtcaccaatggaaacgtccattacttttccgttgcgcgacagaaaaacggatatctctttattaagctcctgcgtaaaccgcgccatatcgaacagcagccctgtggaggcaaactcctgcgccgtcatcttatgttcgtatagctgctttatttcctctaaaacgctgttcctgatgccttgtgtattcccgtgtatttccatattggtattataacagaaaacaagaaaaaagactgcctcttttgcggcaatctttcgatggtgcttcccgtcttattttgaaactttcctgatagaatcccgcagcgcaagctcggtattgatcacgtacggcacaggcgcgatcgcatcccttccctcgcgtatcatgcgcaggaggcgcattgccgcctcgatccccagcagctttttgggatggatcgccgatatgattccaagattgccggaagcaacgccgtcatcaaagcttaccattgaaacatctgcaggaattttaataccgttctgcacatagaatttgttgatctcaagggcgatcaggtcgttatacgataccatcgcggtatagtaatcgagcgtatccagaatcgctttgatgctgatctctaaaaggatgttgttgtcatagttggaataaaaccacccgatcagttcttcgcggacgggaatccccgcttcattcaaagcctgcacataaccaaggtaacggcggtgcccctgcaggtcgtctcctttgaatatccccgcgatctcagtatgccccgcctcgatcagcattcgcgtcattcttttggacgcgccgatatcgtccatcaaaatgctcgggcattccaccccgctgtaataattatggatgaacaggaacggcacctctttttcctcgagcttacggtagtattcgatattcgggttcggcagcgcggagcgcgtcccctcgatgatgagccctgcaacatccgaatgatacatgcggtccaaaaagccgcgttcctgctcgatcctgttttcagaaatgcacaagtcaatctcgtatccttcgagctttaataccgtctcgatctcctgaaagatatgtttgaaaatatattcgtttaagtaactgatcagtatcccgaccgttttggaagtcgcggcggcaaacgttttgttgacatacatcccgcttccacgcactttcctcacaatgccgtcttcgctgagctgcgccattgcgttccttaccgtctgcctgctgatgccgaatttccggcacaataaattttcagacggcagcttgtcgccctggcggaaggtcttatttttgatattatccacgatccattgcttgaggacaatatatttaaaattgaaattcttaccgtttccatcgtccatagcgttttttagcctccggacttaaattctttcttttattgcaggcagtgaatgagttttctatccaggatttccaacacgcgctgcgcggtcttttcatcaatcaccaaataattgagaagaccggtattcaaaacgccgatcgcggaaagcgcgcggtattcccctgcaatgatgcccatgactctacccgcttttttcaggtattcttcaccaatcccaatgatgcggctgttataatcgttgttaacgaattcgcctttgatgttgatgcggaaggcacaaatgtcgcctaccggctttccatagttttcatttatcatgtcaatcatccggtcgagcggaacctgcttattgttttcatagtaatccggcggcgcgcccgccgacaccacggcaaaatcgatattcgcccacttttctacaatggactgcatatagacgctctgcatataaagcgcgcggtctgcgatcgtctcaacgatcgccggcgcataaataaatgacggcgtgccgtgcagcttttcagcgaacatacgcaccgtctcgttgagctggtattccatccctacgcggttggagccgcccaaaagcggcacgacgtttacatcataaatatctttattgatcggaaaggactgcatgaattcatagcacatcctcccccatgcgatgccaagggccgagtggcttttcaatatctcagacgcgagcagcccgccctgcgacgaaacgatgcggataagcatttcttccgaggtaacgttcgtcggcaccacgcggcagtcatctagatggaaccggtccttaaaaataccggacaacgaatcgttgttggcgtatgggtctttgatgtttatctcaatgatcccgctttccatcgcctccgagagcatcatcgatacgccggaacgcgaaattccaagctttttagcaatttccgcctgcgtcattttttccgtataatacattttggcgcattgcaccatgatttggatgtcgttcttgccgtccacttacgttcctcctgccccattgctcctgtattaatcgcatgcggaccaatagctgtccatcgtatcgatcaattttttgaattttttatatttgcgggcatagactcctacgtttgcattgtccggctcgcaggtgtagctcgcatgataaaatgcctgcgccgcctgcctcatatccgcaaattgcccgtccgcgaccgctgcgcacatcgccgcgcccagcgtccccagctcttttgctttgcaaacctctattggcataccaagtacgtccgcaaacatctgtacccacaccttggaattggacggccctcccgaaatacgcgcaacctttacgccgctctttttgtatcccataagtttttcaacatggtaacaggtagaaaacgccacgccttcgtaaatcgcgcgcagcatacttgccttatcgtccatacatgtaatatccataaaacacgctttggctttgggattggcgttagtgccataaagatacggcaggaacaccacatcgcagtcttccggctttacggaagccaccagcttgttgcactgctcatagtattccttgctgcttcgtccttccgcttttaatattttttgtataaaccactccaggttacttgcagaagtcatgctcccttccattatattataatatccgtccaacgtatagatggaagacataaataaatccttgtcctgcacaggcttcttatccacatagcaggtgatcgcccatgtgccgccgacaatactcagcactgtctcgtccacgataccggttgcgatcgggcaggctgtaaaatccactaaaccgcccgccacgatcgtcccttcggcaagtcccgtctcctttgcagcccttttcgttatccttccgcaaacgtccgtagatcgctttaactgcggtaacaggcgcatgcattcttcggctcccagggccgcgaatacttcctttgaataatcgccgcgcaaaaggtccatagcgctgatggacgacatattggaaatctcgccccatgcctcgccggtcaggaagtaacgaatgacgtccgtgcagctcagcgcatactgcgatcgatcgatcacctccggtttgtggattaaaaaccatttcaaaagcgggacgatttgccccgcccacagcgattgctttgtgatgggcaggattttttcaaaggtcccgtccgccatccattcttccaccaaagctgccgcgcgcatatctgtggaaataatgccgtcataggacggttttccgtctttccctattaaatacaagccgttaccgtgccccgtgactgagacaccgccaatcgtctttggatcaacgccgcttttttcaataacttcgcggatacactgcgcgttcgcctgatacagcaggttcgtatcgcgctgcacataatcggcctgcggcagtatctgcggtacgatcgctgtcgctaccgccacttcatttccattgccgtcaaacatgcccacctttgaaacgctgccgccattatccagtcctatataatattttgccataccgtgtcccgcctttccgtcctacttgcctttacataccgtctcgagctttttttgtaaaaattgccgcgccgtcctgacatactcaatggatgcctccgtctggtcagaccacatttccatcacgaacagtcctgcatatccgcgttccccaaggaaggaaaagaatgcatcaaaatccacgattcccgtaccatatggcgtatccctgattacattcagctttccgtccttgacgtgccatgcaatcgtgtccttgtatccgttttcaatatcagtatacaaatcctgcatggtaacgccgcaggctgtcaagttcgcgatgtccgcatagattttgagccatggggaatcgactttgtcgacatatgccttgatctttgtaagcgtatccatgaaatccgtatccacattttcaatggccagcgttaccgcgcgttgcgccgcatactgcgtgacctctttgagcgattccagaaaacgctgctgagtcgcctcgcttctcggtccataatattcgtcatagcctgcaagctgtacgattcgtattcctgccgcaaccgcgaaatccaccgcatcgcgtaccagcttaagccccgtgcttcgcgtatcgtcgtcctcgcttccgagcggaaacctgcggttgccgctcagacacatcgtaagcagtggaaaatccctttccagcaatgcgtttctgatctccaacccctcttgactgcccggcttcacgcgcgccattttctcatccgtctcatcaacgctgagttcgataaaatcgtatccgactgtttttgccttctctattttttgtttccatccgagacttttgggtaaggctttttcgtaaagccctaccttgcaatcttttaaacccatgccatccctcttactgtccgtatctgctgaacatctccaccgcgaggcggtcttcttcttccgtcatgatcgccggctgccctgccgcttttgcagcgaggtagctgcgcgcaacatcttctgtataaacggccgcatacagcgcttccttcaggttcccgccaatcgttacgactccatggtgacgcaggatcaccgcgcgtttccctttggaataatccactgtcaaaatgcccatttcaaggctgcccggcgtactatacggcgcaacatatacctccccgagcgccacattggaaagcgtcgtacagcaagcaggcagtttatctccaatcaggcccactgccgtcgcatatggctggtgtgtatggatgatcgcgttcacttccggcatatgttcgtagatgtattgcagggcgaccgtatctacagaaggttttctcgttccttcgatgatctcgcctgccttattgaacacgatcaggtcgtccggaaccattcccacatagcccataccggacggcgtcacgatgatgtcgccgttttccttgcgcacgctgacgttccctccggacatcgtgatcaacctgttgtccttcatctcaagcgctgccgcgatgatcgctttcttgtcttgttcatacattgttttatcctccgttttatttaaataaattttgttgccgttcttatccgccgatcacgcatgtgatgccggcgcgctgtacaagggattgcaatccttccatgtcctcgttcctgagctgcatttgctcttccattgcataatccatccccaatgcgcggtgtttatgtttgccaaactggtggaaaggcagtagatcgatgcgcttcacgtcgaattctttcgcccaaatgatgacagacatcacatgcgcccttgtatcattgaacccaggtatgatagggcaccgaaaaatcacatttttatccctttgcctcagcctaaaaatattgtttctcaaaacatcgatataatcgcctgttccctccggcataatcacactcgttttctgcggatccgttgttttgacatccagcagtatttcactgacatcttcaagccccatccacatgttttcccaactgacgatgccgcatgtttccactgcgaccggtagatattccttcttgcacgcacggacaaggtcacatacaaatcccgcctgcaacagcggctcgccgccggtgatcgtcacgccgccacccgaccgcgcataatatatctcatctttcatcacctcgtgcattacctccgcgaccgtcatatcgtctccatagatctgccgcgcatctgccggacacatctccacacacctgccgcagaaattacagagcgtagtattggtgcgcaccttgctttcaatatggtagatcgccttttgagggcacaggtcttcgcaacgcaggcacgcggtacacaggttatcaaatacgacgatttcgctttccattttctgcgactccggattgctgcaccacggacaccgcagatggcatccctttaaaaacacagccgtacggatgccttcgccatcatggatatggaatttttcaatattaaatacctttcctgtttttcccatcctgtttctcctgttttctaatctctgaacgcatattcttttcacgataccgtgcaagaggattttatggttttaaaatttcatgacacttgtcaagtcacatgttaggacagccaaaacagaaatacaagaacaaattccaattcaaatacaacatattttgcagatataacaacttcgaaaacatatgtcaaagcggttgttatttattccgctcaggcatgcaaaaagttgttataaaaccgcttaaaataggcgttctcccgtttacaacccattcccttgtgcctataatgggctaaggggatatgcgtcatcccaaattacaaacttcaaataccgccggattttcctcaggcgatccataaatgttatttttcagaaaaggagaatttcgtcatgaaatatgtcagcaaaacagcaaaagaatataaagataccaatgcacagatactgggcaagaccgtttaccgcagcaaaaggattgaaaacttacgcaacttcctgctctcttccacccccactatttgttcggagcgtgcggtggccgtcacaaaagcctatcaggaatttgagggagaaaatatttatattctgcgggccaaggctctgcgtaaagtactcgaggaaatgagcatctttatcctggacggcgaacttttggtcggtaaccaggccagtacgccgcgcagtgcgcccatttttcctgaattttctatcgattggatcatagatgaactcgacggaaaacctatgcgccccgaccagaggcagggagaccgttttatcatcagcgagcagcacgaaaaaaacatacgcgaattggcgcccttctggaagggtaaaacacacgctgagcattgtgaaaaacttttgacagacgatatccgtagtacaggcgcgatcggcgcagtggattcctactggctgatgaacggtgcggacggacacctgacggtagacttaaaacgtgtcgcttacgaaggattgacatccttcaaaaaacaggccctctctaagatcgattcgctcgacctttctattcctgacgatatgacgcagcttccgttccttcagtcgtgtatcatactgtgtgatgcgatcacggcattttcgcaccgctacgcaaagcttgccaaagaaatggcggaaaaggagaacgacccaaggcgcaaagaagagctgaataaaatcgcagatatttgcaaccatgtgccggaatatcccgcgcgcacctttcatgaagcgctgcaggcttattggttcatcaatatggtcatacagatcgagaacaacgggcattcctattcgcttggtcgcatggataccaatctatattctttttacaagaacgacatcgcatccggcgaattggaatctccggacgatgcggtggagcttttaagctgtttgttcttgaagctgtttcaattgaacaagattttcactttcgacaaccagaaatcgttttccggttatcagcttttccagaacattactatcggcggtcaggacaaaaacggccacgatgccaccaacgagctttcgtatcttgtgctggaaacacaggctgctatccgcctgcacacgccttccgtatccgcgcgttaccatgaccgtgtttccaataagtttatccaggcgtgcctcgattgcattcgtcttggaggcggacagcccgcgttttacagcgacgaaatctatattccggcgctggtcaaccgtggtatgtccgtggaagatgctacggaatattctgtcgtcggctgcgtggaagccgtatgcgagggcaaatgcggacaccgtcccaatggttcgggcctgatcaatttgggcaagattgtcgaggttgctttaaataacggcgtcgacccgagaacgggtatctgtccccattccggcaagggcgaccttacgacgttcaagactttcgacgaggtgtttaatgcagtcaaggagttcagcgcatggtatatccgcgaacaggtcatttgggacaacatcatcgataaatgcacggagcaatatatcggcgatccgctcgtttccatgcttatagaagactgcattggccgtggacgcggccttaaggaaggcggcatgtactatgattatgcagggcctgaatttattggcacagcaaacgtgggcaattgcttagcggcgatcaaaaaagtggtctttgaagagaaatctttgagcgcacagcaggtcatgcatgcaatgcgcaccaattttaaggatatgcagacttcccccaccggaccggaggtacagcaactgctgctaaacgcgcctaaatatggtaacgacgacgattatgtcgataacctgacggtggaatatttccgcttcatatgcgaagagatcgtcaaatataaaacgacccgctatgggcgcggacccataggcgcaatgtggcagccgtccaccagtactatctcagccaatgtccccttcggcgcgatggtcggcgcaacgccggatgggcgcatggcgggtgaaccgcttgcagatacgacagcccccatgcacggaacggacacgcacggccctaccgcatccttaaaatcggtaagcaagctccccaccgtactcgtttccggcggcgcgcttttgaatttgaaactgagccctgcctccgtggataccgaatcaggcaggcagaagtttacagcccttgtgcgtaccttcctcggcgacctgaaaggaatgcatatccagtttaatatagtcaatgcagatatactgaaggaggctcaaaaggagccgcagaagtataaggacctgatggtccgtgtggctggttacagcgcgttgtttgcgccgcttgaccgcgacctgcaaaacgatatcatcgcaaggaccgaacatgttttataaatgcatactatcacataaaaccccctttctttgaaagggggttttatgttgccggaatcgcgcccgtcttcttgaattcagcctgtaaatatcatataataaaattattctgtaaaaagattggggttcttgatatggccaatgaatatgatccgcaaaccctaaaacgggttcagggcgtgatccttgaactcttaaaggatttcaagaaaatatgcgcaaagtatgacctcccttattttgcattcggcggcaccgccatcggcgcgatacgccatcagggctttattccgtgggatgatgatatcgacgtatgtatgctgcgggcggactatgaacgttttttacaggttgcgccggacgagttgggtagcaaatatgatcttctgacgattgaaaatacggatggatatgtcctcccctttgcaaaactttcgaaaaaaggcactgtattcttggaagcaacggataccaaccggacctatacgtcggggatctttctcgatatctttccgttcgacgtgcttgccgcagatacgcaaaagcggaccaaacaaatcaaaaaagcgtggttttgggccaggatgtgcgtgatgagcgaatatagcgaagtgaagttgcccgattcactcactggcgcaaaacgttctgccgcctctgccgcagtaaaattcatgcatggcgctatgaagtttttccgttttaccaaacaaaaagcataccgccgatatctaaaagctgtacgtatgtatgaaaatgacgaagatgaatacgtgactgagttttcgggcatggagcctgataaaatttattttatgacatcagatttgtttccgctccaggaaatgccctttgaagatacgacgatcagcatgccgcgcgatccccacccccatctcacgctgcagtttggcgattatatgaccctgccgcccgaggaagaccggaaaaaccattaccctgccgtgctgaaatttggagacgaataacatgaacgttttttatacgacagataataaatttgtaccacaggtagcaagcggcatgtgctctttgtttgaaaacaacacaaatatgcctgatatttccgtttacatcgcttccatgggcgttacgcttgaaaaccaacaaaaattacagaattttgcaaaacaatacggacgcgaagttttctttgttgaaatcaatgatctatcttcttatatcgatttttcgtttgatacgtccggctggaacagtattgttcttgcgcggctcgtccttgacaaacttttgcccgaaaacgtggaccgcgccctttatctcgatggcgatacgcttatcttagacagcttagataaactttggcagactgagatgggcgattgcgtggtgggtgcttgtatcgaacccacggtcagcgccagccgccgtgtgaatctggatatgaaagataatccttattttaatgccggcgtactcctcatcgatcttaaaaagtggcgtgagcagcgtacgggctttcaaatactggagtattaccgccaaaaagaaggaaaactctttgcaaatgaccaggatgcgatcaacggttcgcttgccggagagatttacgtgctcccttcgcggtataactattgcaatacctttgatttttatccttaccgcaccttgaaaaagctggcgtctcccgcgccttatatctccgagcaggaatataacgacaccaaagcgcatcccgcgatcatccattatctgggcgaagagcgcccctggcgggtgggcaatacgcacaaatacgctgctgaatttgtgaagtacctgcataagaccccctgggcggatatgccgatggaggatggctgggaaacctatttcaaatgctttaagctgttcaatacggtaacgaagccttttcccatgcttcgctataagatcatcgattccctgatccccgtttttatgaagcggcgggccaaacaattgaaaaaacaaaaaacgaacgcttaaagcgtccgttttcatttgcgacttatttcaatttcatctgccacatcatatccgaaagcgccaaatcacgcttgaaaccgttgatgtcgatatccgcgccaatatgtacgaactcgatccccgccatttccgcgtaatcgcgcatatggtctgcattcagcgcatagcttaataccgaatggtgcgcgccgcctgcgaggatccacgcctttgcggaggtccttaaatcaggcagcggcttccacatcgtgctcgccacaggtaaattgggcatctccccaatcggctttacgcattccacatccgccacgatcaggcgcatcctgccgcccatatcgatcagcgatgcggtgatcgcttttccggcggcggattcaaagaccatccttgcgggcgcttcccgatcgccgatcccaagagggtaggtgccgatacgtattttgccctgtgcaatgcttggatccacttccagcatgtgcgcgcccaggatcagctcgttgccttcctcaaaatgataggtataatcttccatgaacgcggtgccgccatccatgccaaggctcatgcgcttcatgatacgcagcagcgccgagaccttccagtccccttccccgccaaagccgtatccgctttccatcaggcgttggcacgcaaggccgggaagctgctcaagcccccacaggtcctggaaattcgtcgtaaatgcgccgaaatccccatcttttaaaaacctacgaagtgcggcttcgatcttgagctggtaacgcaccgccttaaggtttgtatccggcatctcgtacttttcactgcattctttgaaaagtacgtccacttcttcgtccgtgaccttctccatcgccgcgacaaggtctcccacgccatgcgtattcaccgaccagcctaatgttatctgcgtttctatcttgtcgccttccgttacggctacgtcgcgcatgttgtcgccaaagcgcaccacattgagtttttgcccttccgcgatcccgaccgcgcttcttgcccatgcgccgatttcccgcgtgacctgcgcgtccttaaaatacccgaccacgaccttgcgcgggatgcgcatgcgcgtcgcgataaaaccatgctcgcggtcgccgtgcgcgctctggttcaggttcatgaagtccatgtcgatcttatctaaaggaatcgtccggttatactgtgtatgcaggtgcagcatgggcttgtttaaaacagagagccccttgatccacattttagagggcgaaaaggtgtgcatccacgtcatgatcccaatgcacctgtcatcataattcgcttccttgaccgcagcgtagatttcatccgcagtttttaccaggtctttgtatacgattttcactggtatatcttcagacgcacccaggaacgccgccatttcctttgcatgcgcccctgcctgccgaagcgtttcctctccgtacaagtgctggcttcccgttagaaaccatatttcatattgatcgaatactttcatcatttcactcctgtttttgtccgtaataagcgtcctttccatgcttgcgcaaatagtgcttatccaggagttcacgcggcattgcatccatccttccgcccgtcaccacttcgcctacaaacgccatcatcgccacttcgtcgagcacaacggatttttccacagacttcgccgcgttttctgcccatacgaaaggcccgtgactttttacaagcaccgcattcatcaaatccgagtcgaggttttcaaaggtttcaacaataactttgcccgtgttccattcatactcgcccttgatttcttccgccgtaagcgcgcgcgtacacggcacctcgccatacagataatccgcatgcgtcgtcccatatgcgggcagtcccctgcccgtctgcgcccatgcggtcgcccacctggagtgcgtgtgcgtaatgccgccgatattcttgaaatgttgatagagcaccaagtgcgtatctgtatccgaagacggatgcaaatccccttccgccacgttgccgtccatatccacaaccaccatatcctgcggccgcagcttatcatattctacgccggacggcttgatcacaaagagtcccttttccctgtcgatacccgaaacgttcccccatgtaaatgtgatcagcccatatttcggaaggagcatatttgcttcatatacttcctgttttaattgctcaagcatcctgaacgcctttctttatctctttcaagcgtttcatcacgtcgttgccgcctctgccaaaatagtcatgcaatgtactgtattccgcataaagtttatcgtatatttttgcattttcctcattgggcaagtacgtgatatcctttaattttcccatcacgcgggcagcgtcgtacacgctgtcatacccgccgttttcttttcctgccgcaaccgcgccaaaaattgccgcgccaagcgccggtccctgtgcgctgcccgatatccggatcggttttttgatgatatccgcgtagatctgcatggcaaacgcgctcttctctgcgatcccgcctgacgcataaaactcgtctaccggcacgccgtgctcttcaaagttctcgatgatcttgcgcgttccgtatgccgtcgcttccacgagcgcgcggtacatttcttccggctttgttgtgagcgtcattccaagcatcatacccgtcaggtcaacgtctacgagcacggaacggttgccgttccaccaatcgagcgccagcaggccgcttgcacccggcttttgctgctccgcctttttctgcaaatagacatgaatgtccatgccctcttttttcgcttgctcaaaataccgcggtggtacgcaattgttgaccagccatgcaaagtggtcgcccacgcacgactgccccgcttcataccccaccagtcccggcatcacgccgtcggtcacatagccgcaaatgcccggcacgctgcattcatcctcacacatcaggatatggcatgtcgacgttcccatgatcgcaagcattttccccggaccgtcgatcccgactgccggcacgcatacatgcgcgtctacgttgccaaccgcgacgggcgttcccgcccgcaggccggttttggccgcgatcttttccgtaatcccgcccgcgcggctgccaagaggcaagatgtccgttcccagcttttcttccactacgttttcaagcctcggatccagcgccgcaaaaaattctttggacgggtacccgtcctgcttgtgccagatcgctttgtaaccagcgcagcacgaattacgcgtctccttgccggtaagctgccatacaagccagtccgccgcctcgataaagcggtccatttcttcgtatacctcaggcgcgtcggtcagtatctgccatattttagggatcacccattccgatgatatcttgtttccgtaccgcgcaagccatttctccccgcgcttagcggcgatctcgttaagcctgtttgccttgtcctgcgccgcatggtgtttccacagcttgacgtatgcatgcggattgtcctcgaatcccttaaggaaacaaacgggggttccgtccgccttaacgggcatcacggtgcatgcagtaaagtctacgcccacgccgatgatatcgtccggtgaaacaccgctttcacggatcacgaccggcactgttttttcgatcacgtccaaataatcctgcggatgctcgagtgcaaaatccacgcccagctttttcccgcccggaagcgactcgtccatcaccttgtgcggataatcgtatacgctcgtcgcgatctcctcgcctgtttccacatttaccagcaatgcgcgccccgaaagcgtaccataatcgataccaacagaatacttcgccattttcgttctcctttacgttactctgatatttttttgattgaacttctctccctgataaaggaaggcatataacaacatacgcgttcttccctgatctcatccgggtgcttgatcaaatgcagcagcctctgcgccgcctcgatacccaccttttcttttgggtggtttacggacgttaagtcgtttccattgatcttcgcgtccacggaattatcaaacccaacgatagagatatcgtcaggtacgttccttccctgcttattcagtttatggatgagccgtttggctacaaaatcattgtaacatacaagagccgtgcattcatcgatcgaacagataaagtcttcttccagcatgtccatcttctgcggcgaatgcgccgtgtttgacgaatcgtaccatccgatgcaattctcattaacttccagtcccgcgtccatcagcgcgcgcacatagccggcgtagcgccagtgcccctgcaaatcatcaaatttgaaataaccggcaatttttttatgccccgcctctaccagcaggcgggtaatttcgtatgtccattttttatcgtccatcagcacgcttgtacactggaaatccggataataattattgacgaagacgatcggcaccttatttgccaccagcgccttgtaatattcgatgttcggattcggcaaggcggatttgattccttcgacgataagacccgccacattggaatcgatcatccgttccaaaaatttcgcctcgttttccacgcggttatgcccaaatccaaggtcgatcccatatcctgcttcactcagtatcccctcgatccccgacagcacttccgggaatatataattatcgaggaagctcatacaaacgccgaccatgttgtttttcggcttcagtatctgctttttgacatacgagccgcttcctttgcgccgctcgatcgcgcccaaatcctctaattcgtcaagcgccttgcgaaccgtctgcctgctcactgaaaacttgctgcacagcatgttctctgatggcagtttgtcgccatattgaaaacggcctttatcgatgttttcgaccagccaatcgcgcaacgccctgtatttaaaattagttgtctctgcagccccagttttcaagagttcatcctcgccctcgcctattataaattctttctttactgaaagtcagcaatatattccttgtttgcttcgatcagttcccctaccatctcgttgatctgatccagggttgtcattgccgccgtgagcggatccatcttgatcccctcgtaaatatattgcaacttcttttcgtttgccgcctttgccatcagcacatgcacgttgatgttcgatatattgagtgctgcaagcgcatccggcagttctcccacatagcatgggtgtatcccctcggagtccgcatagcacggtacttcaacgacgctgttccttggcaggttttcgatcagccccgtattcttcacattcaggtttgcccgaaacggcttgcctgtaaggtttgcatgaatgatctccggcgcatattcaaacgtcttgaccatcggtatatcctcgcctttttcgagcatccctttgagttcctcaaagtaatcgtcggccgccatctcatgatcgagccaccatctcctgtcaacctgcaagtccttgatcgcctgctcgttcttgcggaaatatggtacatattccgacatatggaacggcgattcggaaacaaaatatccaaagttctgcataattttgaacctgacaatatccacaaggcgtacgcccatcgtactataatcaggctcacggtcagccattttgatgatatcctctaccttctccgcccgcctgaaaagctccggataggcatccttgccgtccactttatactgcaaaaaccaatccatatggttgatgcccgccgcccagaaagacacgtgttcacgcggcacttcgaggtaagctgacaattgcagcgccgtgctctgcacattgtggcaaaagccaaataccttgattggcgtttcgtttgcaagcgccaggcaaagaggagccatcggatttgtgtaattgaataaatatgcatccggacacagttcttccatatccctgcagattgcaagtatctccggatacgcacgcaggaaacggaacattccccctggtccgatgatatcgccgatggcttggtgcacaccatacttgtccggtatctcaaggtccaacttgtattgttcccagcccccgacattgatggtattgatcacgtaagtagcaccttcaagcacttccctgcgcctgtctgtcgctttaattataacatcctttttggcttgtttgcaaagctgttttgcaactttttccattacttccagtttttctacattgatatcaacgagcgatatattgtcgatcctgatatcatcgtacagaagcaaatccccaatcaattttttggcaaacatagcactgcctgcaccaatgattactactttgttcatttttttctcctccgcaattttttcattttatgtccgccagtatgaaattttattcatttttattcattccggttatacattcaatcccttttctacttgtttgatcgtattgatggccatttccgtatacttatcgtaaaattcgttgcatccgccctgcgccatcactgcaaacgggtctgcacccgccggaagaagctcaaacgtcaggtatccatcatagccgatgtcaaggagcgcccgcagaatcggctcgaaatcgatatgccctgctcccggcgcggcgcggttgctgtccgcaagatgaatgtgcacaaggtcttccccgcattcgcgcagcgactgcgccatatccgcctcttcgatattcatatggaaggtatcgcccatcgcacccacattcggcatatcgatccgctttacaagcgcgagtacgcgcgctaagctgtgcgcgatataggattcataacggttccacgactcaatacagatcgtgatacccgaccgtagggcatattctgcacactcacgtatattttccaccgcccaagaaagctcttcctcaaaatctgcaaccggagcgaccttcgagcacgctgtcggggcgacgatcactttttccccgcccagcgcggctgtaaaatcgacgacctgccgtacatattcctttgcatggtcgcgcaccttgtaatccggatgcaccagatcgcgctgcggcgtaaaaatagaacaggtggacgacaccttgatcccgttgtccctgcataattggttgacttccctgatatcaaaacggtccggttcgccaagcatctcgatcgcgtcataaccgtactttgcaacgcgctctatgctcgccttgatcggttccccactatacaccaacgcatcataactatatcgaaacatatgctttgcccctttcgtcggatattcccatgtgcctttgcgctatttcccctgcacaccggtcaacgcgtcctttccatatttttccatcctttcgcacaggctggaaagcacctgcaaggcgtcgcccatgatcgcgacgtcgctcatcgggaaaatcggcgccgccgggtcggcgttgatggaaatgatatgccctgcgtttttgatcccgatcgtatgctggagcgctcccgagataccgcatgcgatataaaggtcaggcgcgacggttttccctgtctgtccgacctgcacgtcgaacggggcccatccttcatcgaccgcttttctggtcgcacccactgccgcgtccattttgaccgccagcttttgcagtatcctgaagttttcggcgctgccgatcccatatcccccggcaatgacaatttccgcctctccaacgtcgcggaacacattttccttttctaccgccttaataaattgtactttgcttttttgcgcatccatatccatatctacatagataaattttgtatccgtcggcttttttacttggttcacaagcagcacattcggccgcacggacgccaattgcgggcggtggtcaggcgatatgatagaggccatgatatttccgccatatgtgggcctgatctgcaccaggttccgctccgtgtcgatgtcgagcgccgtacagtccgccgtcagcccgacctgcaacctacacgatacacgcggcgcaaggtcacgtccgttttccgttgccggaaatagtatgcctgccggtttatatgtccttgccaactcgcaaatcgcatttgtaaagagttccgtatcgtatcgtttaagcgaatcattttttacgatataggcttggtcacagccggttttcgctacgcttgtttcaaaacccgcaggaacatccctgcacagcagcacagcagaaaccttctctccaaggatatccgccagccgctttgcttcgctcaggagttcaagcgacaccttttgaagctgccctcgttcctgattgacctccatcactgcccacatgcctgcatattccttgaaatcttgttttttcgcagcaacgctgtcattcgatatggcctgcacagggcacgctttcacgcattccccgcaaaaaacacaggagtcccctacctcgggcagtttatccgtcatttcaatcgcaccgaacgggcatgcgcccgcgcacagtccgcagcctacgcatttattttgatcaacaactatcatattatcctccttgtaagctcaaacgatgtatcgcttgaaaacggaatgctccatcagccggcctgcaaccgcttccgcgctgccccgccagaggtcgattttttctttcttttcgatcccgccgcttaagatcatcctgatccgttcctcggcgggtaacgtgtcgtctatcgtcacatagctttttgcgcgcgcatccgacatcttgatcctgacgaccttggtcggcgaaccgtcgttgccgatccttgtatggtcaatatccaggtctgctaccttcagcactttgatttctttatctgtttccgccagcgtccttggtcggttgatgccctttaaaacacataccagcgcaggaagctttgcttcgtaaaattcgatgtttttgccgacctcgcgctgtacttttacaacatcgccttctatttccgcatcgcgtacatacgtgaattgcgggatacccaaattctcagcaataatcggccctacctgccccgtacatccgtcgaccgcttcgtttccgcatatgatcaggtcgtatccaagttttttcgcaacggcggaaagcgtatatcctgtggcaagcgtatccgaaccgccgatcagcctgtcggaaacgagcactgcttcgtccgctcccatcctcaggcaatattccaaggtagaacttgcctgcatgggacccatggaaatggccgtcacctttccgccgaccctgtctcgcaatgcaagcgccgcttctataccgttttcatcatacggattaatgatactggggacgccctcgcgtacaaggttgttcgttttactgtcaatttttacttcgctggtatccggtacctgctttacaaacacaataatattcatcaagcgtccctcctttatatactgcgcgccaaaatttcggcctcgaaaatgacctgttctattgcgcgtggggctacgcagtcccctgcggaatagacctccggccgtttccctttgaaggctttatagattgcattatccgacctgcattgccctgcaaccagaacggtatccatgcctgacaggcgtttttctttgtggttatacacattttccaggatcacatcgcctccgtcaaaaccgacgatcgcatggtttgcgatgatctccgctccattttcataaagcctcttggtgagcaggtacacctgcccgccctcgatgtccgtgcctacgcttgcagagggtgtaacaaccgtcacgttggcgttaagggcaagacaataatctgcaacgccgccgccctgccagaaaccgatatcatcgtacaccagcacattgttgccgatcttttcaacattccgaagcgcttccctaacatccatgacagccatttgggccgtttcaaggcctttgaaatcaggtatcagcggcgtggaacctgtcgctaccacaagtacctgtgggtcgatctctttgaccattgtttcatccacttctgtatcgaaatgcaatggaacgcccaactcctgtaattggattttcagataacggtatacttcctccaattcattccggtatgggatcttttctgccaggcgtacctgtccgcccactacattgtctttttcgtatacctgcactttatggccgcgctttgccgcgatctccgctactttgaggcctgccacgcctgcgccgacgaccatgatgtttttcttggtctctgccggctccagcgtgccgatcccaaaatgtttttccctgcttacgcccgggttctggatacattccacataaatgccgtcaacacccacgcacccttcgttgcatccgatgcaatggcggatatcgtctaaacgtccttccgccgtcttgttcggcgtttccggatcgcaaaggagctggcggcacataccgatcaggtcggcattgccttccgtaaggatcgtttccgcctgcacaggatcgttgatacgtccaaaggccgtgattgggatatctacgtttttcttgagctccgcgctctcatagaccgcccatccgagcggcaggggcgacggcgggatctgcatataccagctgctgaacgttcccgcatccgtgctcaggtaattgactccgccttcttccagcgcctttgcaattttcattccatattcgagcgaatacccataccatgtgaattcgtctacgcacagtcggacaccgatcgggtaatccggcccgaccgcctgcctgatcgccgcaatcacttccagcgggtagcgcatgcggttttcaaaactccctccatactcgtcttccctgcggttaaaaaacggggaaacgaacgtacgcaaaagcccatcatgcgcgatcttcaattctactgcgtcccagccaagttccttttgccatgcggcagaattgacgtaatattccttgatcacctccatgtcttctttttcaagctctttcgtattaaagtggcaatacggctcgttcatctgcgtcggggcgaccaatagctgaggaggattcagcaaagtcgtatggccgccctgattcagttgagtaattgctttgcacccatattcgtgcacttcgtctgcaagccgtttgaaattatctttattccttggttcaaaccctaaaacatatttaaaagacatctgactgttcgggtcgacattttggctcaccgttacggccgccgcgccgccctttgcgcgttctacgtaatgccttacattccggtctgaaaataatccgttttccaaatacccctcgtcaagcgcataacccgtatggtgaggcagaaaaacgaacctgttcttaaatgttaccttacccattgtaaatggagacaacaggtgtttgaagtcgcttcgtgtttccattgcaaggtttcctttcaattgcatgttttataattcgggaatccatgtgcccttaagcggcgcagccctatcaaaaccgcaccgcttatcaggccacatacaagaaatatttaggagcgtaggtctcattatttgctgatcaatccgcttttcctgtctgttgtgatgatgatacacaccaggaagataatacctttgatcagttgctgcgtgatcgggtccgccccaatcaggacaagaccgttggtgagacaggtgagcatcatagcgccgatgataaccgccatatagtttgatttcgcgccgcccgatacggaaagcccgcccaagaccagcgcgatcataacattcgtttccgtaaggtttcctgtctgcgccgtagcggagcctgtgcgtaccagcgcgaaaaatgccgctacgcccgcgagcgcgcccgcaatgacgaatgccagaactttagtacgatccacgtttacaccggaatatgtggcagcgatttcccccgagccgatcgcccgtacctgccgtcccagcttggtgaatttgaatacgatgaaaccggctgccacgatggctgccacgacgataaactttccgacgaggttgtcgtagtcgtagatcgcgtaaggcgtttccacgcggaagttactcgtaaagaatacgatcagccccctaaagatgaacatcgtacacatcgttacgataaaggactgtattttgaattttgcatgcatcacaccgtttaaaaggccgatgcctgcgcctactgcgatcgccgccacgatagcgagcggaatactgaaactggatacgaccgccgccacatagcatgcaagccccacgatggacccctgcgagaaatcgagcgatcccatcgtcatgacgaacatgacgccggccgagcagataagtaatgtaagcgcttgttctatgatcagtttccagttggagccgtccatggattttccttgtgtcaatatgctaaacaatacaatgacgatcacaagtccgaggtacgggatagcgctttgtaacatctttttattcatgatgtttcccccttagatcatgtagtggataatcttttcttcggaaagtccttcttcgcggagcagctcgccggtgatctcgccgtcttttagtacgaccagcctgtcacacataccgatcaactccaggatttcctcagaaatcattacgatggatttgccctgcctcgtcaactcctgcatcaactcgtaaatagatgccttgaccatgacgtcgatcccgcgcgtcgggctgtcgagtaccaggatatctgaatccctcccgagccattttgcaaggacgaccttctgcttattgccgcccgaaagcgccgatacaaactggtttatattctccatctttacgttcatcttcgttgcatattcgttcgtgaatccacgttccctttttggggaaataaatccttttctctgcagcttgtccatgctgctcagacacacgttgtcaaggatgctggcgttgatcatcaggccttcctgatccctgttttttgaggcatatgccacgcccgaagcgatcgcggtcttgatactgcctatctccacgttcttttgcggcagtttcaccgttcctgtctgtttttccaacgcgccgaacatcactttccccagctcgtgcatacccgattccgtcaggccgccgatgccgaggatctcgcctttatgcagctctacattgatattctttaatgcaccttccacatttacatcctttaaggacaagacgacctcgcccttgatgtttgaatgcgtgtcttccctgtaatactttccggaaagttcacgcccgaccatatacttcttcaagtcgtcctcgcatacttcatccgtgacagggaacgacttgatatgttcgccgtcgcgcagtacggtgatggagtcgcaaagctccagcacttcctgcaggtcatgcgagatcacgattacactgccgccgccggctttgaccctgcggatcaaatcgtaaagcttctcgcgtccgtcatgtgaaagcgccgtcgtcgtttcatccacaacgagcagcttggggttgaagtaggtcgccttgacgagttcgatcatttttctttcttcaaatgtatagtgcgcaacatcatcgctcggattgatcttatcgaatccgaaaatgtcgagatgtttccttgcgtccttattcatttttttggaatcaactaccccatttttgatgaaaagttcctcattgccaaaaaagatattttccgccacggtcaggtcttcgatcgtattcatttcctgtacgatgatgcttacgccgtgcttatttgcgtccagttggtttttcggttcgtatttttgcccttctaaaaacatttcgcccgaagtcacggtatggataccggtgatcatattggtgatcgttgattttcccgaaccgttttccccgatcaggccatgtatttcccccttgtatacctcaaaggaaacctgctttacggctttggttacgccaaatgttttggaaaggtcctgagttctgatcagtacttctttactcattcttttctcctccttttgcccgcacagaagcggttatttcaccacttcggcctttcctttgtttttgagtcccatagccgcaactatcaccagaagaatcacgccgatgattgtgttttgcaatgtagaatccaatccgttggtcatgataccgctgatgatcatcgcgatgatgaattcaccgatgataatcgaaataaccggattgacgtattttttgaatgcaagcccgatgaagcagcccatgatcggcgtgaaattccgcgacatgctgctcatgccctgtaccgggatgaccgtcgagctgtagcaaatcgtcagcagcgccgtgatccctgtaaaaaggccgcagaggataaatccgattactttatattttgaaacgttgacgcccatgttttgcgccatcggttcgtttttaccgattgccttgatataaatacctgtccgtgtatatttgataatgaacatcgcgattgcgaatgcaatgaccgcaataatgagattccacggcgcctgcccgagtatccggtactcttccgcaagcacgtaactgttgccgcccgccaaataacttgcgaggcattcgtaaatgatcatcagtcctaccgtagcaatgatggacggtatcttaaacttcagatatagaaatccatttgccacacctaccagcgtccctaccaggatcgcgccgattacaagccctacaaacccgaattgtacagagagcatgcatccaacaagcgcgctcaaaataatatttgcgccaatactgaagtcgaacagccccatcgtaagcacgaaataaaaaccgcaggctgcgatagaaggcagcagacattgctgaagcaggataaatatactttccgcactgccaaagcgggtgggctgtaagataaagaacaccagataggtagcaacgagtaaacccagtagtaaaactaaactcttcactttgtttttcataagattttacctacgtttctccgttcatttcttttccttggaaattacctgcctgccgcttacccggcacgcttcggcgcgccgggcaaatacaggcatttttttacttgattactctgtgttatgcttattttttcaaatctgcgtgtctgtccataacatcctgtaacgacaggtcctgcgccgctttcacaaaatcatcctttgtcagggaaggattgtgcgtgatagaaagctgctggatttcttctgctgtataaggaagaatgtccccgcggaaccattcgtcgaatgccttcgcttcatcgccgcttgttacatagatcatgtccataacgatctcaaccggttcctgtgcccaatcagcgcctgctacagagttgtaagccaacatgaatgagaagaacgggtcgcaccaatgtccgccggacatcgcgtcaagcgtaccgctttccatgtcatcgatcagcgtatccgtgaagtctgtggaaacgagtacgatgtcgtccgtcttgtttgctttttgcagcgcgctcattgcgccgatcaggttttcaccaccgccccctactacaacgagcgcatccatttcaggataagaagccaaatagttttccgtaacctgcgttccctgttcgccggtcgctacttcccacgtctctgcgacaacattgacgccaaactcttcgaacgccttcatgtaaccggcatatcttgtctcagccgtgaggtcgccatggttgtagttgatgataccaacgtttttgcagcctttttcgttcacgatcttacccatgttgtagccgacctgcatctcgtcctcatgcacctgtccaccgtagtttgcagaagagaatgcagcgttcttaacgtcttcttcattcaaggtgcggaagaactggaatacttttccgtcatactgctcagcaaccttgatcgccttaggaatctgtccttcagccgtgttacatacgatgactgcgtcgcatccgcttgcaaacaaattttcgatgccggtaacgactttttcatcttcaaaatcgttcgctgcgtattcaacgtcgcagtcaagggcctctgccgccgcatcgatcattcttttcatatcttgcgccagcggcatcgtgtagttaaagaaatccaccccgatcttaattctttcgccatctgctttaggctcagcactgtccttcgccgcttccaccgttgcggatgcatcgcttgaagccgccgattccgacggagccgcgctctcctgtgcaggtgcagagcaccctaccaccatcattcccagtaatgcaacacacattacgaccaacaaaactttttttaacatgttctttctccttttccctctttatctttattttgcctttccggcaaacttttttaaaaatggcaaacaaaatacactggcagtgccgtttctttttcagacacttggcacaccgatatttgatttaactttttccttatgaattcttgttagataactttgttttttcgctatatgtaacttaacattttgcaatacatgtgtcaacggattttcgggcattttagcacgaacttgtattatacatctgcgggtttttcaaaaaacttgtattattatttccatttttttacaatttaatataaaatacgtctttttacggtaaaagcaataccattccatccgaacttgttattgttttcttcttcctcgttctgtaaccattgcatttcgacaattatttttgtgctttatatattttatgcacaaaatacatctttatgcacaagttttgtattgttttatcaaaaacctgtatttatttttaccaaaaaagcatccccgcacacttacctgtgtgcggggacatccctgctgcatccgttctgacaaaattcaactattgtatttgcactccttcaaacagtatcaagatactctttgatccctgtcgcgatcgcctgcgcgacccgttgctgatattcactctcctgcagcttccgctcctcctgtggattcgaaaaaaagccgcattccacaataatactcgcctggtcgcccggccgcagcaactggtaatcccccgcgctgatttcgcgcggcttatccaccttaagcatctcattaagcgcactttgcacattttgcgccagcccatacccttttgccaggtcgtcatggtaaaacacctgcggaccgtgtgcgctgcttcccttttcataaaaattttgatggatactcacaaaaacatccgcgtgcgattcttctatgatcgtttcgcgctttttcatgtccgccgtttttctcttttgagcggacggttcctctgccgccgcaatcggttcgtccgaatcgcgtgtcatgatgatctcgtaaccttcctgctgtaatatggcctttaacttttgcgcgatctcaaggtttacctctttttccagccggcctgtcgatactccctttgtaccgacatccgtatccccatgccccggatcgatgattattttgattttcccatcgtcttcctttgccgccatttcaagagccgcttcccctgtctgggcagaaccgtccgccgctttggaaatttccgagggaatgatacggaatagtgtgatccccataatcactgctaagcttaaagccataaggcatacaaaccgttttgtgacccgccgccgtctttttttccgtgtgaccgttgccccgtgtatcgcgcgcatatgtccctcccaaaaatgataaatagaaaccccgtatctacacgatacggggttttcgtatacaattttcatcccatttgtatcatttttgtaatttttaacggaatcctgttacctgattttaatgcccacaatctgcgagccgcgcgtgcctacgacaattgtattttcaaatactgccggcgacgcttccacgttcgcgcccacatttatcttatcatataccttgcccgtaagcccgtctaagaggaacacgtttcctttactgtcacactgcacgatgtatgcggtaccatcctctgcgtataccgccaccggcgagctccacgcatatgccttcatatcgaatacccaacgctcctcaccgttcttcttatcaagcgccacaagtacgccgtttggtttgtagggcatacgcgccaccggaacgatcaacagatccgaaatactgccttttcccagcacaggcgttgcctgcacaccgccggatacgccgtataccgtatgtacgtcgtatggtttttcccagatgatctcgccgttgatggcattcatcttgaatatcgatatcttgcccatattggtggcgtcgtttttttgccaatggagcgacggcgcgacatataaatatttgcttccgtccgcttcttcttcaaacaccggcgatgcattggtatcatcctgcgtatcctgcgtccatacaagctgcatggtattgagatccatacacatcatatttccgccattatccgcaatatacatatattgtttccagataaccgcgctgtcttccatcccccaccaaaagctttcctcgctcgtgcggtcggtattatacgtccatttcaccatttcggacggctcgatgctgagtttccctgtttgcggatcaaacttcgtatttagcttcatcgaatagatgatcgcgttttcccccggatagaaaagcgtatccgtaccggcatgcaccagcgcagagctgtcgtagccgtggaatatacgcggcgagaagggatcctttgcccccaattcatacatcgtgtcaaaatttgtcaggctgcaaaaaaatgcgcgggcccagccagcttccccataagagtccggcagcgaatctcccgcccccgcaaacagcatcgggataccgcgcgggtcgatcgctcccgctcccttaaacggcagtcccagctttaacgtatcgcgcgtaggcgtgccgtcttcgatatcgataaaatagacatttccgtccattgtcgcgtaaatcgcttcgacaagcccttctttttcttttttggccggatacagattcataaccctgcgcgttttttcatcccagcgtacgatcattggctgaccggtccagccgcttcccgaccacacggccgaacctttccccttactcaaatcgcttttttcaaggaatccggttttgatatgccaataatcaggatccagctttttttgcttgatcacaggagttccaaagcttgcagtatccctgtagttgttcccgcggaaggtaacgataccttccagcttcgtatattcgtcgcctgtgccaaattcgatggattgctcccgcctgaacgaatttacaggcacttcctccccatttacgcaaaggcgcgtgtgaaagcccatcttctccggcttcgtattttccgtcgcatacggtacctgcgcatccgcatctttctgcgcctgcggatggtattgcgcctttatactcccctgcgtcctgctgccataacggcggaggcgaacataaacgccgcccgctattatgagtatggccaatataactaaaacaacgatccatgccatgccaatgtacctgccttattttcgatatgtttgactggattcattatacaatgttgtcatccaaagttcaaaccgcataggctcgttggcaatagatagcatcacaataagtttaaactaatttcccctggaatccccagtttggaaattccggaatggaaataaacatatcttctttggctacctggacggcattaccaaatatatcatatattttttctgtgagtatgcttttgctgtcataatcggcctgcccatgcaggtttacttccacaaacgccccgttatccttgttttttcctccaaaatacaaatcggtaccgtccatgaaaccgatcatgagtaccgcttccgatttgttcggaatcacagaaataacttttcccagttcccctttgatttgctccttttgttccttcgccagtttttttgatgttactacctgaatataaggcataaattccacactcctctattatttattgacagaagctaaattgcttgtcttgtctactcttgaacagccattttctctaagcgaaacattttagcataaaacgggtcttcatccattttataaaaagtgaacaggtgccttgtaattgcttcaatcacgtcgtcaacatcccttcgggtgagggcgtctataatttcgtaatgctgttcataatttttaagttgctgcccgctttgggaaaataccgctgtctgcaacaaacgcgttttgagcaatatttttttctgtatatctaccaaaagctcgcttcccccaattttcacaagttccatatggaagtcagtatcatacttgatctggtgaaagaggtcatgctttttataagattccctacactggtctgcaatcccttttaactcgtcaaaatcccggttactcccattttgtatcgcaagcctcgccgacatggaatccattgttacgcgcaccatccctatatcgcgcatcattgcgtctgtaaaggtaacaacttctgcaaaccggttggtataaatattgataataccgtcattggcaagacatctgattgcctcgcgcacgggagtacggctgatatttagcgtatccacaatcttctgttcaggtattttatctccgcattgtatctcagatgtaaagatcatttttttgatatagtcgtatgccagctccacaagactattttttttacttgttttcatacctttcctttctttatctcatataatgtatttcatatataattattgtaaaacagattgtatacaattgcaagatgattattttttaatttcaagaatttgtaaaatcaaaaatacctaatatacttttcctacattaataatatattttcaattattttaattttaaaaatatatataataataaat

SEQ ID NO: 17 - DNA, 53419 bp, Christensenella sp.
accgacaacgcgatctttccttccgcattggtgtccgacgcgccctgcggcgcggcgggcgcgcagcccgccagaactaaaaaaaacaacgccattgcaatacaaagtatttttttcatgctgcttctccattcatttttcctgcttattgccccaaaatgatgaaaggaactcccgtatccagttcgcaataaactgtccgtctacatcgctgaacaaagtatccaagccctttgtaatttctttcacccccggaatatcgccgatatggttcacaggattttcatatgatttttcacaatacctgacaagcgcgtcaaactcttctaatgtcaaagtatttgtctcccatatccgttcaatcccttgtaacttgatggcatctaccaatttcgtcctttgcttatcgtcaagacgatccccgtccattcccaacagacgattgatcgcttccatctcaggcgtaccttgtatctccacaaggttgatctcgcctttttcttccagctccctgcggagttcgtctacgccttgcaactcatacgctttgtcctgtccatctttttcttcatccggatgcgctttcacatagtcgcgtatctttgcttcctccggcgtgagcggctgcgcaccagcctcaatctgctctactgtttgcggtatctttatcactatcctcgccgacgcttccggccgaatccacttgtcccctcaattccgctacccgcgcttccaaaagcggcttgagtttttccgtctgctgccgcacaaaatcgttcttcaattccttttccccaaataatccctgcaaaaacgggtcggcaaggtctccgtccgaacgttccccgccttgcccgttacgttgcccgggcaaatagacggatggcacatggcggatatgctgtattaagctataaaaaagaagcgcattcctgcacttcttttctatacatatttttctacagtcccatcataccacgtcccttatggacttggcaggacgctcgccagacatttgcggacatgccacgcccctagacgatctccacacccgcgctaatcgcaaaacgcagcgcttcccgatcaagcctgtcgtccgaaacaagggcgctgacatcctcaagctgggcaaaggtgaacggcagtaccttatccattttactgctgtccatcaatatgatgaccctgcgcgcacgccccagcacttcctttttgatttccgcttctgtgtacgtacccgtcgtaaaaccgttctcgatggaaaatccacttgccgccaaaaacgcggtatctatattcacttcctgtatgaagcgcgtgcagttcgtccctgaaacggcgactgtgttgcggttcacctgcccgccgatgagcgtcacgctcggcttctgttttttgatcagttccatagcaatattgacgcccgacgtcataacagagagatattcgtcaggcatctcttttacaaactgcatcatcgtagaacccgcgtcgatataaacggaacgtccttgttccaaaaactgcagcgccttttgcgcgatccggcatttttcgtccgtgcactctgtcgcgcggcgcgaataaacgttttccgcttccagggaaagcgcgtgcagcgcgaccgccccgccgtgggtacgccgtaatacgccctgctcttctaaaaatttcaggtcacgccgcagcgtgacgcctgagctttcggggaacttctcctccaattccttcagggtaacctccccgtgctcttttagcagttccttgatttcttcgcgtcttttcatcgctgaccatcccgcctttttcctgtctatattatggaagtattatatcatttttatcaccgtaatgtaacttttcatgataaatacgttgtgaatttaaattttttttaatttttttatatttgaacgtttttaaagtaatttgcttaaatgcgaagatatcgcattttttaaatgaacacacgttcacagaattttcattccagccgaaaaccgcattaaaaagcctttcccgccttgacttttttatttttaaatcgtatcatatacattaaatgaactgcgttcatataagatttttcagagatatggcgcaaaaaagcatgtaggatttatttggaggttttattattatggctatcaagaactcgatcaaaagtgcaggtgctaacgttgccttctccgcagcgttcaagtatctggaaaaggaccctgtaaagaatcttcccaaactcttaaaatgggcggataattttacaaagggcaaccagtggaataaatccgtgaagaatttccaggattggtgggaacagcagacatggcagggcgttttgatgaaacgcgtcctgacagacgtcaacgtaaactacctgaagagattcatcctgaacttcttcctcaattccggcgttaagggtatgccgatcgcgcaggcaaagggcaaggaaatgggcgtacaggtcccgtgggcgatcctcatggacccgacttccgcttgtaacctgaaatgtatcggttgctgggctgccgaatatggcaagcactacaacctgacctatgaaaagatggacgagatcatcacgcagggcaaggaactcggtatttatgtatacctgttctccggcggcgagccgctcgtacgtaaaaaagacctcatccgccttgcggaaaagcattcggactgcgcattcggcgcattcacgaacgcgaccctcatcgacgaagatttcgtacaggatttgctgcgtgtcggtaacttcacgttcatgatctccgtagaaggtacgcccgaagaaacggacgcccgtcgcggacagggtacgtacgacaaggttatgaaggcgatgaagctcttgaaagacgctggtatcccctttggttactctgcttgctaccacagcaagaactaccagacgatcgcgagcgatgaatggaataacacgatgatcgaggcaggctgcctgttcggttggctgttcacttacatgccgatcggcaaggacgctgtgctcgacctgtgcgtaacgcctgagcaaagggcgcatatgtataagagagtacgcgagatgcgtgaatataagccgatcttcatactcgacttctggaacgacggcgagtatgtcggcggatgtatcgcaggcggacgccgttacttccacatcaactccaacggcgactgcgaaccgtgcgcattcatccactatgctacgcacaacattaatgagtgcacactggaagaagctctcggcagcccgctcttccgtaaataccaggaaggccagccgttctcggataacctcttgagaccgtgcccgcttcttgacaatccggatgggctcaggaaagcggtcaacgaatccggtgcacatccgacgcaggacttagaccttgagggcgttgacgtgcttacggcaaagacggacaagattgctgagaactggaagactaaagcagacgagatctggtcatgcggccacttcccgttcaacggcgtgatcaaccacgcaatggacaagagagtggataccacaaacggccagggcgctgcggcttgcggcaactgcggacatgttccctgcgacagggagacagaaaagccggcaggacttgactgagcaaacagaataaaaggcatctatgatgcttgagacgatccaaagtccccgtttctattgtgaaacggggactttttatgctgcaaaacaaatacctgtccagctcggccatataccttgcggttttggctggaagagcatatactaaaagaaatccgtaacgaactatcccccacacacttttatggagatgagaatggaaaacaagcagtttctttgcaaaattacaaaaaagctttggaaatattacctgctgtcgcccagcgtggaacattttgaaaaaatcttatcctattgctcagaaaattttattatgattgggacggggaaacatgaattttttgtttctctggaacaactggcaaacaatatggccggtaaccttacggcggcggaggatatccgcttcgatgtgatcgacgagtggtacgaatgccttgagctgagcgccgatatatgtctcgtttacggcggaatctgggcgcggcagcacgcggaatcccaggacgacgtactggtcgacatggatacgcgtttcagcatcctataccagagacaggaaaccggatggaaaatcatccatctgcaccattccatgccctatttcgaccagcagagcggagaatactatccccgtaccctttccgaacaggtcaaggacgctttggcgttggcacgggaataccggaaaaaggccgaacttgacctgatgacggggatctacaacaacgagtccttccggctgcacattcaggaactgctgaataacgatcccgccccatcgggcaatttgtatgtatttgacttggatcatttcaaatcgatcaatgatacgtatgggcacagcgcgggcgacagcctgctcaagctgttttccagccttttgaaaaagtactttccaaagaactctctcatcggcaggcttggcggtgatgaattttccgtgtttgagcattccatttccggcgaggatggctgtaaccgtactattcttgcgttggaggatgaatactgccgcgaaggtaagaaagtatccggcggcgaaagtattcccgccttttcggttggtattgctcgttttgacggctcgcaccgttcctaccatgcgctttttgggcaggcagaccgcgccctttaccaggcaaaacaatcagcaaacaatatttaaggaaggaatcttgttatgaatgatggactgaaaatcaaaatgtactcatttacgatagactgtatcaatcccccggagcttgcaaaattctatgcggcgttgttaaattgggagtttatttcgattgacgaagactgggcatgcgtatgcgcccccggatcaagccagggagcctatcccggcattatgttccagcgcaaccttgaatataagccgcccgtgtggccggaagagccaaacgcgcaacagcaaatggcgcatctggacttcgcagtcaacgatttggatggatcggttgaatatgcgctcaattgcggcgcaacgatcgcgggtacgcagttttctgatggctggagggtcatgcttgatcctgccggacatcctttctgcttgtgccaaatgaaagagatcatggaagatccacagttttcattgctataaaaaaacgtttgttttatttcaccctcgcgctcatgccgatggttgcgaaatattttccgtcctcaacgcgcatcatttccctgtcgcccacagcgtactcattattatcgcatgcaagccagtccgtccatgcctgtttgtggcatgtaagatcccgtacggatatccgttcaacggatggttcgcttttccatagtttttcccaccatacgccggaatggaaattcatatccggctgccagtatgcttccaattctttaggcgcgttgcccatttcctgttgcaggcccggtacggccacggcaatcaggccgccatgtgctgtaagcggtgcgactttttccgtcaggaatcccttgccgcagccaaaatagtggtaagaatcgacggtgaacaccgcgtcgaaatacctgtctgcgaacggcaggttgtttgcgtcggcatggataggtacgatctgctctcccagccccattgcacggaacctttcatagttttccgtcgcgggtatccacaaatctgttgcgaatacctgcgcgccgtagcggtccgccagccacatggacgtaagccccctgccgcagccgaggtccaatatacgcgccccttcgggcagcgtaatatctttgcacagctcctcaaggatcagtaccgcgcttggtcccatcatgttttcttttaaaaaatcatgatccagcttcataagttttctacaccaatttttcaatgaactttgcgagcatgtccgcactgtcctttttgccccattttttctgcgcgctgcgcatttcatcgagcttgagcggatttaaacgcatctgcctgatcaccatactgagcggctggtaagcgttggcgtgcaccgcaagggaattattcagcaaaaacgcgatgttcatattctccacgcccggcatgggttttgtaaggatcatcggtttttccttggcgatcgtctcggaggtcgaaagtccgcccggcttggtaatgaccgcgtccgcagcgtcaatatattcgtccatattatcaacaaatcccaagatatgcaccggatttttgaactccattgccagcagcttgtttttgagccgcgtatttgtcccgcacaccgttacgatctgcgtttcttcgaccgtatcgatatcctgcagcacggggatcagccctgcaaaccccatgccgcccgaggccatgagcacggtgaacatgtccggatcgagccccagcttcgcgcgtgcttccttctgcggaatagcatgtgtaaacttgggcgcgatcgggatccccgtcggcagtattttgttttcggcaataccgcggcatgtaaattcagggatcatcagctcgttggctgcgacaaaatagtccatcgccgtatattcccaaaacggatgcagggaataatccgtcacgatgccaatacttttgatctttggatcgatcatgcctgtttctttcagggatgtaatgaggatcgccgtcatcacaatggagcagacgatgacgtccggctttgtctcctcgatgtatttttgcatcttgcttttggtaaggtttgcaaacgcccacgggaaattcaacttcatatccgaacgcccgctcgccttttccgcggccttataaatgttctcattgagcttgggcacaaaccgtcccatcgcggtatatcccttgtcaaagccaaggccgatcgccttgttcaggaatttgtaagtatccagtatttcgcaggtatgccctttctcttccaagctcgcgcgcagcgccctgcttgtcgaattatgcccctgcccgactgtcatgcttaaaatcaacactctcatactaaacctctttatatcgcgtttttcaacaaatttaatatatcatagataaccacttcattcaatgtcataactatgaaacctttcttaagattgccccttgaaaacgcgctattgcgggccagcgcgcgttgtgctatcatagatgttggcgtttttgcgcctttatgaggtatatttttatgaatgaaaagaaaacgatcgttttaacgggcggcggcagcgcaggacacgttacgcccaatttggcccttgtaccagggcttttgggccacggcgtcgacgtacattatatcgggacggcggacgggatcgaaaggacgctggtacacgatatcccgttccatacgatcagcgcagggaaaatgcgccgctatgccagcgtgaaaaacgtgacggatatttttaagatattcaagggtacaaaggaagcgaaacggatcttgaagggactaaaacccgaccttgtttttgccaagggcggttttgtatccgttcccgtcgtatgggctgcggccaagctcaaaattcccgttatcctgcacgagagcgattatacgcccgggcttgcaaacaggctgtgcgtcaaaaaagcgcagaagatttgcctgtcgttcgatagcggacaagcgcgcggcccgcgcagcatcctgaccggctcccccatccgcaaagatattcttaacggagaccgcgcggccggactcgcaacctttcagtttagtggcgcaaaacctgtgttattaataatgggaggctccttaggagcccaagctatcaacgacgcggtggacgcggcgatcggccctctttgcgagcgctacgacattgtccacctgcgcggcaaaggcaagctcaatccggagcttgaaggcagcaagggttacaagcagtatgaatacatggaaaaaggacttcctgacgcgtttgcagcggcggatattgccctttcacgttcaggcgcgaacgccatctttgaatttttggcattaaagctgcctgctttacttgttccgcttccgctttccgcgagccgcggagaccagatcttaaacgcgcaatactttgaaaagcgcggatatgcgcgtgtattggagcaggaaaacctgaatgcgcaaacccttcttgacgcgttggacgaactgatcatacacaaagacgatatgataaaagcaatggaaaacagcaaggaagcggacggtaccaaaaacgtgttgaacgttatccttgagagcatgggagtgcaatgaaaacagcagaaatcacggaatttgtagaaaactataacgacctgccggcagccgagcgcaaggaaggcatcgcagcgcttttgaaagacggagaactgcaaaaagtatatgcgcaggtcaagggcggcaacgcgcgcgctgccctgcgtatccttgccgatctgggcgagcgggcgcaggatgtcgcgcttgccaacatcgacggcctgttaaaactgctcaaagacagcgaccccaaggtgcgcatgcttgcggcgcaggtcatcggcaacacatgtgcggctgactacttggacgagctgatcgagggcgtgatgcacgagcaaaccatttttgccctgccctcctaccttctcgccatcgggcgggccaagagcgaccgtgccaagcggtttttggaatcctaccaattacgcagcgacattgaaaaacaccgcgacgaggaaagcgcagctttgagtaaagccctcgcgaattttgtgatccgtaccaaggcgcgcgtgcgcgtcctccccacggatgtgatcgtgcttgcctcccccaacctgaacgtaacgtattcacagtgcaaggaagcgggccttaaaccccgcaaattcggtaaatacatcgctgttacttcccttgccgatttttatgatatttataaactgcgcgcctatacggacgcgtacatttacctcggttcttcccccgtttcggaactccctgcatttttaaagcagcgcgaagcggcggtcatgcagcgcacgggcgttacggggtatcggctcgaggtacgcaataccgcgcacgaggtgcgtatcgacatcatcaaaaaatgcgtggcggccatgaaagagctggtcaatacgccgtcctcgtattcggtggagatcatgatcgagatcgacggcgacacggcgcaggtgtttttgaatcctttgacggacaaccgtttcgattaccgcaaaaaggctattgcggcgagcatcaatccgggcgttgcggcaagcgtatgcgcttacgccagcgaatttttcaatccggatgcgcgcgtgctcgataacttctgcggaagcggcactatgctttatgaacgcggattttacccgcaccactccttaacgggcgcggatatcaacgtcaccgccatcgaagcggccaaggaaaacagccgttatgcgcatgtgcatccgcagttccattacatcgacgcgctgaaattcacagcaaaaaaatacgacgagatccttgtcaatatgccgtttggtctgcgcgtgggcaaccattcgcacaacgaaaggctgtacaaggcatatttccgtgttttgccggagatcctcacggaaaagggcgtggccgttttgtatacgcacgagaaggcccttacagagagcctgatcaaaagctgtaataattttgaggtgttaaagcgcgcgacgtttgacgcgggcgggctttatcctgcggtgtatgtgctgcgaaagaaagactgaaaaccgttttttccggttgcaatcctcccgttttgcctgtatgatgaaataagtgatattattattgtttttgacgaatcgtcacgacaatacaaagcgggggggacttttatcatgactatttctaattctgattactatcgtttgaatcaatacggcgccatactcattttattgctgatacgtattattgttggccttatttcggcgtttaacggtgtgtttacacctactgagatgctcaaacccgaataccagatacttccgaccctttacgttatagtgctcgcactgcttattatttgcatcgtcttcttttttaaacggaatgttattttcattattacgtacggcatcgtcgctattatcagtattctattgaacctgtgggtgcagagctttttcggagctcttgtcgtactcattatcgaaggcctctttatgacatacttgctcgtttccaaacgttcaaagatcgttttcaggctggtcgatgtgaccgttgaaaacttagacgataccgtgacgcatatcagcgccggaatacattctgtcgttacggaggagccactttctactgcaaacgctctgcaagatacggcaggaaccactgcgccagccgcaagcattccacagtcacagccgcctaggcagcctgcccctacggcatttgcaaagcaagaaaccattttccgcacagcggaggtttccggcgaaatggaaaccctttcccctgccgcgaaaaaggcgctgcaagcgcgcatcacgaaaaacattcgcaaacaaataaaatagcgaaaaacgcatcaaaaaaggacaggcgcaacgcctgtcctttgtgtttataccgtttatttgttttccggatttccctttgttatcttgttatgctggtcgaaaaggccgatgacacagaagaaaataccgatcgcgcacaagaacccttgcgcaaaatcgataaaactgttttgcatcatgataaattgccccaaaagaatattgatggcaatcgctaaaattcctacaatcagatatagattcggacgtattttcatctccgtgccgcctttttcatgttagtatgttcattatatcaccacaaattttaagatacaaccgacttttttgactttttatacaaatttaacatttatttttccagtgctcctgccgcaaatccgcacgatgcgatcatttccatgtcgcttttgagggcgcttcctaccgtggtaagcatgccgcctgtgatggccgcgttcacgcccgagcccagcagttccctgccgccgtcgcgcaaacggacccgtcctccagcaaggcgcagcgccgcgtccggaagcaggaagcggaaaaccgccgcagtccgcacgatctcctcttccggaagaacgggcatgctttcaaggggcgttccctggatcggattcaggatattgagcggtacggagcgcacgccgagtctgcgcagcgcaaccgccagatcgatacggtcagccatgcgctcgcccatgcctatgatgccgccgctgcatacggcaagccctgcgtccttggcgcgccggatcgtttccagcttatcgccgtaggaatgcgtggtacacacatgcgggaaaaaattgcgcgacgtttccagattgttgtggtatcgctccacgccggacttttttagcataacaaattcctgccggtcgagcagaccgtgcgacgcgcacaggtgaagctgcggatacgcctttttaagcgtgcggtaggttttgcatagggcggagacctcggcgcgtgtcagcttcctgccggaggtcacgatggaaaaacgccgtacaccgccctcgaagcttctttgggcggcggcaacgatctccccttcgccgagcaggtcataaaattccgtagctgttttataatgtgcggactgcgcgcaatacttacagtcctccggacattttccgcttttaccgttgatgatggagcagaggtcaaaggtgtcgccgcagcgcgccttgcgtatttggtctgccgcctgccgcaggctttcgatttcctcccccgcgagtctgaccgcttcttcgcttgttacctcaccgccgtcaagcgctttttgcaacatactttccagaaaatccatcaggccgccgccccctttttcagtacggggatcagccgcttggcaagccatgacgccagcaggcagcgcaggatatccgccggcagcaccatgataatgcacgaccagatcgcggcccatacgccaatgggcgtctgcatgacataattcatgatgaagtaaaaataaacaacgccgatcaggtatacgggaaccatggcgatcatgcctgtcaaaaacagattccccaccgtcagctttttgagtttccgcacgcgccggcccgcgacgaacgcacacaccgcaaacccgatcaaaaagccgaaggtcggcttcagcacatacatcacgccgccgccctccgtgaaaatgggcaggcccaccagccccagcgcgatatataccagcatggaaatactgccgtatttcggccccaataaaaaacctgccaacagaacaaagaagccctggaacgtaatgggcacatacggtatggggatacggatgaacgcgccgatcgcgatgagcgcggcaaaaagcgcgcacaaaatagtatcccttgtcgccgttcgtttcattggtgacttctccattgcttgttttccccctatcatttatgaatacgaaaatcagtataccatgccgcgttttaattgtaaaccgttttattattattggtatacaataatacgaatgtttacagctattccaaacgtggtatactaaaaagcatattaacaggagcgtaaaacatgaaagtaagcgagctcaccaaactgcttttgaaaaacggcattacgcgaaagcgtgagggaggcaggcacgacctttattacagtcccctgacgcgcagtacgtttcccgtatcccgccaccgcaccgaggaactgcccgcggggacgctggccgcgatccttcgacaggctggtctgaaacaggaggtatcttaatggcaatctatcaataccccgctatcataagacaggaaacggacggactttattccgtttgttttcccgaccttgaaagctgcgtatcatacggcagtactttagggcacgcgctcgagatggcgcaggacgcgctgtcccttatcttatacgatatggagcaggaatgcgcggcgatcccccagcccactcccatagaaagcgtcccttgtgatagcgcctgcgtgcgcgccgtcatgatcaccgccgataccggcgcatacgaaaaacaatattgccggtgcaaggacgcggcagcgaagccctaagcccgtccgcatttacattccccctgattggtgctatattggaaaaaaggtcacgacgctgtttggagggtatcgcatgaattttttgcgttatcagaaaatccgtttttggcttcttatggcaatgccgttcttttggtattcgagatcgttatgctgaatgtgacgtggagcccgcatcccagtaccgccacgttcgtttttatcggcctgctgttcctctggtttttctgcctgtttgcggtcatccctttttcatacggtattaccacaaccgcacgcggtcgtctgaacggtctgttccttccccgttcgatcaatatttttcgctagacgaccttgcgtcgatgatatcgccggattaattcaaaagccgccaatcaaggcggcttttttcttacttcttcctgggctgcaaatagtgctcgggcgtcgcgttgtcaaagatacgcttcaaatactgccccgtatagcttttcttgtttgccgcaacctcttttggcgtgcccttggcgatcaccgtgccgcccttgtcgccgccgtccggccccatatcgatgatatagtccgcgctcttgatcacgtccaggttatgctcgatcaccaccaccgtgttgcccttgtccgccagcctgttcagcactttcaccagctttttcacgtcgtccatatgcaggcccgtcgtcggctcgtccaaaatgaacagcgtattgcccgtctgttttttggaaaggtgcgtcgccagcttcacgcgctgcgcctcgcctcccgaaagctgcgtggacggctgccccagcttgatatacgaaagccccacgtccatcagcacctttaatttgctttcaagccgcgggatgttctcgaagaatttgtacgcttcttccaccgtcatatccagtacttcaaagatattcttccctttataacgcacctcgagcgtctcgcggttgtacctctgccccttgcatacctcgcacggcacgtatacgtccggcaaaaagtgcatctcgatcttgatgatgccgtcgcccctgcacgcctcgcaccggccgcccttcacgttgaaggaaaaacggcccttctggtagccgcgcgcctttgcgtcctgcgtcatcgcgaaaaggtcgcggatcatatcgaacatgcccgtatacgtcgccggattggaacgcggcgtacgcccgatgggcgactggtcgatatcgacgaccttgtccacatattccagcccttcgatcgccttgtgcttgcccggcctgtccttggaatggtagaacctctgcatggacgcttttttgaggatatggttcacaagcgtgcttttgccgctgcccgatacgcccgtgaccgccgtgatcacgcccgtcgggaacgctacgtcgatatccttcaggttgttttcctgcgcgcccttgacggtgatccactgctttgctttgcgcagcttgcttgggatgcggatgagctttgcgcccgagaggtactgccctgtgatgctctttttgttctccatgatctgcttgggcgtaccttcagcgatcaccttgccgccgtgcgcgcccgcgcccggcccgatatccacgatgtggtccgcattgagcatcgtctcctcgtcgtgctcgacgacaatgagcgtattccccaaatcacgcagtcccttcaaggttttcagcagcttgtcgttatccttctggtgcaggccgatgctcggctcgtcgaggatatacagcacgcccatcagcccgcttccgatctgcgtcgcaaggcggatacgctgtgcttcgccgcccgacagcgtccctgccgcacgcgacagcgtcaggtaatcgaggcctacgttgatcaaaaagtcaaagcgcgcgttgagttccttcatcacgcgttcggcgatcatcttttgtttattatccagcttgaccgtattgatatattcccgcgccgcgcggatggacatatccgaaagctccgcgatatttttgtcgccgatcttaacggccagcgtttccggtctataccgtttgccgtggcacacgggacacggcgtttccaccatgtagctttcgatctcgcctttcatgtattcggaggtcgtttccgtataccgccgctccaggttgggcacgatcccttcgaacgcggcgttataatagcccgcgccgcccatgccgtcgtattccacgcgcagcttctcgccgtccgtaccgtaaaggagcgcgtgcttcacttcatcggaaagctcctcgtacggcgtgtccatatcaaacttgtaacgcttcatcatcgcgtcgaggtagttcttggcgatcgtcccgaccgcgccgaaattccagccggaggctttgaccgcgccttccctgagcgttttcgttttgtccggcacgatgaggtccggatcgatctttaaaagcatgcccaggcccgtgcattccggacacgcgccgaagggactgttgaaggagaacatacgcggggtcagctcctcgatgctcacgccgcagtccgcgcacgcaaaattttcgttcatcagcttttcttcgtccgtatccatgttgcggatgatgaccagcccgcccgtcatgcgcagcgccgtttcgatggaatccgtcacgcgcttcgcgctgccttccttgatgatgatgcggtcgatgactgccgcgatggtatgttttttctgtttctcgagtttgatctcctcgtccagctcacgcgtttccccatccacgaccgcgcgcgtaaaaccgtcctttgcaaggtcttccagcacctttttgtgctcgccctttttggcgcggatcacgggtgcgaggatcatcagcttcgacccttccggatttctcatgacctggtcgaccatctgatccaccgtctggcgcgatatctttttgccgcacttcgtgcagtatacctcgcccgcccgcgcgtacaaaaggcgcaggtagtcgtgtatttccgtaaccgtacccaccgtggagcgcgggttgcgggccgtcgttttctggtctatggagatcgccggcgaaaggccctcgatgaggtccacgtccggtttttccatctgccccaaaaactgccgcgcatacgacgacagcgattctacataccgcctctggccttccgcataaatcgtatcgaacgccagagacgatttcccgctgcccgaaagaccggtgatcacgatgaatttgtcgcgcgggagcgtaatgtcaatattcttcaaattgtgctcgcgcgcacccttgatgtgtaagtagtccatatcgtatcctctttatatatttaaaattttatattttgttccgtctgccatccggcatgtaatgccgccctacttgctcaaacagcctacctcgcttcgcgacgtaaaactcgcatacgtccggcatcacgatgccggatggcgtggcggcttagcagtaagcccttacttcttttgcagttcctcgatcatatcgcgcagcttcgccgcaacctcgaattccagctctgcggcggcctgcttcatctgctgcgtcaggatatcgatgcgcatgttgcgctcatccctgggcaggttctttaacgcctcgtcttcctccgccttctgggagatcgcgagcgggtcgctgacctcttttgaaatcgtggtcggcgtaatgccgtgcttctcattatattccctttgcagggcgcggcggcgctccgtctctcttactgcggcgtttatggaacgcgtcatcctgtccgcatacaagatcacgcgcccttccgcgttacgcgcggcgcgcccgatcgtctgtatgagcgacgtttcgttgcgcaaaaacccttccttgtccgcatcgaggatggccaccagctccacctccggaatgtccagcccctcgcgcagcaaattgatgcctaccagcacgtcgaactccccaaggcgcaggccgcgcatgatctcgatgcgctccagggtgtcgatatccgaatgcatatacttcacacggacacccatttccgtataatattccgtcagccgctccgcaagccgttttgtcagagtcgtcacgagcacgcgcctgccgcgcgccgcgatatcgccgatctcgccgagcaggtcgtccagttgcccttccgttttgcgtatctcgatcgcgggatcgagcagccccgtcggacggacgatctgttccacgacctcgccttttgcgaggtcgcgctcgtattccgcgggcgtggccgaaacatataccgcctggttcacacgcgcgttgaattccccaaactggagcgggcggttgtcaaaagccgacggcaggcgaaagccgtaatccacaagcatctgcttgcgggcgcggtcgccgttgtacatggcgcgcacctgcggcagcgtcacatgcgattcgtccacgaacagcaaataatcctccggaaaataatccatgagcgtatacggcggctcgccgggcttgcgtccgtcgaaataccgcgaataattctcgatgcccgagcaatacccaagctccttgagcatctccatatcgtaaagcgtgcgctgctgtatgcgctctgcctcgagcagcttcccctgctccttgaacatctccacctgcgcgagcatatcttttttgatgtcgggtatatgcgcaagcaccttttcgtgttccatcgcgtaatgcgacgcggggaagatgataacgtatttttcccttgtcagcttcttccccgtgagcgcgtcgatctcagagagctgctcgatcgtgtccccaaaatattccacgcggatcgcgcgttcgctcgtccccatcgggtaaatgtccacgatctccccgcgcacgcggaacgtgccgcgcgacatgtcgatatcgtttcttgcgtaattgatggaaaccaatttttccagcagccgctcgcgtggatattccatcccctcccgcagggctgccgcaaggttcccgtagtcttccggcgcgccgatggaatagatacacgacacgctcgcgatcacgatcacgtccttgcgctcgagcaaagcggacgtcgccgaatgccgcatcttatcgatctcgtcgttgacgctcgaatccttctcaatatacaggtcgcgcccgggcacgtaggcctcgggctggtaatagtcgtaatacgaaacaaagaattccaccgcgttattgggaaagaactctttaaattcactgcaaagctgcgccgcaagcgttttgttgtgcgcgagtatcagcgcggggcgctgcgtgcgcgcgatgacgttcgccatcgtaaacgttttgccgctgcccgtaactccaagaagcacctgcgcgcgcttattgtcctgcaaaccgcgcaccagctcgtcgatcgccttgggctggtcgccggcaggcgcatatttggaatgtaattcaaacttattcatactacctcgcttatctcggttgccccgtctcccccgtaaaaaaccagtaacttgtattataccacatatcatgtcaaaaatgattaaatcagcgcactttacacaaagaaaatccccgcataaaaatgcccgctgaaaacgtctttatggtacaatggtaatcaaggaaaaaacggatcacggaggatggtttatgataaagcatatcgtatgttttaaattgaaggacccttcgcagcaaaactgcgagcgggcaaaggaagtgctgctgtctatggacggtaaggtggagcttttgcgcggcatcgaagtcgggatcgatttcctgcattccggccgctcttacgacctcatcttagaggtgcttttggacgatgaagcggcgcttgacgcttaccagcgccacccctaccacgtggatgtggtcaaaaagcatatgcacgccgtgcgcgaaacgagcgttgccgtggattattacctggattaagcaaaaaaccaaataaaaagacgcctgcgggcgtctttttatttagccgttatgcgcgctggctccgctcctttatccacccataccgccgacacaatagttgcgtattcaactaacatgccaacaggttttatgctgtcgccgatcattccggttgtcaaggatacggatgaataatacttgactttttaagtactcaatataataatagtatatatacaatggttaccttttggtatgcattggtttgggggatactattttgacagatcaaaaaagaaatatgggaacgcggaaaaaaggtcgccgcgcacggctttctttaaagcgttttttttatgtatttttatgtattacactcgttttgggcggttcgtcccttgcgctggcacaagaggacgggacggttaataccggcgatacgcccttgccgcccgcctcagcgcccaaacccgcagccgcgccaaacgactggacaggcaggacggatatcctcgctttatccctcactaccatgcaatataaggacggcggcaggtgggttgacctttcgaaaagcggcagctcctacacttttcctgcggacgtcacggtcgaatccttgagcgagttcaatatcggctttcgcttcgacattgcaaacgatacattgggttacctcgtgcagccccatgatacgttttccgttacgctgccggatgcgctgcccttatcccccgatatcgcctctggccagtgctatatgggttctgtcgccattgctgacttcctggtcgatcacacggcaaatactatcacctttaccttcacacaggagattgacggcgtagataccttcgggggcggctgcacgtttgaactggaccttgaccaaggtaagctgaattcctccggtgcgactaatattgatatcgacctgcaaaatacgggaacgcccgatgcagttattaccttccccggccgtaccgttccgagcggcattgcaaagaccggtacatacgaccccaaaaccggacagatcacgtgggagatcacgatcggaacaactgccaaaaacgtcgaccttgacggctacacgctcaccgatgcgcccccatccggcctgatccttgtttccgcagggatcaaaaaaggggacgcgctcgccccgatccccgattttgccaccaacggctataccttttccgcgggcgacaagaccccgcaaagcctgaccgtggtgacgcaggtaatcgacagcgttttcacctccaatgcaggtgcaaacattaccaacgaggcagtccttacgcacggaacggacacagaacccgcgtcgggtgcttggaagggcacggatactgtgagcgtgcctgctactgatattgggaaaacagggacgcaggtcgacgccaacaccatacgctgggagatcaagctcaataccggaacaccggcgaacgtccttgctgacgcggtcgtgaccgaccaactttccaccgacctgaaattcgtcgagggcagcgtgaaattgaacaacaagaacctttccgctttcgcggccgagggcgcggatgcggtatgcgacgccggaaacctgctgaccataaccatgcccaagaacatcaacggttcttataccatccgctttgatacgcaggtggaaaacggcaagctgcccggcacggaccccaaggtacagaacaaggcggaaatgacgtggacggttccctttgcggacggcggaaacggcaaaacggccacctatggcacgccgcagatcgaaacaaacttcaactccgtatttttgaataagtcctccccaacgtttgacagcgcgaccggccgcatcacgtggcgcatcgacccttccgtgcgcatggattcctatgcgcaggcagtcataacggatacggtgcagcctgaccaggaatttgtcacgggaagcgttgttgtaaaaaataacgacatcccgcttgacgcggcggcgatcgccgccatcttttcgatcgacgctgccgcgcgcgatatgaccttcaccttttcagacgatccgtcgaaggccaattatgcggcggacctcgacaaaatcgtcgtggaataccagacaaaggcgcttccctattttacggaaaacaacgtatcgcaccaatataaaaacagcgcccacctcgacgtagacgctacttattcggacgattccaacgcctcgcgctatatcaaaaacgaaatgcttaaaaaggacgcggcctatacgttcaacgaagcggaaaacgaagggtatatgcattataccgccaaaatcaacgcttccaagaccgcgctcacgaacgccgtcctgacggacgacatcggcgcaatgctgacaacggtcaccgatttttccggcaacgtattaaacggactgcccgcgcccgattggcagctcgaccttgataaatcctatctggacgatgcgcccaatacgcttgcctcgcttgtttccggcgggtctgtttcctatcaaaacaaactgctttccataaaccttggcagcaccggcgacgagcatgcgctgcatctgtttgtgcgtcttgcaaacaaggacgattttttccgtgaaaaccttaagatctccgcgcaaaacaatatatccattgcggcggacgagctttccggcggcagcgccgccttttccgtttcttcgcccgtgacggcggcaaacacgatcgaaaacaaattgtctgtcaaaagttcctccccgtgcgtggtcttggacagcggttcttacatcgaatggaaggcggatatcaaccccaacggaacgacgctcagtgcgcccgtagtgatggataccctgcccaaaggactggaattcgacagcggctccgtcgccctgtttcgcagcacacacgatacaagcggacatttggacacggcgggcagtcctgtggaagcttctcttttcaaggccgcggtcaaggataataagttaaccgttacgctgccgcaggacggcgattcgtatacgctcgtataccgtacctatatcgtcagcgaaatagcaggcggtaacgccaaaaacgatatcgccctttacgataacgatacgcaactcgatgcttcctccgcctcggaaggcataagcaacagcgcatggggatatctcacgcgcacgacagcatgcgtcatcgaaaaaacggacgcggatgcacttggcttaagcgcggtctccggcgcaaaatatggaattttcaccacgcccgacgcggacggcacgccttttaaaacaggcgttaccgatgcggacggcaaaatcattttccgcggtctcaccttcgatgcgcagtactatgtaaaggaaatggacgcgtccgagggctatacgctcgatccggctgtctatccataccgctccaagatgcccgcaaacaaggtagcggacatcccgcccctttccgtcgcagaaaagcgcgtgtctgcggacgtgacggtacaaaaaactgacgcgctcacctccggccttttcctgccgggcgtgacctttgaactggcgcgtacctttgacggggcagagccggacggcgttcccgttgggctcacaccggatcacggcaaatatgaatatacaggtgcggacagtgcgcaggacgctacgtccgcgactacggcagaagacgggcacatcacttttgcgtcgctgccccgcgatacgtatatcctgaccgaaacgaagcccctgcccgattaccttccgccggacgatccgcatttccggttcgaggtcggcatgggcggctccgtattgtttgatacggcttccggcatttccgtgggcggcacgatcgtcaacacgcacaaagagcctcccgctacgccttcccccggtcctcaaccatccccgacgacgcctgtaagcacgccgccgccaaatgcgacggggggcacaacgcctccggaaagcggctccggcagccggcaatcccatgcggcaaagacgggcgatccttccgatccggtattgtggatcattatcgcgtgcggcgcggcggcctgtgccgttaccgtccccgttatcttgaaaaagaagcggcaatagcgtaatgttaaaaggccacagcaccggttaggtgcagtggccttttttgatatattgatgacgcgcccactcactcgatcgacttcattgactccaccatgtcgatctttttgagcttgaaatgcagcacaaaattcacaataaacgcaaaggcaagcgtcagcagccccgcgtacaggaaggccgtccatgggatctccggcgcaaacatgacgatgtccacctccgccgtgctgacgacgaatttctctaagaatacgcccagcacaagcccgaccagcatgccgatcacagcggatatcgtgttttcacggtaaatatacgcggatacctctccgtcgtagaacccgagcaccttgatggtcgcaagctcgcgcatacgctccgtcacgttgatgttgacaaggttatacatgacgatgaacgccagcatacccgccgaaataatgatcaccagcatgatactgttcatgctgtccaccatgtccgcaaactgcgcggtcgtatcgctcgcgtacgaaagcccttgcacatggtcgtaggtgagcagcgtttcgctgagcgcggacaggtccgtgccctgctccatatccatcgcaaacatattactctgcggcttgcttccaaaaagctgcgcataataatccggcgtcatatacacgtagttcatcgcgtaattttccgtgatgccgctcacctgcgcctgcgcgctgttgccgtccgcatccgtgatcttgaaggtatcgcccaccttcagcttcagaagcttggatagtttctcgttgatgatcgcgccgtcatcactcagtgtaagcggctgtttatcttcgcgcgtacgcagcgtcacataactgccgatctcctgcggttcgtccggtacgaacgccgttgcgctcaccttcttgccgcttgcgtcaaaaacgtccaatcccttgtagtaaagcagcatttcgctcttcacgcccggcgtatccgcaacctcttgctggatcaccgtaaggtcttccgccgtcgtttcgtcgtctaaggacccgagcgcatcgtatacggatatctcgttgaactgcttatccacgattgccccgatggaatactgcaaaccaaagcccgtgagcataagcgcggtacatccggctataccgataaccgtcatcagcacgcgttttttatagcggaacaggttgcggatcgtaaccttctgcgtgaatttcaatttgctccacagccacgtccacttttcaagcagcacacgcttaccctttggcggcgccttgggacgcattagctgcgccggctgttcttgcaattccttgtagcccgccgcccatgcggaaaaccctgtgaccgcaatggaaacgatagtgcaccagaacgcgtagtcgaagtggaaaggcgtcaacccttcgggcataaaataacgcatatggtaagcgtctataaccacctttgggaacagcgtgaagccaatcgaaagcccaacgatactgccaacgatgcttgcaatgatcgcgtaccaaaggtatttcgccataatggaacggctggaatatccaagagccttcagcgtgccgatctgtatgcgctgttcctccaccatgcgcgtcatggtcgtaaggcacacgagagcggcgaccaaaataaagaacagggggaacaccgccgcgatcgcgtcaaccttttccgcgtcgtcctggtagctggaatagcccgggttgttgtcgcggtcccatacgtaccagacgggcgttttcacatccgcaagctgctgctccgcatcgtcaagctccgcctgtgcgtccgcgatcttctggtcggattccgctttgccgtcctcgtattccttccgcgcgtcgtcaagttccttttgtccgtcgtctatctctttttgcgcatcttcaagctgctgtgcgcccgacgccttctgctcatcgagctccgcctgtcctgaggcgatctgcgcggcggcagcgtcgagctgcgtcttgctgtcgtctaattgcgtttgcgccgccgcaagccggctttccgcttcaccgatcccctgcctgagctgcgcgagcccctcttttgcgggtgcgagctgcgtttccatatcatccagtgcagaggatacccctgccgtgatcccgccaagctgtccgccgatcgccgccttctgcgccgcctgcgcgccatctgacggatcgagcgtcacatagctttgcagcaaggtcttgacgctcacgccggagggcaatgtacccgccggaagcagcgcatccagcgccgaggatgcgtcgattactgccgcaacatccgcaggcaggtaagaaaggtccggaacatatgtatttgcaaatccgcttaccacgccgttcacgcccgtcacgagcgtgcgtccctggtctatttgcgcctgtcccgaggtgatctgcgtttccagctcgcccgcctgctgcttcaattgttcgatctgccgctccgccgcaggcttttgtgcgttaaacgccgccagcccatcctcgtattgcttttgcccatccgcagcagcagcgcgcgcatcgtcaagctgcgcctgcgcagcggcgatctgcgtgttgtattcagccttcttctcgtcgagcgtcgcttgtccgtcctcaagttccttctgtgcgtcgtctatctttgcccgcgcgtccgcaagctccgtttcggcctcggtttttccgtcctcgagttcctttttgccgtcgtctatcttctcctgcgcctcttttacgatctcgtcataacgcgctgtttcgcgctgctccgcgacctgttcaaacgccgtgaccgcgcttgccgcagcgtccttatacggttgctcgaacggatcgagccccgccgtatcgtccatggtcaggtatacgtccgtataaacatccagcgtgaaatcctgctccgggatcatcatgaagcaatcgatctccccgtcgccgatctgcgccttgccacggtcgaatgaaataaaagaagacgattccacgatccctacgaccgtaaattcgtccgtcttaagcgtatccaaaatatcgtcgtcctctttaccggcaagcagcttgaccgtcccgccgatctcaaagttctccggcgaattgatgttcttttccaccacgcactcgccctctttttcgggcagcctgccttctttcagcacaggcttgttgagttcgttttcatcttcgcccgatgcggaagttttgatggaaagtactttcgtaatggtatccgagcggtcgcccgaatcaacaaacgcgtccaccgaataagcgggcatcatttcgcggatgcccgaaaccccttctatcgcctttaaatcattgtcgttaaagccgtaagtggaaaccagatgaatatcagcaagagcagtatcttcataatactgcttcatcgtcagcttcatgtcgggacagctcgcctttacgccggcaaaaaagcccacgcccagcgcgacgatccctaaaattgaaaagaaacggttgcggcttttccatatttcgcgcagcgcttcttttacaagcatatgtcgtttcatccgtttaccactctatctcttccaccggcgtcggatgctcatttaagataatctccttcaccttgctgttcttcatcctgatcacgcggtcggccatcggcatgatcgcatggttatgcgtcacgaccactaccgtcatattcttttcgcggcacgtatcctgcaaaagcttgaggatcgttttccccgtttccgaatcgagcgcgcccgtaggctcgtcgcaaagcagcagcttaggatttttcgcaagcgcgcgcgcaatggagacgcgctgctgctcgccgcccgaaagctgcgccggaaaattatccagcctgtgttccagcccgacctcgcgcagcacttcctgcgcgtcgcgcgggtttgggcatatctgtgttgccaactccacattttccttggccgtcaggttttgcaccaggttataaaactggaatacaaacccgatatcgtaccgcctgtattccgtcaattggcgcgcattataagcgctcacctcgctgccgtcaacgaggagcagcccttcgtcgcatgtatccatgccgcccaaaatattgagcatggtcgttttacctgcgcccgaagaaccgacgataacgcaaaactcgcctctttctatggtaaaatcgactccgttcgacgcggtgatcgtcacctcgcccatgcagtaccgtttataaatatcctttgccgtcacaaagctttgcatatatattctcccaagggcttcttttcatacttttccatgatatcacgcctagcggcctgccgccagcataaatatcataatctattttatcataatatacctgtgtgaattgaatttgaacaattctggataattatgtatatggacgtaatttttgccagccaaacaaatacgcttcattaagagttgtcgcacggcggcggaaatgctataatgtcttgatatgaacagattactgctaggcaataccaacaacctggaacgcaaggtatacttctggaacatcgtcgggagcaccgcaaacgcgctcgcgtccgtcatactgctgttcgtggtgacgcgcgtcgcagggacgaacgacgcgggcatttttacgctcgccaattccaccgcgctcatgatgctcaccatcggtttttacgaaatgcgcgcattccaggcgacggacgtcaaaggcgtttattcgttcagcgactacctgatgtcccgttttgtaacggtcgcggtgatgatcgccgtgagttttttctttgtctttctcggcggttacacacaggaaaaagccgccgttatgatccttttatgcatttacaaagtatttgacgccttggaggacgtgttccacggcatgtatcagcaagaaggccgccttgacgttgcgggccgttcgctttcgctgcgcgtgctgctttccacggcgacattcgtgatcgtactcattgctacgcgctcccttgtcggggcgtgcatcgcggccatcattgcggctgccatcggtttcatgctctttaacctcacggtctttcggtatttctacaaaggtaaattctattggaacacaaaagcaatatttaaacttttgtgggtatgcctgcccatgtttttgggctcgttcatgctcatatacatcaacaacgcgcccaaatatgcgatcgatacatatctttccaacgactaccaggcatattttggctatctctttatgccgccgttcgtcatcaacctgttcagtacgttcattttccgcccgatggtcacgcccatggcggaagcatggaacgcgcatgaacgcggaaggctggtacgcatcatcggcaagctcctggtcgcgatcgttttccttaccgtcgcaggcgagatcgtcggttatttcttgggtattccggtgctgtcgtggttttatggcgtagaccttggcgcataccgcgccgagctgttgatccttgtgctgggcggcggatgcaacgcggtcgttacgctgatgttttacggcattaccgtgctgcgcaaacaaaaattgctcgtcgtcggatatggcgcgacgctcgccttatcgctcgttatatcgaacatccttgtgcagtcgcacggcctgatgggcgcatccgtggctttcgtcatttccatgatcgtcctcgcgctgctgttcttcatcatcttcattatctgctacaagaaggaagcgcgaaaaatggaccttgaggacgcacaaaggatacagtaaagatatttacatcgggttttgcccgtgatataataagagacgttccgttctacctgtgaccggttatggccgtcagcaacaaatcggtttttcgagccggaacggggtccccgcgaaagcccagcgcagcgggtttcgtcgggtaagaggagcaaccgcccgaaaagtgagctctgccgcatgcggcggagggaacaaacagggcgtgatgcgacgaggggcattagcgcagttggtagcgcaccacaatggcattgtgggggtcaggagttcgaatctcctatgctccaccacaacaagaaaatccaccgagctataaggcgacggtggattttttgcagttcagcggttctttttaagcaaagcgacaaaagaacttcctaatatatttgccggaaaaggggcgcatgaactataataacgttcatgcgcccctttcgttgcaaatacggcataccatggttataaaacttgaatgttaatatgcgttgcttgcagcaacgggcagttcctcatacaatagcgttaacggctgaaagaaaggatgtcatccctaatgttaaacgaaaatattaaagcaatcagaaaatcaaaaggactttcgcaggaagaacttgctatcaagctgaatgtggtgcggcaaacaatctctaaatgggagcaaggattgtcagttcctgattctgatatgttgatattcatgtcagaggcgcttgaaacacccgtaagcacattgcttggagaaactgttatcgagtcggaggttaatgatttaaatgcgatttccgaaaaactggaaatcataaacttacagctcgcacaaaggaaaaccgcgagacgaaaaacgctgcacgggctgctgatctcattgtgtgcggtcatagcaacaatttccgcggtcttaatagcattgaatagttcttacttaggttggaattataatgaccctgaaaccgccgttgtcggagtagcttttcatgcatttgaatggctgtttgtcaggttagcgccgattatcctgataggggcaatcgttggaattatcctgacacggaagaaagtataaagctgttctgttttggggggcacagttcagaccttaaaattcttatttatcagccgacacatacaagcatattgtaacaacataagttagatgatccattccccgtcaccctttcagtttaggatttaattcatgctcaactataaaagcaatcaattcttccggcgtcgggtattcgcctgtgcatggaatttgtttccaataggctctgacctgttcatcaggatcggaatatccggcaatgatcgctttttctatttctttcattgtcgcttcaacactcataccatgttgtttggcaacagcttggatcgcttgtttttccttatttctattcatagttacctcccttgcatgtgcaagaagtctgattagatttttcagagcttataaatatagtctatccagactaaactgatattgtcaagaataaagatattttctttaattcagatggtgataggagcagaatatggatagaaaagaatacggaaccatccgcattaagcttgatgagctgatcaaaaaatcaggacttagcaaaaacaaattaagccatagggcagaaatgcagcgcacgcaaattaaccattattgcaacaatgaaataacaaggctggatatcgacgttctgtcccgaatatgcacggtactgaattgtaagatcggggatctcttggagtttatccctcctcaaaaataaaaaaacaaaagcgcggcagccaaatatatggcatcgcgctttttcttttagatcgcaagcttgctttattgtgttactccattgctgtaaacgacacagtcacatctccctttcccagcgcctctgcaagaccttccgcattttctatgcgtcccagccgatagtgcaagcgctgctattcgtttcatattccccttcacccctttacgatttgtttgatcaccctcgccggtacgccgcccacaacgctgttctgcggcacgtccctgctgacgaccgcgccggcagcaactaccgcgccgtcaccgatgcttacgccgggcaggatcgttgcgttcgcgccgatccacacgtttttgccgatgcagacaggcgcaggaaccatatccgcgcgtttcttcgggtcaaggtcatggttgagcgtagcgatcaccacattatgcccgatgagcgcgccgtcgccgatggtgatgccgccctggtcctgaaacttgcaccccatgttgatgaacacgttcttccctatggaaatatttttcccgcaatccgtataaaagggcggaaacatcccgaaggtatcgtccaccggcttgccgatgatctgcgaaaagatctcccgtatctcctgcggcgtgtggcaactgccgttgagctttgcgctgagcgcgatcgcttcctgtgaaacgcggtgcatataccggtggacctgcgaccctgccttcacggtttttcccgcgttcaggtaatccaggtattcctgtaaatccatcgccgctcacctgtaggatctgcgaaggatttcaacgcagtccgcatggtccagctcgcacgggttggcgagaaacagtccgcccatcgtttcccttgcgtttgccgcaagcgtatcaaactcgccttccgcaatgccgtaatcgctcattttcaaatccgcaacgccgcaatcctcctgcaacgccgtcagcaccgtaataaaatcctccggcttatccgcctgcggcatgcccatcgcctgcgccattttaataaatcgttcgtcacaggcgtggcgttcgatgaaatatccgtagaacgcttttgagatcatgatcagccccgcgccatgcggcaggccgtgatggaatgcgctcatcgcatgctccagcgaatgctcggcggtcgtgctgcacagcgtcatggcaacgccggaaagcgtattggcaaacgccatatgctcgcgcgcgggcatatcgccgccgtcacggacagcccgcgcgagatacttgcccacattttcaatcgcggtcagcgcgtacatatcactcatgaggttcgcgccgtttgagatataacactctgtagcgtggaacagcgcgtcaaagccttggtatgccgtaaactccggcgggacggacttcataagctccggatcgatcaccgataacaccggaaacagctcgtcatagccgccaaacccaatcttctcattggtatcgtcgtttgtgattacgccccactggtcggcttccgaacctgtccccgcggtcgtcgtgatacatacgaggggaagcggtttattttgcataggcaatcccttgcccgtgccgcccgagatataatcccaaacatcgcccgggtttaccgtcataaaggctatcgccttggctgcgtccattacgctgccgccgcccagcgcaacaataaaatcacattcgttttgcttagcgacgtccgcccccttcattacggtcgatttcagggggttggcctgcacctcgctgaataatacaggctctatccccgccttcaaaaattcgtccgccgtctttgcaagcgcgccgtttgcttttaccgatttaccgtttgaggtcacgaccagcgcctttttgccgggcatagaatattgcgaaagctccgcaagcctgccgcttccaaatacgaaccttgtgggtacatacatatcaaaactcatttttatccactccttatcgtttcctgttttcctgtcaataccattataatttatgcgaattggaatagccaatacttataaattatgtcttaccatagttttaaagcataatagaaagatgtataatggatctatatcgcaaaggaggaagccgcatggaactgagggttttacgttattttctcgctgtggtgcgggagaaaaacatcaccgcggccgcacatgcgctgcacatgacgcagccgaccttatccaagcagttgaaagagcttgaggatgacttggggaaaaagctgtttgagcgcggaaaaagaacaatcacactgacagaagaagggctgtttttgcggcggagggcacaggaaatcgtcgacctcgcggaccagacggaagcggctctccacgccgatgatgatttgattggcggggatatttatatcggcggcggcgaaacaaaggcgatgcgctttatcgcgcaggcggcaaagcgattccatacggcatatcccggcgtgcgcttccaccttttcagcggcaacggcgaggacgtcgccgaacggctggataaggggctcatcgatcttggcgtgttcgtgggcgttaccgacctcaaaaaatacgattacttaaggttgcccgcaacggatacctgggggttgctgctccgcaaagacgatccgcttgcgcagcgcaggtcggtcacccccgcagaccttacgggcctccccctcctgtgttcccgccaggccttgatacaaaacgagctgtccggctggctgggctacaactttgacgaattgaatatcgtcgccacctacaatttgatttacaacgcttcgcttatggtggaggaaggcgtaggcagcgccctgtgtatcgacggtttgatcaatacgcccggggaaagcaatttgtgctttcgtccctttgagccgaaaatcacagccacccttgttgcagcatggaaaaagtaccaagtgttttctaaagcggcggaaaaatttctggagatacttcaaggcctgttcacgcaggaacagtaaagggcgctgcggcgcggaccgtccatttcctgtgtttttttatcccgcaggtacttgacaagcaacgcggtctgcgttaatatataacagtgttatatagcagtgttacataaggagaaaagaatttgtacgaaacagaagcgaccacgcataaaagcattctcaaggccggcaaggacgagttccttttaaagggtttccgcgccgcttccctgcgcaatatcgtaaaagaagccggcgttaccaccggcgctttttacgggtattacaaaagcaaggaagaattgttcgatgcgctggtgtccgtgccatatggcgtgctcatggaaaaattcaacgaggcgcaggataaattttccgccctcccgcctgtccagcagccggaacatatggccgatatctccggagactatatggactggatggtcgattatatctatgagcatttcgacgcgttcaagctgcttttgtgctgcgccgaagggacgcgttacgaggactttatccacgagttggtggagatcgaaatggattccacccaccgctttctttctgttttgcgcggtcttgggcacgctgtcaaaaaaatcgatccgcgcctggagcatatccttatcagcggcatgttctccggtttttttgaaatcgtgatccacgatatgccgcaggagcaggcgcacgggtatgtgaaagaactgcgtgcgttttataccgcaggatggcaaaaaatcatgggtctttaaacccttttatttttaatctcgagttagctttcgctaactcaaacaaaggaggaatctgacttgaaaaaacaatcgaacctatcacgactcatgggttacgccggcaggtataggtatttcacttatacatcctggatactttcagcagcaagcgcaatccttgccctgatccccttctggtatatttggaacatcatacgagaggtgcttgaggccgctcctgatttcagcagcgcgcaggggcttgcctacaacggatggatggcggtgctgttcgccgtcctgtccgtgctcgtctatatctccggcctgatgtgctcgcatgtttctgccttccgcgttgctaccaacattcgcagccaggcgatgcaccacatcgtaaagcttcccctgggagccgccgaaaaaatcgggagcggcaagctgcgcaagacggtcaacgaatccagcgcggcgaccgaaacttaccttgcgcaccagcttccggacaaggcaggcgcgatcgcaaccccctgcgggctgctcgtgctgctgctcgcctttgactggcggctgggccttttaagcctgatccccgtagcgctggcctttttgatcatgacgcgtatggcaggcgcgaagatgcagcaaaaaatgaaggaataccaggacgcgctggacgatatggcgggcgaggccgtggaatatgtgcgcggcatccccgtagtcaagacctttggacagaccgtgttttccttcaaaaaattcaaggattccatcgaccgctacggcgtgtgggtcatttcctataccaagcaactgcgtacgcccatgatgctgtatacggtggccatcaacagcgtatttgtgttcctcatcgcggcggccctcgcttttacgcaaaacggcgtgacggacggtttccttttgaacctcattttttatatcatcatcacgcccgtgatctccttgacgctcactaagatcatgttccagagcgaaaacgcgatgatcgtagacgacgcgctgaaacggatcgacagcgtgctcgacctgccgccccttccggaagcggcaaagcccgaatcccccaaggacagctccatcgttttggaaaaggtcagcttcagctatgatggacaaaaagacgcgctgaaggacatttccctttcgatcgatccgggacaaacgatcgcccttgtcgggccgtccggcggcggtaagacgacgctcgccaatattattgcccgctttttcgacccgcaaagcgggcgtgtcctcatcggcggagcggacatccgctctattcctaaaaaagaactgatggacaccgtttcctttgtgttccaggacagcaaactcattaaggcttccatccttgaaaacgtccgcatgggtaagccggatgcaagccgtgaagaggtcatgcgcgcgcttgaggccgcgcaatgtatggatatcatagaaaaactgcccaacggcatagatacggtgatcggcgcaaaaggcatctatctttccggcggcgagcagcagcgtatcgctatcgcgcgcgttctcctgaaagacacgcctgtcgtcatcctcgacgaggccacggcttttgcggaccccgacaacgaaacgcgcgtacagaaagccttcaacgagctttcccgcggcaaaaccgtcatcatgatcgcgcaccgtctttccacagtagtaaacgccgaccgtatcttcgtcctgaaggacggacaaatagccgaatccggcgactgccgcagcctgatggcagcgcacggcatattcagcaggatgtgggaagattaccagacttccgtacaatggaaggtcgcaaaggagggttaaccgatgatcaaaaaattacaaaaaaaatacgctttatcgcagcagggcgcgaaagaccttatcaaaggctgcattgcgtgtaccctgcaaaatatatcctttatgtttccggttggtttgctgtatttccttgtaaacgaccttctctccggcggcgtgggcgaaggcggcgcggtattttatatcgttggctgtgccgcgtgcatcgtcctgatcctgctcgccacatggttccagtacaacgccacctattttgccacttatacggaaagcggcgtacggcgcatttcccttgcggaaaagctgcgcaagataccgttgtcctttttcggcaaaaaagaccttgcggacctcacgagcaccatcatggcggactgtacgtttttggagcagagcttttcccacttcatccctgagttgttcggcgcgatcgcgtccacggcgctcatcgccgtcggcctgttcatcttcgactggcgcatggcgctggccgcgctgtgggtccttcccgtttcctttgccatcgtcgccctgtccgcaaaggcgcaggaaaagctgaaccggaaatccatggacgcaaaaatggcctgcgccgacggcatccaggaatgtatcgaggccatgcgcgatctaaagtcgtgcaatgcggaggctacttatcttgcggggcttgaccaaaaaatcaaagcggtggaaaaacgttccgtcatcagcgagttcggcacggccgcgtttgtggtatccgcatccctgatcctcaagctgggcatcgccacggtggcgctggtcggttccatgctgcttttaggcggtacgctcagcatacttgccttcttcatgttcctgctggtggtatcgcggatctacgacccgctccagagcgccttgcagaaccttgccgcagtcatcagcatgcgtaccaacatcgcccgtatgaacgagatactggaccatcccctgcaaacagggctggatacgctttccaacaagggatatgatatctcctttgagcatgttggttttgcctacaacacgggggaaacggtgctccgcgacgtgacttttaccgccaaacagggcgaggtcacggcattggtcgggccgtccggcggcggtaaaacaacggtatcccgcctcgcttcccgcttctgggacttaagctccggcaagatcaccgtaggcggcatggacatctccacaatcgatcctgaaacactgctttcgctctattccatcgtttttcaggatgtgacccttttcgacaacacgatcatggaaaatatccggatcgggcgcaaggacgcctcggacgaggaggtgcttgcggcggcgcggctcgcgaactgcgccgaatttgccgaaaaacttcccgaccggtggaatacgttcatcggcgagaatggctgcgagctttcgggcggcgaacgccagcgcgtttccattgcccgcgctttcctgaaaaacgctcccatcatcctgctggacgaggcgacggcttcgctcgacgtggagaacgaaacgctcatccagtcggcgctttcccgcctgatccgcgataagacggtgctgatcatcgcgcaccgcatgcgcacggtcgcaggtgcggataagatcgtcgtcctctcggacggctgcgtgcaggaggaaggcgcgccggataagctgcttcgcggaaacgggctttatgcccatatggccttgttacaggcggaaagccacgactgggcgttgggcgatcactaaaaacagtaccatgctttgtacggggccaaaccggtcccgtacttttttatttgggcagatacaattttgatgcttccatgatacagtttgtatgcggcgggcgcgtatacttccttttaaatacatgcttcacagaaaggaacttccatgaaaaaacgaatatccatgctccttgcaatccttttattatgcttccttatgggctgcggcgctgccacaggcgagcctgcctccccttctcccacgccttccgcgccggatgccgccgccccgcccacccttccttcggcggcgcccacggcggacgccccgtctgtcacaacgatcacggacaaccttgccggcaagacgctcaaccggttcaagctggacgttacgctggatacggaagcccataccctggaagtgtcgcagctcctttcctactgcaacaacaccggcacggcactggacgaaatctatttcaacctgatccccggcgcattcggcgaagacggcggcgggatcgacgtacattccgtaaaagccgcagaaaaggagctttccctcgaacaggaaaagcagacggtataccgcttagcgctttcgtccccgcttgcgccggaggaaatattgcctttgcagatggactataccgtgcgcatccctgaaatccaaaaccgcttcggttaccaggaaaacgtatataatttaggcaattttatcatcacgccagcagtttatgacgcggacggctgggcagtccagccatatacgatcatcggcgacgcattttacacggatatcgcggattacgatgttaccgtccatgcgccggacggttatacggtcgctgcaacgggccggaaggaagcggatggcagcttccatgcggaaaaggtacgtgattttgccttttgcgcaagcgacggatacagtacgcttacggatacggcagacggcgtggatgtcacagtctattatggcgacgatatgaaaaagaccgccgtccgcatgctcgagacatccaaaaaagcgctgtccttatacagcgaactgttcggcgcttatccatacgacacgctgtccgttgtggcaagcgggcttaccggcggcgtaagcggtatggagtaccctacgctcatcatggtcaggaccgacgtaacgctggacaatatggaagaaatgggcatcgatcccacaaacatggaggaagtaaaccgctatgtgatgctcatcgaccggacggtaacccacgagatcgcccaccagtggttttacggcattgtgggaaacgaccaggtcaggtatccatggctggacgagggcatgtgccgttttgccgaatgcctgtatgaacaggcgtatccgccgccgcagcccaacgccgatatcccccttgaagaggagtttaaatttatgcacgaagatttggcggataagacgtacgtcgatacgacggacctcaatacttccctttacggttggatgaaggaggacccgataggctacagcggcatttatgtgaagggggcgagcctgctttaccaaatgatggagcagatgggtaaaggcgcgttccaaaaggccctgcgcgaatatgtggatacctttgcctacggcttcgccacctctgaaagctttgtgcggttctggaacggcaaagatgatttttccgcgctgtttgaatcctattttgccgaaacacagtctcccgaatgacccacacaaacaaaagcccgcttttagggcggctgtgacaaagaactatgaattacggtcgataaaatatacagtgctgaagcatactcagcctgtatatttttattttgtcgttaatagatgagcactgcccgacccgccctgacactccttttataactacaaggcagattatcaattatcgccacgccagcgggtttaatatatttttggttaaagtgctcctttgcctcggcagagaaatagtcatcatccaagatgatataccgaacaccagaggtcaagcctagctgttgcgtataaagacttgccttaaacattgtgttcgtctgcacgaacgaatcaaaggcattaagcatttttgctatagtgccattcggattttcggaaaatcccacaccgtctacatttccaatcaaataaacgggtttgtcggaatggccttcattgtacttatcgattcgttcccttatttcgacagtctcgtcagatttattcacgccatactggccgggatcagaagtatggataagcgattgcaccaatgcgcggatatcaccatcggtatcctgaatgatcagatcaaagctatggattcctacggctgcggcttcatgggatacgatttccattgttgcaagattgacattcggatccttttgggccatagggttcagatgcttatccgcgggataaagggctgcgcccgcatcgtgaaaactctgcgcggccaactgttccgcaccgtgtccccggtacttagcttgtttttgctgaatttctttgggggcaattaggttattgaaaatttcttttaccaagtcctccgacaaggataaaaaaacatttagtatccgttccagatcattcgcaataaagtattcagaaattatctttgcccattcctctttttcccgcccggacaatctcccaataaaccattttgtatcatgcttaatcaaattttcgcgtttttccaaaaccaatctttttccggcgcttgttgtggaaatatgcgcaagatatgtcagatccaaataaaaacgcttgttagagatcccaagcaaaaggcgaatatcatttataaacctcgggttatgtaacaacactccccgtatggatttcgcaaagtttttttgaatgttgtttcggcagtgattgataaaagcaatcaaatcagttacaacgctatcgttaagcgtttctcctctgtaaagcgggatatccttctgtggcgccacgcaataccaaaattcttgcaatttatccatgtttgttctcctatggcgtattcgcaaacaattacttgcatccaagatgaaactattgtaatatagtttttgttacatgtacagtattttttcttttgcacattggaggttttatatgtacgatcttcattccatacacgcgcaactgcaagataagaagtcgttgattttcggaacagaacagaagataatccgttgtctttattataagttggaatatctacaaagcaagggcgacccattgttttccatgtggcaaaacgagcttgagtttacccatggaaaccttagtgaacttctctctcaaaattcaaaaatccatcctgatgaattatgtacgctgtatggatttgaacctacaaaggaattaaacttattgcggctcctgaaaagtattcagaccttttatagcgtcttgattaagcttatcacttttaatatggtccaagggcagggttccgcttccacaatgaagcatgataccaatggtgatgcaatgaaagccattttatcaggacaagcgtttattgatctaggtataagcaactattgctatgacgactggttttcttggattttgaaatactgggattctgatatcgaggagcaatgttgcaaactttggacatgtttagatgcggaaaatacaataatttcaatcaaaggttttattcaaaacttccgttcagacagtttaaaacatatttatgaaactgttattccgaaggaaattcgtcacgcgctcggtgaatactacactccagactggctggcaacatgtacgattaaaaacgcgttaaatgcaagcggacaaaaagttgcagaccttcgctttatagacccaacttgcggcgccgggacttttttaacaagagtaatgcggatgatccaagccgaatcaatgaatggccttgtgcagccgtcaatgattgccggttttgatattaactctcttgccgttctcacggcaaaggctaattatttagcaacaatgatagatcagcttagctcctactctaactttgttattcccatataccattacgatatcatcaatacacctgcaaggaaagcggacaaattaatcgttgacaccaattgcgatttgatttgtgaaattcccttttccgtttgcgaaaaagcaactcaaaagagccgccgtttttgcgcggatgaatttttacaattgctataccaggatgaagaatgcgccgctttatgcaaaaccctttcggcgtacgattctatcaatctaaaaataatcgccaacatcctgcttaatagaattttggcattttacgaaaaaaaggcggatattgtcgtcggaaatcccccatgggtaaattgggaatatctcccgcaaaaatataagtccaaatcccagcatctttggcctgaatacggattgtttaatgccaaaggccgtgacttaagtttttccaaagaagatatttctatattaattacatacgttgttattgatcgcttccttaaggaaaacggatatcttagttttattttgcgccaggcaatgttcaagtctgcacaaaacggcgttggatttcggcgtttcaaattagaaaaaggcaatactgaattcagagtattacaggtggatgatttgtgtggagtcaaaccatttgagggaatccatagtcgaagcgcgcttgttctcataaagaaaaacgagaaacaaacatttccggtaccgtataattgctggaccagaagaaagcttttcctgaaagctaccagggaatcggacgcaactgccgattcgatcatggcgtttgttgatattgaaaaaatgatcgcatttcccgctgacaaaaatgatccgtcttccatctggataaactcgcctgaaaagattgtttcggtaatgaacattcttttaggaagcaacccatataaagcgagaacaggcgttttcaccggtggggcaaacgctgtttattggatgaaggtgtcagaaggaaacggggaaacaataaaaatcagcaatatagtggatcgagctaagcgaaaagtgaaagctacaaccacagaaatcgaatccgcatttgtatatcctttggttcaaggcagtgacatatcccaatggaacgttactactaaatcttacattttgtgcccacatacccctgagacaaaaatgtatcctgtagaggagagcgttttaaaaactatcgcgcctaaaacatttgattatttagcgggttttaaggatgatttagacgcgcgtaaaggttttgccggatgggaaaaagagattcaggcccaacacttttattcgattttgagaattggcgagtataccttctcaaaatataaagtggcctggcggtatattgcgcagtcttttattacggctgtcattacctcagcgcaagattgcttcgttggtgaaaaactatatattccaaatgaaaaaataatgtatgttggaactgattgcaggaacgaagctttttatctttgcgggattttaagttcttcgcccgtaagttattgtgttaaatgttacatgaatccaaccagtatttcggcccatgttcttaacaagcttaatatcccacaatatgatcctaataacattcttcaccaaaaaatagccggcatttgcgagaaagggcatcatacaaaagatgataccctgagagttacacttcagtctgatttggatgcggcaatcggggaattgtataatataccaactgagtctataaaagtaattcagaacgcggaaactgccctgcgggagaaaatgacaaattagcggggctttttgttttggcgtcgttgtgctaaaatggagcgggggggaaaaagacatcggaggaaactcaatgatcggactgatcgatggcggaggcgggatgcgcggcgtttacacctccggtatttacgactacatgctggacgcgggtatcgagatggattacggtatcggcgtttccgcaggcgcggcaaacatgattacctaccttgcaaagcagaaaaaacgtacgctcaagttttttgcggaatacacgttccgcaaagagtatatgggtatcggcaactggctgaaatcgggcaattatttaaacctcgactatatttatacgacccttacggtacgcggcggcgaatacccgctcgattacgaaaccttcgcgcggggcacatccccgttttttatcgtggctacacaggcacatacgggagaagcggaatacttcacacgccgcgatctcgcgcaggacagctacgacgtattgaaggcttcgtgcgcgatccctgcggcatgcaagccgtatcctgtaaacggcaagctgtatttcgacggcggggtctccgaccctattccctacaaaaaagccctcgcggacggatgtgacaggctcatcgtccttgtcacgcgtcccttggattatatcaagcccaaacaaaaaaacatgtggctcttaaagcgctccctacgcaaatacccgaagattctccacgggctgcagcaccgccacgaggtatacaaccagtccatctccgaattgaaagagctggcggcgctgggcaaggtactgcttgtcgcaccggacgactgctgcggtgtaagtacgctcaccaaggataaggatgcgtttttgcggctgtaccaaaaggggtacgcagacggaaggcggatcacggaatttttgaataaaaaggatacataaaaatgaagatcgcggttataaacggcacggaagtcaagggctgcacttaccacatgaaggaaacgtttttggacgccatgcgtgacggcaacgagatcacggaattttacctgcccagggacatgccccacttctgctgcggttgcaaaacgtgttttttgaaacgcgagcagctttgcccgcatgcgccgtacgttatggccatttggaaagccatattgtcctgcgaccttctcgtgttaacctcgccggtgtacgcgctgcgtgcgacgggacaaatgaaggccctgcttgaccacctgtgcgtacactggatggttcaccgtccggaggaaaagatgttttcaaagcacgccgtgatcctcaccaacgctatcggcgtattcaacggcggcgcgcagaacgaaatcgctaccagcctgacgtggctgggcatatccgatatcaggaaactcggcgtggggcttttggaaggcgttttctgggatgagctttcggacaaacggcgcaacgccatcgtttccaagatcgaaaagcacgcgaaacggtatacacctcccctaaagcccgcgcgcaaagagccgaaggtttcgctcctgtttgccatcaccaaagcaatgcaccaaggcatcgccaaaaaggaagacccgctttcggcagataaccggcactggctcagcaaaggctggatcaggctgtaaaccgcaaacaaaaaccggcatgcggtatgccggtttttttattggaataaattcagaataccagcccgatatacggcgcgaccgcgatcagcgccgtcgataacacaagcaagggcacgccgtatttgatcacgaagcgcagcatagctccttgttttcctgtttttaccaacgcctgcgcgaggcgcacgatcgctttcttcatgttatatgcccctcccgtgtttgaaattttcccctgaataccgtaataaagtatatataccctgcttttttcattaaaaacaccatctaagcgcctatcctgcatagaaaacgcgcttacattttttgtatctttgtggtatactgtatttataaacaatgacgcgcagtcaaaaagacgtaagtcctgtcgttttgtatgtgcgttctttttttaccatgaaaaacaggagtgattaaaatgttccagaaagatgattatgtgatgcatgagtctgcaggcgtatgccgtattgccggtgtggaagagcgtgatttcatgcagggtgaaaaaaagcagtattatattttgaagcccttgcactctccctgcgacagtatattcgttcctgtggacggccatatcaaaatgcgcaatatcctgacccgcgaacaggcaaacgaactgatcgaaaagattccggagatcgaggccgactggctggacgacgatacggcgcgtgagcaaagctataaggacgctttccgctccttcgactgctacgaatgggtcaagatcgtcaaaagcctgtacctgcgcatttcggagcgcaagcaggatggcaggaagcctcttttgatggacgaaaaatacctcggacttgcggaagaatacctgcatggcgagctttccgtcgcccttgacattcccgtgaataagatcggttcgtatattgcgcgccgtatccgcgaatcggaaatggaatggtaaaaaacctcctccggtggtacaatggataaaaaatgttccccggagggattttttatatgaaaacttttttcaaaggctttttgagcggcatgcttgcactcgcggtgatcctcgtgtgcgtgaccgcttttgacgattcttatacagtctcgagcaacgccgccttataccctgtcttttccaaaatgcaggatatccaaaaacttttagacgataaattttattttgagcaggacgcgcaggacgtcgcggacggcgcatacaccggcatggtctttggccttggcgatgaatattcctattaccttaatccctatgagtaccaacagtacctgcgttccttgcagggtaattatatcggcatcggcgcgacggtcagccaagaccctgaaacgcttgcgaccacggtcgtcagcgtagatcccgacggtcccgccgcaaaagcgggcatgcagaaaaacgatatcatcgtcgcggtggacggcacggacgttacgcagctatcccttgattccctcatatacgactatgtgatgggcgaggaagatacgcagctcacagtgacggtgctgcgcggcgaagagcggatcgacctgcccatgacccgtaaaaacatcgtcgaacaaacggtatttcaccgcatgcttgacgacacgaccggctatttgcaggtcacctcttttgaggacgagaccgtggctcagtttatcgcggccatcgaggatatgcaaagccagggcatgcaaagcatcgtttacgacttgcgcggcaacggcggcggcgcgctcaacgcagtggtgggcatgctcgattacgtgctgcccgacggcctccttgtttacaccgaggataaaaacggcaaccgcctcgacacacgcgagggcagcgacgggcacgaggtagacatccccgccgtgattttggtggacgagaacagcgccagcgcttccgaggtcttttccagcgcaatgcgcgattacgcgcgcgcctcgctcgtcgggacgcaaacgttcggcaagggcatcgtgcagcagacttacagcttgggcgacggcagcgcggtaaagctgaccgtgtccgcttatttcaccaagagcggcacgcccatccagggtgtcggcctcacgccggacgtggaggtctcaatggaggacggcgagcccaaggaccccgcgcaggagcttgcccccgagcgcgacgcacagcttgcagccgcccttgagttgctgcacggcgagtaacattcccgccgtgttaaaataatacctgacccatataattttatagtgttttcgccttacttatgataaaatgtagggatggccgcaacgctggtttgatgcgatccggcaattccaaaagcggccgtgaaggaagcctggtccaatggtctggaacatcaccgcagagtgtctttcagcgatcatcctgtgtatcctgtgggtctattcgcgcaagggtaatactttgcctaccctcaaaaacacattgttccaaatctgcttcctcgtcacgttcatcgccatttcatccaacatcgtttcgaccttcctgatctataattatacgaccgtgccgctctttttgaactggctcgcggcgatggtctactttatcacgacaccccttatgggcgtcatgtacttctgctatacgtcgtccatcatcttcgaggatcatccgcacctgaaacgcatgctttggctcgattgcataccggcggcggtctatcttgccatggtgctgataaacccgcttaccaaatggcttttcgatattgacccgctgggcggctatacgcagggtccggcgatcgccgtaacgtatatcgtcttttatatctactgtttttcgtgcctcgtcattacgctcatctggggcaggcacctcgaccgttcgatccgcaatatactggcgtccttccccatcatcgcggggatcgtcatcgtcatacagcagttcatccccgaatatatcctgtccggcagcgcggcgacatgcgcgctgctcattatttacctttatttgcaaaacaggcagatctcgctcgaccacctgacaagccttcccaaccgccaggaatttttgaaggcgctcgagctgcggacagaccgttatcacaaccagccgtttacgctcattgtcctgtcactgaaaaacttcaagactttaaacgaccgcttcggccagcataacggaagcctgatgctgcgcgccgtcgcggaatatatccggtctgccgtccggccaaaccgcgtctaccgctacagcggcgacgaatttgccattatggtctccaaaacggaccgcgcggctgttgatactatccttgcggacctgaaccagcgcatgatacttccctgggaagcgggcacgtgcagctctctgctttcgtgcgggatcgcgatcgtgcagtatccaagcagcgcgaaaacgctggaaggcctcatagacggcatcgaatccacggtcgcgcaggctaaaaagagcgtacaccaaagctattgttattgtacgcaggaaatgatcgaccagctaaaacgccgcagccacattatcgagattttaaaggaccggctcttgcatggcagctttgaagtatattaccagccgatcatatccctggataccatgacgtttaacaaagcggaagcattgctgcgcattcctgacacgcccatcggcccgatctatccgtcggagtttatccccatcgcggaggataccggactgatcatcgacattacctaccaggtacttgccaaggtatgcgccttcgtccggcatctcctggacgaagggaaggacatcgccgccgtcagcgtcaacttctcgtccaagcaatttttgcaggacgacgtagcgcagcgcgtttttgacatcatcgaaaagagcggcgcgccgcattcgcatatcaagatcgaaatcacggaaagcgtgctcgtcgaaaattttgtcgctgtaaaaaactttttgaatgatatccacagccagggcatccgcttcgcgctcgacgatttcggcgttgggtattccaatatctccacagtgctcggctttcccatcaatacggtcaagctggacaaaagcctcgtatggtcgtccatcgagaatcccaaatcccgcgccatcgtacagcatatggtggccgctttcaaggaacttgggatcgacgtcctcgcggagggcgtggaaaacgaacagcagcgctcctttgtgcaaagctgcggctgcgatatgatccagggatttttattcgcacggcctatgccgcagggcgaagcggccgcttttctggggaaatccctcgaggaaactccccacatcagggggtttgaagtatgaaatcattttcaggtaaaaagggctttaacgctcatagaactgatcgtcgtgatcgccatcatcggcgtgctcgcggcgctgctggttcctactttttcgtcgctcacccagattcgcaaacatctgaagtcctgaagattctctgcttcatacgtaccttttgtcggcttcccgccggcatcgacagccttataactatattttgccaacgcaatataccccttgttgttccctgttttccggactattttttgtgaaaatgaaattatactatatcaaatatgaaatgttttatacattatatcattatcttttggaaaaaacaccagtattatattaaattttcttctagcaatgcgttttttggctggattccctcaaaaattcatcttttcttggctttttggagtttatattatataatatggatataatatcgacacgatatggtattcattcattgcaaacgatacttagataatgccctgtccggaacggaggtcgcttttatatggcaaagcacaaaaaaatcgttattgtctcgattgtcataattttagtgatcgcggctgtcgcgctctttttgatgcttttttattccaataccgtcaagaatactttgaacgatgaggtcacgtcttatttaaaagaagtaacgacgcaggaagcttccctgatcgagaccagggtcacgggcaacctttccacgcttgaaggcctcgccaccgcgctgagcgcccccgagttcgagaacgcggacagcgagcaggttttcagcatgctcaaaaacgtgcaggatcagaacaatttcaagcgaatgggctttattgatacggatggcagggccgtcacctcagacggcgccgtagtggatttttcttcgcgcgattatttccaccgcgccatgcagggtttgccgaatgtatccgatactcttacagatgttctcggcagcgagggtgaaccgatcaatgtatacgccgttcccatctataatgagaaccgtattgtttccgtgctgttcgcgacgcagtccacagaggaattcgaaaaggagatatccgtctccacatttggcggcagcgggtattcttatgtcgttaaccgtaacggaacaagtattgcgcgcgcgcatcatccgggcgcaatcaattttgacaatatctttacgcttgacatggataacgtagcggatgtagacgatacttttgatatcatgcaaaaagacatgcaggcgggcaaaagcggcgttgcgcaatattataaggacggcgaactttattatatgggctacacgcccatcgatgtgaatgaatggtacatcctatcgaccgtgcccgcgtctgtgatcgccgccaagagcgcttacctgatcacgctcaacggctgggtcacggccatcatcgtcgcgactgtcgtggcactcctcgtctacattgcggtctcccaaagccgcgcgcgcagaaaactcgaaaggatcgcttttaccgacgaagtgaccggatcgctttcctgggtcaaattccgcgaggactgcaaggatatcctaagcaagcaccccgaggaaaattttgcgtttatcaattttgacatcaacaaattcaagatattcaaccagctttatgattacgataacggaaacctgctgcttcgccacatcgccgatgttctgaaaagggacatgcgcgaaaacgagctgtattcgcacacgggttcggacgaattcaacgtctgcatcacgtatttttcacagggcgatatcatcgggcgtatcctgaaatggaaccaggagatccgcgaataccaatttgcgaaaaagcgcaactataacctgcttctttcctatggcatcttccccgtcccgcctggcgatacgtatatcacgcgcatgagcgaccgcagcaagatcgccaaaaacagcatcaagagcaattcgcatgtgttctatgcgttttataatgaaaagatgaacgccgacatgctgcgcgaaaagcagcttgaaaacgatatggacgcggcgcttgaagacagcgagttcatcatatactaccagccaaaattcgacctcaaaacagaacagcctatcgccgcagaagcgctggtacgctggctgtcgccgcagagcggttttatgaaccccggcatattcattcctgtgtttgagaaaaacggctttatcatcaaactggatatgtacgtatttgagcatgtctgctccatgctgcggcagtggatggacgaggggcggcctgttgtgcctgtctccgtcaacttttcgcgcctcaacatataccgcagcgatttcgtggagcagcttcttcagatcatccaaaagtacgatatctccaccgaccttttggagatcgaactcacggaaagcgcgctcgtatacaatgatgaactgatccttgcgcgcatgcacgaattaaaggatgcgggctttaagatcacgatcgacgattttggcacgggatattcttccctgaaccttctgcgtacgctgcccgtggacgtgatcaagctggacaaacgcttcttcacgcagcgttttgacaacgaccgcgagaagatcgttatttcgagtatcgaagatatggcgcagaagctggagatcaccgttgttgccgagggcgtggaaacgactgcgcaagcggatttcctcaaaaaagtcggcgacgatatcatcgtgcagggctttttatatgcgcggcctatgcctgaggatgaatttgccgcgttgctcaagcgcatcggaaacggccgtgaaggcggagaatcgccctccgaaacaccggaagacgagctttgatccgcttttctttttcatgcacatttgctattagaagaagttttcgctgcgagagcttcttttttcatgcattctatcgctttttatgctataatagtatagaatcgtgaggtatttatgaaaatcattttgtcagacggaagcgcgatccagatcgcggtcagcaaaaaaacaatgaaaaatatcaggctgcgcgtatgccgcgacggcagggtgtgtgtaagcgcaccttacggtaccgcagagtcccgtatctatgaatttgtaaattcgaaaaaaggctggatagaaagccatatccgcaatttccagaaagccgagaatactgataccatgcagtatttaggcgctgaatacgcgttcgaggtcgttaaggaccgccgcacgggcgtcgccttgaacggtaacaatatcacgattttttgtaccaatccggagcaatataaagaagtcatggacgcctggtggaaacagcaggctcttgaaacgttcaatacttttgtggataagtggtatcccgtcgtatgcgcggatgatgaccgcaggccgctcgtgaaggtacgcaagatgcagaccctttggggaagctgtaccagcagcgaacgcaccatccggctcaattattatttgctgtgcgcttctgccgaatgcatcgaatatgtggtgctgcacgagctgatccacctgatccatccaaaccatggcgagcagttccgcgctttcctcaacaagaacatgccggactggaaggaacgcaagacaaaactggaacaggaatgttccgggctgcgcatggcctaggcgcttcctttttttgtatgtttttgcttgacatctttatgaaaaatctatataataattcttgcgcgttacggacgcggcaggacgcgggcgtggcggaattggcagacgcgctagacttaggatctagtgccttaggcgtgaaggttcgagtcctttcgcccgcaccatatatcaaaataaagttttgcgggagtggctcagtggtagagcgtcgccttgccaaggcgaatgtcgcgagtt

SEQ ID NO: 18 - DNA, 52152 bp, Christensenella sp.
atatactaaagattttaaaataatttacgatataatatgtattgttatatattcctattattattgtttcttattattacttcgttaggattatataaataataccgctcgcagagaatcaacacctgaaatatcgtttgattgttcgggatttgcctcgtgggtactgaagcattccggcgtatacagtacgcccaatacggttacgcatgttgcgtcctatgtcgatatcttacattgtggaaagccaattggctacagcagtatcgacacaccatgttggactgggcgcctttatgcttttggacggctgtgagcaaggggatgagggcatgcgataaaagttacaacctatgcagcccaaatatatcagtactgcatgaagttaatcaatgaaatgacaaaagcggacctgctggaaacaaaacaaggctgtaaaggctgatgccacgtaaagaaagccccggggagtgtgtcgatatttgatgtaatcagcatctttgaaggggcgaaaaatccggttgctaaagaaaaaaatccatgaagcgtgatccattcaagttgtatatggatgaattttttgccggtgaaagggaacgcttgaaaaagacgccgttagtagcaatataccaggagtaggttatggagggaaaaatcgcagaaatacaaaaaatgaaatcgccctgcgatttattgcagttgacggcaaccttgcccgtccatatacaagagcattgcaacagggtagggaaatatacaaaggagctgtggatatatttatatggtggaaacggcggcagtgaagcggaaattgccgcacggttccatgatattggcaaagtatatatcccacacagcttattgaataaaccggatatcctggatgaaagcgaatacgggattataaaaaagcacgtggaatatgcttccaggatatttgcgccggataaggttttgaaatatgcaggattaatattgacggatgaagcaaaagcattgatgcgggaaacggcctgttcacaccacgagcggtgggatgggagcgggtatccgaacgggctggaggaaacggatattccactcagtgccaggatttgcgccgtgctggacgcatacgacgcgatgacggcagggcgcgtttataaaagcagtatatccgcgaaagatgcgtgcagggaactgcttaggaatgcggggagccagtttgacccggagatcgtcacagagttcgttggatatatcaatgctataccaggttgaagaagtctttaatgcatggaacaaacaatggttgaggagggatattgtgttaaagatacaggcaagcctggaatatgcattgcagatgctgcactacatgggtcagcgcgaaagagagctcgtccaggcaaacaaaatggcgcaggatatgaaggcatcctatttatatatgatgaaaatactggcaaagatgagagaagcaaagctggtggaatttgtccaggggcgccacggcggataccgcctcacaaaaccaataagggaagtatctgttttggaggtgtactgtgcggtggagggagaatttatactgcgccagtcagaggatgaagctattgggatatattttgccggaatagagacatggattacagatacgatgaaaaaaacgaagctggttgtatcagaacagggctgctacggcggctaccgcttgggaaaaagggtggaagatatatccatctatgatattgtttgcgcaatatagggagagatcagcatttattcgattgaccggcctcgggaagagcaggccagccgtatcatgttgtctacggcagactatttcgatagattgaaaaacaagatgaaaaatgcactgaaaagtatgaacctgattgagtactgtgagaagtatatcgatagcctttgaatatgggcagggaataagaaattataaaagtgtcaagtcatgagatcgctggcaacaaattgttctaatggattatttggtcggtcattctggaggcgaaaatatgataagaaagcaggttcagattcttaaaaatggtgccaggctgacctgaaatttgggattggaaggaactccaatcgaatacgcgaagaaaaatatgagtataggttaaatttccctttaaaggtcgctcccagcggccttttttaatgactatgatgacaaattgtgcttcacctggaatacgagagaaatcaaagatggttttctctgcgggtgtagatcgccgccaccttagtcaaggagttgattggaatctcgacaagcataaggagacgttttatgaaaatgaatcttagggatttttatcccatctattgctaagatgtggaagaaataatgaaatgatgcgcatgggacaaagccaaagagaatattaaagagataaaaacaaatatgcaggcgcattaagccagatggtatcttaaggcggcaaaccgggaagcgctggttgccgcctcaagattttttagtatgacaattttgctcgtggaaacctaccgatttatgagagagtgatctttttaataagttcactcgtttcggtttcatagtaagcagaacctgtatgcatttgtcgcgatcggccaggtttggacaactatacaagacaacaggcacatgaagaaataagcaggatattcagggaagtttttccaaaatacggtatggccgtaagggaaggacaggttgaactttcccacatgatattggacaatgctggataaaaggatcgcattgtgcgacgcaggagcaggaatcggaaaaacctatgcttaccttgtagccgatataatatataagaggtataagagcagcaaggcattattgatgctgtaaaatgaaattaacatggatcagataccgcatttatccaaatatgatcgccgccaggtatgcgtgccggatacttgcaattgcaaaataattttatgcaggtataagcgatttgtgaaggacagtatgcatccacggtgttttttccaaatatgaaatcacaatttttttattgcggacctgatatactggcgcaacgctatgcaggcgcttttgccggattgtactgccctaattatagatgaagcgcataaattgccggaaacggccaggcgaatgtttggaaaaacgctgccggcagggggagtgaccttgctgcaggaaagcctggcggcagaacagtttatccttgtagccgaaaaagtacaggatacgatgtgtccgtttatagaggatatccaggcactctcaaagaaggaaaatacgagatatgtaataacaaagaaacgcgccaggttagttgaaataatatataaaagtattgtgggaatcgagaacaatttgggaagtattgttagcgatcccctgaagaaccatatagaaaaggtgcgcggatttattgagctgcttcatgcaggagcttcggatcatttgctgtatttagtaagggaaaaagacgatacggccagtattgtagcggctgtgcctaatggcggcgagtatttagacaatatgctgtggacgccaaggacgccggttgtattgacgtcaggcacgatggcagtacatggggatttttcgcgattcgaatatgttgcagggcttgagaacaatgaacgtgtcaataaggcagtttccagttcgccgttccattatgggcggaattgccgtatttttaccccaaaatggaatatatccgaaaagtccccagtatcacagggaccttgccataaccataaccaagatgctccaggctgctcatggacacacattggactaaatgatgataaaattttgacgagagatcaatgcgcgtggacagaccgtaacatagcaggtattcttaaaaatgaaaagtatattggggacagtctatttcagaaaacgtatacgactgaatcgcttccttttttgcaaaggaagaataagggagaatatccgcaatactatcaatactatgtagaagcttcccgcgaagcgattatttccaaagaagagttctacaaggtgcaggatcgtctactattattttgtaaattggaacagttatttcgcacggtctcactaacgcgcaagacaagaacattattaactcattcgagaattacagtgaccgtggagtgttaaatgaaattagcatattacctcgccgtgaagcagttgttatcggccaagcagttttagtacatccattagagtaaaaatcaattacttgcccgatggcattcggcctaagtctaaagatccacttgatgatacattcaaattgtcgtaaacattgcttatttgatgttatcgttgtattatcagtattttttgaaatgttgtacctgctgtaccaccattcagaccacgccggaatatgctccgcagacgagaccccgcgcaaacgagcgaggccattttacctgtatctattttataccaacgacacaaagaaaaagccctcaaccatgcaaggttaagggcttttctcatatttgtgtactacttgatttttggaacatattaggtgtaagtgttccatagcatgttttcccatttcttttgaataagcgatttggttttggatctgggaaaaagggggaggatacttttgtttttttcaggcttgtcttccatctcttttatttgtattatagagatgaagcaaaaattgaactttgcaggaaacggaagacatgcgccgtttagggatcgttgaatatggttattgaggtatagattaaagccgtatagaaggggagattgattaaatggataacgacgtatattttaatcctacaaagattttttttggaaggaatacagaacttttagtaggcgaggaaatagcgaagcacagccaaaaagttttattgcattatggcagcgggagtgcagagcgctccgggcttttagaccggatacggaaatcgcttaaagaagccggagtggcagtatatgagttgggcggcgttcaatccaacccaagactcggcctggtttacgaggggatcaatatttgccgtaaaaatggtattggctttatcctcgcggtaggaggaggcagcgtcattgactctgcaaaagcgatcgcctgcggtacgccgaacagcgacgacgtatgggactatttcatgggtaaaaaaaaggcgcttgctattttgccgctggcaaccgtactcacgatcccgggggcgggaagcgaatcttccaatggcatggtgatcaccaaagaagatacgatggaaaaaatggcgtatgaggatgaacgttcgcggccggttttttctgtacttaatccggaactgacatatactgtgccaccatatcatacagctgccggtattgtagatgccttcgcacatattatggaacggtattttacgaacacggaggatgtagacgttacagacaggatgagcgagggcgttatgaggtcactgctgcgttacggtaggatagcggtcaccgaaccgcaaaattataaagcgcgcagcgaaacgatgtgggcatgtaaaatggcgcatgacggaaccttgggattgggacgggaagaagattgggcatcccatatgatcgaacatgaattatctgctaagtatgatatctcacatggcgcgggtctttcggcaatctttccggcttggatgaagtatgtttactcccataagccggaacgatttgtgcagtttgcggtgcgggtattcgacgtggaagattcctttgaagatcgcgactggacgatcaaggaagggattaaacggacaatgatgttctttaagagcctcaacatgccgacttcgcttcgtgacctgggcatcaacgataaggaggcgctggacgagatgtcgaagcgttgcgttgctcactgtgggggcgtagtagggcattttaaggaactcagcgaagcggatgttagaaatattctggaaattgcttattaagcacgggcatgacaaggccgccgttttggcggccttttttgtttcatgggaacggggaatatgatagaataaaagaaaaaaataaaagatgagggtacgctatgcgctttttacatacatcagactggcacttggggttttcactcaataatatgccgatgattggcgagcaacaacattttgtccggcagatcgttgatattgccgagcgtgaaaaggtggatgcggtggtcattgcgggggatatctttgaccatgctgtctcgaacccggacgcgatcagcctttataatgaagcgatgacgaagttatgtctggaaaagaaaatagcggtcgcgatctgcgcgggaaatcatgatggcgccgcacggctgtcttcgtgcgcggaacttttaagcaaagcgggcttatatatagcgggaagcatcaagaatgggataccgtccgtgaatctagcagatgcgaccctgcacttgctgccgtttttttcgattgaggaagcacgatatctatatccggaagaagaaatcaaaaactatgatatggcaatgagaacgctgctttcccatcttccgcaaagcgatgggaaaaacatacttgtttcccattgctttgtaagtaacgcggtgacggtggaaagcgaccggtcggcgatgatcggcggcgccaatatggtaggagtcaatacttttgcaggattcgattatgtcgccctgggccacttgcacaaggcgcagaatatcggccgcgacatcaggtactgcgggtcgccgatgaaactctctttttctgaagcaggccatacgaaaagtgtgacaattgtggatacgcgggatatgtcgcgcaaggaagtgaaacttgatatgagaaacgacctgcgggtactaaaggggacatatcaggaattgttgagtaccgcgcggaaggatgcgaatacatccgactatatgaagatcgagctggaagatgaatatgcacatatggaatttcggtatgcgttgcaggaattttatccgaatcttttatcattgacaggaaaagagtttgaaatagaaaaggaaaatacactttccgtggagcaggcggcaagccttgacccgaaggagatcatgatgcgtttttatgaagaatattcgggcggggaaaaaccaagcgaaaaacagatacaatggtttttgcgcgcgctggatgcaacaaaggacggtgaagcgcaatgactccggaatttttgagctttgaagcatttgggccgtatgtaaaaaaacaggagatcgatttttccgtttttaaaaaagcgggattgtttttgatacacggaaaaacaggcgcgggcaagacgacagtactcgacgcaatgacatatgccctgtttggggaaagcagtggcggcggacgcggtgatttttcggctatgcgcagcgactttgcgcaggacgggcaaaacacttcggtcagttttacgttcagcatccacgaagttcgatacaaatttacgcggggactgcgcgtgcgtaccaaacggaacggggaaaaagaactgcaggcatcgcaggatgctttctttatggacgacacaggagagttcgtaccgtttttcgaaaacccgggcgttaagaatgtcaggcaaaaggcagaagagattctgggattgacttatgaacagttcagacaggtcattctgctcccccagggtaaattcgaggagcttttggtggcggactcggcaacgaaggaggagattttagtcacgctttttaaagcggaacaatggcaagagtggaccgattggctgtgcgacagggcaaacgatttgaaacgcgaaaaagagagcagcgaacagaaaatcagcagtattttggagcagcatggatgcgctacggtgcaggagatggaaatggtcttggcggaagcggaaaagcagtgcaaggcattcgaaacactaaggaccaaactggataaagaactggaaaaagcgcgtatggcattgcagaacgcacaggctgtgcagacgttatttgacgaacgggaaagcactattgcaaaaaccaaaaaattaaacgcccaaaaaggagaaatcgtgcaactggaaaaaagggttgcgcgctgcatgcaggcagaagagatcatgccgctgcgcacacaggcggcacagcgaaaggcgcaaaaagaggaatgggagggaaaacaacgaaaagcaaggcaggagatcgatgtgcaaaatagccgtctcagggaagcgacaggcatgctgcgcacgattctgcaatctatcgtggaggagcaagaaaaacttttcaatcagacaaaacaattgcatgatttgcggcgggagaaagaagaagagcatataaaggccgtacatgaatacatgcaggatgctgcttttgcactttctgaaaaattggaggatggaaagccgtgtcctgtttgcgggagtacgcatcatccgaacgctgcgcagcctgcgccgcaccaggtcacgatcgagcaggtacaggtgctggaaggcgaggtcaaggggatcgaaaagcaaatcagcgactgtgaaaaggagcagttgattctcggacatatgaaagaggaatgcgaaacggcggttgccaaatataaggtggaagcaggggaagcaggaaagaagcaggcaagtaaaaatgatttaaaggcatggatcgatcaggcggacacagcctttcatgcgatgcaggcggccgatacaacgtatcagctcactcaaaaagagactgaaaagcaggctgccgcatttcatgaagcggtagaagcttttaaagcggcatgtattgagcgcggctttgaaacggacgaacaattcaggaagagttatatggatgagcgggaaaaagaaaaagctcgtcaggagatacaggatttcaaggtgcaaagcaagatagcggaacaaacatcgggaaatctgaacgataagctggatggcattgagcggcctgataccgaagccctgcgaagagaagtaaagaaaaaagaggaagaacggcaaaaagcggaaacgcagtgggcggcagcaaaggcaaaaagcgggattgtgcaggagtcgcttgataaggtgaacggagagcaagagggtttagcaaaaaaaaccgaagagtatgtcgaactggatgtctttgcaaagcttttgcgcggcgacaaaggagttggcttgaaacgctatgttttgggtgtaatgctttcggccatcacccggcaggcgaacactttgttaaaaaaggtacatgacggacgctaccagctttaccgcagcatagacgggcagggacgtgcgcgcaagatagggcttgaccttgaggtgtttgacgcacatacgggagaaagaaggagtgtgaagagcctttcgggcggagaaaaattccttgtggctctggcgctatccttaggcctttctgccatcgtgcaagctcaaagcggggggatacaaatagacgcgatgttcgtggacgaagggtttggttcgctcgatccctcgtcgatcgaaaatgcgctggatattttggcaagtatacgcggcgggcaaaggctggtggggatcatttcccatgtgcagcttttaaaggaaaatatcgaagcgtctattgaagtcaggaaggaacgcacgggaagcgaaattattgtcaatatatagccaaaattgttattgaaacatatcagagtacggtagtataatatcgataaaacaaatgggggagaagcaaaatggcatttgataagatggactggcatgcagtcaattttccggataatatagcgtatgagtgcgcgggaacccacattgggatgtaccttgcatggctgatcgaaaacgatatgattgaagaagagtggctggaagaattcgatgcggagatggataaggtcaaaaaccgtgaaatgacaggccgcgaacttcttgtggaatgttttgacgagagcctgatcgaagatatgatgacagacgaggcgctggaattcactgcggattattatgattcccaatatattgacgattatgcggatgtgcttggcgatgaaggcgctgattccgaattcgcactttacctgcatgaagatacatgggaaaattatgaccgcgtggagcctgtgatcagctcgaaatttgaaaaatggaagaataagcagtttgattaaacgtcattttacaccgcgcagaaaatggccgcgcgtgaaatcgcccatgggctttgccggatgaccttgcatggccctgcggtattgctgcgcgatggatgcgcactgtgcaggggattccgtcgtgaacttaagacgaaggacatctgcgctgacctggtccaatttgtccgccataaaaagcggaagggaattcaatatagatatgcagcaagctgaaccggcgcggacgatagggaaagattttcccatacggtcggtaagaaaagcggtgccgtctacgcggcatctttttttatcgcattgaaagggacaatgaatggttgtcatgaggggcaggcgcccataaacgatcgcttcggtgggcaggattttatttttacaaagatcgcgtatctgcgcaaggttcagttccgcactgagcgtagcgcgctcgtatccaagacctcgtaaggtgcgcagcgtgtcgctgttcatcacattgaaggaaagatcggcgattttgcgttggaccgtactgtcgagaagggtggcaagcatttccccgtcaaaagaggcttgggcaggggatgaaggccggtggtcgatcaggggatgcacgccgatacattgctttttcaggttgtgcgcttccatagcgacctcggtagcccatgacgcagaaactggcacatatacaatatcaacgtcttttaacacggccaaggcctgctttttgcccgtgacctgcgcagcaagtaaacgggaatggggaacaacagcgcaggcagcagccgtgcagcttggagacgcaggctgtatcgcttgttcctgcacaattggcgcaggcggcatcttggcgctgaatggctgcgtcgtaaaaccacggcggctgaatgctttcagaagatcgtccttatctttttgggtaacgatccttgtgtccaatgctttgcggtaaacgcgcgtgacagtaccgacgtattgcgccggcttcatgcggccttcaattttgatactcgcaataccggctttctcgatctcgccgatataatctaccaaacaaaggtctttaggagaaagcaagcggccggatttcttttccagacggtaatcgaggcggcagggctgtgcgcatagtccacggtttgcgctgcggccgccgaaaatactgctcatcaggcactggccggaatagcatacgcacaatgcgccgtgtacgaaaatctcaagctgggcgccggtttgcctgcggatattacaaatcccatcaaaggaaagctcacgcgcgagaatcacacgcgaaaaacccagctctgtaagtgcgcgtacgccctcggtactataagcagtcatctgcgtgctggcgtgaagcggcacgtccggatagaactgctttagcagggaagcgcctcccaaatcctggacaataaacgcatcgacccctgcccgggccgcttccttggcggttgcaagccaggaagggatctcgcggtcgcgtacaagcgtattgagcgccaaatacaactttacattcgacgcatgcgcatatgaaacggcctgcgcgatattttcgaagttttcggcaagattacgcgcgctgaaattctgcgcgccgatatatacggcatctgcgccgttttcaacagcagcttttaggctttcaaacccgcctgcgggagataataattccataagagtattatacaacaacctgtcaacagtcgactgccttgatttcatacgagttttggtatataataaattgtttttgaatgtaaaggagattatataaagttggtaagagaagatttaagaaatattgcgattatcgcgcacgtagaccacggtaaaacaacgctggtggatgagatgctcaagcagggcgggagcttccgcgataatcaggtggtggcggacagggtcatggattccggcgatttggaacgggaacgcgggatcacgatcctcgcgaagaataccgctacctattataataatgtcaagatcaatattgtagatacacccgggcatgcggacttcggcggcgaggtcgaacgtgtgttgaagatggtgaatggtgttgtgttgctggtagacgcttttgaaggtccgatgccgcagacgcgctttgttttgcagaaggcattggaattgaatcaccgtgtcattattgtcgtcaataaaatggacaggccggatgcgaggctgaacgacgtaggtgacgaagtactggagcttcttttggaactggatgcaacggacgaacagcttgacagccctatcgtctattgctcgggcagggaagggacggcgacgatggatcccaaccagccgggcgaggatctaaaaccgctttttgatacgatcctgagttatatccctgcgccgcagggagacgaaaaagcgcctttgcaaatgctcgtttcgtcaattgactataacgaatatgtcggcaggatcgccgtgggcaggatcgaacgcggtgagattagacaagggcaggaagtgtcactgtgtgattaccatgcggaagatttgtgtacgagcggcaaggtaacggcgatctatcaatacgacgggttaaagcgtgttccggtcgagagcgcaaaagcaggggacatcgttgcgttttccggtttggaaaatgtgaatatcggaaatacggtatgcgcacaatatgaatttgaaccgattccgttcgtgaaaatttcggagccgacagtagaaatgacattttccgtaaacgacagcccgtttgcaggacgggatggaaaattcgttacatcgcggcatttgcgtgaccgcctgatggcggagcttcggaaggatgtttcgctggcggtgcatgaaacggacagcgccgaatccttccgcgtgctgggacgaggggaaatgcatctttcgatattgatcgagacgatgcgccgcgaaggatacgaattccaggtgtctccacccaaagtcctgtataagaccattgacgggcatatgtgcgaaccgatcgaacggctgcttgtggatgtaccggcggaaagcgtggggagcgtcattgagaaattaggttcgcgtaagtccgaaatggttcacatgacgccgcagggagagcgtatgcgcatcgaattcaaaataccggcacgcgggcttttcggctaccgtggagagtttttaacggacacgcgcggagagggtatcctcaatacggtatttgacggttacgagccatataaaggcgatatcgacaagcgttctttgggatcgctgatcgcctttgagacgggagaatcaatcacttacggactgtttaacgcgcaggagcggggcacgctgtttatcggcgcgggcgttccggtttatatgggaatggtagtcgggtattcgcccaagaatgaagacttggtcgtaaacgtctgcaaaaaaaagcatgcgtctaacgtacgggcatcgggaagtgacgatgcgcttcggctgattccgccaagaaatatgagcttggaggaaatgctggagtttttgggagatgacgagcttcttgaagtaacgccgaataatttaagaatcagaaagagagtattggaccatcagcaacgcatgaagtctaacaaaaagtaatatgggaatcacgaagaaagtattggagaattgcaaacggccgcagggcatcgtcggaaggcagacgataaagcggatgaataaaagccatgcccagcttacggcatggggcttttcgcaaatcagtttagaggacgggagcgtcattctggacgttggctgcggagggggaaaggcgctgggacttttatcttccaaagtgccgaacggtcggctatatggtatcgattattcgcaaacatccgttgcctgcgccataaaagaaaataaaagcgatgtaaaagcggggaaaatggaaattgtgcatggaagcgtttccgatatgccgtttgaagataatttctttgatctggttacgtcggtggaaagctattatttctggcctgacctacagcacgacctgaaagaggtgctgcgggtactaaaaccgggcggaagccttttgatcgttgcggaaatgtacgatcatgaggagcaaagcgagaaggataaacagatcgtggaaatgcttgagatgcacaataatacgcctggggagttccgcgatatgttatccggcgccggctacagcagtatccgtgtcgaggaaaatacggaacacggatggatttgtgcacaaggcataaaataggaaataaaaaacggcatcagccgtttttttgatatcttttttattctgccagcttatgcagcatgaacgacatgttttcgcccagcgtttttaatgtgtccgccgcctcagcatcgtttttccactcgtccttgtcgcaagccatggtgaagttccaataagaggaactgacgataggcatctggcttatagtaaataagtaattgattgccgccattgtaaaattagatcccgcgcgccgtgccgttacaacagccgcaccgggtttgtttttcagggtaaagccattctcgcgtgtgatacgcccgagacggtcaatgagcgctttggtttcggtcgtcatgctgccaaagtaaacaggcgagccgatcaagataccgtcggcggcgtttgcggccgctatgaattcattcattttgtctttttcgatggcgcacttattattatgtacgcgcagacataccttgcaatcaagacatccatacaataaatttccgccaacctgctggatttcggtatcgacgccatgtgcgctcaattcgtcgcataccattttcaaactgtggtatgtatttccatccttgcgggggctcccgttaaaagcgactactttcataaggacactcctttcaaatatattatcattagtatagcatgaaacagtgagaaataaaatttatctaaaaaaacggaaaagcggtttgaaaaggaaagattagatgatatactgttaacggtattttacttcatatttatatcttatgcaggttaaaggagaactcgatggaatttcttgtgaacggcattatggcgcttacgtggcagcaagtggttatgttcgtcataggtggggtgctgatttttctggcaatttccaaaaagctggagccggcgcttttgctgccaatggggttcggggctattctggtcaatatcccgctttcgggtgcgatagaccaggtgatggccggggtaggcaatgtgaacggtatcgtagactggttgttcagtgtagggattgaggcctcggagatgatgccgttgttactctttatcggtattggagcaatgatcgactttggcccgttgctaaaaaatccgaagctgttgttttttggcgcggcagcgcagtttggtatttttgccacgattacggtggcagcggcgcttgggttctccattcaggatgcggcttcgatcggcattatcggtgcggcggacggcccgacgtctattttggtatcacaggtattgggcagcggctttgtaggcccgatcgccgtggcggcatattcgtatatggcgctcgtacctattatacaaccgatggccataaggctcgtcaccacaaaaaaagagcgggccatcaagatggaataccatggcgaagatattcccaagattgcaaaaatattgttcccggtcgttgtaacgatgatcgcggggctggtggcgccggcatccattgcgcttgtcggattcctgatgtttggcaacctgctgcgtgagtgcggcgtgctcgattcgctttcggataccgcgtcaaaagtgttggtcaacctgattacattattattgggaatcacgattgcctctactatgaaagcggaagactttgtcacgtggcagacgctgatgattatgggccttggcctggcggcgttcttctttgatacgatcgccggcgttatgtttgcgaagctgatcaatatatttagtaagaagaaaatgaatccgatgatcggagctgcggggatatcggcattcccaatgtccgcgcgcgtggtgcagaagatggggcttgaggcaaacaaccagaaccacctgctgatgtttgcggtgggcgcgaatgtttcagggcagatcgcgtctgttgtagcaggtggcgtgatcctcggtcttgtaccgatcatgatgtagggaaaggaagggcagtactatgaatgaagtagtaatgaattctttggatttgatgtggaagggcatgctttccatctttgtcgtgattgcggcaatctgcatcgtggtcatgatcatgaataaagtcacgaaaaagaaaaagcagaaagaatagaagtggattataaagaaatcttggccagccgttttattgacctgtatggaagcggcgtattgccggaaaagctgcgcgtgtataaaaaactgagaaacgtgatctcctttgcggctgttttgccggaggacgtaattgatgaaatcgccggaggaccgacgaaaacatattttcaccactacaggacatgtaatgcatatcttgaccagacggcctttttactggtacaagcaattatgcgggaagggttccatgcagtttatattccggcttcgcagtcggtcagcgacgatggttaccggggagtgttgtctcataaagcggcagcgcggctgtgcggccttggtggaatcggtgataacgatttgtttcttaatgccaaatacggctgcaggataaggttgtcgacggttcttactgatatgccggtggaagagggaaaaacggcagcaaatccatgcacccattgcggcagatgtatcagggcgtgcccgtgcggcgcattgagcggtaagcattggaacgaaaacatgtccgttgatgagatgatcgacgtgcgcaaatgcagtatgcatatgaaaaaagcgtaccagaatatcggacggggagcagtgtgcggtatctgcatatctgtatgcccggtcggaaaaaaggaataagtggtttaagagcctgtagatagggtattaataggatcgttcataaaaattattaataatttattacaaaactatttacaaatcaaaaacaaggttgtataataaaccaaagctataaatttggacatcactcatgatgagcaaaaacagaggagcgtaatatgcgaaatattatatctaatgttaaggatggcctttcaaagacggtggataccgtgaaaggcaagctgtcaggaatggccggcaatatctctagcatgagaaaggtacagaaaaaaagagtactgaagatgcagggtgcatctgtacggcgcagtccggtacagtcagcgtatgtctcacgtacgcggcacacagcgggaacacaacagacaggccgtgtaacgcgcagatatgctgcaaagaaagtgaatgcgaaacgctttacggcggttatcgcgatcgcccttgtagcagtgatggttccggtcatggttatggcggcaaacggcgacacaggcaaaatgcctgaaccggttgaagctgccccggccgtagcacaggcagaacctgaagcaacgccgtccgaaacaccggtagagcaaaacacaacgcaggtaacggaagaaaacacttcccttactgctgaatctgttgcaacaccggaagcgacagcagagccgtcggcagaaccgacaccagagccgacgccccagtacgtcacacttactgcaggcatgaacgatccttctgttccggcattgcagcagcgtttgatggatctgcattatatgtctcaggatcaacctacagattattttgggccggcaactttatcggcagtacaggcattccagcgcaagcatggtttggacgtagacggtgcggcaggtcctgcaacacaggcagcaatcttctctgctgatgcaaaagaatatacggcggcactcggagctgatggtgacgacgttgcggaaattcaggaaaggttgttagagcttggttataacgtaagcataacaggtcatttcggtgaaatgacggagaaagctgtaaaagaattccagcgtatgtgcggtcttacggacgacggcagcgttgggaacgtaacaaaagatatattgttctccgataatgcggaaccttccacagctaaagctgaggcagataaaaaagcggctgaagaagaaaagaagaaagaggaaagcagttcctccaataaggggaacggttcttctaatagcgataagggaagcagttcttccggcagcagcagtggaagtagtagcggcagcggttcttccagcagcaaaccatccaagccctcttactcggcagatccaggcaacgtagaagcattcatcagcgtggcaatggatcaggttggcaaaccctatgtacgtgctggaaaaggaccgaatagctttgattgttctgggtttgtatactatgcccttagagaaagcggtaatggtattgactatatgacatccggcggatgggcaggttccggctacacaacggtaggctgggacgacatcgaacgcggcgacatcctttgcttagaaggtcatgttgcaatctatcttggcgacaacatggttgtagatgcttcctcgagtgcgggtcagatcgtagtcagaagcatgggttcttacttctccagcaactttaaatgtgcgaagagacttttctgatcgaaaaattaaaatttaggaacggatgcaaaacagcatccgttctttttttatgttcttgtatagttcatacttatttgatataatatcttttcagcaggaggttttgtatgacgaaatatgcgttagggttggacatcggctctaccacaataaagatagtactggtagatgatgaaaacaacattttatttaatagatacagaagacatttttctgatgtacgcggcgaacttttaaaccttttcaaagaaattgcacaggaatgcggcgaatatgaggtcacctcggctattacaggctctggtggccttactgttgcgaacttgcttggcttaccttttatacaggaagtggtagcaggtgcgcgcgcaacgcaaaaatatatcccgcaagctgatgttgttttggaactcggcggtgaggacgctaagattacatatatgaagccgtcgcttgagcagcgtatgaacgggacctgtgcaggcggcacaggtgcgtttattgaccagatggctacgcttttgaatacggatccggcgggacttaacgaacttgcgaagtcataccataccttgtatccaattgctgcgcgctgcggcgtttttgcgaaaacggatgtgcagccactgattaatgaaggggcggcaaaagaagatatcgccgcgtccatttttcagtccgttgtaaaccagacgatatcaggacttgcatgcgggcggccgatccgcggtaacgtcgcttttctgggagggccgcttcactatttgaccgagcttcgccaacggtttatcgagacgttagggcttgagggggaagcgattatccatcccgaaaattctcatttatttgtagcgctgggcgcggctttgatggcggagggtaaagccttcaaaatcaaggaattgccggatatgttgatgaatgcgggagacggggaacacgaaacaagacggcttcgccctttgtttgagacagaagaagaatatgatgaatttatacagcgtcatgcacaaaagaatgtgcagcgggctgaactttgcgaagcggagggcgcatgctatttaggacttgatgcaggcagcacgacgatcaaagcggtggtgattgatgatcaataccgtttgttgtattcacattaccattccaacgaaggaaatccgctcgattcggcagttgaaattgttaaagatatttatagtaagctgccgcaaggcgcgcatattgccggttcatgcgtcaccggttatggggaagcgatcattaaagaggctttgaagcttgaccttggcgagatcgagacgatggcgcattacaaggcggctgagtttttcaataaggacgttgacctgatcatcgatatcggcggacaggatatgaaatgtttgcgtattaaaaatggcgtggtagacggtatcatgctcaatgaggcatgttcttccggctgtggaagctttttgcagacatttgcgtattctttggggataccgatccaggaattcgcgcaggaagcgcttgcttcgcgcaatccggttgaccttggaacgcgctgcaccgtatttatgaacagccgtgtgaagcaggcgcaaaaggaaggcgcaacggtaggggatatctctgcggggctttcctattccgtcgtaaaaaatgcgctgtataaagtcataaaggtgaaagatccggccgacctcggaaagaatattgtggtgcagggtggtacgttcaaaaacaacgcgattctgcgcacctttgaattggagcttggacgcgacgtagtcaggcccgatattgcagagttgatgggcgcgtttggcgcggctcttttggcaaaaaaagaaatgcagggcaagcgttcgtctatgatcgaccaagaggcgcttgagcattttacttataaggggagttttgcccgctgcgggaaatgcgagaaccgctgcatgctgaccattacgacctttgaagacggcagaaaatttgtttcggggaaccgttgcgaaaagggtagcggccttttaaagaagaacgacatgcccaacctgtatgattataaattaaagcgtgtatttgactatgaatcgctgccggaggagcaggcgccgaatggaacggtagggattccgcgcgcgctgaatatttttgaaaattatcctttctggcatacgatgtttacgaagctgggattccgcgtcgtactgtccgatccttccagtcatgcgatctttgaaaaaggaatggagacgatctcctcggatacggtatgctatccggcgaagctgatccacgggcatatcgagaaccttgcggaaaagggagtcaaaaagattttttatccgtgtattcctttcgagcgtaaagagtttggtgattccaacaatcattacaattgcccggtcgtcacttcctatccggaggtcatcaagagcaatatggatgtgctcagggaaaaggatatagaatttataaacttttttgtggcgctcgatgaacgggagttcatgccgcagaaaatcatgaaagaatttgggaaatatggtattacgcccgagcaggcgcaggaagcctctgacgctgcgtatgccgagcttgaccgttttaagcaggatatgcgcgaccaaggcgagaaaacgctccagtggctttctgaaacgggaaatacgggcatcgtgcttgcgggacggccttaccatgtggatgcagagatcaaccacgggattccttcgctcatcaccagctatgggcttgctgtcctgacggaagacagcgttgcgcatttagggcatctggaaaggccgatccgcgttatggaccaatgggcctttcatacgcgcctttatgaggcggctgcggccgtcgcgcgttatgactgcctgcaattggtgcagctcaattcgtttggctgcggcctggacgcgatcaccacagaccaggtgcatgagatcattgaagcggcaggaaaaatttatacggtactgaagattgatgagatcagcaacttaggcgcggcaaaaatcaggctgcgttccctgatcgccgcattgaaggaacagaaagaagaagcggcagagaggccgcggcctaagcaggagcgcgggaatgcagtctggaaacggcgtatcttcacaaaggagatgcgtgagaaggggacgattgtgtgtccgcagatggcgcccttgcagtttcagtttctaaagcaggcgttcgatcctacgggatacaattttaccgttcttacggaagtgaccaaggaagacatcgacgtcggtctgaaatatgtcaataatgacgcatgctatccgacgattatcgttgtgggacagcttgtcaacgcttttcttacgggaaagctcgatccggacaatacggttatcatgctcacgcagacagggggcggatgccgtgcatccaactatcttgcattcctgcgcaaggcgcttaaggaagcgggatttccgcaggtagtcgtggtatccatcaacttctccggattggaaaaaaatccgggcttccgttttacgccggggctcgctatgcgcttgctgctcgccattccattgggagatttgctacagaagctgttgcttgcgacccgtccttatgaaaaaaacaagggtgaaaccaacgcgctgtttgaaaaatgggtgaaaaaagtacaggacatcgtggagcatacacgctattttggataccgtaaggcggcaaagcagatggttaaagactttgaagcgatcgagcgcacggatgaagtgaagccgaaggtcggtattgtgggagagatccttgtaaaatatcatccggacgcaaataaccacgcgatcgaagtgattgaacgggaaggcggcgaggccgtcatgcccgcgctgatggaattttttacgtacagcttatatagttgtaagttcaaacatgaggaaatgggaaaatccaagggagtctataaagcgtccatgtttggtatctggctggtgaactggttccgtaacccaatccagcgttcgctcagaaagagtaaatattacacgccctacccggatatacgccatctggccgagcagtcggaggaaatgatctcctgcggaaactgtacgggggaaggatggttcctgacagcggagatgcttcatctgattgaagagggggcgccgaatattatctgtgtccagccgtttgcatgcctgccgaaccatgtggtgggcaagggtatgatccgcgggatcaggaacaaatatccacaggccaatatcgtggctgtggactatgacccgggcgcgtcggaagtcaatcagttaaaccgcattaagctgatgatctacagcgcttttgaaaatttgaagttgcagcaggcaagtaaagattcgcaataacgataagaaagccggattttgtgcaaaaattcggcttttgttatattaggctggattttgttatcacgagtgaacgccatttgcgctgtaatcggcctttgttgtggttgacgctgttcatttgcggtgatataataacttatcgggaacatgggatcgaaaagtatactttttcattcggaaagagaaggcacaaaaaagcgcccaaaagggcgcttttttaaaaataatctattgttttgtgcagaattgaaaagtatgcattttaaggtttattggagataaaagtatgaaacgtttttgggctttattactgaccgtttgtttgtgcctgggactgagcgcatgttcgggaaaaggtgaaaacacggttgtaatctattccagtgcggaacaataccgcaatgaatatatcctttcccgcctgaaagagcagtttccacaatatgatattattattggttatatgccgagcgggaatcaagccgcccgactgttggtagaaggtgaaaaatctgaatgcgatatttcatatgatttggaatatggctatgtagaaaaattaaaagatgttcttgcagacatttcccaatatgatgtttcaaagtttgaagaggacatgttatcgccggataacagggtcttgccggaatgccgtaacggtggatgtatcgcgatcaatatggaagaactcaaaagccgaggactcaaagaaccggccagttatgaagatttattaaagcccgaatataaaaatttgatttctatgccaaaccctaaatcctcgggaaccggatatatgttcttgaaaagcctggtaaacgcctggggagaggaagaggcctttgattattttgataaattgtccaataatattttgcaattcacatcgtcggggtcgggtccggtaaatgcgttagtgcagggagagacagtcattggactggcgatgacatcgcaggcagtacaggaaataaacaacggggcgccgcttaaaatattattttttgacgaagggtcgccctattccagatatggcgtagggatgataaaaggcagggaacagcgccaatgcgtaaaagatgtgttcgactttttaaacgatacactcgtcgccgaagataaagagttgttttttccagagaagatatataaagacatcgattttgaaacggaaaattttccgaaggatattaaatatgcggatatgagcaacgataccaaggcggaaaaagaacggctgcttgaaaagtgggtgcattagatgaatgaaaaacttgtagtggaaaatatttcaaaggattttggatcgaatgaggtcctgcataaccttagttttgctgtacatgaaggcgagtttttgtccgtacttggtccgtcaggatgcggaaaaacaacgcttttacgtatgctgattgggctggaacaaccgacgaatgggaagatattcaaggatggagcggatatcacgagcagcataccttctgcaaggggaatggggatcgtgtttcagaattatgcgctgtttgaaaacatgacggttttgggcaatgtggaatatgccctgaaaagaaatcctcttttaaaagataaggcgcgggagacggcattaaacctgctcgagcaggttgggctctcggagcatgcggataaacgcccgggaaaactgtcgggcgggcagcagcaacgtgttgcgattgcaaggacgctggcgctgaatccggatatcatcctgtttgacgaaccgatgtccgcgcttgatgtggataccaggctttcattgcgcggcgaattgaaaaatattcaaaggaaatttggctcgacgatgatctatatcacgcacgatcaggaagaggcctttgccatgtccgaccggatcatggttttgagcgagggaaaaatacagcagctcgatacgccaaggaacatcatagaccatccggcaaatgaatatatagaacgttttgtaatacacaacatccaattgaagatagactccctgatccagtttgcgaggacagaggcatgagcttaaaaagaaaaggtttatcgggcgttaagctgttactggcggcatttttcatcgtagcagtacttctgccgcttctttatatgttgtcgtccatggcgggcgaagatataggaaagctaatctcgtcagagggctttctgacagcgcttcggaactcgttactcgtatcccttacgtctacgctgatctcagttgggcttgctacggcgctcgcatggtttatcgaacgttcagccatacgccataaagggctgtttacaatcttgttcacacttccaatgctcattccgtcgatttcacatggcatggggctcgttgttttatttgggtcgaacggggtattgacgaacctgcttcatctgaacggcagcatttacggattttggggtatcgtgatcggttcggttatgtattcttttcccgttgcgttcctgatggtatccgatatgctgagatacgaggacagcactccatatgaagcagcctccgtactggggatttccaaagcgaatcaatttacagcgattacattcccttatatgcgcaaacctatgatatccgtcgtttttgcggtatttacattgattattacagattatggcgttccgcttacagtaggcggacaatttacaacgttgccggttatgatgtatcaggatgtggtaggccttctgaattttggaaagggcagcgtcattggattggtattgttggttccggcattcattgcatttctgattgacctgctggacaagaacaagggaagcctttcgtttgtgatcaagcctttccggattcttaaaaataaggcaagggatgcggttgcttatctttcgtgcagcgtggtcagcctgtgcattttgttgcctattgccgcgtttgccgtgctgacattcgtaaaaaaatatccgatcgatatgtcgttcaccctggataatatcacgcaaacaatggatatcggcgcaggcagatacttgctgaattcactgattatagcggcatgcgtttccctgatcggcgtggcagtggcttacatcacagcatatatgacggcgcgcgtgcattccaagtcctcgaaaatgcttcacttggtttccatcataacactggcgatccccgggcttgtactgggcctttcctatatgatgtttttcaatggaacatttatctatggtacgctggccatcttgattcttgtcaatattatgcacttttttgcgtcgccatacctgatgatgtataacacattcggcaagctgaaccaaaatttggaggcagtcggtgcaacgcttggtatcagcaggggacgtatcatccttgatgtgctgataccgcagtcgaaagcaacaatcgcggaaatgtttgcttactttttcgtgaattcgatgatgacaatttccgcagtatccttcctgtcgacatttactacgcagcctctgtcactcatgataaccctgtttgaagcacagatgatgctggaaagcacggcgtttgtttcgctgctcattctgggcgtgaatcttgcgctcaaggggggaatcaatttgtataaaagaaatttaaggaaaaaggaactggcatgaatttaacaagaaaccaatttgatcttttgacttgtctggaaaaaaatggatccttaacgcagcgcgaattggcaaaacaattaaataaggcgctcggcactgtcaataaaggaatggccgaactttcacagatgggctgcatacaagacggcacgattacgcaaaagggactaaatacactggaaccctatcgggtgaagcgcgcgatttttattgcggcaggctttggcacgcggcttgtaccgatcacactgaatacccccaagccgcttgtgcgggtcaacggaacacgtatcatcgatacgctgcttgatgcggtactcgctgcggggatagaagaaatttatattgtacgggggtatttggcggaacagtttgaccagcttttatataaatatccgatgataaagtttatagaaaatcctgtttacaatgaggcgaacaatatttcttcggtcatgtacgcaagggggcttcttgaaaatgcgtatgtgctggaagcggacttgctgctataccaccctgagattatcacaaaatatcaatatgcatccaattacctgggggtgccgacagacgaaacggacgactggtgtttttatagtgccaatcacaaatacattacgaaaatgagcgtaggtggaactgattgccatcatatgtttggcatatcctattggacgcatgaggatgggaaacgtctcagcgaatgtgtcagggacgtatatgaaaggccgggcggcaaggaacggtactgggatcaggtgccgctggaataccacttgaaagactttaatgtggaaataagggaatgttcttttgatgatatcacggagatcgatacgtataaagaattgaaaaagatcgacccgacttatggggaagcttaaagaagcgttacattttcagtatttgttaagaaagccaaaaggctttctttttttgccattgcatcgtcataaccggccttatattgcgcggaaagcttttgaggatccttttccatccggccggcgataatcggctgggttgggcggatgatcagggcattgccggctttttcttcctgctccgcaatttgaaggcttttgttatagtattcatagcggttggcgactgcatgcgcaaaacggcgatgggcaggatagcgcaaataggcataccaactcattttgcttttacgatgcgcaaatccttcattgcgcgtcagtacgattacgtttttgcggttgcctttattgagggaatattcaatcggtatggaatcgcttactcccccgtccatcaacttatgcccatcgaccttcacgatggtcgacgccatgggaatggcggcagaagcgcataggtatttcatgtccgaatcttcattcaggtcgcccaattggtggtaaaacggccttccatccgcaacatttgtcgcaacgatcgtaagctttttggccgaatttttataggcatcataatcaaaaggaataatgttgcgtgtcacttcgtaaaatacatatttcatcccgaaaaacgaaccggtcgtaagaaaattccataagctcagatatttacggttgatacatgtgttataaatggtaaggttccggccgcgctgtccggaaatataagaaatcgcgttggcggcgcctgcagaaacaccgatgatatcttccatgtgtatacctatatcaagaaaggcatctaatacgcctgcggtgtaagaaccgcgcattcctccgccttccaatactaaacctgcttttgtcattccataccaccttctttcttattataacttttttatcaaataaaatcaaaattatggtagaatagaacaggggagagtatggaatggaaattttgattgggattttaatcgcggcagctgccgtgtgggttttatattactttatgacttattctaaagaagcgagaggcggggaatggatgaaaacctgttcatttgcccatcgcggactgcataatgatcaaatgcccgaaaactcgatggaagcctttgaaaatgcaatcaagcatggatatgcgattgaacttgacgtacatctttcaaaggacgggcatcttgtcgtattccatgataatgcgctggcgcgtgttacaggggaaaaaggcatgattgaggattacacccttggtgaactgaaagaaatgaaattgtgcggtacgcaggcggcaatcccgacgtttcaggaggtccttgcgctggttgacggcagggtgccgctcctgatcgaaactaaaaatgtgggacgcgcaggacagcttgaagttgagctgtatgaagcgttgaagcagtaccgaggaaagtatgcggtacaatcattttctcctttctctatgggatggttccggaaaaatgcgccggaagtattacgtgggcagctttcggcaatgttcacatatggagcagaagagataccgaaatggcagcgttccatgttgaaacacttatgcacaaactttatatgccgtccgcatttcatcagttatgaaatagaaggcagggggttgccggttgtaaggcgaatgcgcaggaaggggattcctgttttggtatggactgtgagatcgcaacagagcagggatgctgcgctcaaagatgccgacgcagttatatttgaagattttgaagcataaaggcgataagggagaaagacatgcaaaggaaaacaaataaagtgattccgattttactgattatatggggcgctcttgcatttttgattctggttccgcaaatctggtggttaggccttgctttcgctgcattggctgtgatatggggtggaatcactttgagaaaatataacttgtatgctgtagttgggatgctgatgggaattacagcctgcctgatttatgtgttcacggtcaacgtatcgggtattctgtaaatgaattcaatggaatgagtggaataaacccgcccggatagattgatgcaggcgggttttgcattgtttagcaaagaaaaaaggtattcttaaaaaagggtggtaaatactattcttttcagataaaatgttaatatcagaaaaataacgggagggtggatccttgttaaagctttataagggccttggaaagtatgcgggtcagcttcttttgttgatccttttattacttggccaggttttttcattattgatgttacccaatatgatgtctatgattatcgaccagggtgttattgtgggagatatggggtacattacatcggcaggtcttatcatgcttgctatttcgcttggaggcagcgcctgcgcaatcggcgtggggtattttgtttcaaagattggcgttggcttttgcacagatgtgcgtaagcggttgtttcataaagttggggaattcacattggcagaatttgaccaggtaggaacagcgtcgcttacaacgagaacaacgaacgatatcatgcagatacaggactttacgattatgttattccgtgttattatactggctcctatcatgtgtatcggcggtgtggcgatgtctatgcaaaagaatgcacagcttgcatgggtcatcattgcttgcatgcccttaatcgtggtttttcttgtattgattatgcggaaggcgtttccgatctttaaatcggtacagacgaagcttgaccgtttgaaccttgttatgcgcgagaacattacaggagtacgcgtgattcgtgcgtttacggctgaaggcagggaagaaaagcgttttgaagacgccaatgcggatatgacgcaaacttccatcagatcgcaaaccttgctgtctacgctgatgccgatcttgatgctcatcgtcaatcttggtacaatcgctgttgtatggttcggcgggcagcagatcgcgcagggatcactggcggttggagacttgatggcctttattcaatacttagtcctgattatgtacgcattggtgatgatgtcaatgatttttgctatgatgccgcgggcaagtgtttgtgcagaccgcattaatgaagtgatggagattaaaccggatatcatgaacagcacaaaccctcagcaaccacaggaaaaaacaggtattgttgaattcaaagacgttacattcaaatatggcaatgcagagaatccggctatcgcaaacatatcgtttcttgcgaagccgggagaaactaccgctattattggtgcgacgggcagcggaaaatcttcggtaatcagcctgatcccgaggctttacgacgcgacggacggcgcggtgtttgtagacggcgtagatgtgcgggattacgatgtgcaccagcttaggaaacgcatcggttatgtgccgcaaaaggcggtattgttttcagggacgatccgggaaaatatcgcttacgaagatgaagatatgcctgaagaaaaaatggaaaaggctgcaaagatcgcacaggcagattccttcattgaacagaagaaaaacaagtatgacgatccgatcgcacaaggcggttccaatgtttccggcggacagaaacagagactggcgatcgcgcgggcgcttgcaacggacgccagtatttatgtatttgacgacagcttttcagcccttgattttaagacggacgccgccctgcggaaagcaatcaaggaaaatacgcacggtgctactgtgatcatcgtcgcgcaaaggatcaatacgattattgatgcggataatatccttgtgctggacaagggcaggatcatcgcgcaaggcaggcatgacgaactggtcaaaacatgtgatgtttacgctgaaattgcgcgtacgcagatgtcttaagggggtggcttatcaatgaaagcgataaacaacggacagactgctgcgaaagataaagcgaagaattttggcggaacggtaagacgcttacttggattttttgcgccatataaaaaacaattagtaacaattttaatttttgcgcttttgggaactttattcctgattattggtccgaaaattttgggggaagcgacgaatacgatctttgcaggcgttgcaaatgcagcggaaggaaatgaggcgacagcaggaatagactttgtacgcctgtccacgattttagcttccctgatcgtcatatacggtctttcagcgctctttacatatatgcagcagcgtgtgacggctaaagtagcacagcgcacggtatacgacctgcgtgaagcggtcgaccttaagatacagcgtttgccgctcaactatttcgatacgcatacgcatggcgacatcctttccaggacgacgacggatattgagcggatcagcgcgacgatccagcagtccatgacgcagcttataacggctgtcttcacgatcattggtattattgtaatgatgttcagcattagttggcagatgacgctgatagcgcttctcgtcctgcctgcggcgttatttctgtcgacgctggtcgtcagaaaatcacaaaaatattatattggtcaacaggataagctggggagtgtcaacagttatgtggaagaaatatattccggacataacattgtaaaactatacaacactgaaaaacgtacggaaaacgaattcgatcagatgaatgatgcgctttacgaagatgcgcggcgctcgcagtttgcttccagtattttgatgccgattaccaacttggcaggaaatgtgggctatgtaggtatttgcgtactgggggggatcatgacttcgaacggtacgctcacggttggtgcaatacaggcatttatccaatatatgcagcaatttacgcagccgatcgtacagacttccaatatcgtgaaccttctgcaatccacggttgcagcggcagaacgtgttttcgaattgctggacgagccagagcaagagccggaaaataaggatttaaaggtattggaggatattcgtggagaaattacctttgaccacgtgcggtttggttacacgccggacaggatattgatttcagatatgaacgtacatgtggagccagggcataaggttgcgatcgttggcccgacgggcgcgggaaaaacaactttagtcaatttgctgatgcggttttacgaactcaacagcggaagtattcaggtggatggcattgatatccgcgatatttcgcgtaaaaaccttcgccagcaatttggcatggttctgcaggagacatggctgtattccggcacgatccgcgacaatatccgctacggacgtccggaagcctcggatgaagaggtctatgaagcatgcaggatggcgaatgtagattcgtttatcaggacgctgccgggcggctatgacatggtcataaacgaagaaggcagcaatatttcgcagggacaaaagcagcttttgaccattgcacgggcgttttgcgcacggccgcaggtgctcattttagatgaagcgaccagttctgtcgatacccgcacggaaaagctgatacaggatgcgatggataagctgacgcagggaaggaccagttttatgatcgcgcataggttgtccacgatcaaggatgcggatattatccttgtgatgaaggacggggatatcattgagcagggcagccatgatgagcttatggcgcagaatggattctatacggggctatataacagccagtttgcataaaacagatatatcctgaaaatggaagggagtgcaaagcgatgacggaagatttttatcagtttaccagtctgcgccttgacagcctttccaacacggaacggcagatttttaactacgtggttaagaatatgcataaagtcaaaacaatgagtatccgtgagcttgcgacagcatgttttgtttcgacgacgacattgttcaggtttgtcaaaaagcttgggttttccggttatgcggaatttacggcaatgatacagcttacggagcggtcttcccgcgaaatcacgatccctaatgtgatgcataaggagaactaccaggaagaatacctgaaaaatgtaattgaagcggtcaaggtgatcagcaacgataagatcgaaaagtttaacaggatcatggaccggtatccgaaggtatatatcctcgggtgtggtttaagcgaggatgtggcgcgttacataaggcgtattttgatggtgcttgggtatgatgtcgaaacgcctgtagaagattacgagatcgcttcgatcatcaagcgtatcaagcgcgaggatgtacttttggtactttcatattcgggaaacaataaaatactggcccgctacatcgaacagatcgtcacggtggcaacgccgacgattatttccattacccgtgcagataataacatcatccagaatatgagcgatctcaatttttatatttttgcagatgatgtttcttatgacgacttggatatcacatcgaggtgcggtatgatcgcggtcatcgaaacgctgatgtataaacggatcacagagcagaaatagggtatgtacgcaataaaaaatgcgcatagcatgctatgcgcatttttggtttcctttttcaaaacaaaccgatggtctcaccgttttcatcaacgtcgatattcattgcggcaggtcttttaggcagaccgggcatacgcatgatattgccgcacatagcgacgataaaacccgcgccagaattgagccgtacgtcacgcacctcgatgcggaaatcttcgggcgcgcccagcttggcagcatcatcggaaaacgaatactgggtttttgcaatgcaaaccggcaggttgttatatccgtgatcttccaacatatggattttttcagaagccctgcggttgaaatcaacatcctccgccccgtagattctggttgcgatcccgcgtatcttttgctcgatagactgggcgtaatcatatggatggctgggagaagaatgcacggggatgacagcgtcgaccttttgggcaaggtcaagcgccccttcgccgccctttaaccatacgtcgcataccgaagccggaacatcgagctcctctgcatgagataaaatcgcattggtttccgcatcgctgtccgaagcaaaatgattgacggcgatcaccacaggcaggccgtatacccctgtcaaattcctgacatggcggtcgaggttgggaaagcctttggttaacgcatcgatattttctttgttgagggtttctttttttacaccgccgtggtatttcagggcgcgggccgttaccacaagaactacggcatccggccagatatcggcgttgcggcacttgatatcgaggaatttttcagcgccgaggtcagcgccgaagcctgcttctgttacagcataatcggaaaaagcaagcgccatttttgtcgccaggatactgttgcatccatgggcaatattggcaaaggggccgccgtgcatgagtatgggagtatgctccagcgtctgcacgagattgggtttgatagcctcctttaggatcactgtcatggcgccgcccgccttcaaatctttggcaaaaacagcctctccatccacattataaccgatcgtgatattatcaaggcgttttttcaaatcctgtaagctggtagccatgcacaaaatcgccatgatttcagaagcggctgcaatgttgaaaccgtcttcgcgcggcacgccgtccgttctatggccaagaccgcatacgatattccgcaaggcacggtcattcatatccatacagcgcttgaacatgatgttttttacatcaagacgcaattcatttccatggtaaatatggttgtcgatcatagcacacaacagattgtttgcggtggtaacggcgtaaatatcgccggtaaaatgcaagttgatatcctccatggggatcgcctgcgcatagccgccgccggtagccccgcctttgatgccgaatacaggccctaaagaaggttcgcgtaaggcaagacatgcttttttaccaagttttgaaagaccatccgcaaggccgacggaaacggtagttttaccttcgcccgcaggcgtagggcttatggcggttacaaggatcagctttcccgagggggcatcctgttttttttccagcatttcgagggataccttggcgatgctctttccataagggatcaggtattcgtcttcaataccgagtttgtcagcgattaccccaatgggttccgcttgtactgaattggctatcctaaggtcgttattcattctgtttactcctaaaatgtatcataagttttatgcaataacctatattttgatatatatattaccgtttgtcaaccgaagggattgtgctataatagctttatgaaaaaggaattggattttttgagaattgacggaaagtattacggcggagaccagaactggcatacgcataaaatgatgaaattgggcggctgttctgcggtatgtgcatgcgaagcctgcatataccttgcaaaaacgtttccgcaatacaggaaactttatccatatgatccgcaaaatgttacaaaagctgactttcttcgtttttttgaaacgatgttccgatatatttatccgggcattgggggacttacgagcatcgacaagtttgaaaaaatgtttttaaaatatgttgcgactaccggagtagaagtgcagctgcgaaaactatcaggctgtgcgccgcttccggaagcatgctgttttgtcaaggactcgctcgacgcggatatgccgatcatgtacctgatgctaaagcatgccgatcctgcgttcgacgagtacgaatggcattggtttaatttgacagggtatgaggaaacggaagggaaactgatcgtcagcttcgcgacatggggttgcaaacatgaatttgattttttgcgtgcgtgggacacccaaaagtgctggaagggcggcatgatttcctttgcactttagtatctatgtaaagcaaaagtacatgctttgcggaaaaaactttacatctcgcggcgtttttaatatactattagaaggcgttttttgcgaaaggggcaaacagaactagtatgaagagaaagcttgttttattattggtaattattatgaccgcggttacggtctttgccggttgtggtggagcacaggagatcaagcgtcctgagccggaagaaggaaaaacaaccgtagaagtaacaggatcatgcaaggcggtattaaacggagatacattgacggtgtcgggagaaacgaacctgatggatgggaccaatgggatcatttctgtattgaatgccaacggtattacgattgaacagcagaaaattactaaaaatggcgataacctgacatgggatttcaaaaagaccgaggaatggccggaggttgtttacggattcatcacttttgatacacaaaaatcggatggacagcctacagaggtcaaggaagcctacggaagcaaattccagaatctcaccggacagaatacgatatgggatcaaaaaggggttattgttgttttccaaagtgaggaagtaaaagtaaaataaggtatattatggctctgtgcagcgagcggcatggagcttttctgcatagaaagctggtgtttattattatgaatcagatcaaagagatcgcacaaaggctgcgtgcgcttagggagattgaagaaatcgacgccggtgaaatggctgagatcacgggtaaatctgaagaagaatatttggagtatgaagcgggaaacaaagattttgcgtttagttttttgtatacggcagccaaccgcttgggggtcgatataactgagcttttgacgggggagaatgcaaagctgaagaccttttcattggtgagaaaaggcgaagggctgaaaatggaacgcagaaaagcttataagtaccagcatcttgcatacattttcaagaaccggagcatggagccgttcctcgtgacggtagaacccaaggatactgatgcggtaaaaaagaacgcacacgaagggcaggaaatgaattatgtggtagagggaagcatgactctttttattcatgattcagcagtattgctcaaggaaggtgacaccgtttattttgacgcatccacgccgcatgctatgcgcgcagaaaatggaaaaccctgcaaatttttggcaatcatttccaagtgaggacggaaagatatgagaatatttgagaaatacagtacgacaggattttccagctatgaggaatttgccgaaaaattcgaaacaatagtgcctgaaaattttaactttggctttgatgtagtagatgttcttgcaaaagagcagccggataaacgtgcgcttttatggacaaatgataatgatgaggaacgattgtttacgttctctgatatcagcaggctttcgaaccaggcggcgaatttcttaaaagcggaggggatccgaaaaggcgataaggtcatgctgatcttaaagcgccattacgagttttggattactattattgcgttgcataagctgggggccattgcgattccggcaacgcacctgcttacaaaaaaagacattgtatataggaataatgcggcagacgttaaaatgattatcagcaccaaagacggcgagctcaaagagcatgttgaagatgcggcagcggattcccccacgcttgataaaaaaatacttgtaggcgaaaagcgggaagggtggcttgagttctggacggagatggaaaaatacggcgacgtgtttgaacgtccgcagggcagcgaagcgacgagcaacgacgatatcatgcttctgtattttacgtccggaacgacgggaatgccgaaaatggtagcccacaattttgtttatccgctggggcatattgtgacggcggtctattggcataatgcggatccagacggcctgcatttaacagttgcagaaaccggatgggcaaaaagcgcgtggggaaagctttatgggcagtggcttgctgaaacgtgcatttttgtctatgatatggacaagtttattcctgatttgctgctccggaaaatcgagaaatacaaaattacgacgttttgtgcgccaccgacgatctatcggtacttcatcaaggaggatcttacaaaatatgatttgtcatctttaaagtatgcgacgattgcaggcgaaccgcttaacccggaagtatattaccagtttttggagacaacaggcctcaaactgatggaaatttatggccagacggaactgacggtaacgatcgggaatttcgtttggatggaaccgcggccggggtcaatgggcaaacccaatgcgatgtatgatcttgatatcgtcaatgaaaatggagagatatgttctcccggcgaaacgggtgagatcgttattcatacggataaaaaggtcccgacaggaatgtttttgggatattataaggatgaggaactgacgaagaaggtttggaacaacggactttaccataccggtgacgttgcatggaaggatgaggatggctatttctggtatgtgggacgtgcagacgatgtgatcaagtcttccggttaccgcattgggccgtttgaagtggaaagcgcgcttatggaacatccggcagtactggaaacagcgattaccggcgtaccgcatccggagcgcgggcaaatcgtaaaagcgacgattgtgcttgcggaggggtatgaaccaagcgaagaactgaaaaaagaattacaggatcatgtcaaaaaatccacggcgccatacaaatatccgcgcgagatcgaattcgtgaaggaattgcccaagacgatcagcggaaagatcaggcgtgtggagctgcgcgaaaaagataatcaataaatttttttggaagtatcaaaaaatcacatcatatgcttttataaagaaaggaaggtatcttcgatggaagaaactacagtaaaaaaacaaaaaaacataggaatcatgatcgtatcgatattgacgatcgtattggtggctggatttttagttgcctttttcgggtttatgtcaacatatgccgcgacagcaggggcggcgttaacggttgatatttatttgactaatctatatatcatcggcgggtttgcgcttatgtcaatggtattattcattctctttatctttgttgccaaagaaaaaagagaagttctcgccaaagtgtttatgtggggcgtattacttttagctgcaatgtatgccactacgtttttctcgagttggtcgcagggggcggcaaatgttagcttctatgcatcttacatcccatgggttgcactcacggtcgcagcagttacaatgattgccggatgggacagcagcgataaaaagcgaatgaatatgatccagtggatctgtcttgccgcttcgattgtgatgtccgtattcttctttgccggaatgctttcagctctgatgtccacagaagcattggcaatttacaatctggttgttacattggctatcaatgcggcggtgaatatgtttatcctgctgcttgcgcttatcacacgttcaaaaaggacgtttgataaagtgatctttgccatgagcgacgaggaagcggatattgtggaacggatcgaagcgcgtgtagaggaaatcgcggatgaagtagaagaaattgccgctgagggagaagcctttgtcgaagcgaagacggcggctgatatcatggaagaagaatccgaaaaagcagaagaaaaggcagcggaaacggaagtcgttattgaaactgaagttgtggtggaagagactgcagacgataaggacgaagaaaagtaagggaatacgcaaaagaaccgaagcacccgcagcttgtcttgcgggtgtttttgcttgtgaaaaagtggcaggttgtgctataatataatatctattgttataaaaagggaagttgtttgtaatgaaaagttatcgtgaaattttggaactcaacattccgaaaagacggcagtttatcaacatcacgccgcaggtacaggacgcgctggataaaagcgggatcagggaaggattatgcctcgtaaacgcgatgcatattacggcaagcgtatttataaacgacgatgaaagcggcctgcatgcggattttgaagcatggctggaaaaacttgcgccggaaaagccatataaccaatatgcgcataatggatatgaggacaatgcagatgcgcatttgaaacgaagtgtaatggggcgcgaggtagttgtggcagtgacaggtggggaacttgattttgggccgtgggaacaaattttttacggtgaatttgacgggaaacgcaacaagaagattatgatcaagattattggggaataacaggaagatgactgaagaaagccgtaatacggaagagcaaggtgcgattgaagaagagccaaagcacagaaagggcacagccgaaagaatgtgggcgcccatcaaattgcatttggacgaagattaccagtatgtgacaaaaaactggggtttgcggtttttgtattattttgctatgtttgtcggcatgccgtttggatatctgtttttcaagatacgctgggggttccatgttattggaaaagaaaatgcaaagcttgtgagaaagactgctgcgattacggtagcaaatcatgtgcataacatggattcgcccatgctcacttatgtattttatccgagcgcgccatattttgtggcgctaaaacataattttgaagcgtttattattggaggactggtacgtgttttgcgcggagtgccgcttccttccgatttgaaaaattttgagcgtttttctgaacagatgaacgatgtattgcaaaatacgacgcgtaaagtacacatttatccggaagccgaaatttcgccatactgtaaggaactgcggaagttcaaaaacggggcgtttcattttgcagtaaaaaacaatgtgccggttttacccctcacgtttgtatttccaaagaagaataaaatcaacctgatcgtaggtaaacctgtttatctaaaggatgtaccagggacagaagggctcaaggaacctaagcagaccgtgctgatgtgccgttatgtaagagaacaaatgcaaaaaatgatagatgattattatggaggaccgaaatgaaaatcagaaaagcagtgataccggcggcagggcttgggacccgctttctacctgcaaccaaggcgcagcccaaagaaatgctgcctatcgttgacaaaccgacgatccagtatatcgtggaagaagcggtagcaagtgggatcgaaagtattgttattatcacaggcaggagcaagcgcgccattgaggatcacttcgataaatccattgagcttgaactggaattaaataaaaaagggaaatgcgatcttttgcaattggtagacgatattgcgaatctcgttaatgtgatgtacgtacgccaaaaagaaccactgggacttgggcacgcgatcggcacggcacgtgattttattgggaacgagccgtttggcgtgattctgggggatgacattgtgaaaagcaaaaagcctgctttaaagcaattgattgatgcttatgaagaatgtggttcaactgttattggcgttcagaagatagaaagaaaagataccgataagtatggcatcattgcgacaaaagacatgcagggaaggttacatcaggtcgacaggttggtggagaaaccgtcgagtgatgaggccccgtccgatttggggatcatgggaagatatgtgatctctccggaaatctttgatgtgatcgacaaaacaaagcccggcaaaggcggagagatacagcttacagatgcgctgcagaaccttcttgaaaaggaatctatttatgcgtacgagttcgaaggaaaacgttatgatgtaggcgaccgcctgggctttttaaaggcgacatgcgaatttgcattagacagggacgatttgaaagacgattttcaggcatatttaaaagaactcacaggaggtatgaaatgagcgatattgcaaatataaaatcagcgcccgcgggtaggcagaaaattgaatgggtcaagcggtatatgcccgttttaaagagttttgaagaagaaatggcgccgcaaaagccgtttgccggatataaaatgtgcgtttgttgtcatttggaagcaaaaacggcttatttgatccaggtcatccaggcatgcggggcgcaggtagcggcatgtgcttcgaatccgctctcaacgcaggatgatgtggtggcggccttggtggaaggcggtgcggacgtatatgcgattcacggggaaacgcctgaggtatatgaagggcacatcagaagcgcgcttgggacaaaaccaaatttgattgtagacgacggcggcgatgtgatcacgatgctgcatgaagaatttccgcagttgcttgagaatgtgatcggggcaagcgaagaaacgacaacgggggtattgcgtctaaaggcgatggaaaaagcgggtgcgctcaagattccggtcattcctgtcaatgatgcacagtgtaagtatatgtttgacaaccgttatggaacgggacaatccgtatgggatgggattatgcgtacaacgaatctgatcgttgcagggaaacgtgtcgtagtggcaggatatggctggtgtgggaaaggtgttgcaaaacgcgcagcagctctgggggcacgggtgattgttaccgaaatcgatcatatcaaggcaacagaggcgttgatggatggatttgatgtgatgacgatggatgatgcggcatcgttgggagacgtttttgttacggtgaccggctgtgaagacgttattgtaaaacgtcattttgataaaatgaaggatggcgtgctgctttcgaacgcagggcatttcgactgtgaagtaaaggtttcggagcttgcggaaatcagcgagaaggtagtggaaatgcgcaacaacgtggaaggatatgtgcagaaggacggacgtatcctgaacgtgattgcgggcggacggcttgtgaatctcgcatccggcgacgggcatccggcggaaattatggatatgagctttgcgcttcagtttttggcgcaaaagtatatcaaagagaaccatcagtcgatgaagccgggacttatgaatctgcctgaggatatcgactatagcgtggcgatacgcaaattaaaagcaatgggcggagcagtggatgtgttgacgccggaacagcataaatatctgtatggggaataacaatgaaaataaaaattgaaaatgctgatgtcgttacgaataatgtaaacaaagatgttctggaaaacgcggttttgcagattgatggagagaaaatcctgtatgtcggagcggcggaccaggcaccggaatttgaagcggacaggacgattgatgcgcaaggcaatgtagttatgcccggattctttaatacgcatacgcatgttccgatgaatatgtttcgttcttatgcggatgatcttgatctcatgacgtggctcaatacaaggatatttccggcagaggaccgtttgaacgatgagatggcgtactgggcaagtatggccgcgatgtgtgagatggctgcggccggaatcgttggatttaacgagatgtatttctttatggattctgtagcaaaagcagcgcaggaaagcggtctgcgggcggttctatcgagggcggtcgtcacgccaaatgaagaaacggctgagcgtactttccgtgaaggcgtcgcgctgtatgaaaaatataataatgtgggaaaactcaaggtttacctttcaccgcacgcgcaatatacggtgggcaacgatatgctcaggcgtatcgcaaaagaagccgcaagtcttaaaacggggatccacatgcatatttccgaaacgaagggagagcatgagagctgtttaaaagagcagggaaaaaccccgatcgcactgtgcgaagaattgggattgctagatgttccgtttctggcagcacattgcgtatggatcagtcaccgggatatggaattgatggcgcagcatggctcgtatgtattgagttgcccaagaagcaatttgaaactggcgagcggaatcgcgccgcttaccagtatgatagaaaaaggcgtcaatatctcgcttgggaccgatagcgtggcttcgaacaacaagctttccattatggaagaaatgacatatgctacgctgctgcaaaaaggaacgacgtacgatcccaaaacgatgcctgcagcgcaggcgatcgaccttgcgacgcggcagggcgcgcgtgcaatgggatttgacagcggcgtgatcgaagcagggaaaaatgcggatatcattatgctggatacgagcggcatccgctacgtaccggattacgatgtgatgtcaagcatcgtatacagtgcggatgattcggatgtttgcatgaccatggttggtggagatatcgtttatgaaaacggccggtttagctttgcggatatagaagagattaaaagaaagctggatgaatacgcagttattatgaaagcgatttaacgcagaagtcattaaaacgaggggaaatatgttcaaaaaacgattgattgtaatacttagtctgatctgtgcggcagcccttttatttactgcatgcaataattcgtctgcgccggaaagcccggcggcgggagctgaagaaacagaagtgaaggggacgatagaggggggcgacgcttctctcggaaaagatattaacttaaaggatattaatatcgaaaaacaaggcgagaatacggtcatcaccatgtcgtttttgaatggatcacggacggcgggggtggatgaatcaaaaatttcatccgttccttcttataagatttcgattttatctgccccgatacggcttcaggtggacctcaatattggattttgggattattccaataaaagcgagtggtttacagacagcatcatttttggaatgttcaacacggtacattccgacagtgctgcggtatcggtttattttcaaatgaacgaaggtattgaggccaccgtcaaagaagacgctgaccgcttgattattacgcttgcgccgaaagcagtgcaagtggaaaatgcatactttgtaggcctgaatgcctatgaggaatatgagcaaaacctgattacggcagaccttggatttacaccgacgatgtgcgaggggctttcggatatcatattgatatcttcaccgaaaaaagatgaagcttcggccaaaaagcttgccgatgaaacgaacctaaaaattgcaagcgtagcgcccgcgaaacaagcgtatgtgtttgaaatgagtacagatgcgctgcccgtctataatcaggaagtcgatgctgaagggattattgcggagccggtgatgatggttgcgggcgcgccggttacactgcctgtattggtagaaaatggacggtatttgtgtcagttgccggatgggagcatattgtatgctcgctcttatgtacccaacgcttcagaggatacggagcaggtattaaaggaaaaactttggcgcatcgaacccaacggcaaaaaaacgcagcttgaattacaagatttttacggtatagacaaggcggcgccatctgctgacgggagatatatcgcgatcctcgattccggaatcgaaaataaagtattgtacgtttttgatacgcaggaaaatgtgctccataaccttggggaagaggggttcggcgatgcgacgacttcctttgtttgggatacgcaaagccctgtcatttacgctatgacaggactgggaacgttgcaactgatggaatatgatttttctgtggacgatgcagatcgcgtacaggctgtggaagagaaaaaaggcgccgaatcgaaaatcgctttgagaaatggaaagatttattttgcggataagacagcaggcgatggccttggaatgatatatatgtttgatttaagtacgaaagagcgcgcggaagtgacgcagggcgttgattttgctatatcgccggatggagtaaacctggccgttgttgtaccaattcaggaagatgaagaggaagtgatgtaccggatacagatgctgaataccacgacgggaacggttacagacgtgataagtgacgctatcataaacagcatggcattcggtgcagacaatgataccttgtattttacgacgccgacatatgacggtacgacggaagaatatccctttgcagtagtgaaatattccatcgcaaccgcagagcaatcgttgatcggctattccaaaacatcggaaattgtaccgggaacaaagaatggtgaattttatgtagtggattatttcaatcaaggggataatagcttttatataacctatacatatcaggaacactaaaacagcttaagcggaaaaggctgcaaatgtttgcggcctttttttatcaggaaagaccagtttatgaaaacgattataacagcaatcaacgcaagctatatacatacgaaccctaccgtgcgttctttagccgcatcagtaaaagaaccttgcgttatattttgcgaatacaatattaaccagcctgcgcaggatattttgcaggggattttgcagcaaaagccctctatagtaggcttctcgtgctatgtttggaatattggcatggtattgcgtattgcagaggacttaaaacgcatcgacccaaatataaaaattgtattaggcggaccccaagtttcctttgaaagctacgtattgatggagcaggcatcttttgttgattatgtcatatgcggcgaaggagagaagctgtttccgaaattattggaagcgatcgaatcgggcataggcatagaagatttgaaaagcatattgtaccgcaaaaacggcatggttgcaggggacgatacgtacgcaattctggaggacatagactctttgcccgctcccttcgccttggagcaggacaagtatgacgagagccgtatttattattatgaatcgtcgcggggatgcccgttttcgtgcgcctattgcttgtcgggagcgatcggcggcgggatacgcgagaaatcgatcaaaaaagtaaaacaagagattgatatttttgttcaaaaaaaggtgcggctggtaaaatttacggatcgtacttttaatgcaaatgcagggcgcgcgaaggaaatttggaaatatgtcatagaccatacgggaaaaacatctttccattttgagattggcctcgatttgctggacagcgaggcaattgcgttactacaaaaggcgccaaaagggaaaatacagttggaggccggcgtacaatcgtgtaatcaaatgaccttggaaacggttattcgtaaaacaaatatcgataaattgaagcgtaatgcactgaaaattatgcaagaggacaacatccatttacatcttgatttgatcgcaggactgccacatgaaaatatgcagagctttaagcagtccttcaacgaggtatataaactatacccggacgcgcttcagctcggctttttgaaattgctgaaaggtacaacgcttgcaagagcagccgatgactatgggatcgttgcgcgaagctatccgccgtatgaagtactcaaaacaaatgatatgggggctgatgagttgcttaagctgcgcgggatcgcagggcttgtagaccgatattacaataccggaagaatgagaagaggccttgactatattacggtaaatggtatcattcagccctttgaactttatgagcaattatatgatttttcctgtgagcatggattttcagtcaggccggtgaatgtccgcgaccagttcggattggtgattgtttttgcaaaagatattttaagcggacctcaatttttccaatttctaaaacacctgaaacaggattatatttccgtaaaagccaagggcgctatgccttatgaatttacacaaatcgattaaaaaatttttataaaaacagtttacaaattcgggcaaggggttataataaatatgaaggtcaaagaaagtcaaagaaaggaggcgcgatatgtccatattaagcgatcatatcgaaagtttcataaaggagcttttgatggaggatgaaggcatggccgaattgcagcgaaatgagttggcacagcggttcaattgtgcgccttcacaaatcaattacgttttgacgacacggttttccccaaacaggggttatttgatacagtcaaggcgtggcggagggggatatatccgtgtgaccagacttgatgttgacgaaagcgaatatatccgcgatattatcgacgaaaagctgcagggcggcgtaggcatgcgacaggcagctgaactgatcgagggaatggtagaaaccggcctgatcgacaaaaaagccaagaatattattgtggcggcaatatcggataaggcccttgaggtaccaaatgaaataaaaaatgagcttcgatcatcgattttgaaagaagttttagtatcaacacttttgaaggaggacgattgatatgttatgtgacaaatgtaaacaaagggaagcgaatatacatatacagcagagtataaatggcgtgacaacagaaagaaacctctgtagcgaatgtgcgagtaaggagccagggctgatgaatgcattctcagtggatggattcttcggcgatttgtttgagacgagtctcttgaagcgcggctcaggcaggttaggtaatatgtttgatattacagggctgtcaggtggtattcctgcggcgccgcgcgacaggaaaagtttggaatttgaagatgtcggtggtccttctgccagtgggattgagttgccggaaattaaaatcaaccgtgaaaatacgacggcaaagcagccgacatcgagggtacaagacttaaaggagcagctcaaagccgcaatcgaagcggagaacttcgaaaaagcggctgaactgcgggatcggatcaagcagaacaaagaaaaaggaaaagatgaaaaaaccaagggataagatggtttaagcttggctggtgcgggtacattagttacaaagaaaaggcaccggcgcaatgattggcaggccgtttgccggaaaaaacggcgctgccgtatcattctatgatacggtggaattaggaggattaatatgagcaatatgtctggatttaccgcaggtgcacaggaagctgtcaataaggcggcacagtttgccagcggtatgggagaaaattatgtaggaaccgagcatcttttattggggcttgttctggaaggcggcacagctgctgaaattttggaaaagcaaggaatcaatgaaaacaatgcccgagagtatattgaagcagtctcggtggatggtggatatgggaatccacaagtgatggggtacaccccccgcacaaaaaaaattattgaaatgagcgtcgcgttctcgcgtcagcttgggcagaattttgtgggaacggaacacatgctgcttgcgatcatcaatgaaagggagagtatgggttttcgtatgctgcatgatttgaatgcggatatggctgcaatgcagcaggaaatcctggcaatcgcgcaaggcgcgccctccggagaagaaaaatcgaagtcaacaacgccgaaacttgacaagttcggaagggatctgacgctggcagcgaaaaatgacgaacttgatcctgtcattggcagggccgaggagatcgagcgtattattcagatcctgagcaggaggaccaaaaacaatcctgtgctgatcggtgaaccaggcgttggtaaatctgcgattgcagaaggattggcacagaagatcgtagaaggcaatatcccggatatgctgaaaaacaagcgtgttatcatgctggatttggctggaatgcttgctggttccaagttccgaggcgaattcgaggaacggttgaaagacgcgcttgatgaattgcaaaaagacggaaacgtgattttgttcattgacgagctgcatacgctgattggcgcaggtgcagcagagggcgctatggatgcggccaatatcctaaagccgatgcttgcccgtggagagatacaggtgatcggcgcaacgacgatcgacgaatacaggaagcatattgaaaaggatgccgcgctcgaacgtcggttccagcctgttaatgtcggagagccaacgccggaagaagcgttgcagattttagaaggcctcagggaccgttacgaggcgcatcacaaagtaacgattacggatgaagcgttaaaagcggcagtcgatctttcgacaagatatatcatggacaggttcctgccggacaaggcgatcgacctcatcgatgaagcggcctccaaagtgaggatatcaatgtttacttcgccgccggatttaagggaactggaagaaaaactggaagtgatcggcaaagaaaaagaaagtgcgattgcgcatgaagattttgaaaaggcagcgaagctgcgtgacgaagaagcggataccaagcgtgatatcgagcattgttccgaggaatggcgcaaagccgtggctaaggaaaaaggcgttgtaacagaggaagatattgcgcagatcatctcgagctggacgcatgttccggtgagcaagctcacggaagatgaaagcaagaagctgcttgcattggaagaaatgctgcatgaacgcgtgatcgggcaggacgaggcggttacggccgtggcaaaagctatccgccgcgcgcgtgcaggcctgaaagatccgaacaggccgatcggttcgtttattttcttaggacctacgggcgttggtaaaacggaattgacaaaagcgcttgcggcatcgatgttcggcgacgagaatgcaatgatccgcctggatatgtcggaatatatggagaagcactccgtatccaagctggtaggttcgcctccgggatatgtcggttacgacgaaggaggacagcttacacaagcagtccgcacaaagccatattcggtcgtattgtttgatgagatcgaaaaagcgcatccggatgtattcaacatcctgctgcaggtattggaggacggtcgtctgactgattcgaagggtaggacggttgatttcaaaaatacgatcatcatcatgacctccaacgttggcgcacacgagattgccaagagcaaaatcggttttaccaatggcgaaacggatgatatggaacatctgaaagaatatgatgaaatgaaagaacgcatgatggaagctcttaagaatacgttccgtcctgagttcatcaacagggtagacgacatcatcgtatttcataagctcacggaaaaggatacacagcaaattgcggaactgatgcttggaagcgttgcaaaacgtcttcatgagcgggaaattgatcttacgtacacgaaggaggctgcgaaattgatggcaaaagacggtatgagcgaccaatatggcgcgcgacctctgcggcgcatgatccagcagacggtagaggatcagctttctgaggaaatccttgcaggtaagatcagtatcggtgataaagttaaaatgtatgtagaaaatggagatgttgcatttaaaaaagaaaattgatataatgtaacaaagttcaggtgcggcaaagcgc

SEQ ID NO: 19 - DNA, 45401 bp, Christensenella sp.
atataaatataattaatgcaatatgtatacaattatttttataaatattttttacttttttgtcgatgtattttttcttcctatttaattgacaacgcaattattgtgcagtagtattaatatggttttcgtaaaaccacaaacaagccatgccgcccaagcggcgtggcttgatatcgtatcatggtaaaatcagatacgtacgccttattcgtgccaaaccgccatgataccgttatattgattttgagggggcaatcttttgacaattattgcatttttaattttatttccctttgcagccgcgcttgttttggcgttcatgcgccggggcactcccgtgcgcaggaacacgctctttatattctgcggtgtcatcgttgctgcggtcatctattttgtggcgcaaagcctgtccgtgggacacaccgtgtcctatttgagcgaaacgcattcgctagacaccctgatcctcgtgatcgagtggcttttggcagcccttgtttgttattatagtttccgctataaaaaatactactgcgcgatcctgtccgtcgtccaaacagggctcatcacctggcttgagctgggcgtgcaaaatacggtcgagcccgccatgcatatctactccgataacctgacgatcgtgatgtgcctgatcatcggcgtggtcggctgcctgatctgcgtatatgcaatgggctatatgaaggattacaaggcgcaccactccgaatttaaggacaggcgttcgtttttcttcgccatgctttttgtatttttaggcgcgatgttcggcctcgtgttctccaataaccttacatggatgtatttcttctgggaaatcaccagcatttgctccttcctgctgatcggttataaccagacccaggaagcggtcaaaaattccttcaaggctttatggatgaacttactaggcgggcttggtttcgccatcgccatcgtttattgcgcgctgcaacttcatgtcgcggatttgcaaagccttgtagccattggttcaaccttttcatacgcggtcattccaatcatcctgcttgcgtttgcagggctcacaaagagcgcccagatgcccttctcgggctggctgttaggcgctatggtcgcgcctacgcctacaagtgcgctccttcattccgctaccatggtcaaggccggcgtctttttgctgctgcggctgtctcccgcgcttttcggcaaccttgcgggccttatggttactaccataggcggtttcaccttttttgttacttcccttttggcgatttcgcaaaacgatgcgaaaaaggttctcgcctattccacggtatctaatcttggtctcataacagcgtgcgccggcgtgggcatgtacgaagccgtatgggcgggtattttattaatgattttccatgcggtatccaaatccctgatgttcctctccgtaggcgcggtggaaaacagcctcggcagccggaaagtcgaagatatgcacggcttgattatcaaactcccgcgccttgcctatgtcatgatcatcgggatcgcaggcatgttcctcgccccgttcggtatgctgatctcaaaatgggcggcccttaaggcctttgtggattccaacagtgtcctgctggtcatcttcctgatcttcggcagcgccaccacccttttttactggacaaagtggctggggacgcttgtttccatgcaccataactccaaacccattaaagatatcaccaaaaaaagcgaatggttctctttgctgtgccacagcgttattatggtggccttgtgtctcaccttcccgcttttgtccacttatttcatcgaaccgttcttatccggtatgttccatattaccatgcctgcgatcatcggccccgggaatttgacgattatggtcatgatgctggccttgatcgcgctgctccccattatggtacgctttttgccaatcagcaaaaagaataccttcgtcctttcttatatgggcggtgccaacaccggcgatgaccgcagttttacggattcattcggtaagcccaaacagatgtacctcaccaactggtatatgaacaacctgtttggtgaacgcaaaatattgaccctttcgcttgtgctgtcttcggcggcgcttgtgatactcatgatcctgacgattggaggtgcggtataatgaccatgcagattattacaatgcttctatatatcgcgcttgcccctttcctcggcggccttttgcagggcgttgaccgcaaaatcaccgcgcgcatgcaggggcggcagggtcctcccatcctgcaaccattttatgatgtcagcaaactgtttaaaaagcaacccctgatcgtaaaccgtatacaggattttcttgtaattggcttccttctttttattgtgttcacaggagcgctttttttctggggcggcgatatgctgctcgtattctttgccctgacgctggcggaaattttctttatcatgtctgccagttccacaaactccccattcagcgcgatggctgcgcagcgcgagctgctgcaggtcatgacgtatgagccgatggtgcttctggtcgcaatcggcttttatatcgcaacaggcagctttggcgttgtcgatatcgctcatagcgatatgcctgcaatcacctacctgccgggcatcttcggtggattcctttacattcttacgattaaatttcgcaaatcaccgtttgacctgagtacatcccaccacgcgcaccaggaaatggtcaaaggaattaccacagaactttccggtaacatcctcggacttgtggaaatcgcgcactggtatgagaacattttccttctgggcgtcgtcggcctgttcgtcgtatacagtccttggtggagcattctcattgctattgccgtttgcgccttcgcatatttcctggaaatcctcatagacaacgtattcccgcgtgtcaggtggcagagcatgctaaaatccgcatggctcgtaacgcttattgcaggctgcacaaatttaatgatccttgtgcttgtaaaatagtacaattatcctaagagaggtaactttatgtccaaagtttcaaaatcgccgtggctccttcattatgatggttcaagctgtaacggctgtgatatcgaagttctcgcctgcctgacccccgtctatgatgtggagcggtttggcgtcatcaatacgggaaatcccaagcacgcggatatcttcctcattaccggcgggatcaacgagcaaaacaaatccgtcgtagagcaaatctatgcgcaaatgccttccccaaaggtcgttgtcgctgtcggtatttgcgcctgcaatggcgggattttcaaagagtgttataatattattggcggggttgataccacgatccctgtggatatttacgttcccgggtgcgccgcacggccggaggctatcatcgacggcgtcatcaaggccgtcgcccttctcgatgaaaagcgtaaggccatgccggacggcgaggcaaaggaggcataacatgcaaagcagtaagatattcaacatcgggccgggcagtttggtgtccgaggttctcaacctgaaatatgacggctggcgcctggtgcagatctgcgccacaaaaatcgaaagcggttacgaacttacgtattcctttgccaaggaatacgatctgaaaaaccttcggatgcatatcagcccggggacggaaattatgagtatcagcaacatctacgaaccggcgtttttatatgaaaacgagattcatgatctcttcgggatcagcgtcaaaatgatgacgctcgactatcagggcaacctgtaccggatcaaagaaaaaacgcctttcaaataataggaggaacacaatgtccacacgtagtatcgtacctttcggtccacagcatccggtgctgccggaacctatccatctggatctcgtgcttgaggacgaaaaggttgtggaagccatcccttccatcggctttatccatagaggactcgaaaaactggtggagaaaaaagatttccaggaatatgtttatgtagcggagcgtatctgcggtatttgcagcttcatgcacggcatgggctactgtgaagccatagaacgtattatggatatcgaattaccgccgcgtgcaaaatacctgcgcaccatctggtgcgagatgtcgcgtgtgcacagccaccttttatggctgggtttattggccgacgccttcggctacgaaagcttgtttatgcaatcgtggcgcatgcgcgaaaagatccttgatatgtttgaatattccaccggcgggcgcgtcatcttttccgtcaacaagatcggaggccagcgcaaggatatggatgcggacatgctcaaacagtttttggccgttttcgatgacatcgagtcagagttaaagcccctgtccagcgcattcctggatgattatgcggttgccagccgtttaaaagacgttggattgctgaccaggcagcaggcgcacgatttgggcgcggtaggccccttcatgcgcgcaagcggtatcgcgctcgatacgcgcaaacttgggtacgccgcctatccggaccttgcgtttgaacccatcacgagcgacgtaggcgacagctacgcgcgctgcgacgtgcgaatccgcgaaatttaccagtccatcgaccttatccgccaggcggcggcaaaaataccggacggtgaggtcgcggtgcccgtcaagggtatgccggacggcgaatacatgatgcgcgtggaacagccgcgcggcgaagcgatctattatgttaaggccaacggaaccaagttcctggaccgtatgcgcgtgcgcactcctacctttgcaaacctgccgggcatgctcgaaacactgaaagggtcccagtttgcggatataccgatcctgattttgaccattgatccgtgcatcagctgtactgagaggtaagacgatatgaagatcatgaactttaccaagaccgttttgcataacctgttcagcaagcctgcgacgcgtgcgtacccctatgtcccacgggactatccggagcggacgcgcggacagatcagcatcgacattgacctttgcatcttctgcgggatatgctccaagaagtgtcctactaatgctattacagttgatagagcgcagaaaaactggacgatcgagcggtttggctgcatccagtgcggaagctgcgtggaaaactgtcctaaaaaatgtctgcacatgcttacggcatatacgcagcccgcggcggaaaaatatgaagactgttacgcgcagcccatccctgaaaacgcggatacgccgcaaacagtgaaacaacccacaacggaaggaaaatgaacatgcacgaatatcatgaagcgatccatatcatagaacatgcgatagacgaagcaaaggcaaaaggcttcaaaaaggtcacaaagatcaacctggtgatcggcgaaagctccggtttttccggcgacagtatcaaaatgcattttgaagacgcggcacagggcacgatatgcgagggtgcggaaatttccgtgcgccccgtaaagaccatgctgcgctgcccaaactgccatgaactttttgtgcgcaagccgtttcatttcgagtgcccgcattgcaacgcgcagggcgaacccagcgaaatcggcaaggaaatggcgatcgacagtatcgaaggagaataacgaatgaccttggagatcacggtgctcggcatggtacagggcatcgggtttcgcccgtttgttgcgcggctggccgagcagcttggtgttacaggcaacgtgcgcaacagcggcggcatcgtaaaaataattgcaacggcagacgagaaggcgatggacgaatttgtccatcgccttgcttcgcagccgccggacttcgcaaatattctaaggatcgataaagagccgcttcccgcgcgggattttaccggctttcatatcgtaaaaagcgaatccgtcatgaatggcgcgcctttgattcctgccgacctgcctatgtgcggcgaatgccttaaggaacttaacgatccgcaaaacaggcggtaccgctatccttttatcagttgtacgtcctgcggcccgcgctacagcatcatgcaggccctgccctacgaccgcgatacgacgaccatggatgcctttcccatgtgtccttcctgcacggacgaatataccggtagtacgcggcggcggcatgcacagacgatctcctgccacgattgcgggccgcagcttattttgcgtgacgcttcgggtacctatgaaaagaagagagcccttgaccgtgcggttgcgctgttaaaaaagggagccgtcctcgccgtcaaaggcgtcggcggataccagtttgcatgctcgccttttttgaaagattccgtccacaggctgcggctcttaaagaagcggcagaaaaaaccttttgcggtcatgttccccacacttgaggatatccgtgctgcctgtaaggtcagtccggaggaagaagcgctccttacctcccctgcccgccccatcgttttgctggatgtaaaagaaagcgggtttgcccccaacgtatgcagcgagagccgtaaactgggagcttttctcccttatacgcccctgcaccagcttcttttggaggcgtgcggtcccctgatcatgacgagcggtaacatctctgccgagcccatcatcacgcaggacaaggatatgctgtctttagcttcgcctaatttaagtggcgtgctctataacacgcgcaggatctgcacccccttggacgattccgttgcgcgtgtctttgcgggcattccgcagcttttgcggcgcagccgcggatatgttcccctgcctgtttccctgccggaaaagacctcttttcccattcttgcaacgggcggcgacctgaaagcctgtttttgccttgcggacaaagagcaggcgtatctgagccaatacttcggcgatgtcgggcagtaccatgtgctgcaaagctacagcgataacctgacgcatatggaaagtctgcttggtatccgtccgcaggccgtcgtatgcgatatgcatccccgttactacaccactgcctttgcacaggagcttgcccatgcgcgcggtatccccctgttttccgtgcagcaccaccatgcgcatatcctgtccgtcatggcggagcacgacctgcacgggtgtatcggcgtagcgtttgacggtacggggtacggaacagacggcagcgtatggggcggtgaatttttactatgccagaatgcggatatggagcgtatgggccatcttgcgcctatccccctcatcggcggcgatgaaagcgcgcgcgatgcaggcctgagcgcattgtgccatttgcactcctgcggccttgcgagcagcgacgaacgtttcggaacggtcagcgccgccattgccggtgggatcaataccgttgcccattccggtatggggcggctctttgacgctgtaagcgcgctgcttgaccttaagtgttataatagttacgaaggcgagtgcgccattgcattggaaaattgcgcggcagatgcgcagcgtatgggcatcgatccctatccgcttcattttgatattgccgaggccggcggcgtatttacagcgcagcgttccactttgatacaggaattgctgcctgcccgcagtaaaacggatgtacgcgcccttgcgcttggttttcattacgcggttgcggatatgacgcttgacatatgcaaagcgatccgcctgaaaacgcggcaaaaccgcgttgccctgtcgggcggcgtgtttgccaacgaactgctcttaaaaagatgcgtatatcttttagggcagaacaattttgatgtatatttgaattctgccgttccctgcaacgacggcggaatttcttttgggcaagcctacttcgcggctttgtccaaggaataaggagatattattatgtgtgttgccacctccggtaaggtcgtttccgtcaacggaacgaacgctactgtggattttaatggaaatacgatagaagtacgcgcaggccttgtgcaggtaaagccgggggattacgtccttgtccacgcaggcttcatactgcaaaagctgaaccaggccgagcacgattcgcttcaggatctgtttaaggaaatcgaaggcttatgacggatatcaagcgctttttaaaggaatacgatgggccgcctgtccgtttgatggaagtttgcggcacccacacggcggaaatttcacgcaacgggatccccagtatgctttccaaaaatatccggcttgtttccggccccggctgccccgtatgcgttacggtgacagactatatcgacaagctggtcgagcttgcaggcgcgccggaccatacgatcgtttcctttggcgacatgctgcgcgtccccggcaaaaacggctgcttaaacgatgcacgggcagaaggcggcgacatccgcatggtttattctccgatggatatgcttgcccttgcccaaaaggaaccgaagcgtacttttgtatttgcagccgtgggctttgaaacgacgacccctgcctacgccctgcttcttgaggaggcgcagtcacgcggtatcggcaatatcaggttgttgacgtcccttaaaacgatgccgcctgtgatcgactgggtatgcgctcattcccaaaatatcgacggctttatcgcccccgggcatgtcagcgtcgttaccggcagcgatatcttccggcccctgtctgaaaaatacagcctgcctttttcagtcgcaggttttgacggcggcagtctcctggcttccatatatacgctcgtaaaacggcgcggcaaagcaggcgttttcaacctctatccgtctgccgttacggccgaagggaatatacaggcgcagtccatgataaaaaaatactttatgccttgcgacgccgcttggcgcgggatgggcgtcatttccggctccggcatgacgctgcggccggaatatatacgctttgatgcaggcagcgcaggcctcgaccttgaccatacggatccggcctgccattgcgcgcaggtattgaccggcggtctgcttccgtgcgaatgcccccttttcaataacgggtgcacaccgcaaagcccaaggggcgcatgcatggtgtcaacggaaggcagttgctatcaatacctgatcaacctgcgcagataggagaagggagacgatcatgaaaattacaatggctcacggcagcggcggacaggaaacttcccgtctgatcgatgatatctttgcaaaaaacttcaataatccggtgcttgcacgcatggaggattccgccgttgtttccggttccggcaggatcgccatgaccacggacagcttcgtcgtaactcccctctttttctcgggcggggatatcggtacgctatgcatatgcggcactgtcaatgatcttttgatgagcggcgcaacgcccaaatacctgacctgcggattcatcatcgaagaaggcgcagacgtcgcagaccttgaaaaaatcgcggcttctatggcgcaaacggcggcagaagccggcgcaatcatcgttgcaggggataccaaggtgatcgaaggcaacggcggcgtttacatcaatacctccggcgtaggctttgtgcccgtagggcttgagatcagcgccgcgaactgccggaaaggcgatgtcattttgttatccggaaatctgggcgaccatcatgcggccatcctgagcgcgcgtatggccatccaaaatgaaatcaaaagcgactgcgcgcctttgggggacatggtctcaaatatgatgcatgcaggcgttcaaataaaggctatgcgcgatgtaacacgcggcggccttgccaccgtcctgaacgaagtggcgcatgcttcctgttgccggatcgaactgaatgaaccttccattcccatttccggcgaggtgcatgctttttgcagcattctggggctcgatcccttcacgatggggaatgaaggcaaaatgatcgccgtcgtcgcagagcgggacgcacaaaaggcactgtccattatgcgcaacagcaaatacggcgaaaatgccgcgatcatcggatccatatcgcaggaagcagacgcttgtgtcctgctgcatacggagatcggcggcaccagattattaaacgggctggttggcgagggacttccccgcatttgctgaacatgcgttcattaaaaataacagtggagacaatctatgaaacatacaacggaaatacaacagttttttgacaggcttgcaggcacatgggacgcgcacaaccgtgcggacagtaagaaactgcgatctatgcttactgtcgcaggcctcaagcagcaggcgcgtatcttagacatcggctgcggaacgggtatccttttcccttaccttttggaagcaatgccggagcgcgtcgacgcaatcgatttatcgccccaaatggtatccatcgcccgtaataaagcggcagacgaccgtattcacgtgcgccatgccgacttttacgatctgccggccggcccttcttacgatttggctgtcatctataacgcctatccccattttctcgataaagtgctgttcgcggaaaaattgcatgatttactggtgccgggcggccgtttcatgattttgcacggcagcggacgggacaccatcaatcacgtgcataccggacatgatgtctccgccgtctctattcccttgcggccttgcgcgcaggaagcaaagctccttggtcattatttcgatatcgatatccgcgtggatacagaggactgctatatcctgtccggtacatccaaggaagcggcctgcgtcgtatatttagatgcattataaatttaattgcaacaatataaaaaggactgccgacggcagtccttttttaaagtacatttacaaaaatatcaacttgtgaattcctttaaaatgacgctgaccgccatcgcccccgcatccggataattcagactcctgtccccgacatacgaagcgcgccccttggacgcgaccatatccttggtggcttccgctcctgccgccgcatttgcggccgcattcataaaagcttctttgatatccaaatccttttgcgccgcatcgcgcagagcttctgtcgccggaatcagtgcgtcaagcagcgttttttctccctgcttcgcgccgccgcgcttttgaatccctgtaacggctgcttcaaaaatacctgctatatcgttaagttcaagcccgtccttgccttggacgctcttggatgctgcgcgaaacccactgccccagatcggtccggacgctcccccgcaatattctgtgatgatcagggcgcatcctttgataaatgctgcgatatccgtatcgtcgatctcgttaaattgcttcttcacttccttgaatccttttgcaacagacatgccaaaatccccatcgccggccactgaatccaattcgcaaaaataaacttcgttatcgataataatatcgcacaacctgaagattgttttcttgacttcatctaatgttatactcatcctttgcctccttttcagcggaataacgcaacatccgtatgttccatcaaaaggccttccagttcatcatccagctttagcaacgttatggaagcgcccgccatatcaagcgaggtcatataatttcctactaaggtttttaccggtctgatgccctgttccgccaaaatttgctgtatatcacggttcaacacatacaattccatcagcggagtgccgccaaggctatttaccataagcgcgcagcgatcattttccttcaattccaattcgccgcttagctttttcatcatcctctttgcgagtgaagccgaagtttcaattttacaacgctctattcccggctccccgtgaatacctacgccgaattcgatctcttcatcccccatttcgaatgtaggactgcctttggccggtactgtgcatgacgtcagtgcaaatccaattgactttacgttcttgatcgtcttttcagcaaccctttttacctcgccaaggtccatgcccgcttctgatgccgcacctgcgatcttatggacaaataccgtaccggcaacgcctctgcgtcctgtcgtatacaagctatcctgcaccgcgatatcgtcgttcacgtacacgcattccacctggatatcgtcatcctcagccatttcctttgccgcttcgaagttcatgcagtcacccgaataattcttgataatgagcagcgttcccgcatcgctttgcgtttccaggatcgcatgatatacctgtatggtcgaaggtgaggcaaaaacgtccccgcataccgctgcgctcagcattcccttgcccacaaatccagcatgcgccggctcatgtccgcttcccccgccggaaatcaggcttaccttggtgctatcaagcgctgtacgcttcacgatcctgtatttgggatcaaacgtaagctccggcctgccgtaaacgatcccctcgcacatctcgtttacgatatcctcgatcttgttgatgatttttttcatgcgtaagcaccgccaatctcgtccgccgtccggatcgcagccgcaacgtcctcaggcgtgacctcaaaaggcatattgtccattgtctcgagatcggaacaagcatgcgttgcaacctgcatgagccgctcatccgacaattcttctacgcccagttcctttaaacaaacgggtaaacaaagcgatttgcaaaacgaaagcaccgtatccagcgtttcctgctttgcattctctaaaacaagctgcaccagtgtcccaaaagccactttttcaccatgaaaatagtgatgcgtttcttcaaggaccgtgagcccgtcgtgtactgcgtgtgcggctgcaagaccgccgctttcaaatccaagaccgctcaaaagaatattggcctctatgatattttccaacgcaggcgtgactacattttggttgcacgcggcttttgccttgcatgcgtcttcaagcagcgtcgtatagcatgtttccgcaattgcagccgcagccttcgtactcatcccgcccgacatattcggtttattcgctttgatacatgcgcgtgcttcaaataccgttgccagtgcatcgcccattcccgaaatcaggaagcgcgtgggcgctttggcaataatctgcgagtccaccagtaccatatccggatttttgggtaaaaacatataccgttcaaattcccccgcttcggaataaataatggccaatgcgctcgtgggcgcatccgtagaagcaatcgtcggcacgatcatgaccggatacttcgtaagtgttgccgtcgcctttgccgtatccagcgctttgcctcccccgagtccaatcacgacgtccgctccttcttttttcgttaactctacaattcgttcgatttcacggtcgcatgattcaccgccaaacgctgcatgtataaagggcgtatcacaaagcgccggctccaaaatatcagccacccttgcatagtcgtccggatgtgcgacgatcattgccttgctccccaattgggaaatgtattttcctaagtttttcagttcgtcttttcccaatatgaattttgatggggaagtcattatccttgtcatatccttactcctttttattatatttccgctaacattactgctcaacggaatatcatacattatattcataaaccgtatcgcaaaactctgttacagcctttatttcctgcggcggataaatatatcctgcgacggaaagcatcggattatataccctcgtgatatcaatcatcccgtacttcttgccgccgatctcctttgtttccagtcgtccgcttacaagcaccgcgcacatggagggatattcgatcgcatagatcgcaatagccgttccttccttgatttcactcattgcctcgtcgtattccatagaaaatactgcgcggttcgcctgcgtgagcaaggcctgcggtacgggcagcacgaccggatatccatcgtttccaatatatgcaagcaccttgaatccattgtccgcatccatgtattttcttgtgagcacgctgattgcttccggtatattgccctcgcctgcctgcggcagcacctgccgcgtttcttcctttgcctgcttgtattgcccgatgtccagtgttttttcgctgatactcttttggtgcaatatatgtgcaggcgaatatccgtttacattgttataacgaaactccggaatttgattgagagcgtccagcttctcgccgcttttctcgcttcctatccaatccgccttacccaataccgcctctgttccgttgatcacggacaaaaaaccgatttcatggcgttgctgctggttgcgtttggattgtcccgccgaatattcaccccatatcaatgtgttatcatcataaatatgcagcgatgtcagcatggtaatatggggcgtcaggtcctcatttaccgttgcatagaagtctatttgttcttcatcatgcctgtatgacgtatttaccttttgtattgatttcatggttttctcctatcttgcatcatgcttcagcctgctgcagcgtttccgttttcattgctcccgtccacattaccttttccggatcgacgccgctttttagggcaacatcatataactcttccattttttcctgtttgataagagcgatatcgttcagttgccattccatatccaggcggtcgtatttatccttgcataaattgttgaatgcaagtaactcccacctttgtaccaccggctgcaaatactccgtaataaactttccgatatacaggatattggcttccgtatctgtgatatgcggaatcaccggcgttctgatccatagcttggtatcggggtgtgcattgcaatattccgcaatatagcgggcatttttgaggatgatctcattgtctacgttcgtatatttttgatgcatttgctgctcgaatatcttgaggtccaaaagcacaaggtttgtatacggcaggacgttttcaaatacgtcctgccgtaccaagccggccgtatcaagggccgtatgtatcccttcttcccgcagccgtttgaaaaacgccgtaacaaattttccctgaagcaggcattctcctcccgaagcggtgataccgccatccaccccaaaatagtttctgtctttcaacacctcataaacgaggttattaagctcccactgtgtcccttgcacttccattgcgagcgtaggacatttttttacgcagtttccgcaggtaacgcaggtttccctgttgatcgaaaatcctgcttcgctgttcctgatgctatgcgttggacatgcctcaatacatatgccgcatcccatgcaccgcgacgcataccattcgatttgctttttgggcgacaggctttccggattatgacaccagatgcaacgcaggttgcatcctttgaaaaaaaccgttgtacgaagtcccggtccgtcttccgtagacaatctctggatattgagtatcaatgctttgttgtcctccatgtcccttgctctctttcctttggattttgttaaaacttctggtggctttcgcgcgcaataatttcattctgcaattccttgccaatagacgtgaaataggcattgtatcccgttacgcgtaccagaagcgtgctgtaatcttccggatgttcctgcgcatctttgagcatatcaacatccagtatattgatctgcagggctgtcccgccgttttcgacataaccttttaaaaacgtcttgaattttttcttgtgttccggatcgcgtagtacggtcgggttaaaggtgatcgtatggcttgcgccgttgggcaagctgtttttatagtgctcaaaatcccctgtttcccagtcttttcctcccagcgccttaccgacggaatttgtgtttgccgtcggaccgcccgtgtccgctccgttggacggacagatcgcgtttgacataaactgtccgcgtttcctgccgtccggtgttgcaaatgtaatacctgcataggttacccaatagttccagctcagcattcccgggcggaattgttcgtcgctgccgaccgtacggtatttccagcattctgtcgtccataaatccatgatgcgttttgccagtgcatccgcttcatcgtcatccctgccatatttgggcgctttgtttttggcgatggcctgcagcacctcatacccttcccagtttgcctgcagcgcagtgaccagttcttccatcgtacagattttttcatcatataccaggtatttcactgccaagagtgaatccaccgttgttgcatatgcgacgccttcgatcgtgcaaaaccgcagctccgcgccgcccgcgacaacatcttttccccgttctgcgcatccttttaccaatacggacagaaaaggggtagggctgtattttgcgcgcatcaggtctcccaagttataaagatccacgctttttttgatcacaaacctcatctgttgctcaaacgctctgtaaaattcttcgaatgtcccaaactcacgcggatcgcccgtcttcgggccgtcctgctctatagggtacggtttacccgaaaaatcgtaatggtcgacaatgtcttttccatttcccagcgccagctcaaccgcttttgccaacaccacattacagttaactgtttcagacctgtcgttgccgaccatcgtgttttccatgcatccaaccgaggcgtattcaaatacattgtcttcgttgatgaggtcttctacatgtccctcttttgcctcacgcatcattcctgccatcgcccgttcgtcaaaattaatcaggaagggcgccccctgactgtggctgaccatatctactaccttatcgagtacggcatccggcgttcccctgtgtagccgcacattcggcttgggctccaacataggagtcatatcgtcgatcacttcaaacagcgccattgtcaggtcgtttgaaacgtcaacaccacctttacccgcgcctgagaagttgaatagctgtccgtatcctgctgtgatcccctggttgcatcctacctgtattgcggcgtcataagccgtattacaatgaatgaaaaaacattttaggatttcttttccgaattcgcggtccatgccctgctcgatcgaccttttccaataggggtaaagataacggtcgatgtttccaaacgatgtgcctgcccccgggtaattttcatccgccatgatcagcatatgcggaatccaaaggctgagcatagcttcccagaaattcgttgccggctcccacggtacacggcgcagcattttcgccatttccagtagctcttttttgcgttcctccgtgtttgcccgcggcgcgattgtttcgcagtggtcggcgtatttttccgccagttccttccccatcaggcatgaagtcatcatcgccctaagctgtccgccatgttcgcctttctgctcttcaggcggaagctcgctcaacagtttttcataatactcgtattcactgcgcagtccgtaatcaataatcttttgatgcccggggatcaaatgtcctgccgcaggccccagattgccaaagcccctgttattatattcatcacatcgcgtggaaaaaccgtcctcgccgcgcagcatcttctcccgttcttcggtctcttcttttgtcaggcaatgtgacacgcgcagattgaaacgtcctcccgcgatcaggtcgcccgggaatatctctaccggcacatgccttagcatcacttctttgttaaaccatgctttgcgttctgctatcgtctgtccgtaaaaaccgtccggtacgcgcacgacatgtgaaagaccgatctgcttggcagaatcttccgttaccctatatcccctcacctcctcataggtgatggtattgatcgtcatatcgtacagaagatcccacgattcccctgtagaaaacgaaagatattcgttgttccactcccgctctctccctttgtagtaaaaatcacgcagccatttgattctgggtgaaaggttttttggttttttcagcatatccaaggtgtttttttgtaccgacattttgcttcactccttacttttaaaatttaagatgcattccgtttcccgttagaaagaatgcatagcttccattacgcctttttcattgaaatcgttgtcctgcctgcctatttccgctgtaaccttgcctgcgctcagcaccaatatcctgtcgcagatattgagaagctcacgcgtttccggagaaaatacgatgatacctttcccctgcattttctcactgatcagaaggttatatatttcatttttggccttcacgtccactcctctcgtcggttcgtcaattaagatgacctgtgcatttttgagcagccattttgccacgaccaccttttgctggtttcctcccgataaaaactgtacggactgtttgggccccgtcgttttgatctgcaatttcccaatatattcctgcgtcgcatcgagcagttttttgcccgagatcacgccgccctgcttcattttgtcaagagaagcgacggtgatattatcctctacggacagcatgattgccgcgccttctttctgcctgtcgttggttatcatgccgatccccttcgagatcgcttccttgggcgtagccggcttaatcgaaatgccgtccttcaatatttcaccgccgtccggctgcaacacgccgaatatagaaaacatcagttccgtgatccctgatcccttcagtcccgcaaggccaatgatctcgcctttatgcaaacgaatggagatattttcatataactcgtccttactcaggtttttaagctccagaaggatttccccctgatgtccttccagttccttttcgctgtactcgccttgccagccctccgtttcgcccagcatcaggtgaatgatctttttttcgctcaacggttcttcacgcgcgacaaaggttcctacattttccccgtcttttaagacaacgacttcgtccgagatcgcgacgatttctttgattttatgactgatataaatgattcccagccccttttcacgcagactgttcaccacctcgaacaaatgctctacttccctttgattgagcggcgccgttacctcatccagaatcaggattttaggattcatcagcattgctttggcaatggatacgactcctttcccaaccagggaaagattctgcacgatctcttccacgtcaatattaaagcccaggtagctcagtacgcggttactctcttccctcattttttccctgtcaagcaaacctgattttttgacgatctcgcggtttaagaaaatattttcgtatacccgcatattttcacacagagtcggttcctggtgcaccattccgatcccatgcacttccgcgtcgttcgggctgcgcatatcgacctgctccccatcgatttcaaccgtcccgccgtccttgccgtaaattcccgcaataatgttggaaagcgttgatttccctgcgccgtttgtaccaatgatcgagatcacttgtcccctgtccagtgaaaagtccaccttccttaataccggtacgcccaaaaaacttttctctatatccttcatttcaagtaattttttattcatcttatccacctactgaaattttcatattttaccagcgtatgtcatacctcgatgattttcagttctttcagccttctgctctcattcttctgatgaataattgcaatcactacgatgatacagcctgtgataaacaactgataatatgccatcaagccctgcatgtttaaaatgttcagcaggattgcgataatagcggttgcttgcatcgtacctgcaatgctgcccttgccgccggaaagcgcgatccctccgatgatggagatggcaatactgttcatatcataattgcccttggtcgcctgtgtgatctcgatcccctgcaggcgggacatggacataatagccgcaataccgaccagtaacccgcacaccgcataagcaatgattttccatttatccgtactgatacccgaaagttttgccgctttgaggcctccgcctgtcgcgtacagcctcataccgaatttcgtccggctgcacaggaacaggatcacgagcccgattgccacgaataccagcacgctgatcgggacaacgttcccaatactggcatttcctatgaacttggatgcttcgacatctttgatgaaaatcgggattccgttggaaatgatatacgaaacgcctttgagcaaaaattgcatgcctattgttgcaataaacgccggtattttacatttggtaacgatgagtccgtttcccaatccgacaatcaccgcaaagacgagcgtcaagataacgaccagttcccagccgccggtcataaatccggattttccctgtaagatacccgcgcctgtcgttacctcatataggatactcgcgacattgacggcaagaatcggtgcaaataccaggtttgcacccacgctcaaatcaatttccttggaaatcagcaccaaggattgtccgatcgatatgatcccgttgagcgtacatgcaaataggatgacttgtatattcataggggtcagcagattcggattgatgagccaccccacaaaaatttcaataatcaataccaaaaggagtaggtaccttgacagaaatcccttcctgttattccgttccatctttttttccatcgtcatgccgcccccttaagattccttgagtacgcctgtttttctgttaacaagcccgtatataaatacaaccgcaatgatcagaatgcctttgatcgccatttccacataggttccaagtccggaaagagccagcatgttcatgaggatgcccattgtaaccatgccgcataatacgcctaagatagaaccccttccaccgtccagcgaaacgccgccgagtactgcgatcgcaatggcggtcacttcctgtcctgttcccgcgtcggcgttgcttcttccgatctgtgttgtaataagcggccctgcaagcgctgccagaatgccgcagattacgaatacgatgattttgacgcggtctatacggataccgctcatccatgctgcgcgtttgtttgcgcccgtataatagacatctttaccgaattttgttttcgtggtaattgcccagaacaccagcgccagtacgacgcatagaataaaagtaaccggtataccgcccaaatctcctttggacattgttgtaaatatggggtaggccgccgtcatgaacttcgcctgcgcattggtgataatacatgcgagaccggaataaatagacattgtcccaatggtgaccatcagcgatggaacacgtattttcgcaacgatccatccgtttaaaaaaccgcaggccgcgcctatgccaagcatcgccaaaatagaaagcggctcgttaaaatcgacaatctttgaaatgaccatgacgcttaaggacataatcgccccgaccgaaatatcgatttcccctgtgagtaatacaagtgcaagcccgatggccatgattcctgccggagaattcacccgcaggacatttgccagattggtgggctgaaaaacattgggtaccgcgattgcggcgaatatcaggaaaatgcctaatataatgattgatacgaatattccgttcccactggataaaagccgtgaaatgctattgttcttttttcccattttcttcttcacctcgcgccatcttgaaccgtgatgcatttgggctgccgccccctctttgccggggagggcggcaatcccattgctatttcagagcttttatgcttcgtaaggaggaccaaatgtatactggtaccactgatccggcttctgtgtctggagcccgaatatcgttgctccgtctgccgttaccatcgggatattcggcgttgcgatatcctgcggtacatcttcacccgccaggattttgatcgcagcccgcagtgagatatcaccaattaaaggagtgtatggtgcgttcatctggatcccgccttcatctatcatgctgtatacttctttcgagtcatcgatagacaggatgatgacctgttttccgccttccctgctgtttaagcgatccgcttccttacacgcttcgtatgcgactgctgctttgttgcaatctccgctgaacacagcgtcgatgttgtcatatgcctggaaagcgttttgtgcgttcacgtaagattcctgcctgttatcctgatcatgataggactgcaggatattgatgcccgggaagtagctgcataccttgagaaaatatcctgtacggatcgtatccgcagtgcttcccgccggttttctcagcaatacgacattcgccttgacttccttgccttccgtttcctgtgccagcttccacaccagatacataccgttctgtgcgccgtttgcagggaagtttcctgtaatgcggcacgccacgtcagagtaggacgtgacacgatcggatgtgataacagggatccccgcttcttctgccctttgtgccggcggtccggacgacgcttcaatcatcggccatgtcacgatcgcatccaccccctgggcaatgaaggtgtcaaattgggacgagaaggtattcatatcaaagttgtagtccatgtatacgacttctacattgctgtgccgttctgcttcatacatgatgctgtcctgatagttgccgatccatgcatcgttaaggccggacgataccacgccaatcgtatatgtcttgttcgggtcgcctaccggtccttccgcgagcggcacatagtcgtcagagaaaggcagctttaagctgtttcccgtgaagccgccggtgatctctgtccccatgccggattgccattcaaatccatcatagaattcgcctgtcggataggcctgcgcatatgtatcgagtccctcttccagatacatgtcatggatctgcttgtttgcatcggaaagcgggagatcgatgaagaactgaatgatctgtgcatccgacaaccctttatctgccagcccctcaaagaaagccagcgcttcgagatccgaaagtttggatgcttctgccacaagctgtgcgaccgcatcgtcccctgcagctgtttgctgttccgatggctgcgctgccgtgctctctgcaacaggttccgccgtgctggtcgcctgtgactcactcggctgttcgcttgcggacggcgtctgctccgcgggtgcgcatcctgcaaataccagtgctgccgttaagcatattactacgaatgtgcttaacacttttctcagtcttttttccatatttgttcccctttatcatttatttgtggcaaatgtgccacgaaactaaaatatactatgcctgaatatactgtgaacctgctctttcgtttcacctggtatcatttaagttttactctgaaatagtccggatatggcttgttgcgttttggattatcctcatcatacgggatcgccaaatgaaagtcattaaactattttgtttacgaatatgaaaaaaaacgtcaaaaattttagcacgaaaatcgtactatttagcacatattttttactgttttctgtgcttatcctgttttcttgtttaaaaatggtgttttcttggaatatcgtggtatttttgtgtaaaattatttaatattaaatgcaaattcgtttcattgaatctaaaaaacgcttcggtatataatatatttattccctgaataacaatatttctatatttgattttttgtcagtaggtattgcaaccactttttacgaaggagttttcgtatgcctcattttaacattatggatattttcaacactgccagctttcaaaaaatgcaggacgacattgccgcatctgtgggactcgcgttgatcgcaacggattatgcagggacacccattacgcagcacagcttatgcacacgcttttgcgcactggttcgcgaccacccctattataaaacattatgtgaacgctgcgattcacgcggtggcctggaggcggcgcgtacgcgtactccttatatttatacctgccactcgggtattgtcgattttgcgataccgattatatataataatgcgtatctcggcgcaatcatggccggccaggttttacttgatgaccataaaaatgtcagcggtctggaacagatttatacggacaatagcgtcgcgccgctgaaagccggagaatattacgacgcatatctcgcgctccccaaaatgagccttgaaaaaatcgtctcgatctccaatatgctcttctcagtgtgcaatatgtttctggaacttgaggtcaccaaactctcggatgtctccgctcttcctgaaaaaacgcaagacgaattgcaaccttccgtgccttatataaataaaagtatccttgcgcccgtctatgaatatattgaaaaaaatattttcgacgatctttccttaaaccgcgtatcatccgcctgtaacattagcgctaattatctgagccgcttgttcagcaaattgaacaatatcaccttttccagttatgtgaaccaaaaaaaaatagaatatgctcaaaggctgctggtttcaacagatatgtccgtaaatgagatcgcatctcatttcggatataatgattgcagttactttatcaaagttttcaagaaagaagtcggcctttcccctgctaaatacaggcagcaaaatcaatagccaataaaaaagccccgttccattggaacaggacttttttatttaccagatatcagccgtcggtatgatcttcatcaggcacaggtcatctcccgccttgatactcttcagaagttcaaccttgacctcgcattcccacacgtcttcaaaaagcttcttactgtatcccatcgtgcaatagcaccatgtcttcgtttccagcctgtcgacatccgcaagcatggggcaggggcaatacggaaaactcaaatacaattcaccgttttctaagaaaagccccgcatgatgtgctttttcattatcggcaaactcttccatattacttgcagattcataaagctccctaacaagggcctttttctcctccatgccatatccgcactggcaatccatcctaatgcggatcaatgcctcttcgtcaaacacttcttccatttttcgcatagtttcgttgacccatatccagtttggttcctcagctccggtgccatacacgatcattttggcagttgcttcattgctcacagccttaatgcggtcaaacaaagcctgtttttgcatcttattaatatcaaacatcatttacctcgttttttttacctaaagttgcgtacataaagatactgcaaaccatcaggaaatgctgcatttttgcaatagtcccttttatgtaccgtttgttcataatatttgatattaatgaaagatcggatccagcataaaaaagccctttcaaacaagattgtgtattagtctaccacaacagtttaaaatcgtcaaatccaacagttgaacgttattttttcattatacgcctatcgcgtcagccaatttttcgatttccgtatacatttcttttttttctaatccaagcttttttaggacatccaaagcctcgcttacaaattgttgcgcttcgtgtttttcaccattgctttccgaaaggatagccagcttcttgcatgcgattgcatactccatgttttttccataaaattgacttgtcaatttccgcgaacacaaatatgcttccttggcagatgttttatctccttgcttcagttgcagatcacccattgtgttatatgctgcagccagatgtattctgcactcttccggtaaagcagcatatgcctcaactgcctgttttaaatactccatcgcctcgccattcattccctggcacataaaaagagtcgctatattcgtcagcgcgatcgctttctccggaagaagttcttcatggtttcccgttaaatccaacacctcaaataatgccttttttgcttcactaaacttgcccgtttctgtataaagcaaagcggcgttattcagagcagaagcatatagataactttccttacctgttgtccttgcataaactccgagcgcttctttatatcgttccaacgctttttctctctctccgcccaatcggtaagcgccagccaggttgcttaccaccgtagcatattcgggtgtttcagagccacaaagcgttgcgacaaagtcccttgcaacctcgaactgatcaatggcttgcgtaatcttcccttggttcaggtatagggaacccagttcattatataccgccaactggacatcgtccgtcttgccgcaacacaagaaatgacactttgtttgatccagcaaaaaattttctacttctttcgggtctcccgtcctatacttttcttccaattcctggtagaattcatccagcatctttttgctcctttcaaataacaagtaaaagagggaacgccctgtttgatcagagtattcaaatcaccaaaacagtgcgttcccttttcatttttgcagcaatttcaatctatccggtctgctatctcacttcttcaaactgtgtccgtgaaataagctcgtcctgcacgtccctgccaatctctgtgaacagcgcagcatagcctgtgatacgaaccataaggtctctgtactgttccggcgtatcctgtgcctttctcagagtcttgtgcgacgtcacctggaactggatctgcgcgccgttgttacggaagtaagatttaataatctctacggaatcctccagtgcatcgtctgtagaaagcgcgtcaggagaaagtttgacgttaaagatgatcccgcccgttgcctgcgtctggtccagtttggatactgaattgagcattgccgtgagtccctgcgtatccgatccttgtgtcgggcatatgctgtcgctgcaaggggtcgttgacagtctgccgtccggactcgccccacaatatttgccgtaagccgtattggcggaaaccgtcaggtatgaaggccacatagagcgcggaagttcaccgccgcgcgggtctttgaattcatgctccacgccgttttcatcaatgtatttctggctcaattcatacgaaaggttcatcatgtccgccgtaatttcatctacccagtcgatgtcattgccatatttatcaacgttcagcaacacctggcgcatatcttcatgtccttcaaaattcaccctgcatgcatccatgacttccttgagcgtatactttttatcatcaaagcatacctttttgattgccgcaagggagtttccgacgtttgccatacccacaacgccgatcatggacgtccaatagtattttgcaccgccgtgccaaatctctgtcgccttttcgatacaggttccgtttgtgaccgacatccatggaaggggcattactctctggtggacgttcacttccgtgttcatgagaaccgacgcttgtttgtaatagtagcgcatctgcgtttcatatgccttgatgacgtcgtcgatcgatttgaaatcttctacttcgcctgttttcgggccgaattgctgacccgtgagctgatcgcggccattgttaagggccatttccaataccttgaggtcgcttacccaaatcatgagcaggcttgccgttttacccggcaattgtatttctgaacatcctgccaaggaataagtgcgcgcctcatccatgggtactccgcgcgccagtatcgactttacgaactgctcgtcattgatgatctgcggaatggcgttacgcacgctgatgacgcgcatcgcttcccgcaggaggttatcgtcgcacttattgtgccagcgcaccgacatgttcggctggaaaagtcctacgtccatttgtgcctgcaggcagacatacgataattcgttggtgatgtccctgccatatttatccgtaccgccgatactcaggtgttcgcccatggagaagtttgcaatgaacgttgcctgctgcgtgtcgtaaagaatgaccatctccgccaatttgatgtagaaacagccgaggtattccgcaatggattcctgtgtttcaatcccttcggcaatatctttttcatagtacggaagcatataacggtcaaagttgccgggagcgatggaaacaccgttcgcttcgagctgcgtgatcagttccgtaaaccatacaaactgcgtcgcttcataaaagttacgcgcgggattctccggtacccattcacatgtttcggcgatcctgatcaattccgctttgcgcgtctcatctttttccgcttccgccatttcacgcgctttggcggcatacctgtgtgcaaaggcaatggcagcgtctatactgatgatcatggctttcaagtcgttcattttctgaacgccgtctttgtcgcatatatcgatggacgccaaaaccttctctgcctgttcgcgcttgcctttgagtcccatcttcaaaagattttcgtgatccggtacatagtgtcccgggccgttgccgaatgcgcaccatccgttgatgacctggttttccgcgagctggtgacggcgtgtttccttaggcagcgtctttagcatgttggaatagagacatctttcctcccaataaggaatgatatcttcgagcaactcctttttcacctcaggcgtaacaatgaacctgtctgtcgcacgcgtttcgaattgatcgatttccttcttgataaagtctacgcgcgactccggaaaaacgctgcagctcctgtttgtgacgccgctttgcgcgccgacaatgagttcgccatcacggatcgcacaatcgaggccttccataaccgctttgaaagcaagcgcgcggcgaatcaccatgggttggccttccgtctctttgtaagactgtgtgacaatacgcgccctctgtgtgtccacatagaatttgtcttctaaaaatctctttttaagggcgttgatcctcggggtttcttcttctcttttgcgtaccttataaggctgttgagtgaataacataatcattctcctttcactgcgtttgattatttatttttgaagtaccgtcttttcttcaccggcggcacaatacgttattctgtaacgatattgattcctaaatccctgaaatattgtttattctcttcatcctgttccggcggattagcttccagatctttcaccgcataatccatacccagttcttcatattcatgctgtcccaacttatggaagctcagatatttcaagtcgctcaggccgacgcttttcataaactcagccatcgctttcatgttctctttggaatcattgaggcccgggatcgcgggcaaatcgagtacgatcctgcacagtccggacgctgcggctcgtttgatgttgtctacgatcttatcattcgataagcctgtcaactccttatgccgcttcggatccatatgcttcaaatcaatgtaagcgatctttgcctgcttcaaaacagcttccaacttatcccattctccatacccgctcgtttcgatacaggtatgtatgcccgcatcattgcaaaggcgcagtatctctgccgtaaactccgcctgcatgagtacttcaccgcctgataccgtgattccgccgcccgtagatttgtaataggaagaatccctccgcaccacggatacgatttcttcggctgtcatttccgttccatccatacggatcgcctgcgacgggcatacctcagcgcattgtccacaccttatacaattttcatatacaatcctatgtctctgcccgctcatatcaatggcaccgtgtttgcaggcgtccacgcactttccgcacccgatacacttcgataccaaaaataccggccccggctgcaagctccacgtctgcgggctgctgcaccatctgcagcgcaatgggcatccctttaaaaacacggtggtcctgattcccgggccgtcatgtcttgaatatctcctgatcgttgaaacataccctttcatagttgcacctccctcatctgactgtctgttttacttttgcaatttgcgcaaacgtttgctagttttatgcaaacgtttgctgagcggttaaaaaaatttaaactcccctacatgtttttctaacgaccaactcggtctcaagaatttcgctatttgtttccgcattctccggattctgtattttgttcatgagcatctgtacgcttgcctgccccatgatctgccttggcatgcgcaccgtcgtcaactggattttatccagggacgcataagaaatatcatcaaatccaataacggatatatcgtccggaacgttcagcccgaattcctcgatcgcctggatcacgcccagcgccatgatatcatcccctgcaataattgccgtgggcagttcattgttgatcagcagcttttttgtgagctcatacccgctggattgcttatattctccatgcaggatgtagttgggctgaattggtagcccatgctttttcatgaccgccttatacgcattgatacgctccatattggcggcattcgtctcaagcccccccatgtaagcaatctttttatgtcccagctttatgaggtattctactgcggtagtcgcgcttttaaaatcattaaacgccacataactgcaattttcgttcattggcttatagttggcaaatacaatcggaattttgatttgtgcgtttataatatgtgatatatcgtccgatacggggaaaataatcactccgtcaacgctgctgccataaagtttatgcaggcattctttttccttttcgacattccagccggaattgcataagtaaaccctgtagccatagccgtttgcgcattcttcgattccctggatcgcttccggaaagaatggatttgtgatatcaggtacgatcaaccccaacgtataagtattctttgtaaccaatccctttgccagtgcgttgggcgtataccccatttcattcgcaattttcagtattcttttttttgtttcatcgggaatctggggctgtcctgccagtgcgcgggataccgttgaataagaaacattcgctgcctttgctacatccttgatcgttacgcgcatttttttcttcgccccttatgcaaacgtttgaataacttttcttcactataccatgcataaattccgatgtcaacccatttgtctgatattttatcgtattttccgttatcacatccccttctccgcctctttcagactggcgtatccgtaatcccgaaccatattctcaaaaatcatatatacgattttctttttatccttttcaagttcatgtaaatattggagatatgactgcactgtctttgtagaatacgttttgagttcccccttcagatacgtttcaatcgatgtaaaatatgcgtcgtcctctgcatgcaccggccttgtccgtctaagaaacttggggtattccttcataaagcactctgtttgcgctaaataaataaccgctatctcttcaatataagactgtttttccggactgaccggcgtcagaagccctgcaatcgctttgaattcctccggcgaggtatattccatcataaacccgtacttttcgctgaccaggtttctgccgttgttctcggctgtctgcagatcatcataataactgcttaaggtcttttcatcccacgccataaactgcgatctccgcataatatgaaacgtcgtatcgtcatcctgacagcttgcgcgtcctcctatattgtttaccgcgctgaacatatcccattcttttgcgatgattttttccgttaattcctgcttcgtcatagccttctcctgtaacacggccggttactgcgcgttttggtgcagcgtaacatcatgcatccaacctttggatgtctggtacgcttctacatatttttcaaaataaaacttgtatgcctcgtgcttttcacggtttggttcaacgcggcctttgatggtgaccatattctctgcggcagttactatatccctataggccccgcatgctaccgcgccgaggatcgcgcttcccagacaaggcgcttccgtcacctttgggatcaaaataggcaggttgcacacatccgcatgcgtttgtgtccaaaacgcgctctttacggcgccgccggatatatagatcccgtccggtttcataccgccgttacggaacgtctgcatgattgcctccgtcccaaagcagatcgattcaataatggccctgtataggtgatagggagtatgcccgatggaaagcccgtaaaacataccgcgcacatccggatcggcatatggcgtgcggtttccctggaaataatcgagcgcgagcagcccgtctgcgccgatcggcagcctctcagcgccttcattcagcaaatcataaatacttttcccctgctttttcgcctcttgctcaatgcctccgcaaaattgggtcttgaaccagttaacgatcgcaccggtggacgtctgacccccttcgatcatatgcagccctgggatcacagcgtccggataggagccccacattcccttggaatgcatctcctgctttgtcaatcccaaatgaagatgcgatgtacccgtaatcattgcgatactgcccggttttacaacattcaaaccgatcatccccacaaacgcatccgctccgccttcccctacagggatccctgctgcaaggcccagatcatctgccgctctttgggtgaggcgtcctaccttgatgcccatatccagaacatccttcggaaacttatcaagcaaatctccaaggccgatctcctcataaaacgataccggccagccgccgttcgggcggtcatagtaccaacgcggggccgtcgtatctatactcgctgccaattctcccgtcagcatgtaaatcagccaatctacacactcaaatacataacttgctttttcatataattccggctcgttttcctttaaccataacgcctttgccggcatagattccgccgatacattgccatatccgttaaatttgagcgccgggtgtcctgtctgcgtaatcctctttgcctgagccgatgcccgtacgtccatccacatcagtgcaggccgcaaaatattcatgttttcatctgccatcagtacagtacagcaagtagtatccacactcatgccgataatcgcagccggatctatatcgcttttttccatcaaacggtgcgtagctttgcacaccgcacgccaccattcgtccgttttttgttctgcccatcctgatttcggcgtatataagggataggcagcatcagcaaatgcaataggctctcccgcgaggtcaaatagccccacctttacgctgctcgttcccatgtcaattcccaaaaggcattctcttttcatttttctgctacttcctttcccagtatccgtgacattcctatgtctttatttgaattttgcaatatttcctgcataatcgtctgtgtaaaaaacagcagaacccacaatgataaggtctgttcctgcatctttcagcttaggcacattttgagccgttactccgccgtcaacgccgataacataatttatatcggcgtttgtcctcctgattttatccgtatatttgattttcttgatacaattctcattaaacggctgtcctccgaaacctggctccgcagacataatcaatatataatcaacaaacgggaacacttcatttgctttttctatcgattcacatggatgaatcgcatagcccgccgtctttccaaaagaatgtatctgcctcaacagcctgataggatgacggacacaatctgcctggacaatgatcacatctgctcccgctgatgcaaaattctccacatgcgcttccggattatcgatctccagatgtacttccaccggcaatgttgttatttcttttattttctttacaatatctatactaaaagcaaaattatttacataatgtccgtccataatatccagatgtaataaatctgcgcctgcttgttccaccttcttgatctccgattccaaattcagataatcgcatgccaacaacgatgccgaaaccttcatcctccgcgttctccttttgttttgtctaatatatcaagaaatgatatatttttgaggcaggataacctgcctcaaaatatattttcgtattaagtgttatttagatttataaggttccaatgcagcctggttggcgttgtattcttcatagaattcagcgatgttatctttgtttaccagcgtcagctcagttgctacctctgtttccgtgatttgctcacccttcgctgccgctaccgcgatctgcaccgccagtttacccatatcggtcggggactgtacgatcgtcgacaggaagatatctcccttttcgatcgcttccagctctaccggatcgtcgtcaacgccctggatcaggacatccgtacggcctgccgcctccactgccgcgaacgcgcccatcgcattggtggaatttccgccgaagatgatatccagtttgccttccggataggtctggagcaggtttgtaaccagttcctgagaaccttcaactacatagtttacgggatcctgtttgatgatttcgatgtcaggatattgttccatatattccatgaagccctctgtccggtcacggacggaagtaatttgatccataccgactaccagtaccgtacctttttcggaaccgtttttctctttcagcgtctcaaccgccatctcagccgactgcttgccgatgtctttgttgtcagatgctacgtgggctacgacttcgccttcttcggagcggatatcaacagtaaccaccggaatatttgcttcgttggcctgtagtgtcgccgtaccgattgccgcggaatcaaccggattcaggatcaatgcgttgatatgcgagcctgtaatcatatcttctacgccctcgagttgctgctgtacgtcattgccgccgtcaacatcaacaagtttcacaccttgcgcctccgcttccattttagctgccgccagcatatcctggaagaaggtataattgtagtccatcaaagcgataccaattgtgagttcaccgtctgccgctgccggagctgcagattctgcaccacccgttgcctctgttgttgttgcttcactgggttccgtggaagcggattcctgtgccgcgggagctgagcaacctgcaaatgcggctgctgccaatactactacgagtatcagggctaatacttttttcatttcttttcctccatcaagttattattttgttgcatagcgtattgccatgcaaacttatttatttcctctttcatacaggcataccgctaccagtagaatgattccggtaaagacctgttgccagaatgatgatactcccagaatgttaaagccgttactgaggatttgcatgaacaggcagccaataatcgttcctaaaacgaagcctttcccgcctgtgagcgtcgttccgcccaaaacaaccgcagcgatcgcatcgagctccataccctgtccgagcgtcggctgtccggaggcaaggcgcatcgtaagcaaaatgcctgtcagtcctgccgtaagcccgctgattgtgtaaacaataatcttggtgatatctaccttaatacccgaaaggcgtgcgcattcttcgttgccgcccgttgcgaatacgtgtctgccgaattttgtggaacttaaaagtatccatgcaatgacaaccacaataatcataaaaatcacaggcgtcggaatcggcccaatataaccgcgcccaagttgtgcggcttctgccggaacacctgaaatcgcccgcccgcccgtataaacaagcgcaaggccacgcgccgtactcatcaatgccagagtaacgataaatgccggaattttaatcttggcaataacaagtccgttgatgaacccaattactgcaccaatcgcaagcgcaatcaggatagaggctacaaccggaaggccgttcatcgtcataagtcctgccgccagcgtccctgagagacacgcgactgaaccgactgaaagatcgatccctcctaagatcagcacaaacgtcatgccaattgccacaatgagcgacggagaagcctggcgcactacgctcatcaaattatccgccgtcaaaaaagtatcggatgccactgacaaaacgacgaacagcacaatgaatgcgcacaggatgctaagctgtggaaaccgcttaattttgctccataccgaattttcttttaccaatactacttccttatccataactaacagattcccccttgaactttttcttctgatccaactgagtaagacatcaccaactcctgcgttgcttcctgtgcactgagcatggcttttatttctccctcatgcatcacgacgaccctgtccgacatgcccaacacttcgggaagttcggatgaaatcaagataataccgatcccctggcgcgcgagttctacaatcattttgtgaatttcttcttttgcccccacgtctacgcccctggtgggttcgtcgagtataaggacatcgatatcgcgcgtgatccatttcgcaatcgcgaccttctgctgattaccgcccgacagattaccaaccagttgcataatggacggagtcttgatacgcaattgttttactgcatttttacaaatttcttcttcctttttaaagttcaggaatccacccttgtttgcaatcttgtccatatttgttacgctgatgttatttctgattttgctgttcagatctacccccaggactttcctgtcctcgggcagataggcaagtttgtacttcatcgcatcatatgggctacggattttcacttctttgccatttactgcaatactgccctcgtcttgttttatcgctccgaagatagacattgcaacctccgtgcgtcctgcgccgaccaagccggagaatccaagtatctcaccccgtctcaattcaaaggtgacgttacgatacatgcctttcttgctcagcccttttacttcaagtaccgtatctccaatcggtacttcctgcttaggaaacatttggttaatttcacgtccaaccatggatgcaatcaggctctcctgcgttacattagcgatcgcgtcttcgctgatgaattcgccgtcgcgcataaccgtgatgtaatctcctatttcaaagagctcctccattctgtgcgaaatatagatgatcgttactccattttctgtgagttgtctgataatgcggaataaatgatcaacttcctgtaaagtcagtgacgatgtaggttcatccatgacaataattttagcgtcttcagaaagcgcttttacgatctccagcatctgctgcttggcaacgctcaaagagccgactatatcgtccggcttgatccccatctcatatttttccatcaatgcggccgtacgcttcattgtctctttcttatcgatgagcattttcctggttatttctttccccaagaaaacattttcctgcacggtcatatcgcggcatagattgagttcctggtaaatcattgcaatcttgttcctcatggaatcattcgggttattgatctccaccgacttcccatcgatataaatctcgcctgaatcctttggatatgcacccgccagtatcttcatcaatgtcgatttccctgctccgttttcgccgatcaatatattgacttttcccttgcaggcggaaaaattgacattttttagcgcatggacgcccatgaagcttttggttatatttttcatttccaatgctttttcgtccggcaattcttttccctcctttaaccttgttcttccttaatgcaaatttttattgaatggctatattttttaaaagctgcgcgattacttttttctttatgcaaacgtttttctaaccgcccgaaaaaatttacggcaagcttatataataaaaataatattgcgtctgttaccagtgctttgtttttttattcttagattctgatcctttggtatgaacctgtgtattgggtgcgatatctcttttgtatgaagtcataataacagattgattttattatttcaatagttttttttattattttttatattttcttagttttgcttatttttaattaaaataagtgctctgaaacattcgtttttttcacaaattgtaagagaaaacattgcgattttctatatagatgttataatataaataaagcataaagtatgatgcttgtttatttgaatgagtatcgacgaaagaacagaggggaatattgtgtttccagcacaaagaatcgcgacattaaaacaaatcgtgcgtgaacaaaagacagttgatatcgccacattatgttcggcgctcaatgtcagtgatgttactgtacgcaaatatcttgaccaactggaaaaagaaggttttctgaaaaaactgcatggcggagcgatgcttctcgataccgaaagcgatgttatgttcgataccatgccggaatcagatgaatctcttgaaaaggaagatatcgatcaaatcgcgacgttagcagcttcccttattgaagaaggtgattctatttttatcggccaaggcagtctctgcttggcgcttgccaaaaaattgcgtatgattaataatctgacggtaatcaccaataacattaatgcggttcccgatatcgtggcaaatgttcgaaagttattctttattggcggagaaatacttatccaaaacggtaatctctattcctgcggtaccaaggccattcaacaattggatgatatttttgtgcagaaggcattcattggtgtggattgtatcgataccgctgttggcgtaaccgtgaatgattttgaactttatgaaattatccataagatcgttgatatttccaggcaggtggtaatccttgccgagcatacacaatttgataaagtcggtcttcataaaattgcagacctagatcatttcccaatatatgtatctgataaaaaactagacgaaaaatataaacaatatttttttgagagagacattaaaatcctgacatcttacaatatctgaatatgattaggtgactctggtgaaaaaaaaattaattgagatgaagaatatttcccttacgcttgatactaatgctgtcttaagcgatgccaatttttatttgcaagaaggcgaagtttgctctattctaggtgaaaatggcgcggggaaatcgacattgatgaaagtacttgcagggaattatcctcgttattcgggtgaaatttcttttgaaggtgaacttgaaacggtcgatagcattataaaagcacagaaatatggtatcagaatgatccatcaggcatcccagttgatcaacgaattcaacgtagagcaaaacattttttccggaaatgagatttgttatacgggtcttccctttatcaataagaaattgcaaaaacaaaaagcgcgggagcttcttgatttccttcacgcagatatcgatatttatgcccctgtcgaggagcttaatatcgcacaaaagaagatggttgagattgcccgttctctcgtttacagtgtcaaagtattgatccttgacgaagtgaccgcatctttcacatcctatgatagggaaattctttttgaaattatccgaaagttaaaagcgcaagggattgccgtcgtgtttatctctcataaaatcgacgaggtattggaaattgccgaccggcttgtaatcatgcgcgatggaaaaaccgtagaaaataaggtgattgaaaacaattccgtttatattgacgtagatcacatccttttggaaatggcgggggatgattatattaaccgttatcccaaaaccaaagcaaaacatggcaacattcttatgaagatgcatggggtcagcaatgtgcagaaaactgttatggatgctagtttatatatccgtgaaggtgaaatcgttggggttgccgggcttgtgggcgccggaaagtccagtttggcaaaattgattgcaggtgtggagcccgttgcccaaggcgaatattattataaagggaaaccgatgcagacttgcaggctggatcagtttgtaaaaaacggaattatctaccttgcggaggattgcgcgtccaatctgatcgtaaaacaggatgtacagtataatatgtcccttacttcattggagcagtttacccatgccgccttactcaatcacaaagaagtccagcaaaacgccaaatattatatcgataaactcgatttaaaaagggtatcccccacaaccaccgtaaaatggctttcccgtggcacgcagcagaaagttgctcttagtaaatggctccgggcggatgcgagcctaatggtattagacgagccctctatcagccttgatatcgcttccaaagttgaattatacaatattttaaataagatcgcccattcgggaaaagcaatttttatgatgtcttctgacttaacagaactaatcggtatgtgcgaccgcatttatgtcatgttctctggaaaagttgttgccgaattggatgccaaggaagccaattccgtacgtatcttgcaatacgcgtcgggtaagatgtaaatcctgtccccccacggctgaacacctttccctcaattatcctttttcttccttgatttctccgtccggccacacatatatgatcgcatggcatttgggacatatatatacttttgtggaatgatatgcttgttttgatattctttcatacatttttgtgccgcattgcttgcaattcatgttattccctccaagtatatatattataccactaaatattctcaaatcaggttaatcttacacaaaatttataaaaaaagccctgcctgttacggcagggcttttttatttcatatccggcaaattaagcgttgcctcctcccggtattttcagcgtagtgcttaaggtatttcaaggcctaacaatttccttgttcggaggattcccttggtatggtactgaaaaaattttccatcagatttgcggctagcgctccttattttacagccgaacattttccagcatgctaattagttgtaatatgctttcagcgcttccctgtagtctgctttgaacgtctggaattcatccacttcctcaggcgtcgtgatcgcctgtacgggtacgaatgtttccgcgtctaccgtttcgccggcgagattcttctggaacgcttcaaacgcatattttgcgatttctgtcggatactgtacgaccgttcccagcacatacgttccctcttccttcatcttgtcaaagattgcgtcgtcctcgtccgtaccaaccagtaatacgtccgttctgcctgccgtatcgatcgcgccgatgatgccgaccgttaccggagctgtgatggaatagatcacgtcgaggtcgccttccgcatatgcggagagcttatcctgcatgagcgtataagcgtcgtccgaggaaatggagatcggagaaaccttttcaattgtgatatcaggatattttgccatcacttcatcaaaaccggcttccctgtcccttgtcgaggatgcctgcggatataccacagccagcacggaaccttttgcttcgccgttcttttctgtcagcgcttccacaaccttgtttgcgtcaacgcggcccatctccgtattatcggaagcgacaaaggatacgagttcgccttcgtctgccgtcgtatcgatgcagaataccggaatgtttttatcattcgcatctttgactgcagaaccgattgctgctgagtcgaccggattgatgaacaatacgtccacgccgctcacgatcatatcattgatatcgtcaagctgttttgtcggatcctgtccggcgtctgcgctgactaccttatagcccgcttcatccgccatatacctgatctgcgcgagcatatccgagaagaacggatgctcgaacgtcatcatggaaacgccgatcgtgatgtcgccatccgccgccgcagattcgcttgccgcagcactttccgatgccgccggttccgcaggtgcagtcgattccgccgctgcggaagactgggccggctgttcatttgtacatgctgtgaatgcaaagcatgagaatgccattaccacacaaagtacaatcaataaaactttcttcatttagattccctccaagtatttttttatgcctcttgggcaaactttgttcaatattgatttttgattacatattagactttgacgctttggtataaaggacgaccgccaccaccaggatgacccccttgaggacctgctgccaataggacgaaagccctacgatgttgaatccatttgtcaggacgatcaggaaaaacgcgccgatgatcgtacccagcatatatcccttgccgccggtaagcgtcgttccgccaaggacaacagccgagatagcatccatttccagtccttctgccgaagccggctgcgcagagcctacccttgcggtgaaaacaagccctgtcagcgccgcgcaaaatgcgcagatgacatatgtggtgattttgactttgtcgatattgatgccggaaagccttgcacattcttcgttgccgcccgccgcatatacgcgccgcccaaatttgctccttgcaagcaccatccacagcacgatgaccacgacgatcatgatgatcgagatgatcgggatcccgccgactgtgccgcgccccatctgaatgtattcctccggcagtccggagatcggctttccgcttgaatacaacagtgacagccccttcgccgagctcatcatcgccagcgtgacgataaacggctgtatgttcagtttcgcgatcacaataccattgatcaggcccagtaaaaggccgatcccgatcgcaagcaggatagccggaaacatgggcatccctgcgttcacgataaatcctgcggacaacgttccgcacaagttggcgatcgagccgacggacaggtcgataccgcctaggatcaatacaaaggtcatacctgccgcaacgatcaattgcgccgaagtctgccttaaaatattgataaagttgtcagccgtcaaaaacaccctgcctgcagcgcaccccagcacaatgataaggccaataaatacaattaaaataccgaattgtggaaatgatactatttttttaccgattgacatctgtttgatatcatcaccggctactttactgttgttcattgttctctcctttaaaaattgattatgccaatttggttttatgggcgtgggccattacgatctcctgcgtcgcttcttttccggatacctctcccgtaacgtccccctcgtgcataatgatgatgcggtcgctcatccccaatatttcaggaagctccgacgagatcatgatcacggcaacgccgtttcttgcggcttccactaccagcttatgtatctcgcttttcgcccctacgtcaacgccccgtgtaggctcatccaggatcagcacatcaaggtcctgcgacaaaaatttcgccagtaccaccttttgctggttcccgcccgataagctgctccccgggtgtttttcggaagcaacctttatgcccagcttgccgatcatcctgatgctcagctctttttctttcttggcgtccacgaacaatcccttggaaagtttatcccaggatgtcaccgcaatattgtctttgatggaaccgatcagattgagtccgtattgcttgcggtcctccggaacataagcgattttcgcgctgagcgcatcttttggcatcgagaatttcatcttttcgccattcagccacacctctccgctgtccggcttcgtcacgccgtatatcgcctttgcaagctccgtacgccctgcgccgaccaagcctgaaaagccgaggatctccccttttctgatagaaaaactgacgtcgttgaattcgccctttctggtaaggttcctgacctccagcaccacgtcgccaatcggcaccgtctctttggggaacatattggtgatggttctcccaaccatgttcttgatcaggctctgttcgtccgtctcatcgatcggccattgtcctacgaattcaccgtcccgcatgacgctgatgttgtcgccgatcttaaaaatttcgtccatccggtgtgaaatataaatgatggtaacgcccttcttcttcatgtcggcgatcaccttgaatagctggttcacttcgatctcagtgagcgacgatgtcggctcgtccataatgactaccttcgcttcatacaacaccgatttggcgatctccaccatttgctgttttgcaagggacagcctgctgacgagcatgccgcagtcgatatcgaccccgatattttccatgacttcgttgccttttctgatctggctcttcttatcgacaaaaagacccttgacctgctcgtttccgacaaacaggttttccgccacagacatatgcggtaccaggttcaattcttggtatatcatcgatatcccaagtgctttcgcgtccgccggcgtgtttatgtcgacttcttttccttcatatatcaattttccactgtctttcccatgcgcacccgtcaagatgcgcatcaaagtagattttcccgctccgttttcgcccatgatcacgtttacttccgcacgtttaaattttatcgtgacgtcttttaacgcatgggtcccgccgaatcgtttatcgatgttatgcatttccaatacataatcgctcattcagaaatatacctccattatcggaatgtccgatagcaacgaaacaacatggtatgatccgcaaataccagtcaggacaacctattgttttgtgtcaaacggattaactaaagtaaagatttatccttattatattgtgttccaggatcaaatacttgtaccgttttgctattgcacatcaccttttttgcttttatttgcagagctcgaacatctcgcggatgacagcctcattgtagccgtattcctcctgctctccccatgcctgcgccgtcgcaagcgcatccggcgtcatcttgtcgatcgccgcactgtccgtgatcccagcctcgctaagcgtcgtcggcgctccgatcttcttaaaccatgcctcgatcgccgctatccctgcgctcgccgctatcatatcgtccttgtcccgcactccgaatacctcgcgcgcgaactgcgcgtatttcgccgtccgctccttcaggtaataccgcagcgttgccaaaatcgtcaccgacatcgccgcgccatgcggcgtatcgtagaagttcgagagcgaatgccccagaatgtggatgtttgagttcggaagcccgaacccacagtcgtaaaaaccacaccacgcaaacgacgcctgccacatcatcaccgcccgcgcgtcatgatcctgcgggtcctttaaaagcctgtccatgcattccatgatcgagcgga

SEQ ID NO: 20 - DNA, 43526 bp, Christensenella sp.
acagcagtatgataagcaaaatggtatgcatcgtattgatgatagcgatgtgtattgctctggtgtcctgcggctccggtacgacggctgcggaccagacgggcggagcggcacaggcggcgtcttccggcggcggggcggcgggcgaatcagacgactatccggcggtaacgatagagtattggcacatcaacagcgaaacacaaggcggaccggttgtcgaagaactgattaagaagttcaatgaaaccaatggaaaaaacatcacggtagtaggtaaatttgttgcgaatgcctatgagggaatcgggcaaaacctacaggcggaactcgcgatcggtgaatatccgggagttgtgcaagttggatgggtttacctaaattattttgcggaaaactttccacagtatattggtccacaggagattattgaaaaatatgcacccgaagatacaggttacctggaagaagtcctggagccgaatattctagcgcttggaacggcggcgaatgggaaaattgtaggcctgccatatgcagcttcaactcctgttgtattttataatgccgaccttttccgagaagcgggacttgatccggataatccaccggaaacttttgaagaatgggtggcggcagggcaagccgtcaaagatcaaacagggaatgaagggctttattatgagcttgcaaaaaatgcatatacactgtgtccgatgattatgggaatgggtacagaaatgtatgaaatagatgcaagtgggaaaatgacggcaacattctatacgccggaatccgtagaattgtttagtaaatggcaggcaggttttaatagcggcgcatgtagtcggctaggctcggaagaaggactgggcgtattcgccgctggaaagatgggcgcaacagtacaaacaatcggcaaactttcttatatgcaggaaagctgtacgtttgacctgcgaactgctccctttcccaaaacaggaagtgaagaggattacacggtatgcgtaggcggcaatatgctggcatgcttctcggaagatgaagacgaaatcagggcgtgctgggagttcatgaagtttttatatgaagatgacagtatggcagattgggtgatcggcacagggtatttgcctgtgacacggacggcgatggaaaattctgaaaaattagctgaatttttggatgaaaatgaactcatgcaggcggcgttgacaacgtggccgaaagcaagggcccttcccagttggacggggatcaacggaatgaatgtcgaacaggtcgtcgtagatatgcgcgactccattatattcagcaatgaagatccggataaagtaataaataaagcacaggaagatgctaataaattactcgggtgaaatatagtatgctgcaatagaaattggaaccctagatagtagaaaaagggggacgcgagcgagtaatgtgataaatagaaagggcagaaacgccaattgggagggggcgaaaagcaaaaggtcacggaacagacgattggaagttgaatttgtcaaattattggaggtaataataaaatggaaaagagtaaaaagcctcacagcagtatgataagcaaaatggtatgcatcgtattgatgatagcgatgtgtatggctctggtgtcctgcggctccggtacgacggctgcggaccagacgggcggagcggcacaggcggcgtcttccggcggcggggcagcgacaggtgaatcaggagactatccggcggtaacgatagagtattggcacatcaacagcgaaacacaaggaggaccggttgtcgaagaactgattaagaagttcaatgaaaccaatggaaaaaacatcacggtagtaggcaaatttaacgcaaacgcttatcagggcgttgcacagaatttgcaggcggaactcgcgatcggcaactatccgggcgtagtacaggtaggatataactatctgaactatttcgcggaaaatttcccgcagtacgtaggaccaaagaaaatcatcgagcagtatgcgacggaagacgcgggatatctggaagaaatgctggaaccaaacattattgagcttggtacggctgtgaacggcgaaatgctgggtcttccctatgctgcttccacaccggtggtgttctataatgcggatatcttcaaacaggcaggacttgatccggataatccgccggaaatctttgacgaatggttggaggccggccagacgataaaggataagacagggcttgaaggtctttattacgagatcatcccgaatacttatacgttgagcccgatgatcatgggtacgggcgcggatatgtatactgtggatggcggcggcgaagcgaccgcaacctttaatacgccgcagacggcggaacttcttcaaaaatggcaggatggatttaaaaatggcgcctgcataagcttagggtcggaagaagcccttggagcttttgcggcaggaaagatcgccacgcagattgttacgatcggaaagctgggatatatgcaggatagctgcgattttgacctgcggacggcgccctttccaagaacgggaagcgaagaggattatacggtatgcgtaggcggcaatatgctggcatgcttcgccgaaaaggatgaagaaattcgcgcctgctgggaatttatgaaattcttgtatgaggacgaaaacatggctgactgggttattgagacggggtacttgcccgtgaccaagactgccgcagacagtgaaaaattgaaaaaattcctggatgaaaacgccttgatgcaggcctcgcttgagacgtggacagatgcgcgcgcgtggccaagctggccgggtcccaacggcatgaacattgaccaaatacttgtcgatatgcgtgattccattgtttccaattatgttgatccggcggaagcgctcagcagcgcacaagataagattaacggcatgctgaaataatttgtgttgatgcaagcttttagacaaggtgatagccctgcccctcaaaaagaggggcagggtgaaaagagggggctacaaattatgaagcaagaacggacactacagtcgggatttttccgcaaaaagaagaaattagagagatttttatatttgctgcctgcgatcgttattttttccgtctttatggtatggccgattgtttacaacctttatttaagcacgatggaatggaacatggtatcgccgacccaaacgtttgtaggctttgataactatatcagcgtccttcaggaaccggcttttctgaaggcgttggggaacacagggctgtatgtggtgctcatgatggccttctgtttcgtagtaccatatttcttttcatacatcatgggcaaacttatttcgaagggggataaggtctatcgggctcttatgttttttcccagtcttttatccctggcggttgcggcaatcgttttcatgtggctgtttaactcagtggcaggacctgtagccgagatatttcgggcctttggacgggaatccccgcagtggtttacaacagaaggctatgtcattgtcgtgctgtccattatgacggcatggagatgctttggatacaacctgattgtttttttgggagcgatcgtggaagtcccgctggagctgattgaagcagcaaagctggagggcgcttccaattggaagatattctggaaaatcattgttccgctcacatcgccgacggcgctttacgtttttatcattacttttgtattcgggcttcagtatgtatttactccgatacagatgatcacaaagggcgggccgaatatggcgagtacaaaccttgtatacctgatttaccaatatggtttccaatttttccaaacaggacgcgcggcggctgtggccattatatcattgattatattcctggtcgttctgttcttacaaaaacggttagaaaagagggttcattatgagaattaagaatcacgaaggcttggcgatcggcggcaagggagagtggaaatatcatttaatattactgcttgcgctggcgatcatgatctatcctcttatttatatggtcggaacatccttcaaaacgctgccggagatattttcttccggagtaaatccgatcccccaggagccgacgacatccaactatacgacggtattcgattcccttgaggtcggacggtttttgctgaattcactgatcatcgcggccatcgttacggtcagcaagattataacgagcgtactggcttcttacgccttgtgctttatggatatgaagcattcattcctgatttttaacctgttcaccatatccatgtttattcctttctcggttatcatgataccaaactatctctcgctgagcacgatgggcctcaataataccctgatcggcgtggctctgccacagcttgcggacgcaatgggaatatacaggatacggcagtccatgaggacaatcaacaaatccctcgtggaggcggcgcgcgtcgacggcataggccattttacagtgatgcgcaaaatcgtgattccactggtgaagcccgcgattatcgctatggtaatcttcttcttcatcaattcctggaatgagttcgtatggccgatgctgattttaaaacagcaggagatgtatacgattacgctggcgctgcagaccttcctggattcggagtctggcagcgcatggggatcctccatggcgctggcgacaattgcaacattggtgccattggtcttatatatcattgcgcaacggaagattgtggggacgtttatgcaatctggcgtgaaggaataacaggtacgtcgaaaggagcaaaacagtgaacgcaattgaatttaagaatgttcataaaagctatgatggaaaaacggatattataaaaggaatcaatctgatgatcccctccggccagaggacgatcctgctggggccttccggctgcggaaaaacgacgctgctgcggatgatatcgggattggaaagaatatcgggcggcgagctttggatgggcgacaggattgtaaacgatgtggaaccgggcgacaggaacgtatcgatggtattccagaattatgcgctgtacccgcacatgacggtcgaaaaaaatattttgtttggccttgaaattgcgaaggttcccaaagaagaacgggaacagagacttgtctgggcgcttgatatgctggggcttacgccctaccgtacacgttacccgaaggagctgtcgggtgggcagaggcagagggttgcgctgtgtcgggcgctggtgaaaaaagcgccgttcttccttttggacgagccgttatcgaaccttgacgcacagcttcggacgatggcgcgtgcggagcttgtcaaaatgcataaagcctactcgccgacctttgtttatgtgacgcatgaccaggtggaggcgatgacgattggacaaaaaatcgttgtgctgcacgacgggatcatacagcaatatgattcgccggacgtgatttataaccagcctaaaaatgtattcgtggccaaatttatcggcgcgcccagcatgaatgtggatgatgcggcgatcgagggaaacgagcttatcgtagggcagtcccgtatcaaggtgccggatcgttggttgaaattgatcggaaaacgaaagaagattaaattcggcattcggccggaacacgtcattttgcaaaaagaaccgagcgacgctgtggcgcgcatcgtatatgtcgaaaatcatggtgataagaaatcgatcgcgttccagcttgcagaaggtatgatgatggcgacggccgaggcgaattttgaaacagcgaacgatatgtatacgaaattcgactgggacaagatgcatttctttgatgtggaaacatccgacaatattggttatccggaatcataaagcggaaggcttaaggagaaaataaaatggtagatatcgtagtaagcacatctgcataccttgcatttaatattgtgggaatgcaggatctaagaagggatctgggggtggaagccctgatagaaaatgcaaatgatcattgctggagacgggcgtttgaggtattgctcaacgacaggcccagccaatttaccatacacgggcccttcctgtttatggatctttcgtcaaaggaatgcaaatttgacgaggtaatagaaaactataagtggacttttgaatattacaataagtataatgcacagcattgcgtgctgcatccgcacggctttatcaaagactatgaaagccagagcagggaagaccgcagggcgctttgcatagagcggatacaccggctcgcggaactggcggacgaacaccatgcaaatctgctggtagaaaatatgtgttaccccaaaatcctgtttgatcaggaggaatatgtggccttgtttgatgaagtgccaaacgtacaatcgttaatcgacatagggcatgcattgatcaaaaaatgggatttccataaattgatgaaagatatggggcataaaattgacgctttccatattgatgacaacgacgggatagcggacttacatgtgaagctgggagacgggatattggactccgatgatttttttgacgcctacaaccaatactgcaagggaaaaagacttgtaatcgaatatttgggagtaccgaccagtgagatcgaaaaaagtgcggattggattcgcagtctgaccgttgaataacaaagatatcgcaaaatagcaaacaggagagaaaatatggatatcattatcagtcatttaccttatattggatacagcatatataacatgatggatgtacccgagcaatatggaatggagattttcgcagaatatggcgatgacttctactgggaatgccaactcaaaaaaatcatgaagggaagatcgggcaaactcagtatccacggtccgtttaacgagatcaacctggcatctgaaaaatgtgattttgaagaagtcaaaaaaagcttttgtcggacatttgacttggtaaaccgctatcatgcagtacattgcgtattgcatccgcatggcaggataccggattatcaggggttcaatctgaaagacggccataagaggtcgcttgaacggacattggaacttgatgagatggcaagggagcgtaacgtcgaactattggtggagaatatgccttttacagatcaattgatggatcaagaggcgttcctgaaaacctttggtccggaaaagcatttgcggttcctgatcgacacggggcatgcaatcctgaacaagtggaatatgacggatgtattgagtacgctaaaagaccggatccgcgcctatcatgtgcatgataattttggagatggggacacacatctaaaagtgggggaaggaccaacggactggacaaaattctttgtagattataaaaattattcgccggatgcgcgccttgtactggaatatgcggaagggccggtagacgaaatcgttgaaagcattgatgtgatgatggaacactacgaggcagccaaataaagaacgtatcaaatagcctggactgacaagggcccggaagcttttctataactcccgggcccttgttctttattatattatttattgattattgtccatttccatgatcgggcgggctgtcttggggcgggctgtcttggggcggctggttgaccggaggctgctgtgtttgagaaggccggtatggctgctgataaggcggttgctgcggcgcgtaatattgcccgccgcccggctgctgcgggggatagagataacggttgtcactgttcctgagcgcaaacagcacgaaaggcacgatcacactgaagaaaatagataatatgagcagtacggtcgcgctttccgaatgccagttgtaaatgcggtacagcgagatataaaagaaaaccgcatatacgatcacagctgcaataacaagtacatacaggatgatgaaaacaggccaaatcgtagccatgtagaaaccgcccatgaataaggtacacaatgttaccactacgagcacgaccaccccgacgatgagacccaaaagcagcacggcatagtttgtccttttgttcagatgctgtgcggcataggtgtccgcgagtttgccgactacatagaggtatacgacgggaatccatgcaagccacggattttccagaccgcgccgtttggccatcgtatatagccccaaggcaaagaaaacgtagaatacagccgcaagaatgatccaaaaagcgagcaggccacccgccagaaaaaacggtgcactgtaataataaggcgacattgacatcagtatttcctcctatgatttcataatatagtataagataacatgaaaacagttcagaataacataaaaccttctttttccattataacatgccaaataaaaaaagccagcgaactaatgtccgccagctttacgcatttatcagctattcacgaaactggcgcaggatactaaccgcctggccgatcgttttttccttggcctcatttccgtacttgtctacctggcttttatccttaggaccatgcgtcaggcaggccgcaccaccgatacagccatccgtgcacgccatgccttcaataaagttgttcggcaggacgcctttagaagcctttaaaagcgcgatccggcattcctcaatgccgttacaggagatgggatcgtacgcaaaatcatccttgccatgctcttttaaagcttgcccgacagccgtggcaacgccgccgctgcgggcaaagatacggccgtaataagaagcgttgtcaagcggctcggacggcattttagaaagatcgatttcgcggctgtcaagaagggcgagcagttcttcaaaagtgatgacgcagtctacgatccccgcgacctccggctgccggaactccattttttttgcgatacacggcccgatgaacacgatctttgccgtagggtccacttttttcaaataaatcgatatctgctccatgggggatacgttatgggaaatatgctttgcaagatcaggataatttttcttcacataacttacgaaagcgggacaacaggacgtcgtcaaaaaacctttttcataaagttcatccgcttctttatccgcagccatatccgcgccgagggccgcctccaccacgctgaaaaagccaagatgtttgatgccggaaacaacctgctcgacagatacgtgcccgaactggctggaaatagatggggcgacgactgcatagattttatattttgtattgttttcagacgcctttaaaagacggatcgcatccagcatgtaggacttcgcagagatcgcgccgaacggacactggtaaacacatgcgccgcacgcaatacatttttcattgtcgatcacagcctttttatcatcgtccatactgatcgcgcctaccttgcaggcgttctcgcacggacgtacggatttggcaatcgcgttataggggcaggcatccatacatttgccgcactccacacattttttggtatcgatatatgctttgaggttttcgatgcggatcgcatcgcgcggacatacgttctggcaccggtgcgcgatacagccacggcaagcctgcgttacgcggataccgtcgaccgggcactcgtcgcacgcaatatccaaaacttctactacatttttattctcagggtcgccgccaagcgcaagctttaagcgatcgcctacgatcgcccgttctttataaatacaacaacgcatcgttggctggggaccggggatgatcttctccgcgatatgcaaaaggccgtcttccagtttatcgtcatacgccaaattagcgacttcttttaaaattttatatttcagttcctgaacgcttgtatcaaacattccattattcataaaaatatcgtttctccttttccaatatacctcttatatcatactgttttataaaaaaactgtcaatgaatgcatatttgcaaggcaaaaaaacgggaaaacaaaaaacagcgatttttcctataaaaccgctgtttttcatactgtattattaattataatacagttgttttttgtaaaatttaaccagatgaatatcctcaggcgttaggctatcccgctttatagatcagtaacccatatccttgagcatacgtgaaaggacgctcaaccgctcgcccaaaagctcgctgtcctcggatagtatttgtgaaaaaagctggatatcgccatcaattttttcattgtccgtgcatacttccacggtcatcgcgtcaccctgcaaaccgatgcgctcgatctccggatttttaggatcatagagtttgggataacggtaggcatcacgaaaatatttcatcgcgcttacaaggaaaatcgtcagatcaagtgtacggtgcaacggcatctcctcagactggcgcgaccatttttcacccgtataccgccatatcttggcggagatatctaattttccacggtccgaccactgtgcgagcccgagggatagcccttttgcatctgtatgataggcaagacgcccgtctacattggaataatcttcagcaacgactaccggtttatgcttgagcgtcgtcggaatcttcatagtatcttccattttgtcctcctttttaaaactagtaatttagtaaattagtaatctactagataattatatgccgaatttacatggctgtcaaggctgtaagaaataacccgaaaagtggcgcagcgaaggctctggctttacactttgaaaattttacggtatagtaacattaaaatgggttattaaaatgcagagtaaatttttgcgcaccaggaaaggcaaactatgtttgcggaagtatttcagttatatcagaccagatgggatttctttgcagagttgatctggcaacacttacaaatttctttgatttccattcttttagcggctgttatcggtattttttttggtatcctgatttcagagcacgcacgcctttcgtttcctgtccttggaatcacaaacctggtctataccataccttcgattgccttatttggttttttgataccggcgacggggatcggggatatgacggcggtcattgcgctgaccatttacggattattgccgatggtacgtaatacgcatacggggatcatgaatatccctccggccattattgaggcgggcaagggcatgggaagcacgaatatgcagcttttattcaaggtaaagatgccgcttgcattgccggttatcctcgcaggagcgcgcaatatgatcgtcatgaccatagccctgtgcggtatcgcttcctttgtaggggccggcggacttggcgtggcgatttacaggggcattacgacaaacaaccttgcaatgacggtagccggcagtttactgattgctgctttggcgctcattgcggattttgtagcgggaatctttgaaaaacacgtctatcgaaaaatcaacgggagaaaagcaaaatgaaaaaatggatcgcacttgttatcgtaatttgtatgctgggggtcgcgacactcacgggatgttccggcggaagcagcgatacgatcaaaatagcgacaaaaccaatgaccgagcagtttattttaagcgaaatgctctccgcgctcattgaaaaggatacggatctcaaggtagaaatcacgaagggaatcgccggaggcacggggaatatccatccggcaattgtgaagggcgattttgacatgtatccggaatacacggggacggcatggtcggacgtacttaaaaatgatacggagccggatgcggatgcaatgatgcaaaagctgaacgagcaataccaggaacagtttggtatgaaatgggtcgggctttacgggttcaacaatacatataccctcgcggtcaaaaaggattttgcggaagaaaacaatatacagagtttttcggatcttgctgcgtttgcacccgagctggtatttggtgcggagtatgatttttacgagcgggaggacggctatacgcctctttgcgatatatacggccttaagttcaagagtacgaaggatattgatatcggcatgaagtaccaggcgatcggaaacggggacgtgcaggtcatcaacgcgtttacaacggatggtatgctgaacgtatacgatttgaaaacgttaaaggacgataagaactttttcccatcctattattgtgggacgattgtcagagaggataccttaaaggcgcatccggagcttgaagaagtgctcatgaaaatggatgggattctgacagatgaagaaatgtcgcagctcaattaccgcgtggaaaacaacaaggaagatgaaaaagaagttgcgcgcgatttcctgacgcagaaagggctcttatgagcggcgcaaaaatgattgcttttgaaaatgtaaagaaacattatgatgagaaatatgcgcttaacggccttagcctccaaatacgcgaaggcgagtttgttactgttgtaggcggaagcggcggcggtaagaccacgatgctcaagctgatcaacggattgatactgccggatgaaggcagggtcgtggtgaacggggaagacacgatgcacacggacctgatcacgctgcggcggcagatcgggtatgtaatacagggcggcgcactgtttccgcatctgaacgtgcgggaaaacatcgaatatgttcccaaactccaaaaggaaaaactgggtagtgaaaggctacgggagttgatggaactggtcgccttagacgaggaactttgcgagcggaatataaacgaactttccggcggacagcagcagcgcgtggggattgcccgtgcgctcgcggcgcagccacagcttattttgatggatgagccatttggagcggtggacggtattacgcgtaagcagttgcaggacgcgatcagtgatattttcaggaaaaccggtacgacaatcgtttttgtgacgcatgatttgcgtgaggcggtaaggctggggacgcggctggtcattttaaacggaggaaagcttgtgcaggaaggcgatccggatgaagtgatccggcatccggcggaggaatatgtcgagcggctgtcggagcagcttgattgcgaacaggagtccctcaaacagtaaattttatttcataatagtaattaaaatgaaggaggagtatactatggcaaagatggaaggacttgcacacgtcggcttatttattatggaccttgagcgttccaaagcgttttacagggacattctggatttcgatgtgatctatgagtgcgaaaatgaggatgcggatggcagcgtggcgaagatcgcttttatccaaaacgggaatctggtgatcgagcttgtggagtttgaaaacccacaagcaaaaggggatggcgtcgtagaccatattgcgattgcagtcgaggatatcgaagaagtcaagaaaatgcttgccggacgggggataacctttgaatcgggggaaacggcttttggaaagacggtcttcccgaacgggacgaaatgggtcatgttcagagggccggacggagagcatctggaactcaacgagattatgccatattagcgaaaatcaggcaaaatcggggaaaagagcattcatgcattgtttacaatttgaatgctctttttttgattacaattcatgaaaatagcttattaataatacggacgtacatacgatatgggccaatattaaaaagaaaggatgagacacatatgcgtattatggttgataacctggcagtggatatcgacaaccgttccgtatctcgcggtgacgaggagattacccttaccgcgaaggagtacgaggtattaaagtatctggcgctgcataaggataagatcgtttcgcgtgcagagctgttagaacacgtttgggattgcgactacgattgcttttccaatgtcgcagatgtatatatcaggttcttaagagcaaagatcgacgacggtcacacaaagaaactgattaaaactttccggagacagggatattcgttaactgcctaaaaaatcaaagacggcgcaccgtttatggtgcgctgtttttatgtgtaaaaatacttgacccccatagtacgaatcgatagactgtaaagtaacacgtgagagtttttgaggaaaagcggaaaatgaaaaaaatgacaacaattttaataacagcagtattattaacggcctttactttgctggccgcatgcgcgccgcaaagcacggagccggacacgacgcaagatgggacggtgtttggagatttcaagacgcaggacttggcggggaacgaggtctcacaggatatcttttcaggacacaagctgacgatggtcaatatgtgggcgacctattgccaaccctgtttggaggaaatgcctgacctggcggagatcaacggggagtatgcggaaaaaggattccagatcatagggctggtgacggatgcggcggaccaaaaaggaaaagtgatagaagagcaggtagagcttgcaaaagagatcgctgaaaaaacgggagcggactatacccagatgttgccttccgagatgatcattctaaagaagttaaaggatgtgacagcggttccaacgactgtttttgtggatggaaacggaaaacagttgggggaaagcgttgtcgggtcgcgcagcaaagaggaatggatcaagatcatagacggcttgcttgcggaaaatggagagcagtgacatgaaaacgctgatgcggaacaaatggtggatcgtacttgcggccgtaggcgctgtttttattgttgtgggagtcatgcggggggaagcgcaggtcgtttttacaaaagcggtcaatatttgtctggagtgtattggaattggttaaattttttttgtggatcggctcgcatatcaggatgacggtgcagattgcctttacgttgctcacgaacggctatatggccggatttacgaaaggtactatttttaccggagcaacaaaatttgcctgtgtgcccggactcaattgctattcctgcccaggcgcgctcgcgtcctgcccgatcggcgcgctgcaggcggtgctgggaagcagggattatagattcaccttttatatcgcgggttttttgctttttacaggggcgctgctcggaaagctggtatgcggctggctgtgcccgtttggactggtgcaggatctggtcttcaaaataccgtttgtcaaaaaacttcggaagctgccgggcgataaatggctgaaatacttgaaatatgggattttggcaggattcgtgatcctgctgccatcccttgtggcggatatcgtcgggcaagggcaaccgtggttttgcgaatatatctgcccgtccggcacgctgtttgcgggtctgccgcttgtggctgtcaacgcgggattgcagcaggcggtaggaggcctgttcatatggaaagtcagcctgcttgccggtttgatttttctttcgatcgcggtatatcgaccgttttgcaggtatgtatgcccgctgggggcagtatatgggttgtttaataaggtatccttataccggctgcaagtggacgaacataaatgcaccaaatgcggtgcgtgccagacggcgtgcaagtttgacatcaaagtttttgaaagccccaacagcgcagagtgcattcgatgcggcgcgtgtaaaaaagcatgtccgagcggtgcgatcgagtctacctttgaaaaatggctgggcaggataaagaaaaacgggccaagcaaggtgtaaagctgaactgcaaaaaaggagctgcatccgcagctcctttttgattgcttattgttgatcctttttgtcatcggtatttgtttcgtcgggtgccggttgttgccggtaggggggcgcatagggctgctgctggtagggctgtccgtaataaggctgctgtggagcctttttgggatgcttttcgcggtatttacgcatgaggcagcgtgccagcttaatgacaagaaggacgactgcaataatcactgcgatcaggatgatgacagggagcgccgccataaagccgacggcaaagttgtcaaggaattcgcccacgcccgtcatggaaagcgagaacgcctcgcttgcacggtcgccgagcggctgcccgtcagaaccgatcgtttcgggcgtgatgagttctgtgagcgtgatcgagacagtggcatattcaacgaggttgtccatacggcgcatgttgccctgaagctggtcgagctcgtagatcacatctgtgatttcctgctccagcgcaatgatatcttctgtgtttgtcgctttggaaagatggtccatcagccgagctttctggccttccaaaagctcgatacgcgactgcgtgtcataatactggtcagagaaatcctcggtgtttttttgcttgttggtgacttcgccgattcccgacagcttgtccagaaattcattgtatttgtcgacgggaacgcgcatggtcatggtagtataacgtccggtggcagtattgctgtaggcagaaacatcggcggtggaagattcgtattcgatatatccgccggccgcgccaagctcagcgtttattttgttataatcgctgtcatactgcttggtggatatatcaaaggatgcggaataggtgagtttgcggttcgtttcggggagggccgcattggtcaggttgccgaggtcccctgtccctgcttcttccgccatggcggtctccgccttttcgccgcccgcaatttccgcattgtccgcaggggcgccggtggcctgtggcgccgtatccgcagaggtgctttgcggcgcggaagcgcatgcgccgagaagcaggcaggcaccgagcaatatacacaggaatacagtcaatgtctttttcataatagaacctccagttatcatctttaaaggttagacttcattttcatgaaaaaagttccatctttacagatgcttcataaagtcttaatcttttggagacttttatcttaataattcctgtatatcataaggttagggcaaaagcaaggtgggtatggtataatatacctgataaaaagcggaggtaatacatcatgaaaatattggtctgcgacgatgataaggaaatcgtagaggcaatagaaatctaccttgtaaacgaaggatatgaaatcctaaaggcctatgacggcgcgcaggcgatccgcctggttgaagaaaacgaagtccacctcatcatcatggatatcatgatgccgggcatggacgggataagggcgacaatgaagctgcgcgagtccgcaaacgtcccggtgatcatgctgagcgcaaaatcagaggacaccgataagatattggggcttaacgcaggcgcggacgattatctgacaaagccttttaatccgcttgaacttgtggcaagggtaaaatcgcaattgcggcggtacacgacccttggaagcatgacggaaacgcagggtatataccagacgggcggccttgttctcgacgacatgaaaaagaccgttacggtagacggggagggcgtgaagctgacgcccatggaatataaaatattgcgttacctcatgcagaacatggagatggttttgtccacgacgcagatttatgagagcgtatgggacgaaaaagcagtaggcgccgaaaatacgatcgcggtgcatatcaggagaatacgcgaaaagatcgagatcaatccgaaggaaccgaaatatttgaaggtggtatggggcattggctataaaatcgacaagctcaaggtttaacatttggtttaaattgatagcttggatcctctgtatcgcttcggcgtgcggcgcgacgcttattttgtccggcatgatgcggcagaacgtctcaggcgtcgtaacgagcggacaatatgtcgattcgcgcgattacttaaaccaggtagaaacatatttaggcgaactcgagcgcgcatatttcggatatggcgacgaaacgctgaaaaacgaactgagggattatctcggagagctcaagcaaggccacgagcgtgaaatcatggagattttagcttcggccgaattaggagaatattatgatgattatattaaagagtatgaagcgcagatgggaaataacgaaaatgcgtcgggcgcgaaagcggcagaagcggtgggaagctcggatcaaagcctgtctgatttcataataagcgggatcgaggaagcgacgggaagcggctcgcaagcgtccgaacagacgcaaacgtctgcgtccgacagtgcaagcggcagcctgccgaacgtcgatccgtatgtgaggaagcaactcgatacagtcaatagcaagtatgcggagttattcaatcatgcggaagaatatatcgcgcaaaatgtagagcaaaagggcgaacaggcgaaagcagatgcagaaggacaaaagaatttttatttcgcagtcttgcagaacgggaatttgctttatacgaacacacaggcaaatgatgcggcaggcgccgttgattttatcggaaagctggaagcaaaccagaagtacaactgggagggcggtacgcccggaatatattcgtcgcagggttccgaaatctccgaatttacgcgccagcagaatatggacggggtgcagatctatctcggcatgtcaaacgagacgttcgagcagaaccaggcggaatataacgcgctgtatgtcagttatttaagactttttgtccttgtgctggtgtgtgtggcggttttcgcagcagcgtttttgtggctgatgtatacggcggggcgttcgccggaaagcgatgggatcaaagttacctttatggattccatttacctcgacatcggcgggatattgctccttattatcgtgattttattaggggcaggagtagaccagcttgcaagctggtcgggcagcacgtacggcgcattgcaggtagtgcaaatatgttcgcttgtctccattgccgtttcactgtgcctgatgtggagcatgtctatctcgcggcgcgtgaagcgtaaagagacttatacgctggtcgccgcggtgagcagcggtatcaaaagcgcttatgacaggagcggaatgggctccaagggcgtgggcgcggtcatatggtatttggtcggcggcttactgttggtactgctcatggtctggctgggactcctgatcaatatattcggggtgatcatcggtctggcgttccttgcgatttatgtgatcgcgtcggcgaaatttatactcaagaaggcggctgcgatcaaggatatttctgtcggtgtcgcaaagatcaaggacggggaactcaactacccgatccgcaagggcggcggcgcagacctcgacgaaattgcaacaggcatcgagcatattgcggaagggcttaacgcggcggtacagcatgaagtaaaagcggaacgcatgaaaacggagctgattacgaatgtatcgcacgatattaagacaccgcttacatcaatattgacatatgtggatttgctgaaaaaggaaggactttcgagcccgaacggtccgaagtacctggatgtgctggacatgaaatcaaagcgtctgaaatctttaacggacgacctgtttgaggcggctaaggcaacgagcggggatatgacagtcgatatgacgcgtatcgaactcatccagttcatggaacaggcgctcggagagctttcggacaagattgatgcgtcaggcctggcgttcgttaccgaaatgccggatgagaaaatgtacgtaagcgcggacgggcggcttttgtggcgcgtgatcggcaacgtactggaaaacgcgctcaaatacgcggcggacggttcgcgtgtatatatcactatcaaacgcgtcctgcacaatatctgcatcatcgtgaaaaatgtatcccgcgatgaactcaacatgacggaagacgagctgatggagcgttttaaacgcggcgatgaatcccgccacacggaaggaagcggactcgggctttccattgcgaagaattttatgcagttgatgaacgggcttttctccattgagatagacggcgatttgttcaaggtcatcatttcttttccggaatacagggaaatcgaaacggacgaagaggactcgccagaacaataaagcaatcgtaaaaacgctgcccttataagggcagcgtttttttatttgcttatggagtgcaagttattttctgccgatgaacctgcgaagctggtttagttttttatccgacgggggcatataacggatggaaaggtctatggcgttcgactttttcagtatgcttttgtggtgggagaaggtgtcaaaactgtcctcgccatgatatttgcccatgcctgaatttccgacgccgccaaacggcatgcgggaggtcgcaagctgtacgatcgtgtcgttcacgcacccgccgccgtatgaaaccgtacccaatatccgatcgatcatcggttggcttgtggaaaacaggtacagggcaagggggcgtggatgtgagcggataagggcgatcaggtcgtttgcatcgttgtatgtgagaacgggaagaagcggtccgaaaatttcttcgcccataacgggaaggtcgtatgtggcatggtcgatgatggttggctcgatactgccaagcgccgcgtccgtttttccgccgtagtagatatcggtacctttgagcagccctgaaagccgcgcaaaatgtttttcgttgataattttgggaagatacccgcacgacaggggatcgtccgtataatactcacggatacttgcctttaagtgggagagcaattcgtcctttacggattcatgtacgaataaatgattgggggcgacgcaggtttgcccagcgtttaaaaacttaccccaggcaatgcgttttgccgctacctttaaatccgcggtctgatcaacaatgcacgggctttggccgccaagttccagtgttacgggcgttacaaatttggaggcggattccatgaccagcttgccgactgtgacgccgcccgtaaaaaagatatagtcgaattgctgcgcaagcaagtcttggtttgcttcgcggccgccgagtatgacgtcaacatactcgggtgcaaagatggaatgtatgatgtccgctatcacctgcgaagtattccgcgaatagtcggagggtttcaataatactgtgttaccggctgcgatcgcgccggcgagcggctctatcgtaagctggaacggataattccagggcgacatgatcagcacgacgccgtaaggctccttgagcacgaagcttttggatggaaactgcgcgagcggggtacgtacacggcgcggcttcataagccgttttaaattcttgatctggtatgtgatttcgtcgatcaccaggccgacttcggtctcaaatgcctcaaaatagctcttgtgaaggtcgctgtgcagcgcattgcaaatatcatcttcgcgggctatgacggcgtcccttaattttttgagcgcgtctaatcgaaacgcataggaacgcgtcgcgttggattcgaaatatgcgcgctgggtgcttacagtctgctgcgccttgctcatggatttcacctcgtttgtattgatacttttgtattgatactatatatataactaattggattttttataaacggaaataaaaaatatgatataaaaaagaaaaattaaaaaatcctgtttataaatatgatcgtgtgtgtataattgaatgacggactttttgtccatttaatattgggaggtataaagaaatggtaaagtatgtatgtcaggtatgcggttacacggtagagggtgaaagaccggcgaaatgcccgcagtgcggcgcggatggatcgaaattcgatgaattcgcgggcgagcgcgtatgggcggacgaacacaagatcggtgttgcgcaggggcttgacgaagaagtcgtgcagggtttaagggaaaacttcatgggcgaatgcacggaagtcggtatgtatcttgcgatggcaaggcaggccgaccgtgaaggctatccggaggtagcggaaacatataaacgcgctgcttttgaagaagcggagcacgctgcgaaatttgcagagcttttgggcgaagtagtctatgcggacacgaaaaagaacctgcagctcagggcggacgcggaatgcggcgctacggcaggcaagctggcgctcgcgaaacgtgcaaaagaactcggttacgacgcgatccacgatacggttcatgagatggcgaaagacgaggcgcgtcacggctgtgcgttccagggccttcttgacagagtggtaaaataagtttttagtattggcaatcaaaatacggacaccgcatgcggcgtccgtattttttatgtgtcaggcggtacgcgtacggtactttatatgatataatgaaaaaaacaaacggaacggcggaaacaagatgaataaacaggaacaaatggatgcgcttaaaacagagtttcgggaactgctgctcggcacgggacgggaaaatatgcaggagcttttggattggctggagcaagagacggatttttataccgcgcccgcgagcgcgaacaaccacggcgactatgagggcggtctgctggtgcacagcatgaacgtttataaactgctcaaaaatttcaataaaaccgtgaaatgcgaacgggaagattccatcattattgcagggctgctgcatgacgtgtgtaaagtgaacatgtaccaaaagggcgtgaaaaacgtcaaaacgccgggaaagcgggaatggacggaaaaggaaatttatgtgatcgaggatacgctgccgatcggacacggggaaaagtcggtatatatgctgatgcggcatattaagctgacggatgaagaggcgatcgcgatccgctggcacatgggcgggtacgacgacgcggcgcgcagttatatcggcggccggacgcaggcgaacgcttacgggacctataagctggcgcctgcgcttgccatcgcggatatgtacgcaacatattttgtagattgaaagaacaaaaagagactgccggtttggcagtctctttttatgttatccattttattccgcgcccaacgcggccatcgtgatgtagttataaggttggttgaaatgcgggaggaagaaaatatccagcagcttcagcttatcgatggtaacgccttcctcgatcgccaacgagaacatatggatacccatcgcgatatcctcataagaagcgatctgcgtacctacgatgcgtcgggtgctcttttcatagataatacggatcttgacgcggtggttatcgtggatgaaagccggcttttgcaggtcctcataatccgtataaaggacttccatgcccgccttttcggcagcctttaagttaagacctgtggacaccatatgatatccgtagatgctgatgccgttggaaccctgtacgccgacggattccagaggcgtgccgcatacgttatgcgccgccacgatgccgcttcgtacggcattggtcgcaagcgcgatgtaggagggcgcgcgcagtgcgttgctgtatacagttgcacagtcgccgaccgcataaacgtccttcatgctcgtttgctggtgtttgtcaacaaggatcgcgccgttttgaaacaaatcaagctgccccttggcaagcgcgttattgggaacaaagccaatcgcgaggatcacaagttccgccgcatattctcctttgtctgtgacaagggaggaaaccttgccttcgcctttcagctctttgacgatttcgttaaaatggagttcaatcccgttatcagcaaggaccttatccatatcctgcgtaaaccacgggtcgtaatagctggaaagggaagtatcctgtgcttcaaacagcatggcgtttttaccgcgtctgcgcacagcctccgcgatttctacgccgatatatcccgcgcccacgacggcaacgttgcggatgctctcgtcgtctaaggcacgattgatcttttcgccatcctggaacagcttgacgacatcgacattttcaagctcgagccctgagattttcgggatgatgggaagggaaccggttgctaggatcagcttatcataatcttcgacgatcgtctcgccgcatttgggaagcgcgtatacctttttggcagcaaagtcgatttttgtgacctcggtttccatgtataccttcgcatgcttttctttgaaaacatcctgcgaacaataaaacagtccttccgtaccgtcgatctgccgtccgacccaaagcgccgtaccacagcctaaataactgatgttggagttacggtcaatgatgaccagttcctcgtccggataattgtccaaaatagtgttcgccgccgcagttccggcgtggtttgctcctatcagtacaattttactcatgtcatataccctcgctttcaataaagtttttaatgaaattacttgatatgttttatataaacagaaacgcatccaaagtaacggagcaaattgtatttttacaaaggaaatggtatgatcgatacgatcgccagagccggattttgcataggagagcttttatgaaacgcgatgaaacctacagttttcggcatacgccaaaggaattgatctttaaattgtttcataaaaagagatgcccaaaatgtagcggaaaaatgaaacattttttgataaaagaatatactgggttggagagctttggcggcggcgattcatatgcgtttggcgataggcacaattataattttgcgtcgcattataaatgtcttcaatgtgaaacagaatattctttgcaagaactaatggcatacagcaaacaacaaaaaagaaaagcaagcaaataaaaaacggtatctgaaaacagacgtgaggccggatgagcccacgtctgttttactatttatccgctgtttgtgttattttgcagcaatactttttttcatgaaagcgcttgacaataaaatattattgatatataatcctaattagtaattaatatcaataaggatttagctatggaaacaagaaagacatttcaaaagaatatcatcatggaacaggtgcaaagcttgtaccatccgacggcggaagaggtatatggcgcagttgcgaaagttcatccggcaatcagcaaggccacggtataccgcaacctcggcgcaatggccgatgcagggatgatcatgcgtgttaagataccggacggagctgaccgctttgataaaacgcttaagaagcattaccacatcaagtgcagggaatgcggtaaggtatgcgacgtcgatatgccgtactttgaagggctggaaagcaaagttgccgataagcacggctttgatttcgacagtcacgagattgtatttaacggggtttgccccgattgtaaaattaagaaaagaggtatgtaaaaatgacaaatttgaagggaacaaaaacagagcagaacttgcaggcggctttcgcgggggaatcccaggcgcggaacaagtacacgtattatgcatccaaagcaagaaaagaaggctacaatcagatcgccgatattttcgaagaaacggcaggcaacgaaaaagaacatgcaaaaatttggttcaagcttttgcacggggatgatattccggataccgctaccaacttaaaggatgcggcagatggtgaaaattacgaatggacggatatgtacgatacatttgcaaaagaagcaaaagaggaaggatttgataagatcgcattcctgtttgaactggtcggtaaaatcgaaaagaagcatgaggaacgttaccgcaagctggtagagaatcttgaaagcggcctcgtattctcgcgtgaaggcgatatggtttggcaatgcgcaaattgcggacatattgtgatcggtaaaaaggcgcctcagatttgcccggtatgcgcacatccgcaggcatatttccagatccacgcagaaaactattaatttcgagaaaattaaagggggctgaggcgatatggcaaagtttacctgcgcattatgcgggaatacctatgaagaagaagcggaaggcgttttgtttgcggatcttccggttgactgggaatgtccggtatgcatggggccaaaagccatgtataaaggggatgagggtacgccgcaagcagcgaagccagctatagagccaaagcccgtaaataacgggaattcgcttgcatggccggaagaatttgtgcaccatgacggcggacttttagacgagatccatacgcttgcggagacgggaaaatcgattacggaaccgatgaatacgcagatgggcgttccgtgctttgacgaaatcgtcgttttgggcgcgcagcttgcacggccgccgctcatggaagatgaacctgtcaatcttaaaacaattatcggcaagcatgcaaaaaaaccgatggagctgaaaagtccaatttatgtatctcacatgagctttggggcgctttccaaagaaacgaagatcgcgcttgcaaagggaagcgcactggcagggacggcgatgtgcagcggagaaggcgggatacttcctgaggaaaaggaggcggcgtataagtatatttttgaatatgtgccgaacctttacagcgtgacggatcaaaacctgaaggaagcggacgcgatcgagatcaagatcggacagggaaccaagcctggaatgggagggcacctgccgggggaaaaggttggaccggagatcgcggagatacgtaataagccggtaggagaggatatcctgagcccatcccggtttgcgtgcatcaatacgccggacgatttaaagaagctggtggatgagctgcgtgagcggagcgaaggtcggccggttggcgtcaagatcgcggcagggcatattgaaaaggaccttgcgtttatcattccggccaaaccggattttgtaacggtggacggccgcggcggggcgacgggcagctcgcccaaattcttgaaagatgcaagcagtgtacccacggtttatgcgctttatcggacgaagaaattcctgagggaaagcggccttgatatcgatctcgtgattacgggggggctgcgcacgagcagggacttcgtgaaggcgatcgccatgggggcggacgcggtagcggtagcgtcgggcgcgctcatcgcgcttgcctgccaaaggtatagggtatgccataagggtacctgcccgatggggatcgcaacgcatgaccctaaactgcgggaacgtcttattgtggaaaaaggcgcgcagcgcgtggcaaattacctgaatgcatcggccgaggaattgcgcagttttgctcggtgcatgggctatgataatattcacgcactgacgacggacgatatcgagacgctgagttccgaaatatctgaacataccgatatccgtcatgtataagtaagaaagcaataaaaaagagactgcctttagtggcagtcccttttttattacttattcacgtacatggttgatatattcgtgcgcgtttttggcgatgcgcgccatcaactgttctgccttgagcatctcatccttagacatatcctgcgttaaaacctgattccatttgtgggcggattcatatatgcgctcgatgatcggttcggccttttttgtagtataaagccggctggctcgtttatcttccggcgcagattcacggcggatatatccttgctcctccagcttttggatcgcccgcgtagcggtcgccttatcgaaatatccgcgttgtgcaagctccattacgccgatcccctggttctcgtaaatgcgcaccagaaaaaactgctgtccgccgccgatatgataatcacgcagggaaaggtcgtaaaaacgaaggctcaggcggttgatggcggaagcatatttatttaaggagtattgctttttcattggtctttctccatttttgaattttgcaacagctttgtctgcgtctctaaaagctcttttgcgatcataacaagaaactcttgcatttcaggcaggagctgttcaaacacgttgataaattcctcatcataacacgttgtaagaaacatttctccctggccgccacgcagccattcttcattgacatggaatacagagcagatcagcttgatatgcttatcgctaaagctgcgcttgccaacctcgatcatcgcaagggaggattggctcaggccaagccgctttgcaaattcaatttgattcaggcccagggccttacggatttccttgattcgtttatacacacagataatcctttccaatatgtgtaattaaatattatcacacatttactttataaacaattagaaaaacagatatcaatacgtacaccgaaaaaacaaatattatcacgattaatcacaaacaaattaaaatagtttgacttttaattaatatgtgataaaattacattgtgcaagtcatttttacaaagggggagaggatatggaaggcagagaatatctgtgcaaggaaatgatgaaaatctatagtcggctaaatatcacaaacaaattaaaaatgctttcctatgtaaaattagcacaaaattgcgagaaacaagtcaaaaataaaaccctctccgacaaaggctcattttatcaataatgtcacgatattatacattataaggaggaagaaaatgaaaaagaaattaattgcattacttgttgcggcgctcatgatcgttacgatgctgcccgcggtagcgatggcacaggaagggaacgcgccgccgcaggaaccggcggaagcatcatcggcaagcgaagcaacggtcacgcgagacccaagccctgcaggaggcacgggaggcgtagcgggcgtatgtaattttgcatatgatgcggaaacccgtacggctgcgtttacaggaacgatcgactggtacgcggcggacggcgataagaaccggcctgcgggcaaccgcgtgggagtggaaatcgcgcctgcgggtggcgtaagcgatgtatctgccgcccaattcaagatcaatgacggggactggaacgcatggagcgttgataacgcagacaataatggtttgtggtggtatccgttggtgacggaagaaaacaggatgcagccatacaagatcacgatcgactgggatggcgacggcacggtgtacgggcctacggattatttcatcgattgtacgggagacgtgacactgcgcggcaacgcgctttcgggcatggatgtatcgtttatcgacatgggaaactggcaggacgcgcaggatgtcgcgtctgaaacagcaccgcacgatttaccgtggctgcaggtcaagttccataagaacttggaccagatcagtgacgcaaacaaagcggcgctcaaaatggaatttacgatccaaaaagaggggatcacttcttcgggcgatcataaagacgagcagccggataacggagccaatacttttggaacgggtacggcgacctttgtaagggattctagtgcggtaaacgagcagggatggatccagttcacgctgggagacctcaaaaacctcacgcatagggattttctcgggcttgcgcctgaagatttcgcgggaacatatacgatctccatgaaagcgatcggcaacgaaggcgaaacaatcggcgaagccacagaggaagtgacgtacgatggagacgcattcgtcacccagccggaggtcacgtttatcgacgcaacaaactggaagaacgcgctgggcgttccggcagagcaaacagttgccccagacgacctcccgtggatccagttgaaatacacgatcgacctgacaaagatccagaacccggcggatttcaattatacggtaaaggttgagaacgcgggtattgcggcaggtggtgcaaagacgttcgaaagaagccttgacctttccgccgcgattgaagcgggcaaggaaacggcaacgggatatttccagatcgagatgggcgagcataagaacctgacgcatgaggattttcttaatattgatgcagataagtttgcgggcgaatataaggtgacgctgagcgccacggacggcgacgtttcggatccggcgcttgcacaggcaaagacgattgcttttgacgcgatcacaaagacctatgcggaacccaaaatgtttggcgaattcaagggtacggagatcgtgcgcgtggacggaaccggcagcacggaaaacacatccctgccctggttacagctcaattttgaccgcaagatcgaaatgacgggtatgaaagtgacctttacgcccgtggatgcgcagggatcccctacgggaggacaggcgacggcactgaccgttccgggcggcccgtttgcagtaaaagacaacgcatatatccaggtggcaatgggtggagatgagaaggaaatccagccggggacctatgcggtcacgatcgacgcgacaggcaacatcgacggggttgtcctggaagatacgcttgactgcggtatcgtaacagttttacaagaagaggatacgcaaatcaagcctgtggatccggataaaacgccgatcgctcctatagaagtcccgggcgaaacaggcgcgaaggaagaaatcaagtgtgtcacgggaattgataccaaggcgactcccgcgcaggtagcggcattgtttaccgtgccgacgggcggtagcgtcgaagtgcaggcttcttatgatgacggtgagggaaccaaattggtcggaacaggcagtacgatcgttttgaaaacggcggacggtacggtgtatgatacggtcacagtcatgatcccgggcgacatcggcggatttggcgtgatcgacgtaggcagcagcatcaagctcaacaatcatatcctcggatatgctgaattgacaggcgtatattttgcggcggctgaccttttacaggatgggacgatcgatattttcgacagcattcgcgaaaacaacctgatcttaacacagccgaaataataaacggaaaacatttggaggtaggattttatgaatcacacaaaacggaaatattcggtactcgtcgtgatcgtcgcggcggtactggtactggcgatggcgacgacggcgtttgccgcaggggagaccttctccgtagggctggataaaagcgcggcgtccgtaaagccgggcgaaacggtttcctttacggttacgttcaacgctgtaaacggagatctggcaggctttcaggcaaacgtaaacgcaagcgcgaacctggaatatgtgagcaactcggcatcaagcagcgcgctgcagaacgattcggatgcagggacgatcctgctcacgggcagtgcggcgaaaaaggtcgcagccggatcgagcatcagcgttacctatacctataaggtcgcggcttcggcaaaagacggcgatagcttgagctttgcgctttcagggatcaaaggcggaagtacagacggaaatccggcgacgctgaatggcagcgcgactccttccgttaccgcaagcgtgaccgtccctgcgcagcccacagaacagcccacagaacagcccacagagcagcccacgaaccagccgacagagcagcccacgaaccagccgacaagcgatccgtccgcgcagccttcggcaaccgcttctgcaaaagcggacgaccttgacgatgtaccgaagacaggagacacatccatgaccatctggccgtttgtggcaatcggtatcgcggcggcaggcgtactcatttttgcggcaggcaaaaaagcgctttccaaataggcatatcggggaacacataatatgcaaggcgggggtttcccgccttgcttgttttttggagaattggtatggacgaaaaagaacaatataaaagaaaagtcggcgaggaaccggacaaaaaaaagggaaagattgccggcaaggccgaaaatagtatcgttacatttttgaaacgatggaaatggctggtagccgtctgcgtggcggcggtttgcctggcggtcgtccttccgatcgtattgcagtcaaaaccccagccgccctcaccgattgtagaggctgaggcgcccgttccaagcgcaacgccgtcaaaggctcccatgccagcgccgacccatacaaggaagcaaatgctgcccaatatggaaaagttgtttgcgcagaacaaggatattgcgggatggcttaagatcgacggaacgcaagtggattatccggtgatgtatacgccggaggacggggaatattacctgtaccggaattttgaaaaagaagaggaccccagtaaggaaggatgcctttttatcgataaaaattgcatgatggaaccgagaagcaccaatctccttgtccatgggcataatatgaaaaacggctccatgttccacgcgcttatcgattataaggacgaagcgttttataaggaacataagacttttcgttttgataccttatacgaagaggaagaatacgagatcgtagcggtattcctgtcaaaggtatataaaaagagtgaaacggacgtttttaagttttatcagttttatgacgcggcgacaaagcagcagtttgacgattatataagcaatatcaaaaaaatggagctttatgatacggggattacgccggtctatggcgatacactcatcacgctttccacatgtgaatattccgcagagaacggaaggattgctgttgtagcgcgtaagataacagacacagtatcttaggaataagaaagataaagccggacgccggacggcgggtatttcccgcattccggcttttttcgattgtaaagcgggaaaagctatggtatcttagaagtaattagtaaatacgcacaaggggtggggtcatggataggaatggaatgtcaaattacaggcgcaggctcgtgggggggctgatcctgtacgggatattatcgctgggggtcattcccatttttacgctgtatatggggaccaaggacaatatcctgacggtttctatgtctgcaatgggcaatacgagcgtttccatgcacctgctctttgttatctggacgatcgtgttttgcgggtactttgcaagctttatgggttatctactgatgctgacgaagaatacacattccaaggtccgcggctttgttacgtttgctacggtagtattggttgtggggaatattttccccttcctgccggaaacattgccggggtttgcggaactgcataacctatttgcacagatatcttccgtgtcccttgctgtcacgctgatgcttttcacgctgacgctgcgcaatcattattcgatattattcaaaagggcgctggtatttgtgctcatcatctgggcaatgcttattgcgctcatggcgatatttgggacaaggagcatcacagaaatgtcgggcattatcgtcgcgagcgtctttttgttctgtatgttgctgtggctatacaaggaagatgcgttcgatccggtgcaatccctaaaagaaaacgatgtgaaggaagcggaagatgcggcagataagctcgagaagagggtcatccaagtaaaaaaagaatacctgaagctggaagcggaggcgcgtcatgcgcgcattaaggcagaagaagtcgcaaaaattgcaaaacaccatcaaagcgaataaatgatatgaaacagaaggagcgggcgttgcggaaatgagtaaaatggaaccggaaatgattgctccttgcggcatgaattgcaggctgtgcatggcatatatccgcccaaccaaggcctgtgaaggctgccatgggaaggataccgcaaaacccaggcattgtaccgactgtgcgattaaaaattgtggaaagcgtaaaaccgatttctgttatggctgtgaagagttcccctgccgcgctttgcgccggcttaacagccgttatcggaaaaaataccacatggacatggtaaaaaatctggaatatattaaaaaatatgggatgaagctatttttgcaagaggaagaaaaacgttggacgtgtgatgcgtgcggcgctgttctttgcgtacatcatgatacatgtcctgtgtgccatacggaagtttgcgaatggaaaacgctgaaagaggaggaacaggcatgaaattaatctcatggaatgtgaatggccttcgggctgctgcgggaaaagggttccttgattacctttatgcgagcaacgcggatgttttatgcgtccaggaaacgaaaatgcagcaaggacaggctgcgttcgattttagggattacgacgaatattggaacagcgcggataaaaaaggatattccggcactgctgttttcagcaaggtaaaaccgcttgccgtaggttatgattttgatatcgaagagcatagtcatgagggacgcgtgttaactttagaatttggggatttttacctggtaaacgtttatacgccaaattcgggagaaggcttaaagcggcttgaataccgcctgaaatgggaagatgatttcagagattatctggtatcgctcaagcgcaagaaaggcgtggtggtatgcggggaccttaatgtagcgcatacggagatcgatttgaaaaatcctaagacgaacataaaaaatgcgggctttacgccacaggaacgggaaaagatgaccgagcttttagacgtgggttttgtcgattccttccgctacctgcaccctgatgaaacgggacggtatagctggtggtcttaccgcttcaatgcacgcgcgaataatgccgggtggcgcatcgattatttcctggtgtcggaggagatgaaaggcaggatacaggaagcggatatttatgcggatatttacggaagcgaccattgcccggtcgggcttacattaaaataaaaggagacgaggcatgaacgaggtaaagatcaaaggaacgatcaatacggacaagatcgattttagcgaataccccagcgtagacggagaacttctggggcgtgtgcacaaggcagtgggactcgcgcagcaaaagggagtggatgcgctgatcgtatatggggacagggagcatttttcaaatcttgaatacctgacgaaatatgatccgcgttttgaagaagcgctgctcatactggtcccggggcagatgccaaatttaattgtggcgcttgagggaaaggactactcggaaatcataccctatgaggtcaagcggcatgtatatacggattttgggctggaagggcagccgcctgatggaaaggagctgacggatatcctgcgcagctgcggtatccatgcagggatgaaggtaggcttgagcggctggaaggcatatgccgatgaaaagatgctggatgttccgcatcatattgtccaggcaatatcgaagttgacgcaaaattatattgttaacacgtgtaacatatttactgatagtgattacggcttgcgctcaacaatgagcgccgcggagatcgtgcaagcagagatcatgaacacaatcgcgtcccgccaagtatatgcggcgatccaaaatttgcagtgcggcatgtctgaagcggaagcggcaatggcctttgggatcggcgcacagccgatgatgacgtatccggcgatgagttttggggagaaaaacgtaaggatggggctcgcaagctcgacctatgatacttttttaaaagagggcgatatcgtatccgtggggatcggataccgctttgcaatgatccaccgaagcgcattttttgtgcaggatgaaaaggaattgcaggaatatacccaaggcaagggaaaggatttttatgggcggtatttcgatttggtgaccaattggtacgagacggtcgctatcggaaaaacaggcggcgatgtttacagggcagtaggatcgctgcgggacggaatggggatacagctcaatatgggacaccaaatccatacgaacgaatggatcaacagtattttcttcgaggattcgcagcatcctatcagatccggtatggcgatccagtgcgatatcattgccggagcgccgcagccttttatgagcgcgcatatagaggatgggatcatcatagcggacgaagcgttgcgcacggaaataaagaatatggctccgcaagcatacgggcggatgcagaaccgcaggaaattcatgcaggaagtactcgggatcaatgtcgcggaagaaattcttcccacttcggatattcaggggatgatgttcctttatatggcagataaagaaacgattgttacaaactaagcataagattgaaaacggcggcagggatgccgccgcttttttgtgcataattcttcatttagtcttaagaaagtgtttatcaggctgtaaaacactttcttttttttcgtactataatgaaagcagcaaaatacgggaggatgatatatatgaaaaaggttacaggcaaaatcgttgcatgcatcgcggcgatcgcagtgatggcgggtatactgtgcagttgcgcgccgttttacaacaaggtgggggaaatgatcggcagcatcgcagcggtgcgcgatcgggcgcatgaacgggttgcttctgtggatatggaaacgagcggggagatcgtgctgggtgcgtccgaaaacattggcgaggtgatggagcaggcgtttgcgggcgagtatcgggacggcgaagagcatgctgtaaacagcataaagatgaaggaatacgaaggggtggggatctcgtacgacgaagtaaacggcaataattggtatcataacaaaccggtggcgggtctgtatgacgcgggatataatacgataacaatttcttcatatgccgacatcggcacatttgtcatcattgaacgagatgaggaagaaaagatcacgggcgcgtatgagacggataaagagaatttcaaagagctggcgcgtatcgatatatttgatgatggtgaaaaaggcgcgcgggagatgggatatgactatgttcgcgaagacgcaagcgttagagggcttgaccaaaaagcgtttacaaagcttgaaaacgagttgcgcataaagtaccgtaaccagaatgtatttgtggaatgtaaggattatgtgttctgcttcaacaaggaggatatgctatccatcagctcgtgctgttacatggatacgtccccttatgcggcgcgggtatctatcgactatcagcaaaatgaagggatcgacctgaatttgtttgacgatgacaagacggatgggatcatcatggatgtgctgagggcagacggcagcagcgggcaaagcatagaaaaggtaaacgacgcgatccgcgaggcggttgcaaaggcatatggaatcgaatggaaatatgtgttcgttgatgtgatggcagtgtaaatagcgtgaacgattggaaaacggcggcagttatgccgccgttttgtatgtgatatcgtttccattggaaaagatcgcgatgtctccgttctggtcggtacgcagggtttcgatatgctcttcgccgagcaattccagcgtctctttatggggatggccgtaatcgttatcttttccgcatgtgataacggcaatctgcggcgtggtcgcgtcaagcaattcgtctgtcgtaccattatgcgaaccgtggtgcccgatcttgatcacgtcgatatccatctgggatgcaaattggccgagcatatcggcgatcgcttcttcttccgcgtcgccggaaagcaggaaggacgtattgccgtaccgaacgagcaggacgatactggaattattggtatcgtcgtattttttatcttgcggattcagtacggtaaacccgatatccccgacagtgaaggtatcgcccgccgttaccataacgacaggggtctgctgctctttggcggcgtttaccatattattgtaagttttggttttggcggtttttgaagtcctgtaaaaggttcccacagggatatccagcagcacgtcgtccatggagccgatgtgatccgcatcgggatgcgttgcaatggcggcgtccagtttttcgatgccaagggcctttaaggtttcaatgatctggtctgcatcgtcgttttcggcggcgtctacaagaaccgcatgtccgtcgggcgtatgaagcaccatactgtcggagtttccggtgctcatgatatacaaaatcaggtcgctttgtttttcttccggggtgacaagctctgaaacatttcgctgggcgttgccgtaattgaccgtattatcccaaatatcacctaaattgtctaaaaatgtcccctgcgaaccaaatacgagaaatagtgcgagtataagcaggcagatcaggacaacggcaagccggattgcggtggactttctttttctggccatatggactccttatatcattctacgaaagattatactataatagaaccaagaagaccatacgggagagatgagttatgacacaaaaacaggagcgcgtgatcgtagggatgtcgggcggcgtagattcggcggtgtcggcgttgctcttaaaagagcaaggctatgacgtaataggcgtgttcatgaaaaactgggatgacagcgatgcagatgcgcagtgccctgcggaagaggattatgaggatgtgcgcagcgtgtgctcacagatcggcatcccatattatacggtcaattttgaaaacgagtactgggaacgtgtgttccggtattttttagaagaatataaacggggaaggacgcccaatccggacgtactgtgcaacaaggagatcaagttcgccgcctttttggattttgcgaaaaaagcaggggcggattaccttgcgacggggcattatgcgcggctttttcgtgagggcggcataacgtatttgaaaaaagggctggatgcggggaaggaccagagttattttctgtgtatgctcagccagcagcaaatagaacaggcgatgttcccgatcggggagatgcaaaaagcggacgtcaggaaaatggccgagcaatccggacttgcggtggcgaagaaaaaggattccacagggatatgctttattggcgaacgaaaattcaaacagtttttacaaacctaccttcccgccaacccgggcgatatcaaaacgcttgcgggcaaaatcgttgggcggcacgacgggcttatgtattatacgctcgggcagcgcagagggctcgatatcggcggcagcaaggacggcacgggcgagcgctggtttgttgtggataaggatatggaaaacaacgtgctcgtggtttcgcagggggcggaatcacagcttttgtattcacgcgcgcttgtgatgagcgggatgaacttcatatcgggcggcggagacaaacaggcgtttttgtgcggggcgaaaacgcggtatcggcagccggaccagaaagcgcgggccgaaaagcgcggcgaaggggcgtattatgtggaatttgaagaaaaacagcgcgcggttacgcccggccagtactgcgtattatacgacggcgatacctgccttggaggcggtgtgatcgaagaagtgatattttaacgaatatgacagtacatgtcagtttatctttgtatcatgaaagaaaaaccgacaggaggatcgaatatgattgagctacccgaaagcgtcacgctggcaaggcagatgacaaaagaactgaaaggaaagcgtatcgaaaaagtgattgcgggaaaaagtccgcatcggtttgcgtttttctgcggggatggtgcggcatatgacgctatgctgcacggaaaaacggtaggggatgttgggtcatacggcggacatgtggagatcgagctggaagattaccggctggatttaaacgatgggatcacctttcggcttttagcgcagggcgaggaagaaccccaaaagcatcagttgtatattctctttgacgatgggagcgccctttgcatgagcgtgcagatgtacggggcgatgtccgcttttccggaagggacgaacgacaatccatattaccttgcggcgcgggaaaaggtgtcgccgctttcgaatgcattcgatgtggaatatttccgttccctgatgaacagcgtggacaggaagaaaacgtctgtcaaagcattcttggcgacagagcaacgcatcccgggtttcggcaacggcgtgttgcaggacatcctctggacggcgcggatccatcccaagaagaagttggcggatttaagcgggcaggagactgcggagctttacatggctgtcagaaatgtccttgcggatatggcggaaaagggcggacgcgatacggagaaagacctgtatggcgatcagggcggatataagacgatactgagtaaaaacaacgcggaaatggtatgcccacaatgcggcgggccggtcaaaaaagaggcctatctcggcggaagcatatactattgtcccacctgccagaaattgtgataccgtatgcagaacagccgtttgtttgatatcctttataccttattgaataagcaaaaagtaacggcgcgggaactttcggacaggttcgaggtttctgtgcgcacgatctaccgtgatattgatgcgctgagccttgcgggcatacctgtatatgccacaaagggcaaaggcggcgggatatccctgatggatgattttgtcctgcaaaaatcattgctgagtcgggaggagcgcgaccagatcttaattgggctgcaaagcctgcgtgccgcgcggtatccggagacggacgaaatactttccaagctgaacggactctttcagcaaaaaggtatggactggatcgaggtggatttttccggctggggcagcatggaaaaggataagttcctctctttgaaaacggcggtgcttgcaaagcgggtgatcgcattcgtgtattttggggcaaatggcaagcggacgaaccgcacggtagagcccttgcggatgctctacaaaggaaaagcgtggtatgtgcagggattttgcaggcagcgcgcggattacaggatttttaagctgtcacgcatcaaggagcttgagatcaccggcgaggcatttcaaagggaggcggcgtcgctgccggatgttacggaaaaacaggccataccgccgtgcgttacagtcaggatgcatatcgacgatgtgctgtcttaccgcgtctatgacgaatttgacgaagcggccatccaaaaaaacaaacacgggtttgacgttgtgctcaaagtgcccgaggacgaatggctttacggctatatcctctcgtttggtccgtatgcgcgggtgaactcgcccatgcatgtgaaaagaaatgtaagcgaacgcgtcaaaaagatgtcggagtattatgataatatgacataagaagtcatattatggatgctatgcttatcctacattatatataataaaggagtaagcaagatggaatatgaattggtgaacgtggaagaaaaatgggtggacggcatcctgatctgtacggaaaacgcagatggaaaagcaatgaaggacattggaggcctgtggcaggattttctgggaaacggaaaagcagggctgatacacgggcggacaacagaaaattgtattgggctatacacggattacgaaggggattttatgcggccttattcctacatcgcgggatgcgaagtgagcggaaaggaagagtctgcttttacagttaagaagatacatgcagggaaatatgccaaattcgtggcaaaaggagacctgacgaaggaagtggatgcgatctggaacgcggtctggagccttccgttcaagcggatatacgaaagcgactttgaagaatatatcggcagcgacggggtcacaggggaaatacatatttatattggggttgaggactgatatggacatcatcgaggtaaaccaaagcaatattgatacagagcatttatgctgcgcgatctccgataaaaagagcgcgcaggtgaaacgcgagtggctcaaagaacgtgcaaaggacggataccgttttttcaagatggacggacagggtaaggcgtttatcgagtttgttcatgcggagcacgcgtgggcgccgatcagcgcggatgggtatttgttgattgactgcttttgggtagcgggatcattggcaaaaaagggatacggcacgcagcttttaaacgtatgcatcaacgaagcaaagcgtatgggtaaaaaagggctggcagcggtatcgtccgataaaaagcgtccgtttctttccgacccgaaattctataaaaagcgcggctttcgcatggcggatacggcagagccgtactttgagctattgtatctgccgtttgaaagtgacgcgcccgtgccgcggtttcaggcagcagccaaagagggtaaggcagatggacagggcgtgatgatctattacacggatcattgcccgtggaacgcaaaatatataccgcttttgcagaaaattgccggagagtgcaaggccgatgttgcatttcgcaagttatcttcgaaagaagaggcccaggcctgcccaagcccgtttacgacgtacgcggtatattataatggtgcgtttgtgaccaatgagatgatgagcgataagaaatttatcaaattcctggaggaaaagggactgtaatatggagatggttcccgcaaaaacaatattaacgcgtccgaaagacgattcatggttcggcaacgattataatatgaacctgtatcgcgggtgctgccacggatgcatctattgcgacagcaggagcgagtgttaccatgtggacgattttgacaaggtgtgtttaaagcgtgacgcgcttgttattttggagcgcgaactcagtggaaagcgcaaaaagggcgttgtcggcgtgggcgcaatgtccgatacctataatctgtttgaaaaagaggcagaggcgacgcgcggcgcgctcatgcttttggagcggttcgggttcggggtggccttggatacgaaaagctcgctggtcacgcgcgatatcgacttgatccggcggatagcccaaaagaacagtgcgaatatcaaaatcactgttacgaccacggacgatgccctgtcgaaggtgatcgagccgaacgtatgtccctcgtccgaacgctttcaggcgatccgcgagctgtcggcggcgggaatttttacaggcgtgttatttacccccatgcttccttacatcacggatacggaggaaaacgtaacggaaatggtgcgtcttgcccatgaaaacggggcgaggttcatttttccgatgttcggcgtgacgctgcggcagaatcaaagggagtattactatgaaaagctggatcggcattttccggaactgagacgcaaatataataatgtatacggaagcaattactattgcgcgtcgcctgacgcaaggaagctgagggggctgttccaatccgagtgcagcaaatacgggttgctttacaaaatggcagacatcgtggcggcctataagaaaaaagagccggtcatggagcaaatgacgcttttctgagcagaagcgcaggttttcctaaatgtagtggtcgcataggtgaaaagtaccacatggggcgtcgtaaaaaaggcgccttttttgtggataaaatgtgcataaaaaatacataaaaaattaaaagaaatctgttgacatggggaaggtagtttggtattataaataagccgcaaaaaacgcggcg

(The sequence listing continues in the following parts.)

What is claimed is:

1. A method of treating an inflammatory disorder in a subject in need thereof, the method comprising administering to the subject a therapeutically effective amount of a composition comprising a bacterial strain of the genus *Christensenella*, wherein the bacterial strain comprises a 16s rRNA gene sequence with at least about 98% sequence identity to the polynucleotide sequence of SEQ ID NO: 1, and an excipient, diluent, and/or carrier;
   wherein the bacterial strain is lyophilized, freeze-dried, or spray-dried; and
   wherein the inflammatory disorder is selected from the group consisting of psoriasis, atopic dermatitis, and colitis.

2. The method of claim 1, wherein the bacterial strain comprises a 16s rRNA gene sequence with at least about 98.5%, 99%, or 99.5% sequence identity to the polynucleotide sequence of SEQ ID NO: 1.

3. The method of claim 1, wherein the bacterial strain comprises a 16s rRNA gene sequence with 100% sequence identity to the polynucleotide sequence of SEQ ID NO: 1.

4. The method of claim 1, wherein the bacterial strain shares at least 70% DNA-DNA hybridization with *Christensenella* sp. P152-H6d, deposited with the Deutsche Sammlung von Mikroorganismen and Zellkulturen (DSM) under accession number DSM 33237.

5. The method of claim 1, wherein the bacterial strain comprises a nucleotide sequence having at least about 70% identity to any one of SEQ ID NOs: 2-28.

6. The method of claim 1, wherein the bacterial strain comprises a genome having at least 95% average nucleotide identity (ANI) with the genome of *Christensenella* sp. P152-H6d, deposited under accession number DSM 33237.

7. The method of claim 1, wherein the bacterial strain comprises a genome having at least 96.5% average nucleotide identity (ANI) and at least 60% alignment fraction (AF) with the genome of *Christensenella* sp. P152-H6d, deposited under accession number DSM 33237.

8. The method of claim 1, wherein the bacterial strain is *Christensenella* sp. P152-H6d, deposited under accession number DSM 33237.

9. The method of claim 1, wherein the bacterial strain is capable of increasing production of an anti-inflammatory gene product by a human cell.

10. The method of claim 9, wherein the anti-inflammatory gene product is selected from the group consisting of CCL-19, IL-10, IL-1RA, and MCP-1.

11. The method of claim 1, wherein the bacterial strain is capable of reducing or attenuating production of an inflammatory gene product by a human cell.

12. The method of claim 11, wherein the inflammatory gene product is selected from the group consisting of IL-12 p40, IL-1β, IL-17A, IL-21, IFN-γ and TNF-α.

13. The method of claim 11, wherein the human cell is selected from the group consisting of a THP-1 macrophage, a monocyte-derived dendritic cell (moDC), and a peripheral blood mononuclear cell (PBMC).

14. The method of claim 1, wherein the bacterial strain is capable of reducing or attenuating production of one or more serum biomarkers selected from the group consisting of Lipocalin-2/NGAL, serum amyloid A (SAA), and granulocyte colony-stimulating factor (G-CSF) in a cell, tissue, or subject.

15. The method of claim 1, wherein the composition further comprises one or more additional bacterial strains.

16. The method of claim 15, wherein the one or more additional bacterial strains comprises a strain of *Anaerostipes caccae*.

17. The method of claim 16, wherein the strain of *Anaerostipes caccae* is *Anaerostipes caccae* strain P127-A10a, deposited under accession number DSM 33531.

* * * * *